United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 33

SEQ ID NO: 140545 - protein, 388 aa, Glycine max
  Coding DNA Sequence Number=SeqID_23767
  Gene Ontology: Mol. function=protein serine/threonine kinase activity; Cellular component=membrane; Biological process=protein amino acid phosphorylation
  Homolog annotation: Hit_ID=Q43619; Match level="QueryCoverage=60%, HitCoverage=65%, E-value=3e-71, Identity=56%"; Hit description=PsPK3 protein
  Subcellular localization annotation: CTP_CleavageSite=58; ConfidenceScore=5.13e-01
MKAQLHAYYLPNLSLPPAGVSLASNVGLIPSDESLDLRLFLGSFTNNFSIKSLASAIPASSRSATWTNLTSLLDAILRSVPSLLHPLNGVVPSGAKYSCVPTHDRENAVTGVGPEVDVWCHVRFEAQIEIREHDVAVVAQEDVLGFEVAVDDAERVEVLQGDEDLGGEETRRREGETKLGLFAEEGVEVAAGAEDLRFGLRVGEFLRGEEVFVDDLEGEVGAVVVTEAAEEDAAEVAGAEVAEELKVAEVEAAVGGEVDGGLNGGPVGIAAPVGTAADKGGGGGFRGGECGQTVVEAEGEAASAGEACSCTGGGGGGGAVSGGAGEAEIEVGVGEQQRWLLHGCVLMGRQRRWGPRFKKVDPTGASGTWTDTEKSVHIVRITQLKLQV

SEQ ID NO: 140546 - protein, 55 aa, Glycine max
  Coding DNA Sequence Number=SeqID_23768
MLLLQPQLLLKHVASNVSIASQASDVGALRRLQITYKNMTSEAASISSDSNLCRF

SEQ ID NO: 140547 - protein, 174 aa, Glycine max
  Coding DNA Sequence Number=SeqID_23769
  Gene Ontology: Mol. function=transferase activity; Biological process= auxin mediated signaling pathway
  Homolog annotation: Hit_ID=O49235; Match level="QueryCoverage=98%, HitCoverage=99%, E-value=6e-39, Identity=41%"; Hit description=2,4-D inducible glutathione S-transferase
  Pfam annotation: Domain name=GST_C; Domain location=18-148; Score =54.5; E_value=3.4e-13; Accession=PF00043.15; Description=Glutathione S-transferase, C-terminal domain
MDEVVLVGFWTSPYVMRVKIALLEKGVEYVSPSSFLSTLMRFGRSKKNSSSLMILTTEPEPADCGRRLWASKGEDQEAAKKEFVECLKLLENELGDKPYFAGDYFGLLDIALLPITCRFYTYETFCKFSVEKECPRFMAWVKRCNQRESVSKTLPDPYKVYDFALETKKRFNIE

SEQ ID NO: 140548 - protein, 513 aa, Glycine max
  Coding DNA Sequence Number=SeqID_23770
  Gene Ontology: Mol. function=protein serine/threonine kinase activity; Cellular component=cytoplasm; Biological process=protein amino acid phosphorylation
  Homolog annotation: Hit_ID=Q43619; Match level="QueryCoverage=75%, HitCoverage=81%, E-value=1e-155, Identity=69%"; Hit description =PsPK3 protein
  Pfam annotation: Domain name=Pkinase; Domain location=97-404; Score =216.5; E_value=6e-62; Accession=PF00069.15; Description=Protein kinase domain
  Pfam annotation: Domain name=Pkinase_Tyr; Domain location=97-398; Score=-1.0; E_value=2.1e-12; Accession=PF07714.7; Description =Protein tyrosine kinase
  Pfam module annotation: Pfam domain module=Pkinase::Pkinase_Tyr; Domain location=97-404::97-398
  Subcellular localization annotation: CTP_CleavageSite=55; ConfidenceScore=5.64e-01
MEEPTLLFPDTDLDLSFTSTTTDRTTTTTTTSARTSLARTSSLTLSFNDRLSTFSASETTTASLISRRPHRSGDPNWSAIQAAVNLSSDGRLHLRHLKLLRHLGSGNLGRVFLCRLRDYDGAHFALKVVDKDLLTPKKLSHAQTEAEILHALDHPFLPTLYARIDVSHYTCLLMDFCPGGDLHSLLRKQPQFRLPLAAARFFAAEVLVALEYLHALGIVYRDLKPENVLLRDDGHVMLSDFDLCFKSDVAPNVNFRSHTSPPRVGPTSGCFSCNNNNRHREKLVAEFVAEPVTAFSRSCVGTHEYLAPELVSVNGHGNGVDWWAFGVFVYELLYGTTPFKGCSKEGTLRNIASSKDVRFVHVAEREEAGMAEARDLIEKLLVKDPRKRLGCAKGATEIKLHPFFYGIKWPLIRTYRPPEVKGFIRRNKSNVTCKRNTCWWKRLGLLVRNKGAFAIEGQMMEKSKWFLSLRDLTIEENEDYENRNTSSYRRKQRQAKNGELTVMPNGVTLQSCL

SEQ ID NO: 140549 - protein, 1114 aa, Glycine max
  Coding DNA Sequence Number=SeqID_23771
  Gene Ontology: Mol. function=protein serine/threonine kinase activity; Cellular component=integral to membrane; Biological process=protein amino acid phosphorylation
  Homolog annotation: Hit_ID=Q9SHI2; Match level="QueryCoverage=95%, HitCoverage=94%, E-value=0.0, Identity=65%"; Hit description=Similar to leucine-rich receptor-like protein kinase
  Pfam annotation: Domain name=LRRNT_2; Domain location=33-74; Score =54.7; E_value=3e-13; Accession=PF08263.3; Description=Leucine rich repeat N-terminal domain
  Pfam annotation: Domain name=LRR_1; Domain location=101-123; Score =14.7; E_value=0.33; Accession=PF00560.23; Description=Leucine Rich Repeat
  Pfam annotation: Domain name=LRR_1; Domain location=125-147; Score =1.6; E_value=1.4e+02; Accession=PF00560.23; Description=Leucine Rich Repeat
  Pfam annotation: Domain name=LRR_1; Domain location=149-171; Score =9.9; E_value=4; Accession=PF00560.23; Description=Leucine Rich Repeat
  Pfam annotation: Domain name=LRR_1; Domain location=173-195; Score =16.4; E_value=0.1; Accession=PF00560.23; Description=Leucine Rich Repeat
  Pfam annotation: Domain name=LRR_1; Domain location=197-219; Score =5.6; E_value=25; Accession=PF00560.23; Description=Leucine Rich Repeat
  Pfam annotation: Domain name=LRR_1; Domain location=221-243; Score =14.9; E_value=0.3; Accession=PF00560.23; Description=Leucine Rich Repeat
  Pfam annotation: Domain name=LRR_1; Domain location=245-267; Score =9.8; E_value=4.1; Accession=PF00560.23; Description=Leucine Rich Repeat
  Pfam annotation: Domain name=LRR_1; Domain location=269-291; Score =7.8; E_value=10; Accession=PF00560.23; Description=Leucine Rich Repeat
  Pfam annotation: Domain name=LRR_1; Domain location=293-315; Score =10.6; E_value=2.9; Accession=PF00560.23; Description=Leucine Rich Repeat
  Pfam annotation: Domain name=LRR_1; Domain location=317-339; Score =8.1; E_value=8.7; Accession=PF00560.23; Description=Leucine Rich Repeat
  Pfam annotation: Domain name=LRR_1; Domain location=341-363; Score =11.9; E_value=1.7; Accession=PF00560.23; Description=Leucine Rich Repeat
  Pfam annotation: Domain name=LRR_1; Domain location=365-387; Score =15.7; E_value=0.17; Accession=PF00560.23; Description=Leucine Rich Repeat
  Pfam annotation: Domain name=LRR_1; Domain location=389-411; Score =6.9; E_value=15; Accession=PF00560.23; Description=Leucine Rich Repeat
  Pfam annotation: Domain name=LRR_1; Domain location=413-432; Score =12.6; E_value=1.2; Accession=PF00560.23; Description=Leucine Rich Repeat
  Pfam annotation: Domain name=LRR_1; Domain location=437-459; Score =11.6; E_value=1.9; Accession=PF00560.23; Description=Leucine Rich Repeat
  Pfam annotation: Domain name=LRR_1; Domain location=461-483; Score =11.7; E_value=1.8; Accession=PF00560.23; Description=Leucine Rich Repeat
  Pfam annotation: Domain name=LRR_1; Domain location=485-507; Score =11.6; E_value=1.9; Accession=PF00560.23; Description=Leucine Rich Repeat
  Pfam annotation: Domain name=LRR_1; Domain location=509-531; Score =15.0; E_value=0.27; Accession=PF00560.23; Description=Leucine Rich Repeat
  Pfam annotation: Domain name=LRR_1; Domain location=533-555; Score =13.2; E_value=0.96; Accession=PF00560.23; Description=Leucine Rich Repeat
  Pfam annotation: Domain name=LRR_1; Domain location=557-579; Score =18.1; E_value=0.033; Accession=PF00560.23; Description=Leucine Rich Repeat
  Pfam annotation: Domain name=LRR_1; Domain location=581-603; Score =16.4; E_value=0.1; Accession=PF00560.23; Description=Leucine Rich Repeat
  Pfam annotation: Domain name=LRR_1; Domain location=605-627; Score =13.3; E_value=0.87; Accession=PF00560.23; Description=Leucine Rich Repeat
  Pfam annotation: Domain name=LRR_1; Domain location=630-652; Score =1.3; E_value=1.6e+02; Accession=PF00560.23; Description=Leucine Rich Repeat
  Pfam annotation: Domain name=LRR_1; Domain location=654-676; Score =15.7; E_value=0.17; Accession=PF00560.23; Description=Leucine Rich Repeat
  Pfam annotation: Domain name=LRR_1; Domain location=77-99; Score=0.5; E_value=2.3e+02; Accession=PF00560.23; Description=Leucine Rich Repeat
  Pfam annotation: Domain name=Pkinase; Domain location=810-1084; Score= 140.0; E_value=6.3e-39; Accession=PF00069.15; Description=Protein kinase domain
  Pfam annotation: Domain name=Pkinase_Tyr; Domain location=810-1084; Score=106.2; E_value=9.6e-29; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::Pkinase::Pkinase _Tyr; Domain location=33-74::101-123::125-147::149-171::173-195::197 -219::221-243::245-267::269-291::293-315::317-339::341-363::365 -387::389-411::413-432:...
  Pfam module annotation: Domain location=:437-459::461-483::485 -507::509-531::533-555::557-579::581-603::605-627::630-652::654 -676::77-99::810-1084::810-1084
MAILECSNSFHFLNGVYMVLLFCLGIMVLVNSVNEEGLSLLRFKASLLDPNNNLYNWDSSSDLTPCNWTGVYCTGSVVTSVKLYQLNLSGALAPSICNLPKLLELNLSKNFISGPIPDGFVDCCGLEVLDLCTNRLHGPLLTPIWKITTLRKLYLCENYMFGEVPEELGNLVSLEELVIYSNNLTGRIPSSIGKLKQLRVIRAGLNALSGPIPAEISECESLEILGLAQNQLEGSIPRELQKLQNLTNIVLWQNTFSGEIPPEIGNISSLELLALHQNSLIGGVPKEIGKLSQLKRLYVYTNMLNGTIPPELGNCTKAIEIDLSENHLIGTIPKELGMISNLSLLHLFENNLQGHIPRELGQLRVLRNLDLSLNNLTGTIPLEFQNLTYMEDLQLFDNQLEGVIPPHLGVIRNLTILDISANNLVGMIPINLCGYQKLQFLSLGSNRLFGNIPYSLKTCKSLVQLMLGDNLLTGSLPVELYELHNLTALELYQNQFSGIINPGIGQLRNLERLRLSANYFEGYLPPEIGNLPQLVTFNVSSNRFSGSIPHELGNCVRLQRLDLSRNHFTGMLPNEIGNLVNLELLKVSDNMLSGEIPGTLGNLIRLTDLELGGNQFSGSISFHLGRLGALQIALNLSHNKLSGLIPDSLGNLQMLESLYLNDNELVGEIPSSIGNLLSLVICNVSNNKLVGTVPDTTTFRKMDFTNFAGNNGLCRVGTNHCHQSLSPSHAAKHSWIRNGSSREIIVSIVSGVVGLVSLIFIVCICFAMRRRSRAAFVSLEGQTKTHVLDNYYFPKEGFTYQDLLEATGNFSEAAVLGRGACGTVYKAAMSDGEVIAVKKLNSRGEGANNVDKSFLAEISTLGKIRHRNIVKLYGFCYHEDSNLLLYEYMENGSLGEQLHSSATTCALDWGSRYKIALGAAEGLCYLHYDCKPQIIHRDIKSNNILLDEVFQAHVGDFGLAKLIDFSYSKSMSAVAGSYGYIAPEYAYTMKVTEKCDIYSFGVVLLELITGRSPVQPLEQGGDLVTCVRRAIQASVPASELFDKRLNLSAPKTVEEMSLILKIALFCTSTSPLNRPTMREVIAMLIDAREYVSNSPTSPTSESPLDEDDGISSKG

SEQ ID NO: 140550 - protein, 98 aa, Glycine max
  Coding DNA Sequence Number=SeqID_23772
MMNLKHDAHFLRLPSEGSPPEERPLVAVILLLLDLMITTTTTTITTTMIVTMTTVVTINMISVVIATTNTSNDHSCSGSNIDNNYGDCGGRSHNCDRK

SEQ ID NO: 140551 - protein, 182 aa, Glycine max
  Coding DNA Sequence Number=SeqID_23773
MKLLQFHVEVVEILYKDEYECSFVQGEIAEGSQFECFEMLWKIKVPSKISVFAWRLLRNRLPTRTNLHRRQLQIIDMSCPFCRCSEEDEAHLFIHCSKIQPLWWESMSWLNIQGATPQTPRQHFLRHGSGLDKVIRVNRWQCWWLALTWSNAVFNGNKVFEDAVFLLWTWLRRFREEFYNTF

SEQ ID NO: 140552 - protein, 935 aa, Glycine max
  Coding DNA Sequence Number=SeqID_23774
  Gene Ontology: Mol. function=zinc ion binding; Cellular component =intracellular; Biological process=anti-apoptosis
  Homolog annotation: Hit_ID=Q10CF1; Match level="QueryCoverage=87%, HitCoverage=89%, E-value=0.0, Identity=48%"; Hit description =Expressed protein
  Pfam annotation: Domain name=zf-C3HC; Domain location=75-200; Score =166.7; E_value=6.1e-47; Accession=PF07967.4; Description=C3HC zinc finger-like
  Subcellular localization annotation: CTP_CleavageSite=66; ConfidenceScore=5.75e-01
MNEDGVTSANPNPSLPKPPSSPPTPAASSAGASSPAFPANTGNGDARRRRDILSADSHAVLGPLLRGASVPSCRPWERGDLLRRLSTFKLAGKLHKVAGSLACAKRGWVNVGVAKIECEICAAQLDFTLPSAPSFEADASGEEFSEQLDRGHKATCPWKGNSCPESLVQFPPTSPSALIGGFKDRCDGLLQFYSLPIVSSSAVEQIRVTHSPQIDRLLSQLQIQTAGELGCRAENACGMGLTGEQAPHPYSYAQKLISLCGWEPRWLPNVLDCEEQSAESAKNGYSSGPAKGSAPDPAPSKKEYSTSSRKDTGDNDVLGSEFNCESRSPLLDCSLCGATVRVWDFLTASRPVHMTPCGIDTPQTSKKIASTRGISAASGINEWAAADGVENERTGDRDEATTPDKRQLVSNKSLDLSLKIVSGPSCSPIILTSTSGHVQGAGEGKDLMIGRPSGSEATSYESQGPNVCKRKLDDGGTTSERPHLNMQQADSTERTVTDRDNNEVIGSQQYSAGPFKRAPDANTTNQLNQERDHAIGIMSTRDSAHASSIIAMNTVYHGSDDESMESVENFPVDVNEFNFPSVDLNETSELNQAQQSVCFQPLLERAGGETGVSSSNACGEVLNTEILTAHARDGPSFGISGGSVGMGASHEAEIHGTDVSVHRGDSLGDVEPIAEVIENQGQAGEFEPSHGLTGDFVPEEISREDPQGDSQAVVSQSTARAADSGSKVIASMKVESVESGEKTSSSMQVLGGLENGAHPSLSCNAVVCSAYEVSKEEVNQARKASHIDDGASHESSRLITDAMGTPYRDNSNGGVEFDPIKLHNDYCPWVNGDVAAAGCDNPCSSSGVGSVALCGWQLTLDALDSFQSLGHLPVQTLESESAASMCKGEAERPPAATEVLDAECLVVMVAVEMLDDERETGIFYWAKRGDSSGRN

SEQ ID NO: 140553 - protein, 1046 aa, Glycine max
  Coding DNA Sequence Number=SeqID_23775
  Gene Ontology: Mol. function=microtubule motor activity; Cellular component=microtubule associated complex; Biological process =microtubule-based movement
  Homolog annotation: Hit_ID=Q9C7T0; Match level="QueryCoverage=95%, HitCoverage=97%, E-value=0.0, Identity=53%"; Hit description=Kinesin, putative; 56847-62063
  Pfam annotation: Domain name=Kinesin; Domain location=388-709; Score =541.0; E_value=1.2e-159; Accession=PF00225.13; Description=Kinesin motor domain
  Pfam annotation: Domain name=Radial_spoke_3; Domain location=83-359; Score=-111.2; E_value=0.074; Accession=PF06098.2; Description=Radial spoke protein 3
  Pfam module annotation: Pfam domain module=Kinesin::Radial_spoke_3; Domain location=388-709::83-359
  Subcellular localization annotation: CTP_CleavageSite=46; ConfidenceScore=5.02e-01
MEDNNQWCLYDHDPLLLTDVSLQQESSSYTHSPNSLSQASLSSRSLAMADEPVSRGDSPSIGFSQENGRFEGNSVKFDDPNVKNVFDGRSILGYSLTSPDLVICGSPDIAGISYGDSPELSKNKHSKDVEQSMELSLENGIKGSQVEVDNGHKIPTVKFSNFCQTFEQEEKPLSPEASFELLPPLVTRNESPQDHPPRDTEMLEDIGVSQEAEMESSEDTEDIGMEEKFKRLKREFDCQRKELTETRRELGEIKRENQQKSRECQEAWNSLKELQNELMRKSMHVGSLAFAIEGQVKEKSKWFSSLRDLTRKLKIMKMEHIKLLEEAEASKKYQADMREMGLIIKSKINEQLESHEDLKSKYIEGAKERKDLYNKVLELTGNIRVFCRCRPLNAEEISAGATMALDFEFAKDGDLTVMSNGAPKRNFKFDAVFGPQAEQADIFEDTAPFATSVLDGYNVCIFAYGQTGTGKTFTMEGTEEARGVNFRTLEKMFDIIKERQKLYCYDISVSVLEVYNEQIRDLLVAGNHPGTAAKRLEIRQAGEGMHHIPGLVEAHVNNMTEVWEVLQTGSNARAVSSTNANEHSSRSHCIHCVMVKGENLLNGECTRSKLWLVDLAGSERVAKTEVHGDRLKETQNINRSLSALGDVISALATKSSHIPFRNSKLTHLLQDSLGGDSKALMFVQISPNENDLSETICSLNFASRVRGIELGPARKQLDTVELLRHKQMAEKVKQEVRLKDLQIKKMEETIHGLESKMKESDNKNKNLQEKVKELESQLLVERKLARQHVDSKIAEQHQMKHQEEQNNTLMRPALASRPLGSLKNFNDPVSGGGWCKDQQINSAKPLAENNILKPCIPFSTMESSIKCIDHAEKENNPDMADKALLPKRPGRASTICMMTPRVPSAIASRRNSLIPLPSIPSLTQFQSPLLPKLTNQADQKDVNGELETNCVPAQTHCESPKEVRIGVKRIGSILRRSLHKKIQMKSPLQQHMRKVGVNVGMEKVRVSIGSRGRLAPRGQVGSGRRGGGAKDIQQKNSQKEKERGWI

SEQ ID NO: 140554 - protein, 100 aa, Glycine max
  Coding DNA Sequence Number=SeqID_23776
  Homolog annotation: Hit_ID=Q9LIU9; Match level="QueryCoverage=98%, HitCoverage=84%, E-value=9e-25, Identity=60%"; Hit description =Putative negatively light-regulated protein
  Pfam annotation: Domain name=Lg106; Domain location=18-98; Score =154.8; E_value=2.2e-43; Accession=PF07844.2; Description=Lg106-like protein
MGSNPRNSLSACVEESVKKKYGGMLPKKPPLISKDHERAYFDSADWALGKQGGEKPKGPLEALRPKLQPTQQQTRYRKSPYAPSGEEGGSVPAEDAPSNQ

SEQ ID NO: 140555 - protein, 990 aa, Glycine max
  Coding DNA Sequence Number=SeqID_23777
  Gene Ontology: Mol. function=translation initiation factor activity; Cellular component=intracellular; Biological process=translational initiation
  Homolog annotation: Hit_ID=P57997; Match level="QueryCoverage=98%, HitCoverage=97%, E-value=0.0, Identity=70%"; Hit description =Translation initiation factor IF-2, chloroplast precursor
  Pfam annotation: Domain name=GTP_EFTU; Domain location=470-632; Score= 129.2; E_value=1.2e-35; Accession=PF00009.17; Description=Elongation factor Tu GTP binding domain
  Pfam annotation: Domain name=GTP_EFTU_D2; Domain location=655-718; Score=52.3; E_value=1.6e-12; Accession=PF03144.15; Description =Elongation factor Tu domain 2
  Pfam annotation: Domain name=GTP_EFTU_D2; Domain location=893-961; Score=15.9; E_value=0.0082; Accession=PF03144.15; Description =Elongation factor Tu domain 2
  Pfam annotation: Domain name=IF2_N; Domain location=390-441; Score =52.0; E_value=2e-12; Accession=PF04760.6; Description=Translation initiation factor IF-2, N-terminal region
  Pfam annotation: Domain name=MMR_HSR1; Domain location=473-577; Score= 3.2; E_value=0.00051; Accession=PF01926.13; Description=GTPase of unknown function
  Pfam module annotation: Pfam domain module=GTP_EFTU::GTP_EFTU_D2::GTP_ EFTU_D2::IF2_N::MMR_HSR1; Domain location=470-632::655-718::893 -961::390-441::473-577
  Subcellular localization annotation: CTP_CleavageSite=37; ConfidenceScore=5.73e-01
MTSFASPVSLGNLMGVSSSGRSHSVVRRVSLSRGNCRGRKRWHCVSLSVCRYSVTTTDFVADQGNSVSLDSNSSRSKGGDDGAGFVLKPPPKPVLKSPENKSDPILGPSRTTGDVEERNKVIESLGEVLEKAEKLGSSKVNGDRNNGSVNKPVRSNANASPKADKPVNSAAPQKSKTLKSVWRKGDTVASVQKVVKEVPKPINDKNEGERTQTRGGEKVVSQTHAPQPSLKPQPPSQPQPMLLSKPSIAPPPAKKPVVLKDRGAAETTSVKSKEKKSPILIDKFASKKPVVDPLIAQAVLAPPKPGKAPPPGKFKDDFRKKGAMAGGPRRRILEDDAIHDEDASELNVSIPGAATARKGRKWSKASRRAARLQAARDAAPIKVEILEVGDKGMLVEELAYCLATSEGEILGYLYSKGIKPDGVQTIDKDMVKMICKEYDVEVIDADPFKVEGLVKKREILDEDDFDKLKDRPPVITIMGHVDHGKTTLLDYIRKSKVAASEAGGITQGIGAYKVEVPVDGKKLPCVFLDTPGHEAFGAMRARGASVTDMAIIVVAADDGIRPQTNEAIAHAKAAGIDKDGANPERVMQELSSIGLMPEDWGGDIPMVPISALKGKNIDDLLETVMLVAELQELKANPDRSAKGTVVEAGLDKSKGPFASFIVQNGTLRRGDIVVCGEASGKVRALFDDGGKRVDEASPSMPVQVIGLNNVPIAGDEFEVVESLDTARERAEARAESLRNERISAKAGDGKVTLSSLASAVSSGKLSGLDLHQLNIILKVDLQGSIEAVRKALEILPQDNVTLKFLLEATGDVNTSDVDLSVASKAIILGFNVKAPGSVKSYGENKAVEIRLYRVIYELIDDVRKAMEGLLEPVEEQVTIGSAVVRAVFSSGSGRVAGCMVTEGKILNDCGIRVKRKGKVVHVGILDSLRRVKEIVKEVNAGLECGLGLEDFDDWEEGDILEAFNTFQKKRTLEEASASMASAVEGVGVAL

SEQ ID NO: 140556 - protein, 74 aa, Glycine max
  Coding DNA Sequence Number=SeqID_23778
MLRQIWSFVPFCRRLNVFRPRPLLSPSNPEIDEFDGGVPSLGPIWNILEGGYFRWKLPSLPGQAGRQSPPSFLL

SEQ ID NO: 140557 - protein, 151 aa, Glycine max
  Coding DNA Sequence Number=SeqID_23779
MEGDFGLFLELLCFQRFLKRERKLPRYGELNPLLVLPCRLSSSFSANTEKNPKEECKVLMTKSRMEIQVDEVRAEEKVEGYKQQSIAEPALELVSDLIELEEVLEEEDDQQERETPIKDSQEGIKMKEEHEKEKQKEKEEIEKENNKKNEK

SEQ ID NO: 140558 - protein, 282 aa, Glycine max
  Coding DNA Sequence Number=SeqID_23780
  Gene Ontology: Mol. function=catalytic activity; Cellular component =cytosol; Biological process=metabolic process
  Homolog annotation: Hit_ID=Q75LI3; Match level="QueryCoverage=97%, HitCoverage=94%, E-value=4e-86, Identity=58%"; Hit description =Expressed protein
  Pfam annotation: Domain name=Hydrolase; Domain location=2-237; Score =11.5; E_value=0.0054; Accession=PF00702.16; Description=haloacid dehalogenase-like hydrolase
MAPIFSTDMDDTLYPLSTGLNLACRKNIEEYMLKHLHMEESEVPKICVDLYREYGTTMAGLKAFGHEFDNDEFHAYVHGRLPYKKLKPDPVLRNLLFSMPQLESIPSNYKTWKSPSQVFTNADQAHAHQVLNRLGLKECFDSIICFETLNPPNYTNVPTDNLALTWSNSFNKDCNQVENRCFNSKTQILCKPSVEAIEVAIQIANLDPRKTLFFDDSARNIASGKAAGLNTVIVGRSDLVPGADYALSSIHNIKEALPEIWEVEGELQQMIQSPAVETMVLA

SEQ ID NO: 140559 - protein, 383 aa, Glycine max
  Coding DNA Sequence Number=SeqID_23781
  Gene Ontology: Mol. function=zinc ion binding
  Homolog annotation: Hit_ID=Q6Z6H7; Match level="QueryCoverage=97%, HitCoverage=77%, E-value=2e-87, Identity=46%"; Hit description =Armadillo/beta-catenin repeat protein-like
  Pfam annotation: Domain name=Arm; Domain location=306-350; Score =19.2; E_value=0.015; Accession=PF00514.13; Description=Armadillobeta- catenin-like repeat
  Pfam annotation: Domain name=Arm; Domain location=58-96; Score=5.3; E_ value=2.6; Accession=PF00514.13; Description=Armadillobeta-catenin -like repeat
  Pfam module annotation: Pfam domain module=Arm::Arm; Domain location =306-350::58-96
MGPAAKTTTMRSISQEAFEELVNENIDDLGMDPTEALQDAIQTLTLQGVDLSGIVTCVPGETNPVIECLDRLRHLETEPDQNLIAQAFNTLHELCANPNSDSNSNVAIATKNGAVELACSLCSKISLAAGSHVVPLVSALNALSSLLHGCDSFDSEFLKHYCRFAAGADVQSTGAFHRCDGPRIVMAFLVDNKGNVELLSSGFRVVASAATGDEIVKEAFMELKVDELILEIMSLHRHKGIQSLYDAVCALLMPDDDRVVASQVYGYARKFAKIGIAEALVDSLSAGVSSHDLISACITLRAVAVNDEICKSIAEKGGIDALLRCIDDSGEQGDKAVAKVCCSLLSKLAGSDANKSAIVGKGGMDKLIKLSARFADDPSVLQE

SEQ ID NO: 140560 - protein, 301 aa, Glycine max
  Coding DNA Sequence Number=SeqID_23782
  Gene Ontology: Mol. function=heat shock protein binding; Cellular component=integral to membrane; Biological process=protein folding
  Homolog annotation: Hit_ID=Q9ST16; Match level="QueryCoverage=99%, HitCoverage=68%, E-value=1e-123, Identity=73%"; Hit description=S -locus protein 5
  Pfam annotation: Domain name=DnaJ; Domain location=9-99; Score=52.5; E_value=1.4e-12; Accession=PF00226.21; Description=DnaJ domain
MKRILKSLNHYDALGLSRHKKIDAAVLKKEYRKKYCITMYEESHLDLTYIVFASLLKECLAMLVHPDKNMGSSLASESFKKLQCAYEVLSDSVKKRDYDEQLRKEESMAKSVCQRSHSSSHQDNADYRSEESRRIQCTKCGNSHIWVCTNRSKAKARWCQDCCQFHQAKDGDGWVEYKGSLVFDRPQKVEIPRAFVCAESKIFDVSEWAICQGMACRPNTHRPSFHVNMVGLEKSQRCNSSRFPWDFDAEMMDEDEEAFDLWLEQALASGLFCETSKRRKSWSPFKLHQKKGKKQWRRTSC

SEQ ID NO: 140561 - protein, 172 aa, Glycine max
  Coding DNA Sequence Number=SeqID_23783
  Gene Ontology: Mol. function=heat shock protein binding; Cellular component=integral to membrane; Biological process=protein folding
  Homolog annotation: Hit_ID=Q2QMA0; Match level="QueryCoverage=87%, HitCoverage=27%, E-value=5e-32, Identity=44%"; Hit description=DNAJ heat shock N-terminal domain-containing protein, putative, expressed
VPFVVIGVRFHQDSWEFEEALVMEDIGLLKQCWQWFRSQKDAGWRARNAVTWCRDRTGVFIDRHWPMVCRGCSRLGSLLRLSVIFWKDSALRGFQSFIRFGPVMLLLIMWSCFLSLTSMYCLVYVLVSMGVAGVAVQYLGYTPGLFIVGLFAILILWMYANFWITGTLLIVG

SEQ ID NO: 140562 - protein, 79 aa, Glycine max
  Coding DNA Sequence Number=SeqID_23784
MGAENTERDELEGDPETVETLKQKSMSHFEEKIEVETLKYRQRMRNKRERRRRRRRRRGIACEKESEFLKRFVKGGRKE

SEQ ID NO: 140563 - protein, 158 aa, Glycine max
  Coding DNA Sequence Number=SeqID_23785
  Gene Ontology: Mol. function=hydrolase activity, hydrolyzing O -glycosyl compounds; Biological process=carbohydrate metabolic process
  Homolog annotation: Hit_ID=Q94EN5; Match level="QueryCoverage=32%, HitCoverage=10%, E-value=3e-16, Identity=76%"; Hit description=Beta -1,3-glucanase
MSCKSQVTTLFMVSILEAHSLKQWWSSDAELDQDTYSSKLISKQLANTRICVIVSVPNDQLLGIGKSNATAANWVTENVIAHVPATNITAICVGSEDYKNDVMGKKMVDKEIKVPINEQNLFVVSKEKHKLCAARGLEQWWPTESELVHFFHNKKNIC

SEQ ID NO: 140564 - protein, 82 aa, Glycine max
  Coding DNA Sequence Number=SeqID_23786
MAPYVGFKIRVVRTGDLIDHRPIKHWGLRGHQSRMRMRARGRFAAIVSIHIAGDNEMLEDIGVSQEVELESSEVSLIVNNDR

SEQ ID NO: 140565 - protein, 105 aa, Glycine max
  Coding DNA Sequence Number=SeqID_23787
  Pfam annotation: Domain name=SWIB; Domain location=38-104; Score=8.8; E_value=0.0028; Accession=PF02201.9; Description=SWIBMDM2 domain
  Subcellular localization annotation: CTP_CleavageSite=22; ConfidenceScore=5.62e-01
MAAAAKSATKKKPAPSNRAAVKATVKKTVAPRTTNSDIQKVVLVSSELGDFLSASQVSRSEAIKKFWAYIKLQNLQSNEGKDSFAPYIASFSSTGPNAITPDILK

SEQ ID NO: 140566 - protein, 47 aa, Glycine max
  Coding DNA Sequence Number=SeqID_23788
MESEARVHGGCAYDLEVAEMESDVGDAEACAIEFFMPVEGLFRIPNN

SEQ ID NO: 140567 - protein, 234 aa, Glycine max
  Coding DNA Sequence Number=SeqID_23789
MNVPKGFLEEWWSLNYDFDSFRAWLQVQDTHGLEAAQGCNASQEAGCSMNVEAMTQLPNNFTPVETFSIGGNSIPSHVMGELPLFSLLYSQQELSGQLSQFFSPFSHQAISGELSQLLLPFSQGELLTSTRADNVTSACIEVEPSIQNTSKPQYTGFSEETDPVLENLINTFWLFDQDQPSLFNDSTAGEINRNMENLLAHGEGNNDRNELVGSQPTLRDGDKTSKASDFSSNF

SEQ ID NO: 140568 - protein, 267 aa, Glycine max
  Coding DNA Sequence Number=SeqID_23790
  Gene Ontology: Mol. function=transporter activity; Cellular component= mitochondrial inner membrane; Biological process=mitochondrial transport
  Homolog annotation: Hit_ID=Q9MBE7; Match level="QueryCoverage=87%, HitCoverage=64%, E-value=3e-64, Identity=54%"; Hit description=SfUCPa
  Pfam annotation: Domain name=Mito_carr; Domain location=165-250; Score=101.8; E_value=2e-27; Accession=PF00153.17; Description =Mitochondrial carrier protein
  Pfam annotation: Domain name=Mito_carr; Domain location=70-160; Score= 92.4; E_value=1.4e-24; Accession=PF00153.17; Description =Mitochondrial carrier protein
  Pfam module annotation: Pfam domain module=Mito_carr::Mito_carr; Domain location=165-250::70-160
MGCTYELHHEQVKTFLVGSAFVGEVPLYHMILAALLTESGSLSNTRCGEFYFYTKVRKLAFPMDIYSLTHFFELVIGALAITIANPTDLVKVRLQAEGQLPTGVPKRYSGAIDAYLTILRQEGIGALWTGLGANIARNAIINAAELASYDKVKRTILKIPGFMDNVYTHLLAGLGAGLFAVFIGSPVDVVKSRMMGDSTYKSTFECFLKTLLNEGFLAFYKGFLPNFSRVGAWNVIMFLTLEQRFLITFLDPHWVKTAVNFPEKLAL

SEQ ID NO: 140569 - protein, 245 aa, Glycine max
  Coding DNA Sequence Number=SeqID_23791
  Homolog annotation: Hit_ID=Q338Y6; Match level="QueryCoverage=20%, HitCoverage=12%, E-value=2e-07, Identity=45%"; Hit description =Expressed protein
  Pfam annotation: Domain name=DUF641; Domain location=66-205; Score =130.5; E_value=4.6e-36; Accession=PF04859.3; Description=Plant protein of unknown function (DUF641)
MTRKVSNFSDLIQRVTASCLLHPLATAAAAVKEDDNSPYESEDNRNDSEEEENENDDEYEDEERLVGPLKAFKVKQMEALMEQVFETVSSMKRAYVRLQEAHSPWDPERMRSADVAVVSELRKLAVLRERFRRSGGGDDDGRRKGRRRGGGGGVASVREVVAPYEAVVEELKKEVKVKDMEVKNLREKLDSAVALTTNGSAQKKPGRSLSKRKLGIQGFWETPALHDLGFQKLLQAKPESSVYEK

SEQ ID NO: 140570 - protein, 189 aa, Glycine max
  Coding DNA Sequence Number=SeqID_23792
  Homolog annotation: Hit_ID=Q10NL7; Match level="QueryCoverage=97%, HitCoverage=99%, E-value=7e-34, Identity=46%"; Hit description =Expressed protein
MEFYTRPNRSDIHLSAEEEATIEAKTRDYFDGVAPQRHTKPQRSEYSAQYVDAFSNAHHSSSSSSIPEFMQFQRLENDPQEKKLEYNGSQVPEEFVETEYYQDLNSVDKHHHTVFLKRADTKKEVEETGRITGTGFIKVEKNGNDFHIEPDNDTGCHHSCKCNPATNDWVPSPSNEVGFNSDKPNRSDN

SEQ ID NO: 140571 - protein, 99 aa, Glycine max
  Coding DNA Sequence Number=SeqID_23793
MEDESSETSTPEPLVKRKKADQTQEAATTSEKSLEATFEPSEPVTNIASLQQAADPSTPEDQTTPVLSPKTSPTTTVVLHLTDEEDVQTQDTQDRSQDF

SEQ ID NO: 140572 - protein, 69 aa, Glycine max
  Coding DNA Sequence Number=SeqID_23794
MDQLKRLSIPSEMLKFFNHACPPRMGHPTRSVHFGPHEHTQHPTYRTWAPSSATTMDKLKRLSIPAANA

SEQ ID NO: 140573 - protein, 92 aa, Glycine max
  Coding DNA Sequence Number=SeqID_23795
  Subcellular localization annotation: CTP_CleavageSite=73; ConfidenceScore=5.52e-01
MCSFSHLYPTPPKKSQWSKIPWALTPPLSLSSLCRPSTLSSGNEHVVAQGSGIQFLHCHPLLPSNMNMLPMVVIGLVENRLKRGTIMKERGS

SEQ ID NO: 140574 - protein, 117 aa, Glycine max
  Coding DNA Sequence Number=SeqID_23796
MNLMVQFEVRFFLWTLSLTINRIFSLVVQEEKQREFGASVSAFNSTNDASQSHAFAVKDSKYQFDHKFNANSKNRIDPFVHIVVDLAILKISASSYMVFPQITRRVSLLLLILKAKQ

SEQ ID NO: 140575 - protein, 92 aa, Glycine max
  Coding DNA Sequence Number=SeqID_23797
MRYEMFEELEEANTAIGVKRGFRSRHYCDNVCFYEEEKWIKGLGRTGEWPSCRCGVGFMELLSGNCFLHHPEDNNALPQHVTLMRTLLLSKG

SEQ ID NO: 140576 - protein, 332 aa, Glycine max
  Coding DNA Sequence Number=SeqID_23798
  Gene Ontology: Mol. function=DNA polymerase processivity factor activity; Cellular component=PCNA complex; Biological process =regulation of DNA replication
  Homolog annotation: Hit_ID=P22177; Match level="QueryCoverage=70%, HitCoverage=100%, E-value=1e-130, Identity=100%"; Hit description =Proliferating cell nuclear antigen
  Pfam annotation: Domain name=PCNA_C; Domain location=193-320; Score =331.0; E_value=2e-96; Accession=PF02747.6; Description=Proliferating cell nuclear antigen, C-terminal domain
  Pfam annotation: Domain name=PCNA_N; Domain location=67-191; Score =317.9; E_value=1.8e-92; Accession=PF00705.9; Description =Proliferating cell nuclear antigen, N-
  Pfam module annotation: Pfam domain module=PCNA_C::PCNA_N; Domain location=193-320::67-191
  Subcellular localization annotation: CTP_CleavageSite=64; ConfidenceScore=5.17e-01
MAGTELFPPKSPQLFPEPSPYINLTFPLISHSSFPFSILISSQTLTLTLTLPVTKENPLCPIIVVKMLELRLVQGSLLKKVLESVKELVNDANFDCSSTGFSLQAMDSSHVALVALLLRSEGFEHYRCDRNISMGMNLNNMAKMLKCAGNDDIITIKADDGSDTVTFMFESPTQDKISDFEMKLMDIDSEHLGIPEAEYHAIVKMPSSEFARICKDLSSIGDTVVISVTKEGVKFSTKGDIGTANIVCRQNTSVDKPEEATVIEMNEPVSLTFALRYMNSFTKATPLSNTVTISLSNELPVVVEYKIAEMGYVRFYLAPKIEEDEEDTKPQV

SEQ ID NO: 140577 - protein, 1990 aa, Glycine max
  Coding DNA Sequence Number=SeqID_23799
  Gene Ontology: Mol. function=nucleoside-triphosphatase activity; Cellular component=membrane; Biological process=cis assembly of U2 -type pre-catalytic spliceosome
  Homolog annotation: Hit_ID=O48534; Match level="QueryCoverage=99%, HitCoverage=94%, E-value=0.0, Identity=61%"; Hit description =Putative ATP-dependent RNA helicase
  Pfam annotation: Domain name=DEAD; Domain location=1364-1537; Score =139.2; E_value=1.1e-38; Accession=PF00270.19; Description=DEADDEAH box helicase
  Pfam annotation: Domain name=DEAD; Domain location=517-697; Score =157.1; E_value=4.5e-44; Accession=PF00270.19; Description=DEADDEAH box helicase
  Pfam annotation: Domain name=Helicase_C; Domain location=810-896; Score=50.6; E_value=5.4e-12; Accession=PF00271.21; Description =Helicase conserved C-terminal domain
  Pfam annotation: Domain name=ResIII; Domain location=1360-1507; Score= 12.9; E_value=3.9e-06; Accession=PF04851.6; Description=Type III restriction enzyme, res subunit
  Pfam annotation: Domain name=ResIII; Domain location=513-693; Score =4.8; E_value=1.8e-05; Accession=PF04851.6; Description=Type III restriction enzyme, res subunit
  Pfam annotation: Domain name=Sec63; Domain location=1017-1322; Score =587.8; E_value=1e-173; Accession=PF02889.7; Description=Sec63 domain
  Pfam module annotation: Pfam domain module=DEAD::DEAD::Helicase _C::ResIII::ResIII::Sec63; Domain location=1364-1537::517-697::810 -896::1360-1507::513-693::1017-1322
MAHLGGGAEAHARFKQYEYRANSSLVLTTDSRPRDTHEPTGEPESLWGKIDPKSFGDRAYRGRPPELDEKLEKAKNKKKKKDRDAAADDATAVPSKRRRVQHDSVLSTSDDGVYQPKTKETRAAYEAMLSVIQNQLGGQPLSIVSAAADEILAVLKNDTVKNPDKKKDIEKLLNPIPGHVFDQLVSIGKLITDFQEVVDVPNGSSAMDGEEGLDDDVGVAVEFEENEDDDEESDLDIVQDEEEDDEDVAEPNGSGAMQMGGIDDEDMEEGNEGMGLNVQDIDAYWLQRKISQAFEQQIDPQHCQKLAEEVLKILAEGDDREVENKLLFHLEFDKFSLIKFLLRNRLKIVWCTRLARAQDQEEREKIEEEMKGTELQPILEQLHATRASAKERQKNLEKSIREEARRLKDDTGGDGDKESRDRSRRGVADRDGESGWLKGQRQMLDLDSIAFTQGGFFMAKKKCDLPDGSYRHLSKGYEEIHVPALKAKPLDPNEKLVKISSMPDWAQPAFKGMTQLNRVQSKVYETALFKPDNLLLCAPTGAGKTNVAVLTILQQIARHRNPEDGSIDHSAYKIVYVAPMKALVAEVVGNLSNRLQEYDVKVRELSGDQSLTRQQIEETQIIVTTPEKWDIITRKSGDRTYTQLVKLLIIDEIHLLHDNRGPVLESIVARTVRQIETTKDYIRLVGLSATLPNYEDVALFLRVDLKKGLFYFDNSYRPVPLSQQYVGITVKKPLQRFQLMNDICYEKVMAVAGKHQVLIFVHSRKETAKTARAIRDAALANDTLGRFLKEDSASREILHTHTDLVKSNDLKDLLPYGFAIHHAGMTRTDRQLVEDLFADGHVQVLVSTATLAWGVNLPAHTVIIKGTQIYNPEKGAWTELSPLDVMQMLGRAGRPQYDSYGEGIIVTGHSELQYYLSLMNQQLPIESQFVSKLADQLNAEIVLGTVQNAREACNWIGYTYLYVRMLRNPSLYGIAPDVLTRDITLEERRADLIHTAATILDRNNLVKYDRKSGYFQVTDLGRIASYYYITHGSISTYNEHLKPTMGDIELCRLFSLSEEFKYVTVRQDEKMELAKLLDRVPIPIKESLEEPSAKINVLLQAYISQLKLEGLSLTSDMVFITQSAGRLLRALFEIVLKRGWAQLAEKALNLCKMGTKRMWSVQTPLRQFNGIPSDLLTKLEKKDLAWERYYDLSSQEIGELIRAPKMGRTLHKFIHQFPKLNLAAHVQPITRTVLRVELTITPDFAWDDRIHGYVEPFWVIVEDNDGEYILHHEYFMLKKQYIDEDHTLNFTVPIYEPLPPQYFIRVVSDRWLGSQTVLPVSFRHLILPEKYPPPTELLDLQPLPVTALRNSSYESLYKDFKHFNPVQTQVFTVLYNSDDNVLVAAPTGSGKTICAEFAILRNHQKGPDSVMRVVYVAPVEALAKERYRDWERKFGGGLKLRVVELTGETATDLKLLEKGQIIISTPEKWDALSRRWKQRKHVQQVSLFIIDELHLIGGQGGPILEVVVSRMRYIASQVENKSRIVALSTSLANAKDLGEWIGATSHGLFNFPPGVRPVPLEIHIQGIDITNFEARMQAMTKPTYTAIVQHAKNGKPALIFVPTRKHVRLTAVDMITYSGADSGEKPFLLRSAEELEPFLDKITDEMLKVTLREGVGYLHEGLNSLDHDIVTQLFEAGWIQVCVLNSSMCWGVTLLAHLVVVMGTQYYDGRENAQTDYPVTDLLQMMGHASRPLVDNSGKCVILCHAPRKEYYKKFLYEAFPVESHLHHFLHDNLNAEIVAGIIENKQDAVDYLTWTFMYRRLTQNPNYYNLQGVSHRHLSDHLSEMVENTLSDLEAGKCITIEDDMELAPLNLGMIASYYYISYTTIERFSSSVTSKTKMKGLLEILSSASEYAQLPIRPGEEEVVRKLINHQRFSFENPKVTDPHVKANALLQAHFSRQFVGGNLALDQKEVLLSANRLLQAMVDVISSNGWLSLALLAMEVSQMVTQG

SEQ ID NO: 140578 - protein, 530 aa, Glycine max
  Coding DNA Sequence Number=SeqID_23800
  Gene Ontology: Mol. function=nucleic acid binding; Cellular component= intracellular; Biological process=DNA integration
SKVPITFWGECVVTAAFLINRLPSPLLKQNTPYQVLHGFAPDYSILRSFGCLAFGATLAFERNKFSPRAVPFVFVGYPQGVKGYSELAISLPIPEPITSNIQPRAIEPNTSETDHPIPPNTSDLPIQLSDSTVDTTIGASSTLSSPPLRRSFRTSNHPPYLSDYIRPQPRQRSHPIQDHCSLVHLNPVYKDFIAQVSTTYEPQFYHQAVLFPEWHQAITTEIKALESDNTWTLVPFPAGKQCIGCRWVYKAGIDFSDTFSPIAKLTSVRVLLDVAVVKNWSILQLDVDNVFLNGDLFEEVYMELPKGQRMTILSLPLAKAKLQALFKLKILGPLKYFLGLEIAKVQQGHCTDSGKICFFHSVHAESKDTSSRCCALSPPIHQRYFRVFIFQQAIPSICLPMQMLIGEDAWTHADQQLVPAEYQTFSLISSEVIWLKRLLLHFEFTIPSIMLFCDSKSAIDLTSNPAHHERSKHIDIDYHFIRELVQSNILKLVHVKSQRQVADVFTKPLLLLACSSFIRKLELINIYSPT

SEQ ID NO: 140579 - protein, 198 aa, Glycine max
  Coding DNA Sequence Number=SeqID_23801
  Homolog annotation: Hit_ID=Q2QMH5; Match level="QueryCoverage=66%, HitCoverage=26%, E-value=2e-28, Identity=58%"; Hit description =Expressed protein
  Pfam annotation: Domain name=DUF828; Domain location=22-161; Score= -109.4; E_value=0.033; Accession=PF05703.2; Description=Plant protein of unknown function (DUF828)
MDKAQTEPWRPDPLHSGMFRPPETPREPMEFLSRSWSVSALEVSKALSPALSKVTLSNGAAVVAIPEDIAGEAEEASATVSGNPFSFASSETSQMVMERIMSQSQEVSPRTSGRLSHSSGPLNGTQSCGSLTDSPPVSPSEIDDIKNCLEQPRRVAPMNVLEYPNLATHSVELRPSYLAALTLHTPVVVSLTLTQAWQ

SEQ ID NO: 140580 - protein, 646 aa, Glycine max
  Coding DNA Sequence Number=SeqID_23802
  Gene Ontology: Mol. function=binding; Cellular component=cytosol
  Homolog annotation: Hit_ID=Q2R0N3; Match level="QueryCoverage=81%, HitCoverage=99%, E-value=1e-130, Identity=47%"; Hit description =Armadillo/beta-catenin-like repeat family protein, expressed
  Pfam annotation: Domain name=Arm; Domain location=334-374; Score=4.1; E_value=3.7; Accession=PF00514.13; Description=Armadillobeta-catenin -like repeat
  Pfam annotation: Domain name=Arm; Domain location=37-77; Score=11.6; E_value=0.44; Accession=PF00514.13; Description=Armadillobeta -catenin-like repeat
  Pfam annotation: Domain name=Arm; Domain location=377-417; Score =23.0; E_value=0.0011; Accession=PF00514.13; Description =Armadillobeta-catenin-like repeat
  Pfam annotation: Domain name=Arm; Domain location=419-459; Score =37.9; E_value=3.4e-08; Accession=PF00514.13; Description =Armadillobeta-catenin-like repeat
  Pfam annotation: Domain name=Arm; Domain location=563-596; Score=3.2; E_value=4.9; Accession=PF00514.13; Description=Armadillobeta-catenin -like repeat
  Pfam annotation: Domain name=Arm; Domain location=79-119; Score=20.5; E_value=0.0059; Accession=PF00514.13; Description=Armadillobeta -catenin-like repeat
  Pfam annotation: Domain name=HEAT; Domain location=212-248; Score =1.2; E_value=30; Accession=PF02985.12; Description=HEAT repeat
  Pfam annotation: Domain name=HEAT; Domain location=339-376; Score =25.1; E_value=0.00025; Accession=PF02985.12; Description=HEAT repeat
  Pfam annotation: Domain name=HEAT; Domain location=383-419; Score =7.1; E_value=5.8; Accession=PF02985.12; Description=HEAT repeat
  Pfam annotation: Domain name=HEAT; Domain location=42-79; Score=2.1; E_value=24; Accession=PF02985.12; Description=HEAT repeat
  Pfam annotation: Domain name=HEAT; Domain location=430-461; Score =4.6; E_value=12; Accession=PF02985.12; Description=HEAT repeat
  Pfam annotation: Domain name=HEAT; Domain location=472-504; Score =9.8; E_value=2.7; Accession=PF02985.12; Description=HEAT repeat
  Pfam annotation: Domain name=HEAT; Domain location=566-598; Score =2.8; E_value=19; Accession=PF02985.12; Description=HEAT repeat
  Pfam annotation: Domain name=HEAT; Domain location=609-644; Score =6.9; E_value=6.1; Accession=PF02985.12; Description=HEAT repeat
  Pfam annotation: Domain name=HEAT; Domain location=85-121; Score=9.7; E_value=2.8; Accession=PF02985.12; Description=HEAT repeat
  Pfam module annotation: Pfam domain module=Arm::Arm::Arm::Arm::Arm::Ar m::HEAT::HEAT::HEAT::HEAT::HEAT::HEAT::HEAT::HEAT::HEAT; Domain location=334-374::37-77::377-417::419-459::563-596::79-119::212 -248::339-376::383-419:...
  Pfam module annotation: Domain location=:42-79::430-461::472-504::566- 598::609-644::85-121
MPTPSASSDPILDRLASSDCAVKFKAIREVKNHIIGNRTKKHSYIKLGAVPAVAAALADSDPNLIVQSAAALGSFACGVDDGVRAVLDAGAFPRLIGLLSAHDEKVVDAAARSLRMIYQSTLAPKYDFFQEETMQFLLSLLESENENLTGLGAGIVIHSCKTIGEQTILCHAGVLEKLTSLLDSSLSQRDASLESLAAIIRDNPAAVSEFVELHGGRALHSVAELTKDRYPRTRLLACLCLISVKNSSTCYLQDIGIKTKLVYILLELLDDSGQVGDEASFAFSSLIAEKEDLQKLAFEANAINKFNCLLQKHPVQPKRLEGVFLALADLCSKLECCRSSFLSLQVLNLVVDALTHEDASVRTAACICLRSVSRSIKNLSAGRFMNERVVCPLVQLLSDLSTSVQVAALGAISNIVVDFMPHKSTFIECGGIKELVQLTKSMDSSLRLNAVWALRNMVFLADKICKEGIFVELTASSMASLICDPEPSVQEQALALVRNFVDGCVYSVEHAFAEDGIILDAVGRQLKKSTKIEIGIQGMYVLSNIASGNEFHKEAVMQLLFPQDENVSHSFFEQFLQSHDSRLRTAAVWVVVNLTFPANPGAFGRIVNLRSFGIVSRIKKMVNDSCMDVKLRARLALGQILTFGDS

SEQ ID NO: 140581 - protein, 54 aa, Glycine max
  Coding DNA Sequence Number=SeqID_23803
MAMMVIREAVAIFGEGAGTSHECCKHMTCADVDNKLTIDFENEASFQPLPKKAE

SEQ ID NO: 140582 - protein, 47 aa, Glycine max
  Coding DNA Sequence Number=SeqID_23804
MEMQKTTVPGSALSKMNWANKPDPYELLGLGYKRVKAKFEHKTSQKL

SEQ ID NO: 140583 - protein, 103 aa, Glycine max
  Coding DNA Sequence Number=SeqID_23805
  Homolog annotation: Hit_ID=UPI000034F397; Match level="QueryCoverage =86%, HitCoverage=18%, E-value=5e-18, Identity=50%"; Hit description =S-adenosylmethionine-dependent methyltransferase
MLKVENHEDQGNYIGSVMQTKSLQLFLLGFMPVVTFRTFVECKDVKAVVSLGCCYNLLSEEMIKDGESQFGFPMSHAVRSIGLSLGKSARDLACQFFSVSRYI

SEQ ID NO: 140584 - protein, 103 aa, Glycine max
  Coding DNA Sequence Number=SeqID_23806
MGTNQNGKRFYQVKVKNLDVTSLKELGRLMGPLQRQAFRKVYGKILDLAAAEVFTEAVVSLAQYYDQPLSKIAAVVGDSAKELDRTKQTRNGVVGLPRKYLEG

SEQ ID NO: 140585 - protein, 224 aa, Glycine max
  Coding DNA Sequence Number=SeqID_23807
  Homolog annotation: Hit_ID=UPI000034F397; Match level="QueryCoverage =88%, HitCoverage=38%, E-value=6e-66, Identity=59%"; Hit description =S-adenosylmethionine-dependent methyltransferase
MMNEFRYSCKSAHQTLQWINEIIHFLTPYSSLINAHVVNFFKDRLWENVDAEWIECLRRESVQNLLLIPSGAVQDQWPTSLKEFILKIRSMVFCQEQADINMALPGLQTISLNTVLAQGMNVKKKHEVEILSAVTNTVANSIRADAILDVGAGQGYLAQVLAFQYQHPVIAIDACSHHGRVTDARAERIKKYYTSQMIKSEYVLQLSSYLLQCDLILETCLTVL

SEQ ID NO: 140586 - protein, 86 aa, Glycine max
  Coding DNA Sequence Number=SeqID_23808
  Gene Ontology: Mol. function=electron carrier activity; Cellular component=extracellular region; Biological process=response to biotic stimulus
  Homolog annotation: Hit_ID=Q04106; Match level="QueryCoverage=54%, HitCoverage=26%, E-value=5e-16, Identity=76%"; Hit description=Prb-1b
  Subcellular localization annotation: CTP_CleavageSite=62; ConfidenceScore=5.32e-01
MGLHKVPFSIFFCVLDLAILAMPTTPKQTSSTSTTQLGHSVCGHYTQVVWRNSLRVGCAKVRCDNGSTFIICCYDPRGNIRGQRPY

SEQ ID NO: 140587 - protein, 249 aa, Glycine max
  Coding DNA Sequence Number=SeqID_23809
  Gene Ontology: Mol. function=electron carrier activity; Cellular component=extracellular region; Biological process=response to biotic stimulus
  Homolog annotation: Hit_ID=Q00MX6; Match level="QueryCoverage=86%, HitCoverage=86%, E-value=2e-27, Identity=57%"; Hit description =Pathogenesis-related protein 1a
  Pfam annotation: Domain name=SCP; Domain location=143-247; Score =15.7; E_value=0.0019; Accession=PF00188.16; Description=SCP-like extracellular protein
  Pfam annotation: Domain name=SCP; Domain location=33-129; Score=36.5; E_value=9.4e-08; Accession=PF00188.16; Description=SCP-like extracellular protein
  Pfam module annotation: Pfam domain module=SCP::SCP; Domain location =143-247::33-129
MGSHKVSFFVFFFLVLAFQPHVGHAQCSQEDFLNGQNDARSDVDVQVPLPPLVWNNTLAEYAQDYAKQRKSNCQLVHSNGPYGENLAGSTGDISCANAVKLWVDEKPYYDRNSNSCVGGAHSSVATIIPLATTLDKDLIKGLARAEVGVEPLAWDDTVAAYAQQYADSRIKECQVVHSQGPYGENLVASPGDVSGTDAVKMWVAEKANYDHKANNVTMAGRLSSAAMTHLAIFKVNNLTSFNVVLRSTQ

SEQ ID NO: 140588 - protein, 354 aa, Glycine max
  Coding DNA Sequence Number=SeqID_23810
  Homolog annotation: Hit_ID=Q9LD39; Match level="QueryCoverage=89%, HitCoverage=80%, E-value=8e-23, Identity=44%"; Hit description =Arabidopsis thaliana genomic DNA, chromosome 3, P1 clone: MGH6
MASLACVNHLPPWLSPRPGSDPEPDFEFPLDPPTTMLPADQLFSDGKLLPLHLKPLSTTTPQTPKSPSSASVNTVTPPTTTSSSSADPYLFSPKAPRCSSRWKDLLGLKKLYQTTNNTKTTPSSTSAKSLKILLHRKTTSSSTSSFSSENAPLLTSISSDAESLSISSSRLSLSSSSSSHDHDDLPRLSLDSDKPNPNLSLNTNQISLHRNPNRRIRLVKNRTNSFDANKHSSDQPSQLSRPGRSPIRRESETVTCRGVSVDSPRMNSSGKIVFQSLERSSSSPSTFNGGPRFKHRGMERSYSANVRVTPVLNVPVCSLRGASKSGFIGFGQLFSSPQKKEGTTTGKGHRSIRN

SEQ ID NO: 140589 - protein, 125 aa, Glycine max
  Coding DNA Sequence Number=SeqID_23811
MERDSASEEIEVNKGAFSEEKEEVDDDVVLRWRRIFRDLAEVEEGVAEEVFPAGGAAGGFGGEEVGVGGGGGGGGGGGDGVNGSGGRSLPSEKSWSAGSMVVGGSKGNSKSGSGSDPGRGESQGG

SEQ ID NO: 140590 - protein, 117 aa, Glycine max
  Coding DNA Sequence Number=SeqID_23812
MDKGMEVPYPVVPSKKEKDRNLVRFLDIFKKLEITMPFGEALQQMPLYSKFLKDMLTRRHKRLGELEIMPTQMTLQLADRSITKPYGVIEDVLVRVKHLSSQQTLWSWISLKILTSL

SEQ ID NO: 140591 - protein, 59 aa, Glycine max
  Coding DNA Sequence Number=SeqID_23813
MAACLGELRLSPEVMSLPRRAGFLTLKSFGGPNQAEASLGELSIQHHKPTSEDQKINER

SEQ ID NO: 140592 - protein, 84 aa, Glycine max
  Coding DNA Sequence Number=SeqID_23814
  Homolog annotation: Hit_ID=Q8H3G8; Match level="QueryCoverage=55%, HitCoverage=5%, E-value=3e-11, Identity=68%"; Hit description=Myosin heavy chain-like protein
YQALNESPVGHNQSPKVTSEAVAIADDINDISCECWEKAENEGTSLKKQVHALTLRNSTLEDRVTHLDSALKECVRQLRQTRCL

SEQ ID NO: 140593 - protein, 109 aa, Glycine max
  Coding DNA Sequence Number=SeqID_23815
MANVCLWEQNASSRVQESGDIIATRRVFTHGDPLVEYWNDLKSALRKRHIDVAPCGACRPWIFFINKLLCFLKIVTAEWRRKKDDWRCHFKEKMSQEEAHHHRKPWIRA

SEQ ID NO: 140594 - protein, 76 aa, Glycine max
  Coding DNA Sequence Number=SeqID_23816
MDAPTNNTSFHSHAAANVCLLCPNTAGQEGERAYVQSGLCTDSSSSNPFYPIIYGITANANPISLLHREWVSAQKG

SEQ ID NO: 140595 - protein, 101 aa, Glycine max
  Coding DNA Sequence Number=SeqID_23817
  Gene Ontology: Mol. function=protein binding; Cellular component =ribonucleoprotein complex; Biological process=mRNA metabolic process
  Homolog annotation: Hit_ID=Q17E06; Match level="QueryCoverage=63%, HitCoverage=39%, E-value=5e-12, Identity=58%"; Hit description=Small nuclear ribonucleoprotein, core, putative
  Pfam annotation: Domain name=LSM; Domain location=5-57; Score=45.1; E_ value=2.4e-10; Accession=PF01423.12; Description=LSM domain
MSAGPGLESLVDQTISVITNDGRNIVGVLKGFDQATNIILDESHERVYSTKMLDISETKRHLSMIKKDHLLRSWFVIPTTTTALSSYESQLHGLYYAIEFA

SEQ ID NO: 140596 - protein, 137 aa, Glycine max
  Coding DNA Sequence Number=SeqID_23818
MEAEENDSVVVESTEPSSSHGSDGDDQLRQSSDVLAKGLSSMLSSVINDFDFRAQQTLQSQNHLSSAIDRLTGERHYQQFVGPTSNTGFGSFKQGLGFEPCGWKNLVERKNPIKVVSQVLRWRLVISKAGGFVPITW

SEQ ID NO: 140597 - protein, 103 aa, Glycine max
  Coding DNA Sequence Number=SeqID_23819
  Gene Ontology: Mol. function=molecular_function; Cellular component =cellular_component; Biological process=biological_process
  Homolog annotation: Hit_ID=O80327; Match level="QueryCoverage=98%, HitCoverage=42%, E-value=1e-31, Identity=62%"; Hit description =Thaumatin-like protein 1 precursor
  Pfam annotation: Domain name=Thaumatin; Domain location=14-103; Score= -54.5; E_value=0.00046; Accession=PF00314.8; Description=Thaumatin family
  Subcellular localization annotation: CTP_CleavageSite=85; ConfidenceScore=5.53e-01
MYAGAYSATFTVTNNCAFTIWPATLTGGGTSQLPSTGFELTSKASSTIDVTAPWSGRFWARSQCSTDTHGKFTCATGDCGSGEVPCKLVEPSSFSSGIHFGLK

SEQ ID NO: 140598 - protein, 309 aa, Glycine max
  Coding DNA Sequence Number=SeqID_23820
  Gene Ontology: Mol. function=helicase activity; Cellular component =mitochondrion; Biological process=embryonic development ending in seed dormancy
  Homolog annotation: Hit_ID=Q6Z7E0; Match level="QueryCoverage=75%, HitCoverage=81%, E-value=6e-37, Identity=31%"; Hit description =Putative pentatricopeptide (PPR) repeat-containing protein
  Pfam annotation: Domain name=PPR; Domain location=100-134; Score=7.2; E_value=1; Accession=PF01535.11; Description=PPR repeat
  Pfam annotation: Domain name=PPR; Domain location=135-169; Score =25.5; E_value=0.00019; Accession=PF01535.11; Description=PPR repeat
  Pfam annotation: Domain name=PPR; Domain location=170-204; Score =38.8; E_value=1.9e-08; Accession=PF01535.11; Description=PPR repeat
  Pfam annotation: Domain name=PPR; Domain location=205-239; Score =23.3; E_value=0.00085; Accession=PF01535.11; Description=PPR repeat
  Pfam annotation: Domain name=PPR; Domain location=240-274; Score =48.3; E_value=2.5e-11; Accession=PF01535.11; Description=PPR repeat
  Pfam annotation: Domain name=PPR; Domain location=275-309; Score =35.5; E_value=1.8e-07; Accession=PF01535.11; Description=PPR repeat
  Pfam module annotation: Pfam domain module=PPR::PPR::PPR::PPR::PPR::PP R; Domain location=100-134::135-169::170-204::205-239::240-274::275 -309
  Subcellular localization annotation: CTP_CleavageSite=47; ConfidenceScore=5.71e-01
MASLLNTVSPAANLSPKTKRPTCGGFLHSQFPNLRTFSLNKGFSRVSASTQIAISPKDTIFNLPNWRVGRNDQKGKELRIYDAFLHLEYLVGKGQKPEVNQATQLLYDLCKFNKARKAVRVMEMMVGSGIIPDAASYTHLVNFLCKRGNVGYAIQLVEKMEGHGFPTNTVTYNTLVKGLCMHGNLNQSLQLLDRLTKKGLIPNAFTYSFLLEAAYKERGVDEAMKLLDDIIAKGGEPNLVSYNVLLTGLCKEGRTEEAIKLFQELPVKGFSPSVVSFNILLRSLCYEGRWEEANELLAEMDKEDQPPSV

SEQ ID NO: 140599 - protein, 110 aa, Glycine max
  Coding DNA Sequence Number=SeqID_23821
  Homolog annotation: Hit_ID=Q1T265; Match level="QueryCoverage=64%, HitCoverage=7%, E-value=8e-16, Identity=61%"; Hit description =Tetratricopeptide-like helical
MESDKIYKFLDELGEKMKMAGYKPDTDYVQQDVDQEEKAESLCSHSEILESANDYKILHKVNECTVSISSKLNSDKKIPIFFYKDASRKRPNCPILSLSEQVSLGQRGQD

SEQ ID NO: 140600 - protein, 478 aa, Glycine max
  Coding DNA Sequence Number=SeqID_23822
  Gene Ontology: Mol. function=binding; Cellular component =intracellular; Biological process=metabolic process
  Homolog annotation: Hit_ID=Q1T265; Match level="QueryCoverage=88%, HitCoverage=82%, E-value=1e-129, Identity=39%"; Hit description =Tetratricopeptide-like helical
  Pfam annotation: Domain name=PPR; Domain location=189-223; Score=9.3; E_value=0.6; Accession=PF01535.11; Description=PPR repeat
  Pfam annotation: Domain name=PPR; Domain location=323-357; Score =39.9; E_value=8.5e-09; Accession=PF01535.11; Description=PPR repeat
  Pfam annotation: Domain name=PPR; Domain location=358-392; Score =15.9; E_value=0.098; Accession=PF01535.11; Description=PPR repeat
  Pfam annotation: Domain name=PPR; Domain location=394-427; Score =11.6; E_value=0.32; Accession=PF01535.11; Description=PPR repeat
  Pfam annotation: Domain name=PPR; Domain location=70-104; Score=16.3; E_value=0.088; Accession=PF01535.11; Description=PPR repeat
  Pfam module annotation: Pfam domain module=PPR::PPR::PPR::PPR::PPR; Domain location=189-223::323-357::358-392::394-427::70-104
  Subcellular localization annotation: CTP_CleavageSite=46; ConfidenceScore=5.30e-01
MRFKGSITHITLLSKSSSIWKQLPSTKVAPSVPTNIPSYLGLRLLKAALNVGDFRRAQKLYDNITQPDPATCSTLISAFTTRGLPNESIRLYALLRARGIETHSSVFLAIAKACGASGDALRVKEVHAYGKCKYIEGARQAFDDLVVKDVPNLVSVSSILPACSVLKDLKSGRAIHGIAVRHEMMENVFVCSALVNLYARCLSVKQARLVFDLMSHRDVVSWNGVLTAYFTNISYEKEKAVEMLSKMQNMGFKPNQITISSFLPACSILESLRMGKEIHCYVFRHWLIGDLTTMTALVYMYAKCGDLNLSRNVFDMILRKDVVAWNTMIIANAMHGNGKEVLLVFESMLQSGIKPNSVTFTGVLSGCSHSRLVEEGLHIFNSMSRDHQVEPDANHYACMVDVFSRAGRLDEAYEFIQKMPMEPTASAWGALLGACRVYKNLELAKISANKLFEIEPNNPGNYVLLFNILVTAKLWSEA

SEQ ID NO: 140601 - protein, 477 aa, Glycine max
  Coding DNA Sequence Number=SeqID_23823
  Gene Ontology: Mol. function=carboxypeptidase activity
  Homolog annotation: Hit_ID=Q69RQ8; Match level="QueryCoverage=95%, HitCoverage=94%, E-value=1e-128, Identity=51%"; Hit description=Leaf senescence related protein-like
  Pfam annotation: Domain name=DUF231; Domain location=318-471; Score =144.1; E_value=3.7e-40; Accession=PF03005.6; Description=Arabidopsis proteins of unknown function
MATREGTLQIAKKKVPLIPLLSILCFISIFFLLSQFKSTSTSHHSLPTFQIEKHEYHRGSCDYSDGTWIHDPSRTPRYDNTCKEIFKGWNCLSAHKSNAPHLSTWRWQPRLCDLPQFDPAEFLRTHTHTNIGTLTLSFWVFDSAKKVALFLGLLMMGVQQCRSVSDGQIKKWRPAGADRGFTFLAYNLTIAYHRTNLLARFGSWSATDKRGALETLGFREGYRVDVDVPDTTWAQALSFHNILIFNTGHWWWAPSKFDPVKSPMLFFNKGQPVIPPLRPDQGLDMVLKHMYLGTIPTINIKMKKYCNTIEHPSQAIFFIRKMHLGIMPSNYIECAFPFHKDIERLNIPYMEEKARLGALKFFRTQSPRHFEGGDWDQGGSCQRDRPLSIEQVEELFSEKNNGTNVETRLVNKHLYKALKGSSFIILDITHLSEFRADAHPASAGGKKHDDCMHWCLPGITDTWNDLFIELLKSKYQG

SEQ ID NO: 140602 - protein, 656 aa, Glycine max
  Coding DNA Sequence Number=SeqID_23824
  Gene Ontology: Mol. function=zinc ion binding; Cellular component =nucleus; Biological process=transcription
  Homolog annotation: Hit_ID=Q2HSZ7; Match level="QueryCoverage=96%, HitCoverage=55%, E-value=0.0, Identity=51%"; Hit description=FAR1 family, putative
  Pfam annotation: Domain name=FAR1; Domain location=65-240; Score=6.2; E_value=4.4e-07; Accession=PF03101.5; Description=FAR1 family
  Pfam annotation: Domain name=SWIM; Domain location=524-560; Score =30.9; E_value=4.6e-06; Accession=PF04434.8; Description=SWIM zinc finger
  Pfam module annotation: Pfam domain module=FAR1::SWIM; Domain location=65-240::524-560
MEGESVSSSSKSQNDVIEKMSLNEGMEDGNGEAPEHGLQKLVQFNEEVEEPKVGMTFPSEQEIFNYYTNFAQHKGFEVYRRTSKMEEDGKKYFTLACVCSRRSENKRSHLLNPYLVTKTQCKARINACLCLDGKIRVLSVALDHNHELCPGKARLIKYTKKSKPQRKRKHDLSNLAGINGDGSIQSPGVEAGEHGSLGFFDKNRRIFIQKASSLRFESGDAEAIQSYFKAANEYFGDVVTFDTTYLTNKYNIPLALFLGVNHHGQSVLLGIALLSNEDAETFTWLFQTWLACMSTGHAPIAIITREDRAIKTAIEIVFPKARQRWCLSHIMKRVSEKLRGYPRYESIKTDFDGAVYDSFSKDDFNESWKKLIYSHNLHDNEWLNSLYNERHRWVPVYVKDTFWAGMSTIDRNESVHAFFDGYVCSKTSLKQFFKQFDNAMKDKVEKECLADFNSFNNLIPCRSHFGIEYQFQKVYTNGKFKEFQEEVACIMYCNAAFEKKEGLVSAYSVVESKKIQEAIKYVTFNVQFNEEDFEVQCECHLFEFKGILCRHILSLLKLIRKTESVPSKYVFSHWRKDLKRKHTLVRSSYGDLIANPEAERLDKMCNAFQEVACMGVNTDVDFKKVMKWIDDLKVELSCKKTSTGITETLPIASNMS

SEQ ID NO: 140603 - protein, 76 aa, Glycine max
  Coding DNA Sequence Number=SeqID_23825
MKANERACSRSPQGHCHYSHRGSPLTMVRDIATATMGGDDAHGLLMDAFHVTLLVNVESTIEELSGERLRLKEKGG

SEQ ID NO: 140604 - protein, 167 aa, Glycine max
  Coding DNA Sequence Number=SeqID_23826
EYYDTYPDLVVVLYCPPLLKTSGSMKWVVGGGQPSLVLDRKVENEGTHPLYVAHLVGKGGFRGVGKVGNMFDVRSGRKINGSNSCGQLDVKDDSMESGKGVLGWGLNVGVMPNIRLRVGVGKGKVRPDGVYDGQMLLGIKGNRGCEDGVTGDVRIVIANGIKPSGIE

SEQ ID NO: 140605 - protein, 60 aa, Glycine max
  Coding DNA Sequence Number=SeqID_23827
  Homolog annotation: Hit_ID=Q9FN32; Match level="QueryCoverage=75%, HitCoverage=35%, E-value=6e-10, Identity=69%"; Hit description =Protein yippee-like At5g53940
MIQCELHNWRARGKESAHERNQKYKEGKFVLERGRIVDEMDFSTEFRIESCVSMSDAENA

SEQ ID NO: 140606 - protein, 90 aa, Glycine max
  Coding DNA Sequence Number=SeqID_23828
MTTIQVVEVVEVGNMDVCQPRQPNPGTCSGCRYNLLLCRNAKASHEQNLNNLSSEGGRDMINGLSVTSKCKRHDTSSKSDGHLSDKQMER

SEQ ID NO: 140607 - protein, 215 aa, Glycine max
  Coding DNA Sequence Number=SeqID_23829
MTFGGYMSLVMFWVFAHLPTIGYFEPEISALDDLITNRWKPTRGIGQAYLIREKLVTSRWMLLLVSGLFLNKPFSLASSVGRVVATCHLMGDAVPPKGPWDCTPDYLPWFYWVSHSYAIPPEEGEPPRLLVHLPPILIQLPPRQPLAEYVPDQFWMVSSTMQSLLGLEVMLEETSHHQTIQQSLQLLQEGFEVRCNLERQRKRAAKGGRKGGRGG

SEQ ID NO: 140608 - protein, 189 aa, Glycine max
  Coding DNA Sequence Number=SeqID_23830
  Homolog annotation: Hit_ID=Q1SWQ8; Match level="QueryCoverage=37%, HitCoverage=26%, E-value=8e-09, Identity=40%"; Hit description =Nucleic acid-binding, OB-fold; TonB box, N-terminal
MALIPDKIREINGFKETLKLVIRITDLCANFERGLLVDIIDVVDELIYQQISSENKRVVFKLKDLSDQLVSCTLWEDYYLQFLEYLNESNGEGPIVILLTHARIKESQVCIKCNNKTDKDNIPFTCACCKYNQQTVLRYRLEVIVYHKEQSTKFMLWNRECITLIGQLADEVNRLKITLIKGAKDTVIL

SEQ ID NO: 140609 - protein, 405 aa, Glycine max
  Coding DNA Sequence Number=SeqID_23831
  Gene Ontology: Mol. function=nucleic acid binding; Cellular component= membrane of vacuole with cell cycle-correlated morphology; Biological process=mitochondrion organization and biogenesis
  Homolog annotation: Hit_ID=Q1RSX3; Match level="QueryCoverage=87%, HitCoverage=70%, E-value=1e-101, Identity=63%"; Hit description=CBS
  Pfam annotation: Domain name=CBS; Domain location=120-270; Score =17.4; E_value=0.0018; Accession=PF00571.18; Description=CBS domain
MSHPPHLALSRWYWHIPFDTVNMEGLYPNQFVLGMVWLLVHQWLPLSVCLYAYVSQLPFQLLLDFLLGHRHEALFRRAELKTLVNLHGNEAGKGGELTHDETTIIAGALELSEKTASDAMTPISETFTVDINSKLDRELMNEILEKGHSRVPVYYEQPTNIIGLVLVSSQYRSTNYQKIMFSLGVFELSLKVKNLLTVHPEDEAPVKSVTIRRIPRVPESMPLYDILNEFQKGHSHMAVVVRRCDKTNQQSSQNNANGKNMLSTVLNFETEIFFINKMLRVSLASEIDSVRDVKVDIDGEKPPKEKALKPKMPLHKWKSFPNTNKSSNRGSRSRKWSKNMYSDILEIDGSPLPKLPEEEEAVGIITMEDVIEELLQCICITQEYWHLVCTGFHEFDKRKCVTMRK

SEQ ID NO: 140610 - protein, 61 aa, Glycine max
  Coding DNA Sequence Number=SeqID_23832
MEEIKSQRQWRRFSHEIESRQLWRRSNHIDNRGDPITTVMGEIQSHRQRRRSNHNDDGRDP

SEQ ID NO: 140611 - protein, 684 aa, Glycine max
  Coding DNA Sequence Number=SeqID_23833
  Homolog annotation: Hit_ID=Q6FCX4; Match level="QueryCoverage=43%, HitCoverage=80%, E-value=1e-102, Identity=57%"; Hit description =Putative fatty acid desaturase
MAEVARQHIDQEAAADVGRTAQLTQVPVAARFIAQAFLREGFRFGGEVAAEDDHVGPDVAQAVGHHVAQHHGEEERASQQREEHVVLQHLAGHLSRHRAGLHPHRTATDAALQPTAQAQVLRGHAPLEQQREDRRDDRLQQVERLPALFREDAQQAVADVIVHATHVGVGVVAEIVGLAPVVGGGNDIPLVGVAIELGVAGPVELAVHDVVAQLHVLQDLRQRQQQRAGDRGRPQQRHPEQRRECRQEQQATATHAEPAHGGSHAADVAGIGGAEAADHTVADRIEFLTESMHLGGAQGTVGSAGHGRRPQRSRVAGGATDAFTAAAVADTHAAAVLGLDAMGFEAFQQRAASRHAQLAATARKRQRHLAFAAGIAQWRRRGEGFGLEASHLVRQAFTRSGNEAVRTAGQHMALRQRRVIAGHLQIMGTDARGRRLTLAGGQQMHAQVRMCRGQRLQFITELQMGGGALPIEQVHRCCQRALAGVAQQAAHRRDATAGSQQQHRRRGRHMELAEGGIEAEQFARLCMVDQMLADPAAIDRLDGDRQLAPTQCGRAVAALPQAPLNLDAQGDVLTGAHAGPVPVGAQDQGRRALAGRLAPDQSGHRLAQGPQGIELARPEIEQRRRDPAPRPTGTPMAAATALSTPEDANSPARRTVSREDLLAAALKLIGPHRSLSTLSLREVA

SEQ ID NO: 140612 - protein, 486 aa, Glycine max
  Coding DNA Sequence Number=SeqID_23834
  Homolog annotation: Hit_ID=Q9SEE9; Match level="QueryCoverage=28%, HitCoverage=28%, E-value=1e-40, Identity=62%"; Hit description =Arginine/serine-rich protein
  Pfam annotation: Domain name=DUF1777; Domain location=18-116; Score= -94.5; E_value=0.079; Accession=PF08648.2; Description=Protein of unknown function (DUF1777)
  Pfam annotation: Domain name=RRM_1; Domain location=171-241; Score =28.1; E_value=3.2e-05; Accession=PF00076.12; Description=RNA recognition motif. (a.k.a. RRM, R
  Pfam module annotation: Pfam domain module=DUF1777::RRM_1; Domain location=18-116::171-241
  Subcellular localization annotation: CTP_CleavageSite=102; ConfidenceScore=5.92e-01
MAKPGRGRRSHSGSVSGSSSRSSSPSDSRSSSRSRSVSRSRSPSRSRSSSPSSSSPSRSSRSRSPPPQRRRSPADAARRGRSPPPQSKRASPPPSLTWYIVQAMLLNGGTMVDFFANCHRQFVKGGLLWRCHWLQWKPSPVRESLVLHVEKLSRNVNEGHLKEIFSSPLSSYLPNSCKSYYLAMHISTCNFGEVISVELAMDRTVNLPKGYGYVQFKTRGEAEKALLYMDGAQIDGNVIKARFTLPPRQKVSPPPKTSAVAPKREIPRTDNASADVDKDGPKRQRESSPRRKPPPSPRRRSPVPRRAGSPRRPDSPRRRADSPVRRRVDSPYRRGGDTPPRRRPVSPGRGRSPSPPRRLRSPARLSPRRMRGSPGRRRSPPPPPRRRSPPRRPRSPPRRSPIGRRRTRSPIRRSARSRSRSFSPRRGRPPVRRGRSSSYSDSPSPRKVSRRSKSRSPRRPLRGRGSSNSSSSSSPPPPPPPPPRKP

SEQ ID NO: 140613 - protein, 508 aa, Glycine max
  Coding DNA Sequence Number=SeqID_23835
MAGSGLPSLGRVKLTDLVPSDGLPSDSYKISVSILSQSLAQFSAVIIQFPASDGALLRSSLESARLYFHQRETYPPADIIHTSESREWCKTSGYYADPHLWQETYDYRPGLTPSEPNNSIEFPPAGLPDIFALFGKAARDILDAISYHLNLRSSPFVEILDNVPLRNREISSSVLSVCCHARPSFQGPQHHNITTQEDGPLIMYPDHDHQVDKSLLSLVKSDRAGLHVRDFQGRWILVDGDLGPQEAIVYPGLALYQATAGYVNPALHKTEINMEANMYGRCSLAFKLLPKSMTNLDCSEMRVAGYGIEAQFQLPVPVDDFMQRSHPTDHLFNRPSLQCFNFQPTHDGSMKTLMRRRKQNPKSKPLPPSKRLRLEAQRVLKERVQDIADKKGIKLRFCNLKECESHIHSVDSPCANIRMEIGWPLGVPFVHPHDLPNKAKLGFLEAYEPGWTEAHQNSDRLVNTRLTLTGDEKESVPLISNVWATMDQVVKIALYSSQGALNLSVARL

SEQ ID NO: 140614 - protein, 98 aa, Glycine max
  Coding DNA Sequence Number=SeqID_23836
MFLDVFLDENDGIEDCTLQLLRDSVIGVFNVEDRTLELHHVDYLSPCPNIPKCSIPFSRFEFGFTKLRLSGGLMVVVGFGCMVVGGGFQLGVDKDSGS

SEQ ID NO: 140615 - protein, 90 aa, Glycine max
  Coding DNA Sequence Number=SeqID_23837
  Homolog annotation: Hit_ID=Q5YDB5; Match level="QueryCoverage=42%, HitCoverage=5%, E-value=8e-11, Identity=82%"; Hit description=C -terminal domain phosphatase-like 2
MLNLRCLAIVFDLDEKLIMANTMKSFEDRIEALKGWLLRGSHSSPTSSSPASTTLAFQVSGFRQQRGRDGHRNCRHEASDGGLQTPFCFA

SEQ ID NO: 140616 - protein, 495 aa, Glycine max
  Coding DNA Sequence Number=SeqID_23838
  Homolog annotation: Hit_ID=P76290; Match level="QueryCoverage=42%, HitCoverage=84%, E-value=4e-97, Identity=84%"; Hit description =Protein yecO
  Pfam annotation: Domain name=CheR; Domain location=287-429; Score= -87.2; E_value=0.0069; Accession=PF01739.9; Description=CheR methyltransferase, SAM binding domain
  Pfam annotation: Domain name=DUF72; Domain location=48-278; Score =160.4; E_value=4.6e-45; Accession=PF01904.8; Description=Protein of unknown function DUF72
  Pfam annotation: Domain name=MTS; Domain location=295-447; Score= -86.0; E_value=0.024; Accession=PF05175.4; Description=Methyltransfera se small domain
  Pfam annotation: Domain name=Methyltransf_11; Domain location=314 -415; Score=51.4; E_value=3.1e-12; Accession=PF08241.2; Description =Methyltransferase domain
  Pfam annotation: Domain name=Methyltransf_12; Domain location=314 -413; Score=51.7; E_value=2.5e-12; Accession=PF08242.2; Description =Methyltransferase domain
  Pfam module annotation: Pfam domain module=CheR::DUF72::MTS::Methyltra nsf_11::Methyltransf_12; Domain location=287-429::48-278::295 -447::314-415::314-413
PAQSGQIVSVCRAIGSCPWQNQVTYGAFSAPQQAGAVLTLRIGLPQWQHANWRVLGIETLADYARLFGCVEGNTTLYALPKPEVVQRWYDMTDDAFRFCFKFPDTISHKAALKNCDELVNEFLRLLDPLSQRIGQYWLQLPAAFSPAQLTDLWAFLDRLPRSFHYGVEVRHAAFFAKGEAERALNRGLQQRGVNRVILDSRPVHASASLSPAAVHARAQKPRVPTHAVRTAGQPMRPAAVHPHAGYGRGVSAAAGAVAAAATAGADAAPAPRLATAIQPVLNAGKRRSVPGYSNIISMIGMLAERFVQPNSQVYDLGCSLGAATLAVRRNIQAPGCQIIAVDNSPAMVERCRRHIDAFRAATPVQVLEADIRDVHIENASLVVLNFTLQFLEPDARLTLLQKIAAGLNPGGALVLSEKFSFEDADVGELLFNMHHDFKRANGYSELEISQKRSMLENVMLTDSVETHKARLKSAGFAHAELWFQCFNFGSLVALN

SEQ ID NO: 140617 - protein, 379 aa, Glycine max
  Coding DNA Sequence Number=SeqID_23839
  Gene Ontology: Mol. function=transferase activity, transferring nitrogenous groups; Cellular component=membrane; Biological process =biosynthetic process
  Homolog annotation: Hit_ID=Q1Z5I6; Match level="QueryCoverage=97%, HitCoverage=94%, E-value=1e-118, Identity=54%"; Hit description =Aminotransferase, class I and II
  Pfam annotation: Domain name=Aminotran_1_2; Domain location=25-371; Score=58.2; E_value=2.7e-14; Accession=PF00155.11; Description =Aminotransferase class I and II
MAFDFDQGIDRRHSDSLKWHKYGDRDVLPLWVADTDFRSPPCIIEAIKQRADHGVFGYGATPHGLIDITISRLAQRYGWQIEPEWIVLLPGVVSGLNLSVRAFTESSQSTVAPTPIYPPFRAAARLAQRAQINLPLQLQQDRWVMQLDDSQMQGNERLLMLCNPQNPGGTVYRRDELEAQLAFAQRHDLLVCSDEIHCDLLLTPSVQHIPFASLSEDAAQRSITLISPSKTFNIAGLGASMAIIPHPELRKRFKQVREGIVPGVDILALVAAEAAWRGGDAWLADQLAYLRANRDWLVQQVNALPELSMVAPEASYLGWIDASQLDVASPALYFEKHGLGFSPGRDFGDDRFVRFNFGCTHATLQQAVSRLQQAVAARR

SEQ ID NO: 140618 - protein, 54 aa, Glycine max
  Coding DNA Sequence Number=SeqID_23840
  Gene Ontology: Mol. function=copper ion binding; Biological process =copper ion homeostasis
  Homolog annotation: Hit_ID=Q6D476; Match level="QueryCoverage=71%, HitCoverage=15%, E-value=2e-11, Identity=74%"; Hit description =Copper homeostasis protein cutC
MHSSRASSHEKEQGMTKLEICCYGIDCAMTAQASGADRVELCSAPREGGLTPSA

SEQ ID NO: 140619 - protein, 83 aa, Glycine max
  Coding DNA Sequence Number=SeqID_23841
MDQNWLKASCISNKRHQSVNDIRSHLICDGIIPNYTKWIWQGELPDMPTVSHTEPIDVDCGSNDFQDYFDDAKESRVKQVPNN

SEQ ID NO: 140620 - protein, 78 aa, Glycine max
  Coding DNA Sequence Number=SeqID_23842
MELASGVKEKFKTTAIKVRKKCDKLRDALWPPPKPGNEKPRGPERKQKAETSSKELYGAATMSLSYKELKEISRGSKA

SEQ ID NO: 140621 - protein, 114 aa, Glycine max
  Coding DNA Sequence Number=SeqID_23843
MCSMMTQHLDVAKWGMVRRSLYSEKRNQRLFPNKRLTEEGRMSVSFDGVHLKMLSVKPLVEATLEPSLPLGRQISMPLLRQNPSILGKNNFSLSEEALTHHILHRKLTTRSLLS

SEQ ID NO: 140622 - protein, 672 aa, Glycine max
  Coding DNA Sequence Number=SeqID_23844
  Homolog annotation: Hit_ID=Q9LHJ0; Match level="QueryCoverage=97%, HitCoverage=81%, E-value=1e-121, Identity=42%"; Hit description =Arabidopsis thaliana genomic DNA, chromosome 3, P1 clone: MMP21
MGKKPESNTGGRASHKELNKVVSGPRSAGVIGERGSRENSTSEWSQREDSINWYDQNAYDSEGSTDGKRWSSQPHSSLAHLHDSKPLYRTSSYPEQQRQEQHYHLQHCSSEPVPNWFDQHIYDTETAHDHDGKRWSSQPHSSVAHLQESKPLYRTSSYPEKQQELPRFSSEPILVPKSSFTSYPPPGGLSQLGSPSHSTGHLNIPYHTGAAQMVLSSQNRSHFSNSALQPSALNLGSHFGVSTRQFPTGSHHNQRIQNQLVNQAGLYPGDHSNLLNNMLQQQLHLHNGSVAPHLMTQLQQQQHRLHHPGQRSAGYLSGFQSHLFNPRPSSGSSVISKYEHMHGITDGRDHKPKSTHKGKHSLRFSLHGSDASSQKSDSGSFQFRSKYMTSDEIESILRMQHAVTHSNDPYVDDYYHQACLAKKPNVAKLKHPFCPSQIREYPPRSRANTEPHSFVQIDALGRVSFSSIRCPRPLLEVDPPNTSSSDQKISEKPLEQEPRFAARVTIEDGLCLLLDVDDIDRYLQFNQPQDGGTHLRRRRQVLLEGLATSLQLVDPLGKNGHKVGLAAKDDLVFIRLVSLPKGRKLLAKYLQLLPPGSELMRIVCMTVFRHLRFLFGGLPSDPAALETTNNLAKVVCQCVRGMDLGALSACLAAVVCSAEQPPLRPIGSTSGD

SEQ ID NO: 140623 - protein, 69 aa, Glycine max
  Coding DNA Sequence Number=SeqID_23845
MVEGISNQLQQLICERDHASKNLRRGSKAHHRQLVCRTICWPSQKIMREALSLVHIQEIILQRRLRGKC

SEQ ID NO: 140624 - protein, 849 aa, Glycine max
  Coding DNA Sequence Number=SeqID_23846
  Homolog annotation: Hit_ID=Q9LHJ0; Match level="QueryCoverage=75%, HitCoverage=94%, E-value=1e-155, Identity=48%"; Hit description =Arabidopsis thaliana genomic DNA, chromosome 3, P1 clone: MMP21
  Subcellular localization annotation: CTP_CleavageSite=36; ConfidenceScore=5.08e-01
MVDTDGFGTGGDVGGTPKTGDLRQLGNVPTATWEFSAMSNSASSFFDASQYAFFGSDTAVQEVELGGLDDDDGLLESNEEEFILNREEADNLKSLSDIDDLSTTFWKVGSRKGIKLNKVVSEPKGAGFIGEQGSRENSAAEWAHKDDVLNWYDQNAYDNEGSLDGRRMPSQPHSSLSQLHEAKALYRTSSYPEQQRQQQHHQLQPSESAPNWFDQHLYGTETNQDGKRWSSQPHSTIAHLQESRPLHRTSLYPDKQQEFPHFSSEPILVPNSSFTSYPPPGGRSHQASPSQNSGHLNLPYHATGAQMALSPPNRSHFPNSALQLSGINHGPPFGGNMRQFPTGSPLNQIVQNQLVNQAGLYPGDHPNISSGLPMINKYDQMLGLMEMRDPMPKSAQLGRQNLRFPPQGFDMGSLRSNSGWPRFRSKYMSIEEIENILRMQLVATHSNDPYVDDYYHQGCLAKKSSGAKLRHHFSPAQIKELPLRPSSNAEPHAFLQVDALGRVPFSSIRRPRPLLEVDPPNSSHAGSPEQSISEKPLEQEPMLAARVTIEDGIYLLLDVDDIDRFLQFNQLQDGGLVLKRKRQGLLEGLATSLQLVDPLGKNGRTVTLAAKDDFVFLRIVSLPKGRKLLARYLQLLFPGGELMRIVCMAIFRHLRFLFGGLPSDPAAAETISNLARVVSRCIREMDLGAVSACLAAVVYTSEPPPLRPLGSSAGDGASLILVSVLERATELLTDPHAASNYNIANRSLWQATFDEFFGLLTKYCVNKYDSVMQSFLIQGTPNMASIGSDVARAISREMPVELLRASLPHTDDRQKKQLLDFAQRSIPVVGFNSNSGDQGHHVNSESVLS

SEQ ID NO: 140625 - protein, 88 aa, Glycine max
  Coding DNA Sequence Number=SeqID_23847
  Subcellular localization annotation: CTP_CleavageSite=43; ConfidenceScore=5.51e-01
MVWNPRASSAGRSGSENVGLSNANVGENPMPRKPKGSSARVIRGRENASSQSSSTRRYSAEVIHAILPGKARTTFNKWVPVPETDTGG

SEQ ID NO: 140626 - protein, 313 aa, Glycine max
  Coding DNA Sequence Number=SeqID_23848
  Gene Ontology: Mol. function=metal ion binding
  Homolog annotation: Hit_ID=Q9M4B6; Match level="QueryCoverage=91%, HitCoverage=89%, E-value=1e-75, Identity=51%"; Hit description=ABI3 -interacting protein 2, AIP2
  Pfam annotation: Domain name=PHD; Domain location=232-276; Score=2.0; E_value=0.036; Accession=PF00628.19; Description=PHD-finger
  Pfam annotation: Domain name=zf-C3HC4; Domain location=233-273; Score= 40.6; E_value=5.4e-09; Accession=PF00097.15; Description=Zinc finger, C3HC4 type (RING finger)
  Pfam module annotation: Pfam domain module=PHD::zf-C3HC4; Domain location=232-276::233-273
MESEDLVKQELEELQKQLGKKLKFEASISSLKSLLQRTYPSASPALRKSLRQGFEKQSATARLVAVLFGYMPSCYCVEDQAHLLVSEPSEKEKLKACIAQAREHLHLEDNPSQALQPSDNQANRGYLFEGHLTVDPEPPQPQWLVQSNLLTTAATLFAAESSQAPAANETTQEDAANMLQDLLNRLEEVVPLMVDGGPVAPKAPPASKEVVANLPVITLTEEILANLGKDAECAICRENLVLNDKMQELPCKHTFHPPCLKPWLDEHNSCPICRHELQTDDHAYESWKEREKEAEEERKGAENAIRGGEYMYV

SEQ ID NO: 140627 - protein, 515 aa, Glycine max
  Coding DNA Sequence Number=SeqID_23849
  Gene Ontology: Mol. function=oxidoreductase activity
  Homolog annotation: Hit_ID=Q5VPG7; Match level="QueryCoverage=74%, HitCoverage=72%, E-value=1e-102, Identity=47%"; Hit description =Oxidoreductase, 2OG-Fe(II) oxygenase family protein-like
  Pfam annotation: Domain name=2OG-FeII_Oxy; Domain location=267-364; Score=46.8; E_value=7.5e-11; Accession=PF03171.10; Description=2OG -Fe(II) oxygenase superfamily
  Subcellular localization annotation: CTP_CleavageSite=56; ConfidenceScore=5.31e-01
MEQHHHQQPQPNNNGSNTTTTTTDPFLLNYTTSDLRTASEFLATWLPFLSRDLCTRCTIFLSDRVRSIDPGEAPQDDTPNDQNDMDVEDNCDNHSLGSWKDGAEVNSSNVETPSQRMSWADMAQEDDEFGVEEDNNNNGGNVVMGDSNASSDVAKVEKPTLPREQREYIRFMNVRRKKDFICFERVHGKLVNILEGLELHTGIFSAAEQKRIVNYVASLQEMGKKGELKDGNPPGILTNGMVDPIPDLFKVIIRRLVKWHVLPPTCVPDSCIVNIYEEGDCIPPHIDNHDFVRPFCTVSFLSECNIVFGSNLKIVGPGEFDGSIAIPLPMGSVLVLNGNGADVAKHCVPAVPTKRISITFRRMDVARRPFGYVPEPDLQGIQPLAYEVEQEKKSSGHRPSRHTNRHKVRRGGGRNDALGSATRNDRFSEPRDSNLSSSRSASRNDRFSEPRDSNVSSPRSASRNDRFSEPHDSNLSSSRSANRWSRKPGQAFSIARFAGFRLAAAGSNYFEFACL

SEQ ID NO: 140628 - protein, 154 aa, Glycine max
  Coding DNA Sequence Number=SeqID_23850
  Subcellular localization annotation: CTP_CleavageSite=66; ConfidenceScore=5.38e-01
MAKVPLPLLLHSVLSMNNASMNSALHQAPSFFKWHNALFAHSFIVFSPLCTVLLPRSIKVKVKALRWSAVAYEVRSVGCVQFWCTANRANQVDPWTRISECMKVFDSREDVLRWARSVAYENGFVAVIVRSDINTGSRGRNSFVLIGCERSGEY

SEQ ID NO: 140629 - protein, 467 aa, Glycine max
  Coding DNA Sequence Number=SeqID_23851
  Homolog annotation: Hit_ID=Q00XN5; Match level="QueryCoverage=73%, HitCoverage=47%, E-value=4e-25, Identity=27%"; Hit description =Homology to unknown gene
  Pfam annotation: Domain name=DUF1350; Domain location=83-464; Score= -30.6; E_value=6.8e-10; Accession=PF07082.2; Description=Protein of unknown function (DUF1350)
  Subcellular localization annotation: CTP_CleavageSite=61; ConfidenceScore=5.63e-01
MASSSFILGSDFKCMFSSRNTKTMSGFGALRHPHPNGLFSKCFHFHTLSTRTVSGTTKMVSDVYVGGVTSFRVNSKMYTKLDSCLVIPPTPNRAKPRAIVKFLGGAFIGAVPEVTYGWGQPLLHELLFGFSLSRANFKMPHVMEPLQMSSLANFMSEMSSLRLEGSYKEGFLVVVVPYNVTFDHSQAAKQVYERFQACLGTILTSGLPQANLSPAQLEDLPLFSIGHSNGALLQVLTGSLFSEKIPKANAIIAYNNRPATEAVPYFEQDAKIVEDCYTSLSAALQLGPAVSQMMPVVEATPFYSIARNASGDVWKMMLDAVRSTLQETEQEILNSLTKFVDQLPSVMNEVTQGVSEFKPTPSENRDCFKCLYNVEHTLLVKFNSDAIDETDILEETLKLRVESLGGTLEKVTLSGNHITPCIQEPRWQVGKLYTPADAVAQGLKSLSLNDTKILARTISDWFRRFEG

SEQ ID NO: 140630 - protein, 119 aa, Glycine max
  Coding DNA Sequence Number=SeqID_23852
  Gene Ontology: Mol. function=protein kinase activity; Biological process=protein amino acid phosphorylation
  Homolog annotation: Hit_ID=Q9LTU4; Match level="QueryCoverage=99%, HitCoverage=8%, E-value=9e-30, Identity=53%"; Hit description =Helicase-like protein
  Pfam annotation: Domain name=DUF889; Domain location=34-119; Score= -87.4; E_value=1.4e-05; Accession=PF05970.5; Description=Eukaryotic protein of unknown function (DUF889)
MTHKFCFEALDESLRDIIKGKSSSNQIFGGKVMVLGGDFWKILPVIPRGSCSDIVHATINSSYLWNHCQVLTLTKNMRLQSNTQATDKEEIATFAQWILDIGDEIIGNPNDGYAIVEIP

SEQ ID NO: 140631 - protein, 100 aa, Glycine max
  Coding DNA Sequence Number=SeqID_23853
MEEAKPISSPMVGGCKLTKTGSEDVSDFTLYGSVVGALHWLPPNILSPFMPTVMQLRPLILMIGGPHLEQLSSLVQTEFPGGPRCRLLSQDPALRLNIEA

SEQ ID NO: 140632 - protein, 97 aa, Glycine max
  Coding DNA Sequence Number=SeqID_23854
  Gene Ontology: Mol. function=nucleic acid binding; Cellular component= cytoplasm; Biological process=DNA integration
  Homolog annotation: Hit_ID=Q1SRN1; Match level="QueryCoverage=95%, HitCoverage=8%, E-value=3e-19, Identity=52%"; Hit description =Integrase, catalytic region
MDYCEYDALLRNGTWTLVDLPPLRKAIGCKWVLKIKENPDGTVNKYIDRLVTKVAPQQLDVKYDFLNGTLQEEVYMTQPLNPPTGGLWVDCTKLFMA

SEQ ID NO: 140633 - protein, 106 aa, Glycine max
  Coding DNA Sequence Number=SeqID_23855
  Gene Ontology: Mol. function=monophenol monooxygenase activity; Cellular component=chloroplast; Biological process=metabolic process
  Homolog annotation: Hit_ID=Q66NX3; Match level="QueryCoverage=79%, HitCoverage=14%, E-value=4e-16, Identity=48%"; Hit description =Polyphenol oxidase
MNKQVPKNCSRHGSDKYVKFDVHIDDDEDNLSEPDHKEFVGTFVNLFHGQGHNIKVTSFKVGISKVLDCLEAEEDDVVLVTLVPKVGKRDVIIGGIKVEFIPKYKD

SEQ ID NO: 140634 - protein, 218 aa, Glycine max
  Coding DNA Sequence Number=SeqID_23856
  Gene Ontology: Mol. function=binding
  Homolog annotation: Hit_ID=Q7XBT9; Match level="QueryCoverage=91%, HitCoverage=35%, E-value=4e-14, Identity=30%"; Hit description =Pentatricopeptide, putative, expressed
LKHIVEEVVSKTKAAEFTIVMDENGPNIDREIDPESGHESEELRSLWECINLAKRIEKHLKSERRGRIAILEHKSEHTSDVREERNVEGEEIRGMSVVEERESEGESEMGVTDPKESIHEQITSKGIGNKSVRGLQVVISLQEHRIHTRTRVNPQQHQLRYRVCERGTADGLQGNESWQRRWADQRKRERAIKLDGHLDNVSLFTVFLLRHIDDECHE

SEQ ID NO: 140635 - protein, 116 aa, Glycine max
  Coding DNA Sequence Number=SeqID_23857
MAETAWELHLGGEEEEEERRRCKILKKKQKNENSKKKSHPTFQVLTLLPPTNLLQDQPLSDKNVIIGVFVFLVCGPLHLPCPWPSSSSLSTAKEREWENERMVLATVVEEKKRGKE

SEQ ID NO: 140636 - protein, 55 aa, Glycine max
  Coding DNA Sequence Number=SeqID_23858
MPDLRFQVGDLAESGCFQGGYRGAWFRCKHSNLNKKRIFGLALASYETLLSNVHY

SEQ ID NO: 140637 - protein, 88 aa, Glycine max
  Coding DNA Sequence Number=SeqID_23859
PSATPPMGYPSKDGPAAVGYTQHKDFQRKPKPGVMDFERNAVTAYPAGAQSNLAAPPPPVGYPTKDDLPSQQNVPVKTTTRGGGFWSG

SEQ ID NO: 140638 - protein, 572 aa, Glycine max
  Coding DNA Sequence Number=SeqID_23860
  Gene Ontology: Mol. function=RNA-directed DNA polymerase activity; Cellular component=chromatin; Biological process=chromatin assembly or disassembly
  Pfam annotation: Domain name=Chromo; Domain location=469-523; Score =34.4; E_value=3.8e-07; Accession=PF00385.14; Description='chromo' (CHRromatin Organisation MOdifier
  Pfam annotation: Domain name=RnaseH; Domain location=20-141; Score= -18.2; E_value=0.0029; Accession=PF00075.14; Description=RNase H
  Pfam annotation: Domain name=rve; Domain location=168-323; Score =76.8; E_value=6.6e-20; Accession=PF00665.16; Description=Integrase core domain
  Pfam module annotation: Pfam domain module=Chromo::RnaseH::rve; Domain location=469-523::20-141::168-323
MDKLKTCLTSAPVLALPNFDKDFVIECDASGQGIGAILMQERRPIAYFSKALGVRNLTKSAYEKELMAVVLAIQHWRPYLLGRKFIVSTDQKSLKQLLQQRVVTAEQQNWAAKLLGYDFEIVYKPGSLNRGADALSRVNEDGGLCQIHTRVQWEEEELVKQEVAADQHLQQIIKDLQEDETSRPGYEWKQGVLLYEGRLSKYAHFVPLKHPYTARVIAETFIKEVVRLHGIPLTIVSDRDPIFMSNFWQELFKLQGTKLKVSTAYHPETDGQTEVINRCLETYLRCFIADQPKTWSVWMAWAEYWFNTSFNASTGRTPYEVVYGRTPPSITRWVQGEVRVAAVQRELIDRDEALKQLREQLLKAQDRMKQLADKKRCDRSFEIGEWVFVKLRAHRQQSVVSRIHAKLAARHFGPYPIIARIGAVAYRLKLPDGSRVHPVFHVSLLKKAVGNYHEEEALPELEGESGVLIEPEEVLASRTVQVQGEKVNQVLIRWRGQMVDEATWEDKIAMKSQFPTFCLEDKTIFSGGSIDRSRTQEEGPNEALAHHHSTVGPKVWYVYSRRKKNVANPNDS

SEQ ID NO: 140639 - protein, 86 aa, Glycine max
  Coding DNA Sequence Number=SeqID_23861
MVLERHVVSVFENTSPLILEPGPSLVGWVRMFPSLGFQAKPFKVTCFPAYISYDFPVAIIKVQLPKQNIQSSKLQELPNVILDSYY

SEQ ID NO: 140640 - protein, 444 aa, Glycine max
  Coding DNA Sequence Number=SeqID_23862
  Gene Ontology: Mol. function=RNA-directed DNA polymerase activity; Cellular component=chromatin; Biological process=RNA-dependent DNA replication
MDERIAALEGEMAGVKASLSSLEQGQATLIAMFEKSLGKGKEGGVIVNGETPETESGQGSKPHPEASKTGPSNDEALLEFRQAVKKVELPMFDGDDPAGWIARAEVYFRVQGTRPEVKVCLAHLCMEGATIHFFNSLINDEEELTWEQLKEALLERYGGHGDGDIYEQLTELRQKGSVDDYITEFEYLTAQIPRLPERQFQGYFLHGLKEEIKGKVRSMSVMGNLSRARLLQVARAVERETTRDGSSSSRSNKLGYGSNRFGSSGPNKGGISDWVLVKGSKEATPRTNGPVPRGEKPGQTERRNGPRDRGFTHLSYSEIMERRRKNQCFKCAGPFGPTHQCPDKNLRLLITEDGGGEESELLAVEVEEGDEEVEGEISLMSFHQLSQTQQAKPQSIKLKGTIHEVPVVILIDSGATHNFISQQLAQKMNLVTTNTSPLNIRLGD

SEQ ID NO: 140641 - protein, 1339 aa, Glycine max
  Coding DNA Sequence Number=SeqID_23863
  Gene Ontology: Mol. function=nucleoside-triphosphatase activity; Cellular component=integral to membrane; Biological process=transport
  Homolog annotation: Hit_ID=Q2PCF1; Match level="QueryCoverage=99%, HitCoverage=86%, E-value=0.0, Identity=61%"; Hit description =Pleiotropic drug resistance protein 2
  Pfam annotation: Domain name=ABC2_membrane; Domain location=1063 -1277; Score=225.0; E_value=1.7e-64; Accession=PF01061.14; Description=ABC-2 type transporter
  Pfam annotation: Domain name=ABC2_membrane; Domain location=361-574; Score=204.0; E_value=3.4e-58; Accession=PF01061.14; Description=ABC -2 type transporter
  Pfam annotation: Domain name=ABC_tran; Domain location=4-259; Score =13.0; E_value=1.2e-08; Accession=PF00005.17; Description=ABC transporter
  Pfam annotation: Domain name=ABC_tran; Domain location=778-968; Score= 107.1; E_value=5.2e-29; Accession=PF00005.17; Description=ABC transporter
  Pfam annotation: Domain name=PDR_assoc; Domain location=579-646; Score=131.7; E_value=2.1e-36; Accession=PF08370.2; Description=Plant PDR ABC transporter associated
  Pfam module annotation: Pfam domain module=ABC2_membrane::ABC2 _membrane::ABC_tran::ABC_tran::PDR_assoc; Domain location=1063 -1277::361-574::4-259::778-968::579-646
MYYFRLTLLLGPPRSGKTTLLQALAGKLDRDLRVGHPLAPFLRNDAMISSYILYFSPKDHRQGSSVSGRVTYCGHELSEFVPQRTCAYISQHNLHHGEMTVRETLDFSGRCLGVGTRHELLLELIKREKQAGLKPDPEIDAFMKATAVEGQETSLITDYVLKVLGLEICADTLVGDEMRRGISGGEKKRLTTGEMLVGPSKVFLMDEISTGLDSSTTFQIVKFLRQLVHVMDVTMIISLLQPAPETFDLFDDIILLSEGHIIYQGPRENVLNFFESVGFKCPERKGIADFLQEVTSRKDQEQYWFARDKPYRYVSVPEFVAHFNNFGIGQQLSQELKVPYDRAKTHPAALVKDKYGISKLELFKACFAREWLLMKRSAFIYIFKTTQIMIMSLITMTVFFRTEMRSGHLEDGRKYYGALFFSLTNIMFNGMAELSLTIFRLPVFFKQRDSLFFPAWAFAIPIWIFRIPLSFVESGLWVVLTYYTVGYAPAPSRFFRQLLAFFCSHQMGMSLFRFIAALGRTLVVANTFGFFVLLLVYVLGGFIIAKENLEPWMKWGYYISPMMYGQNAIAINEFLDERWSAPNTDHRIPEPTVGKALLRIRSMFTEDYWYWICIGALLGFSLLFNICFIIALTFLNPYGDSKSIILEEENEKKGTTEESFASTDKPFEDADIDMAVKNTRESSTPKAGTATTKRGLVLPFKPLSLAFDHVNYYVDMPTVNSTHSSPNLIIFNCYFSIVFSHFLFLSVTIFSYQEMEKHGVEGSRLQLLRDVSGAFRPGVLTALVGVTGAGKTTLMDVLAGRKTGGYIEGSISISGYPKKQATFARISGYCEQNDIHSPRITVYESILFSAWLRLGKEVKRDIRKMFVEEVMNLVELHPVRDFQVGLPGIDGLSTEQRKRLTIAVELVANPSIIFMDEPTSGLDARAAAIVMRAVRNTADTGRTIVCTIHQPSIDIFEAFDELLLMKRGGQIIYNGPLGQQSQKLIAHFETIPGVPRIKDGYNPATWVLEITTPAVESQLRVDFAEFYTKSELRNQELIEELSTPLEGTKDLDFPTKYSLSFITQCIACFWKQHLSYWRNPQYNGIRLFMAVIIGVIFGLIFWKKGNQTDTEQDLMNLMGAIFAAVFFLGGSNTSSVQPIVAIERTVFYRERAAGMYSALPYAIAQVAIECIYVAIQTFSFSLILFSMMGFLWRVDKFLWFYFFMFISFVYFTLYGMMTAALTPNPQIAAIVMAFFLVFWNIFSGFIIPKSQIPIWWRWFYWVCPTAWSLYGLVTSQVGDKDTPILVPGTESMTVKAFLEEEFGYEYGFLGVVAVAHIAFVALFLFVFAYSIKVFNFQKR

SEQ ID NO: 140642 - protein, 996 aa, Glycine max
  Coding DNA Sequence Number=SeqID_23864
  Homolog annotation: Hit_ID=Q2R243; Match level="QueryCoverage=27%, HitCoverage=51%, E-value=6e-33, Identity=37%"; Hit description =Expressed protein
  Pfam annotation: Domain name=XS; Domain location=836-936; Score= -19.2; E_value=0.00032; Accession=PF03468.5; Description=XS domain
MQYNRRREEEHGAPHRFESGPDPFRRNRRDGSDPVQQRKVSPLKVDGVRRVGGGGGNKGASDGFEGRDYEWQHVGGGRRSARVRSRSPPAEPVRKRSHFDDGVGHNRSCSPPPGLRARYELSKTTDYSVDDGKLDGKRVYLDREKDLNEGRLGGGQGSMVDQKFVVRENEVGGSYRYRSIPSDMGVSVTTRYEEASEHLPPPPRGVPAGRFEHERLHHRDGPPMDKMPITESHSGAEKTILHARDVSYSAVSPSYAKDFAGPSHMRDYGGSSVEMSRGDFLCSHGDGICIPASYDLSRNSRKLAEPVGFTGQRAIIDTVRGPEIGPRNMTCHQRCEFSPTRTEREDYLNYKLQVRATQDERLYQYDDLPRRIAPHGRLDYEQSVTEYDNREFSRPYIPHPDLHRTGKSEDSYGNQRRAIVHNHSALQKPKYFDYHDVRRTSIASIQGEAYMRSGYSHFENGKRMPQDYEVSHLGAPEADRLPNLRTEYESRRDGGPGLQQERFQSPPLSKHNSETYRQGVRVQEMRQDLGIHDHSDRLMKRKYNANDEIDVHDLRTIKSSKWGATEEFQDAYECEEWVDDEDMDMLYSSGNVEFNPKIYRKYKKEYDELENGEDFPSDEWVIPQGSMEHVQRHSFQFRKYSNQNIKHHPKSSSSNWYKPQHFSKRNAIQKQPKVWKKYHGYDENKHAANDESSEDWISAAESDPTEGSEEFNQMVHENFLMYSKKLNLNLYVQRRYQDQGKAGSLYCIVCGRRYVDGLNSTNPMTIGPNICSSKEFMDTQRLVTHAFMSHKTGLRAKHLGLHKAICVLMGWDTVVPQDTVTWVPQVLPQAEALAQKEDLILWPPIVIIHNISMSDDNPQNWKVVSMETIEAFLRGKGFVRGRIKLCLGKPADQSIVLVKFLGTFGGLGDAERLHKYLSDNNCSRAEYERVKSEGIKSCNTGETDEGDKVENILYGYVGIAEDLDKLDFNSKKWSMVKSRKEIDDLDKAPVKTDEKR

SEQ ID NO: 140643 - protein, 63 aa, Glycine max
  Coding DNA Sequence Number=SeqID_23865
APVSLASLARKRACCDNGHEPWAPVSTKDKERIRQEGALVLTNMDGEELPSPMNSDVVKRYYT

SEQ ID NO: 140644 - protein, 47 aa, Glycine max
  Coding DNA Sequence Number=SeqID_23866
MVNQGISVYGKKRKHGSTCVGSVIKNPEIFASVPTLLKGLSDPNEHT

SEQ ID NO: 140645 - protein, 92 aa, Glycine max
  Coding DNA Sequence Number=SeqID_23867
  Homolog annotation: Hit_ID=Q1SN43; Match level="QueryCoverage=75%, HitCoverage=12%, E-value=9e-14, Identity=51%"; Hit description =Nucleic acid-binding, OB-fold, subgroup
MTKESWNIIVRVLRLWFVPSLNGKGLRLSMEMVLLRMKGDKIHVSLRKTLIYKFIKDIKEDLVYKVGGDQVVLQQFKVLNMPPMPILPLHTL

SEQ ID NO: 140646 - protein, 184 aa, Glycine max
  Coding DNA Sequence Number=SeqID_23868
MHGACSQTARTTGEFGLRERLATASDDMSMQGRNRHSNWQYAQLIGNRQSNWQILIAEGAGLALLLAGHGSAAVQTRQGVQAKSPLPLAVCLALGSPAWLTGCFSLKILALFHYKSRSSESAQLRFLPLLPLLCFFFISSSIRLTVFFLFCCCLLFLGCALFFKWFHFLYMVSLLFILRDFCAW

SEQ ID NO: 140647 - protein, 57 aa, Glycine max
  Coding DNA Sequence Number=SeqID_23869
MSSHSNIEQEAPVSYPAPSATPPMGYPSKDGPAAVGYTQQRLPEETKTRGDGFWEGW

SEQ ID NO: 140648 - protein, 96 aa, Glycine max
  Coding DNA Sequence Number=SeqID_23870
MPTCMTLQLADRFITWPYGVIEDALVKVKHLIFPDDFVVIDIEEDVDIPLILGRPFMSIASWVVDMGKKMLQMGIEDQKISFDLFHGDKDPSSQNV

SEQ ID NO: 140649 - protein, 99 aa, Glycine max
  Coding DNA Sequence Number=SeqID_23871
  Homolog annotation: Hit_ID=Q1T254; Match level="QueryCoverage=37%, HitCoverage=9%, E-value=2e-07, Identity=72%"; Hit description =Peptidase aspartic, catalytic
MERGIKLILAPKSMRTLPTVTSPIEYGIVSTPGSLCLGVEAKLHGESKVIQRCFDDNKDDDKGDDKKLKDQSKNNSSESRTIQEFKIRIKKNSRLKKKV

SEQ ID NO: 140650 - protein, 117 aa, Glycine max
  Coding DNA Sequence Number=SeqID_23872
MHQSFMSEITLELWECRPATNTLEILSALLAHLSPIRAQPFPPLHLSHKAIKQHNNYNYNHLTFITNNLSRVGHPRTQTTTHTNVASCRACRPWIFFINGVLCFLKINGNGMEKEER

SEQ ID NO: 140651 - protein, 240 aa, Glycine max
  Coding DNA Sequence Number=SeqID_23873
MVAIDARATNFSRLDFARVQGRTIHGPRCCSSVMQRESSVSDCLVHGVEWEEGLGSEEEGAEKRCTEVCQATLNEERTKRHCERTKEREHHVEGGDITIKDILHTKGNLGNKDSLKDKRLGGDRSNEPKALKTSTSERLGQRGREAQKKSEKGEKDIVGSNFGRKDEGKHRGTATKNKIKGGHKKEGGNSKGESEDHGVQTDLSHGSCKGKKIENPQLCLSPIERRKQTERNKGVTKEGI

SEQ ID NO: 140652 - protein, 101 aa, Glycine max
  Coding DNA Sequence Number=SeqID_23874
MPKLSKPNKGPVGHKGTIRSNLEGTRSPNSYQVSRLEEIIPQRRILLVVLTMFQSSALDAKECIWNVRSVVKTNGGGPKVARLVLAMSGTEAIASDGLSAS

SEQ ID NO: 140653 - protein, 252 aa, Glycine max
  Coding DNA Sequence Number=SeqID_23875
  Gene Ontology: Mol. function=RNA-directed DNA polymerase activity; Biological process=RNA-dependent DNA replication
MGIISGTKLPIHSSCVPKSKKKGGKKGCKKQIGVGARDMDMFNKFIFDMGVEDLPTVGRKYTRYRLHGHSNSRLDRILVSDTWIDIWLGSIQYILNRSFSDRCLIVMKILIIDWEPKPFKTLNCWFSEKGFLEMVEKWWCSYKVQRKKEFALKEKLKLLKRDLRDWHKEHFGEIEKQALELVKKIRVLDLKDEEEGLEEMELMRRRKHLGDILRLSRRLESIIHQQSRAKWLKEGDGNTKYFNSLERWIKKM

SEQ ID NO: 140654 - protein, 487 aa, Glycine max
  Coding DNA Sequence Number=SeqID_23876
  Homolog annotation: Hit_ID=Q1SW57; Match level="QueryCoverage=23%, HitCoverage=21%, E-value=4e-20, Identity=44%"; Hit description =HEC/Ndc80p
  Pfam annotation: Domain name=Pantoate_ligase; Domain location=122 -301; Score=-162.4; E_value=0.002; Accession=PF02569.6; Description =Pantoate-beta-alanine ligase
MEVDTFNAKDMERGSTEAELLRNALEEQACDLHTILSHKIKDLEALAMECNQALKRLKIGNGIQYLLNAKETTRAEIMGIDHKLSICNAGHFNEDEFVLNPFIRIGHIPSLSDRVLDQNVGLNFETLRIWKVYVYKKRKTTEKRIRRMLSSLSWQSSVLHSQPKPNVGTPTYIALELIKELNYEGSRADFDCSDLDFSIKVIGVEITRDNDDLAMSSRNVYLSPEEREKLGNNDFFQSFQALSINKSLLRAKSSAEAGQVHSKKLRNLVVQSIDIHFGYFEALVQKVRCSATGLWMGVEWFPCKLVPLNIKRDYLIDVKGVVTTISSIRDSIREYFKGGKSLKRIFIEVNYSSYGTRKSTVSAEAENNNVKKEENNNDNNNNYYNESNSKIENSSECLSKAKRQMKTPFQLETLEKAYAELLVGDYEGGVVGEVGIVGLAVADVVLSPVIEGQEGVVGKEAAKGSGVAGFSDGGAQVGFYGICNSTI

SEQ ID NO: 140655 - protein, 127 aa, Glycine max
  Coding DNA Sequence Number=SeqID_23877
MVANAVLSGRAKEAPMVKNSKTWCHWWRFCWCREPKVLQIIERFRERTVYPVGSEGEHDECGELSNVKAEAAGDTGGTCHGVDEVEHDGIVEVTDEDLEYCYSTAIVVPCVVGALSSATILSHKMVK

SEQ ID NO: 140656 - protein, 241 aa, Glycine max
  Coding DNA Sequence Number=SeqID_23878
  Homolog annotation: Hit_ID=Q5QMQ5; Match level="QueryCoverage=22%, HitCoverage=22%, E-value=1e-08, Identity=54%"; Hit description =Homeobox transcription factor-like
LPVEDYEGGVAEEVGVVRSAVVDVVLSPAVEGQEGVAGKEATKCSGVAGFSDGGAQVIMGQAVVQRCKANVNFHDEEKPLYPPTGCRGAPLLSPYLVINEDGLPYGAALHASLATSYLTNYQQDIARTQNFVCKLLDRSHGVVWTTTAPPSGPLTLISTGQDNYKDEECLSLPTIQWETLASNLEDVSKVVEKFAISKSAVEVAVSMKLQDDAIPALEKLRKHSKPFYSRDYGHKYFTREE

SEQ ID NO: 140657 - protein, 108 aa, Glycine max
  Coding DNA Sequence Number=SeqID_23879
  Gene Ontology: Mol. function=nucleoside-triphosphatase activity; Cellular component=chloroplast
  Homolog annotation: Hit_ID=Q2PMM5; Match level="QueryCoverage=99%, HitCoverage=8%, E-value=5e-40, Identity=81%"; Hit description =Protein ycf2
MKKLTILLYLLSCSAGSVAQDLWSLPGPDEKNGITSYGLVENNSDLVHGLLEVEGALVGSSRTEKDCSQFDKDRVTLLLRSFRDKRIIYDEEDELQENDSEFLQGGTM

SEQ ID NO: 140658 - protein, 102 aa, Glycine max
  Coding DNA Sequence Number=SeqID_23880
  Subcellular localization annotation: CTP_CleavageSite=43; ConfidenceScore=5.50e-01
MTPDFTSTPLCFQGPQSPVESPTVAAFPSVGRRRGGSWVRHPREEGVRSRHQRLFEENVRKIGTCGLPTLIVKGSGVVFTHREGCFPRSYVFLNCDEEIKPM

SEQ ID NO: 140659 - protein, 174 aa, Glycine max
  Coding DNA Sequence Number=SeqID_23881
  Homolog annotation: Hit_ID=Q7XDP6; Match level="QueryCoverage=42%, HitCoverage=21%, E-value=9e-35, Identity=94%"; Hit description =Splicing factor 3B subunit 4, putative, expressed
  Pfam annotation: Domain name=RRM_1; Domain location=1-46; Score=18.0; E_value=0.0031; Accession=PF00076.12; Description=RNA recognition motif. (a.k.a. RRM, R
NVYVPKDRVTNQHQGYGFVEFRSEEDADYAIKVLNMIKLYGKPIRVNKASQDKKSLDVGANLFIGNLDPDVDDNLNQIQDLYMSVTKLYTKSSTTSTVELPPPISASEALIVNTLCALGLAFAFWIANTVYSIELVTHPSLTLFFIWITELPIVTLLYSRYRQNRKQCTVTRVP

SEQ ID NO: 140660 - protein, 83 aa, Glycine max
  Coding DNA Sequence Number=SeqID_23882
  Homolog annotation: Hit_ID=P22738; Match level="QueryCoverage=30%, HitCoverage=6%, E-value=6e-08, Identity=96%"; Hit description=60S ribosomal protein L3-2
MKNSIKHPKVQTKNVDHPFRDDEKLASLGESQGNHVSGARTSDTLHPLETSQRQQLQTTSLEQVQIIHPNITTSPQTTPSTPL

SEQ ID NO: 140661 - protein, 471 aa, Glycine max
  Coding DNA Sequence Number=SeqID_23883
  Gene Ontology: Mol. function=oxidoreductase activity; Cellular component=chloroplast; Biological process=electron transport
  Homolog annotation: Hit_ID=Q1XIT6; Match level="QueryCoverage=92%, HitCoverage=67%, E-value=1e-124, Identity=50%"; Hit description=Zea -xanthin epoxidase
  Pfam annotation: Domain name=DAO; Domain location=65-272; Score= -56.8; E_value=0.036; Accession=PF01266.14; Description=FAD dependent oxidoreductase
  Pfam annotation: Domain name=FAD_binding_3; Domain location=63-418; Score=-80.6; E_value=6.1e-06; Accession=PF01494.9; Description=FAD binding domain
  Pfam module annotation: Pfam domain module=DAO::FAD_binding_3; Domain location=65-272::63-418
MASVQILCACTCQVQLQGSIRYRYDYGYPHHHDKISKHRYYSIRVVDSGNEMVLSNLEEEKRKLRVLVAGGGIGGLVLALAAKHRGYEVKVFEKDLSAVRGEGRHRGPIQLLSGALAVLETIDQSVARQIMEAGCVTANRTNGLADGLSGDWFSVFDLFTPASRKRLPLTLVICRMALQDILVNKVGSNIIRNKSKVVDFIQEPNKVRVILENGEQHDGDILIGADGIWSEVRSKLFGQQEANYSGFTCYSGLTSYVPPYIDTVGYRVFLGLNQYFVASDVGHGKMQWYAFHGEPPSSDPFPEGKKKRLLDLFGNWCDEVIALISETPEHMIIQRDIYDRDMINTWGIGRVTLLGDAAHPMQPNLGQGGCMAIEDCYQLILELDKVAKHGSDGSEVISALRRYEKKRIPRVRVLHTASRMASQMLVNYRPYIEFKFWPLSIKHPGIHVAQALFKFTFPQFVTWMIAGHGLW

SEQ ID NO: 140662 - protein, 68 aa, Glycine max
  Coding DNA Sequence Number=SeqID_23884
MEPPVKKRTESARTRNLWMWKSMSLSREPTTRASSPACEPATTNDDGNQGSDSWIHDVLRGKSGWRCC

SEQ ID NO: 140663 - protein, 871 aa, Glycine max
  Coding DNA Sequence Number=SeqID_23885
  Gene Ontology: Mol. function=catalytic activity; Cellular component =intracellular; Biological process=metabolic process
  Homolog annotation: Hit_ID=Q1RXQ0; Match level="QueryCoverage=99%, HitCoverage=100%, E-value=0.0, Identity=75%"; Hit description =Tetratricopeptide-like helical
  Pfam annotation: Domain name=PPR; Domain location=104-137; Score =24.6; E_value=0.00036; Accession=PF01535.11; Description=PPR repeat
  Pfam annotation: Domain name=PPR; Domain location=240-274; Score =32.3; E_value=1.6e-06; Accession=PF01535.11; Description=PPR repeat
  Pfam annotation: Domain name=PPR; Domain location=275-309; Score=4.5; E_value=2.2; Accession=PF01535.11; Description=PPR repeat
  Pfam annotation: Domain name=PPR; Domain location=341-375; Score =37.4; E_value=4.8e-08; Accession=PF01535.11; Description=PPR repeat
  Pfam annotation: Domain name=PPR; Domain location=40-74; Score=9.4; E_ value=0.58; Accession=PF01535.11; Description=PPR repeat
  Pfam annotation: Domain name=PPR; Domain location=411-445; Score=0.0; E_value=7.4; Accession=PF01535.11; Description=PPR repeat
  Pfam annotation: Domain name=PPR; Domain location=473-507; Score =37.4; E_value=4.9e-08; Accession=PF01535.11; Description=PPR repeat
  Pfam annotation: Domain name=PPR; Domain location=574-608; Score =41.1; E_value=3.8e-09; Accession=PF01535.11; Description=PPR repeat
  Pfam annotation: Domain name=PPR; Domain location=609-643; Score=4.4; E_value=2.3; Accession=PF01535.11; Description=PPR repeat
  Pfam annotation: Domain name=PPR; Domain location=645-678; Score=2.5; E_value=3.8; Accession=PF01535.11; Description=PPR repeat
  Pfam annotation: Domain name=PPR; Domain location=711-745; Score=5.1; E_value=1.8; Accession=PF01535.11; Description=PPR repeat
  Pfam module annotation: Pfam domain module=PPR::PPR::PPR::PPR::PPR::PP R::PPR::PPR::PPR::PPR::PPR; Domain location=104-137::240-274::275 -309::341-375::40-74::411-445::473-507::574-608::609-643::645 -678::711-745
MSYMQLSQKFYDAFKLCGSPPIARKLHAQLILSGLDASLFLLNNLLHMYSNCGMVDDAFCVFREANHANIFTWNTMLHAFFDSGRMREAENLFDEMPHIVRDSVSWTTMISGYCQNGLPAHSIKTFMSMLRDSNHDIQNCDPFSYTCTMKACGCLASTRFALQLHAHVIKLHLGAQTCIQNSLVDMYIKCGAITLAETVFLNIESPSLFCWNSMIYGYSQLYGPYEALHVFTRMPKHDHVSWNTLISVFSQYGHGIRCLSTYVEMCNLGFKPNFMTYGSVLSACASISDLKWGAHLHARILRMEHSLDAFLGSGLIDMYAKCGCLALARRVFNSLGEQNQVSWTCLISGVAQFGLGDDALALFNQMRQASVVLDEFTLVTILGVCSGQNYAATGELLHGYAIKNGMDSSVPVGNAIITMYARCGDTEKASLAFRSMPLRDTISWTAMITAFSQNGDIDRARQCFDMTPERNVITWNSMLSTYIQHGFSEEGMKLYVLMRSKAVKPDWVTFATSIRACADLATIKLGTQVVSHVTKFGLSSDVSVANSIVTMYSRCGQIKEARKVFDSIHVKNLISWNAMMAAFAQNGLGNKAIETYEDMLRTECKPDHISYVAVLSGCSHMGLVVEGKHYFDSMTQVFGISPTNEHFACLVDLLGRAGLLDQAKNLIDGMPFKPNATVWGALLGACRIHHDSILAKTAAKKLMELNVEDSGGYVLLANIYTESGELENVADMRKLMKVKGIRKSPGCSWIEVDNRLHVFTVDETSHPQINEVYVKLEEMMKKIEDTGRYVSIVSCAHRSQKYHSEKLAFAFGLLSLPPWMPIQVTKNLRVCNDCHLVIKLLSMVTSRELIMRDGFRFHHFKDGFCSCRDYW

SEQ ID NO: 140664 - protein, 114 aa, Glycine max
  Coding DNA Sequence Number=SeqID_23886
  Homolog annotation: Hit_ID=Q1SEA0; Match level="QueryCoverage=41%, HitCoverage=10%, E-value=3e-12, Identity=75%"; Hit description =Phosphofructokinase
MDEDKPETHDGRPKRSTKRSEKPSELKPNVSLSGVKVVTDLVVVFDDVEPCLIGSVRFLGTKFVDSDSDVLVIDKSFGFDAAVEEAQGAINFAYVEAESTENGNDIVKLIGRYS

SEQ ID NO: 140665 - protein, 605 aa, Glycine max
  Coding DNA Sequence Number=SeqID_23887
  Homolog annotation: Hit_ID=Q680Q1; Match level="QueryCoverage=72%, HitCoverage=98%, E-value=1e-101, Identity=48%"; Hit description=MRNA, complete cds, clone: RAFL22-41-F10
  Pfam annotation: Domain name=ENT; Domain location=186-259; Score =136.1; E_value=9.8e-38; Accession=PF03735.5; Description=ENT domain
MKTIYWSKESTSTRPCNTTTTSDNEAYDVVGHDISVERQSEKWDAPEEDGGVSCGVAGREGRRGRLEFFWSKKTKKHNNHTLENGTLQRRTLTVSPWCCQRKAHRGHVIQREQDEEDRNQSIPHLIAEICKLAMDYEPYDSSGTDDDLPPTHQNRISRGGGGRLAGNGRSAVGSIPYPRMYGEIDMETQIHQLEQEAYSSVLRAFKAQADAITWEKESLITELRKELRLSNEEHRELLGRVNADDVIRRIRSDKIMKQVINALLDTDNREWRQAGGHQPGVLSTGQGLHDSIPSPTVSASRKKQKITPSVPPSRSFGGPSPPFHPQTLTAPHQPSSAAKRGSAPGSKGKKHKPGQILPGVSSMKQYPSSGPGGRNQVPNRAAMGEHAEGASFDSLVGRRVRTKWPDDNNFYEAVITNYNPADGRHNLVYDMGSANETWEWVNLSEISPEDIQWVGEDPGINHRGGFGGPGHGMNRSVGRDGVPGAGRGRGAAKGQSRKDFLSSQNGIGKKAPDDIQILHTDTLIKEVEKVFSANHPDPLEVEKAKKVLKDHEQALIDAIARLNDLSDGESAVWSSQLQNCYSGIADRRVAAPLKAAFRMRILRKM

SEQ ID NO: 140666 - protein, 72 aa, Glycine max
  Coding DNA Sequence Number=SeqID_23888
  Pfam annotation: Domain name=zf-C2HC_plant; Domain location=13-58; Score=26.9; E_value=2.7e-05; Accession=PF07567.3; Description =Protein of unknown function, DUF1544
  Pfam annotation: Domain name=zf-C4_ClpX; Domain location=26-60; Score= 5.4; E_value=0.028; Accession=PF06689.4; Description=ClpX C4-type zinc finger
  Pfam module annotation: Pfam domain module=zf-C2HC_plant::zf-C4_ClpX; Domain location=13-58::26-60
MANEGSSNPPSTDPRWKYCTRGQGNSCVCTFCGKVTTEHLMAKPGNVATCAKCPKEVREELWGYLKDKKKQE

SEQ ID NO: 140667 - protein, 158 aa, Glycine max
  Coding DNA Sequence Number=SeqID_23889
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=51%, HitCoverage=16%, E-value=1e-26, Identity=74%"; Hit description=ATP synthase subunit alpha
  Pfam annotation: Domain name=ATP-synt_ab; Domain location=10-150; Score=-40.0; E_value=4.2e-05; Accession=PF00006.15; Description=ATP synthase alphabeta family, nucleotide-binding domain
MLLTWLPVNTNIRSYEPPISLNIDKTLFIIINTILEEKSHKQWKAYPQRQQKQHKKQHKIAISEFERKTPWQRRMSLLLRRPPGREAYAGEVFHQHSRLLERAGKLRSQLGEGSMTALPIVETQSGDVLAYIPTNLISITDDLYKAEMGIHFYLAQHI

SEQ ID NO: 140668 - protein, 222 aa, Glycine max
  Coding DNA Sequence Number=SeqID_23890
  Gene Ontology: Mol. function=cytokinin dehydrogenase activity; Cellular component=endoplasmic reticulum; Biological process =electron transport
  Homolog annotation: Hit_ID=Q67YU0; Match level="QueryCoverage=93%, HitCoverage=41%, E-value=4e-41, Identity=41%"; Hit description =Cytokinin dehydrogenase 5 precursor
  Pfam annotation: Domain name=Cytokin-bind; Domain location=5-222; Score=118.3; E_value=2.2e-32; Accession=PF09265.1; Description =Cytokinin dehydrogenase 1, FAD and cyto
MEAIPYALVDVAFTIEAKFVACFEATIQANWLRNFISGLGIVNNIARPLKIFYIIYIVELTKYYYNNSQAYVNEEVAYLLKGLNFVPTFVFEKDASYEEFVNRVYPLEQMLRSEGLWEVPHPWLNLWVPRSRMSDFDKGVFNDIVLKQNITGRSFLVYPTNRRNKWDDRMTPVTPDEDVFYVIDILCVATTFDVVEKLQAQNKQILQFCKDAGIKITEYLNR

SEQ ID NO: 140669 - protein, 71 aa, Glycine max
  Coding DNA Sequence Number=SeqID_23891
MIVNDYNSSIGVSICVNENDGGGSGYGSVSGDDSSSGVSFDDVNSDDDNDGAGTDDDRNKDRLIGILVCKR

SEQ ID NO: 140670 - protein, 180 aa, Glycine max
  Coding DNA Sequence Number=SeqID_23892
  Gene Ontology: Mol. function=translation initiation factor activity; Cellular component=mitochondrion; Biological process=translational initiation
  Homolog annotation: Hit_ID=O42929; Match level="QueryCoverage=96%, HitCoverage=87%, E-value=2e-21, Identity=35%"; Hit description =Density-regulated protein homolog
  Pfam annotation: Domain name=SUI1; Domain location=83-180; Score =41.5; E_value=2.8e-09; Accession=PF01253.13; Description=Translation initiation factor SUI1
MAEKPQPVRVLYCGVCSLPPEYCEFGSDFEKCKPWLIQNVPDLYPDLLKEANEKEADKVADKLQSTGISGAGDGAASSAPKQEEDKQEVVIEKVVRNKRKCITTVKGLELFGVKLSDASKKLGKKFATGASVVKLLLLNSGPNHGKLRLEQGPSEKEQIDVQGDIAYDIVEFITDTWPDQ

SEQ ID NO: 140671 - protein, 58 aa, Glycine max
  Coding DNA Sequence Number=SeqID_23893
MAPWNHGSSPRRANASSLSKLARPGELGSKDKDTNFVQAISLFDQATGENQGSETEKT

SEQ ID NO: 140672 - protein, 118 aa, Glycine max
  Coding DNA Sequence Number=SeqID_23894
MVRNTKLTKLNTKVTTLVIERNTKITTTVIERNRGTASSEPWRGMDMNENDKWNGEKPRGTQRLQPQSWKRTESCGEEPKAEQNPPDDDTSANIIGNGDIWKSGRGTVGDSRRDSTKK

SEQ ID NO: 140673 - protein, 214 aa, Glycine max
  Coding DNA Sequence Number=SeqID_23895
MACVSHLCYHKQYEPTTTTLLHSHVNPVQSRDESRLDRVRSFNLDFYNVDNIERPDPIENSDSPQLDRVPSSSLGQVKSFNLNIYKSEIERLDLVHRPDSSQIGRVSSTSLLDRVRSFNLNFNKVEIEKSSRVQQQVTRAPSILERLKSSLSFDRSMSVTEPESEVTGGGELVEETEEEGVDAKADDFINRFRQQLRLQRLDSIIRYRDMLKRY

SEQ ID NO: 140674 - protein, 212 aa, Glycine max
  Coding DNA Sequence Number=SeqID_23896
  Gene Ontology: Mol. function=transferase activity, transferring groups other than amino-acyl groups
  Homolog annotation: Hit_ID=Q0BZD5; Match level="QueryCoverage=95%, HitCoverage=30%, E-value=7e-26, Identity=34%"; Hit description =Acyltransferase family protein
ERAGGFGQLKQRFLLPPGVIGDVGRQRGGMAVANQRYRRCVTLRLALRIAGGPRGAVIQQAGIALGGDFPFVAELHRFTDARFQATALPQQHHGTGCQQRRGAVAGDQPARTAARPTEWLFDEAPGEPGDDQRHGTDAQRLPDAERPIAADARQTEQRPVPQIPRVGNFTDEAHRRVLQQPLIERAACTDHQTGRQHRQQRQPAREAIAMAE

SEQ ID NO: 140675 - protein, 60 aa, Glycine max
  Coding DNA Sequence Number=SeqID_23897
MSILTSANSRFVMINMITEQDEIVCHSSSSFLTLDDDKILYSSSTLHDIMYTCLVSISVY

SEQ ID NO: 140676 - protein, 849 aa, Glycine max
  Coding DNA Sequence Number=SeqID_23898
  Gene Ontology: Mol. function=amino acid-polyamine transporter activity; Cellular component=integral to membrane; Biological process=amino acid transport
  Homolog annotation: Hit_ID=P0AAE2; Match level="QueryCoverage=50%, HitCoverage=94%, E-value=0.0, Identity=78%"; Hit description=Proline- specific permease proY
  Pfam annotation: Domain name=AA_permease; Domain location=433-849; Score=397.3; E_value=2.3e-116; Accession=PF00324.11; Description =Amino acid permease
  Pfam annotation: Domain name=Branch_AA_trans; Domain location=53-410; Score=438.7; E_value=8e-129; Accession=PF05525.3; Description =Branched-chain amino acid transport protein
  Pfam annotation: Domain name=MFS_1; Domain location=321-709; Score= -50.8; E_value=0.067; Accession=PF07690.6; Description=Major Facilitator Superfamily
  Pfam annotation: Domain name=Spore_permease; Domain location=428-769; Score=-136.1; E_value=0.0021; Accession=PF03845.4; Description=Spore germination protein
  Pfam module annotation: Pfam domain module=AA_permease::Branch_AA _trans::MFS_1::Spore_permease; Domain location=433-849::53-410::321 -709::428-769
  Subcellular localization annotation: CTP_CleavageSite=79; ConfidenceScore=5.38e-01
QFKSPALYRFGPHNALVKPVKPLFSRIQGTTQTQLPPQHQLQAVQKFMTHRLTSRDILALGFMTFALFVGAGNIIFPPMVGIQSGEHVWIAAFGFLITAVGLPVMTVIALARVGGGIDALSSPIGKAAGLLLATVCYLAVGPLFATPRTATVSFEVGIAPLTGDGPLPLFIYSLVYFALVIGISLYPGKLLDTVGHFLAPLKIVALTILGVAALLWPAGGISPATADYQRAAFSSGFVNGYLTMDTLGALVFGIVIVNAARSRGVEDSKLLTRYTMLAGVIAGVGLTLVYLSLFKLGSGSGAIVDQNANGAAILHAYVQQTFGGMGSVFLAALIFVACMVTAPPDSDFNSGADGYLSAVHRTGGAELYPELVESQHAHHCANHADQPAGLSWLPPSLAMLVIAAVVDRVKGREQVLFVMQETNKLKRGLSTRHIRFMALGSAIGTGLFYGSADAIKMAGPSVLLAYIIGGAVAYIIMRALGEMSVNNPQASSFSRYAQDYLGPLAGYITGWTYCFEILIVAIADVTAFGIYMGVWFPEVPHWIWVLSVVLIIGAINLMSVKVFGEVEFWFSFFKVATIIIMIVAGFGMIFWGIGNGGQPTGIHNLWTNGGFFAHGIVGMLLSLQMVMFAYGGIEIIGITAGEAKDPAKSIPRAINSVPLRILVFYVGTLFVIMSIYPWNQVGTAGSPFVLTFQHLGIAAAASILNFVVLTASLSAINSDVFGVGRMLHGMAQQGHAPKMFMKVSNRGIPWVTVLVMMLAMLVAVYLNYLMPEKVFLVIASLATFATVWVWIMILLSQIAFRHKIGKEQAGKLQFALPGGSATAWVGVLFLAFIIALIGYFPDTRISLYV

SEQ ID NO: 140677 - protein, 692 aa, Glycine max
  Coding DNA Sequence Number=SeqID_23899
  Gene Ontology: Mol. function=5-methyltetrahydropteroyltriglutamate -homocysteine S-methyltransferase activity; Biological process =methionine biosynthetic process
  Homolog annotation: Hit_ID=Q6D862; Match level="QueryCoverage=52%, HitCoverage=99%, E-value=1e-166, Identity=76%"; Hit description =Putative methionine synthase
  Pfam annotation: Domain name=Branch_AA_trans; Domain location=418 -692; Score=300.0; E_value=4.3e-87; Accession=PF05525.3; Description =Branched-chain amino acid transport protein
  Pfam annotation: Domain name=Meth_synt_1; Domain location=9-327; Score=-161.3; E_value=0.0017; Accession=PF08267.2; Description =Cobalamin-independent synthase, N-termina
  Pfam annotation: Domain name=Meth_synt_2; Domain location=12-366; Score=-97.5; E_value=8.7e-06; Accession=PF01717.8; Description =Cobalamin-independent synthase, Catal
  Pfam module annotation: Pfam domain module=Branch_AA_trans::Meth_synt_ 1::Meth_synt_2; Domain location=418-692::9-327::12-366
MQRNTAPFRADTVGSFLRPAAIKQAREQFASGTLSADQLRQVEDDAIRQVVEQQRASGLQVVTDGEFRRAWWHFDFFGHLHGVELFEADQGIQFNGVQTKAHGVKVTGKVAFNPQHPMLDHFRFLQSVAGDAVAKMTIPSPSVLHFRGGRKVIDATVYPDLEQYFADLAQTYKDAIKAFYDAGCRYLQLDDTVWAYLCSGDQQQQIRERGEDPQQLAHIYAQVLNRALEDKPADLTVGLHVCRGNFRSTWISEGGYEPVAEILFGSVNIDAFFLEYDNERSGGFEPLRFIKPGHQQVVLGLITTKTGELEDAAQVKARLQEAAQFVSLDQICLSPQCGFASTEEGNSLTEAQQWQKIRLVVDIAQQFKSPALYRFGPHNALVKPVKPLFSRIQGTTQTQLPPQHQLQAVQKFMTHRLTSRDILALGFMTFALFVGAGNIIFPPMVGIQSGEHVWIAAFGFLITAVGLPVMTVIALARVGGGIDALSSPIGKAAGLLLATVCYLAVGPLFATPRTATVSFEVGIAPLTGDGPLPLFIYSLVYFALVIGISLYPGKLLDTVGHFLAPLKIVALTILGVAALLWPAGGISPATADYQRAAFSSGFVNGYLTMDTLGALVFGIVIVNAARSRGVEDSKLLTRYTMLAGVIAGVGLTLVYLSLFKLGSGSGAIVDQNANGAAILHAYVQQTFGGMGS

SEQ ID NO: 140678 - protein, 95 aa, Glycine max
  Coding DNA Sequence Number=SeqID_23900
SRSEDADISREGADDDIANETFSQSWPEDADISGEGADDDSWPEDADISEEDLSSLDDKGANNRKVSPHAIGLTGHDSKKCARITIGCLRVPPDS

SEQ ID NO: 140679 - protein, 43 aa, Glycine max
  Coding DNA Sequence Number=SeqID_23901
MDVSPSLEELVQMVENEGSYIEGVTVVMAKRVSDAIQSCKGIG

SEQ ID NO: 140680 - protein, 100 aa, Glycine max
  Coding DNA Sequence Number=SeqID_23902
  Gene Ontology: Mol. function=drug transporter activity; Cellular component=membrane; Biological process=multidrug transport
  Homolog annotation: Hit_ID=Q1SD91; Match level="QueryCoverage=99%, HitCoverage=20%, E-value=6e-29, Identity=64%"; Hit description=Multi antimicrobial extrusion protein MatE
MEGNLEKKLLSREQKSEEENLSLVKRVWEESKVMWIVAAPAIFTRFTTFGISVISQAFIGHIGSRELAAYALVFTVIIRFANGILHSLKAESVAGITFCG

SEQ ID NO: 140681 - protein, 694 aa, Glycine max
  Coding DNA Sequence Number=SeqID_23903
  Gene Ontology: Mol. function=protein kinase activity; Biological process=protein amino acid phosphorylation
  Homolog annotation: Hit_ID=Q1SD79; Match level="QueryCoverage=99%, HitCoverage=99%, E-value=0.0, Identity=87%"; Hit description =Tyrosine protein kinase, active site
RSPDQESVGSGTKRSSVSSGGRPRNQKEFFYKFVESDSLTAKLVDWFESVTEKSELKQQAFDVPFELIELQKFDYALEGISFQQLTRMPNAVHASTSDAVEATAYLAIEDFLHASIKGLWEAFWSQDEPMPFSVDCLYNANMKFYQAEKAIANGRLGGLCGTGILLNNPRHPHGKWDHVLELALLRPDIGGHAVGSDRQPSPSVLGEALFYALRMLLARSLSRLSFFPDPSTVFVLLVDSQYGGVVKVEGDVNKLNFDMKNVYECAAEWVKNHSRISVSPIDRIWNKLGNANWGDIGALQVLFATFHCIVQYAGMPKHSVEDLAADHSSRLQTRRVERQLGDTGVNGNGLFRYQQRSVSPEIVEVQDDSVKVDSKESMITEGTILWLEDSDWQKGYQIKEVINTSELTYFIASHVEDPGQNLFLYVGSHPSQLEPAWEDMNLWYQVQRQTKVLTIMKQKGLSSKYLPQLSASGRIIHPGHCRRPSSGGNCDHPWCGTPILVTSPVGETVAEMVRTGQFGSDEAIRCCHDCLSALSTVASAGIRHGDIRPENVICVKSGVRHPYFVLIGWGHAILEDRDRPAMNLHFSSTYALQEGKLCSASDAESLVYMLYYSCGGVFPDLDSVEGALQWRETSWSRRLIQQKLGDISTVLKAFADYVDSLCGTPYPMDYDIWLRRLRRNIREDDHGKEIDGTG

SEQ ID NO: 140682 - protein, 110 aa, Glycine max
  Coding DNA Sequence Number=SeqID_23904
MGEVRRREGRGVLGHCRNWKGRGSARAEGYFCLLTSFKRCRNNFLFINMQFTALPRAHRTIQLISSIYMTAYYPNKIHTMPTIEMYIDNIKNPNYLVVHLSPFIPKSLRL

SEQ ID NO: 140683 - protein, 131 aa, Glycine max
  Coding DNA Sequence Number=SeqID_23905
MGWELFWEVYQKACDLRQSMLKSLMFIYGAMNDLESSQPVSELVVEVLKMATYEGVRAVEKSTIRDITNGIRANLSPSTDLEVVQVWDCIVEEDLKELIAITYTNKMHILFSSSSVKNSTVKCVWLGAIMG

SEQ ID NO: 140684 - protein, 71 aa, Glycine max
  Coding DNA Sequence Number=SeqID_23906
MGDNLTLISSDGEDDLQEILNKKIDWLGNILEEIPKEIANFCCSSIHDEEDEHSSEDIVEGDFLVVSKVVE

SEQ ID NO: 140685 - protein, 80 aa, Glycine max
  Coding DNA Sequence Number=SeqID_23907
MGKRVKQQSEFDCDSRMAMNFVLQGVHHGHPFRSIVEVIKWWIQKDWQVQISHVYTDENVLVDCLASLAHDYDLICIFFR

SEQ ID NO: 140686 - protein, 52 aa, Glycine max
  Coding DNA Sequence Number=SeqID_23908
MSSLKKLSKELSLEMLLGGCLDPSQVSPREFHYYPNPCFALTKGRASLKGGY

SEQ ID NO: 140687 - protein, 119 aa, Glycine max
  Coding DNA Sequence Number=SeqID_23909
MGKGSVGALSGPKCGPPKRDDVYGMSSKIKVEGGLYQQNEGVCGPSIVKDKPILVTNIPQSQEEVTLLDFSSCGTDSSKRVNGVDDPILFFRDEMRDALTLKAILRSFEMAYGLKINFH

SEQ ID NO: 140688 - protein, 68 aa, Glycine max
  Coding DNA Sequence Number=SeqID_23910
MHFFLKLAKALAKGAATKTEGARMRKENNRKVENDDNAVLHDGKQHANNIFPMNQYPPDSSPPSNRFC

SEQ ID NO: 140689 - protein, 337 aa, Glycine max
  Coding DNA Sequence Number=SeqID_23911
  Gene Ontology: Mol. function=transcription factor activity; Cellular component=intracellular; Biological process=regulation of transcription, DNA-dependent
  Homolog annotation: Hit_ID=UPI00005F7A99; Match level="QueryCoverage =100%, HitCoverage=98%, E-value=1e-109, Identity=58%"; Hit description=COG1609: Transcriptional regulators
  Pfam annotation: Domain name=LacI; Domain location=6-31; Score=46.1; E_value=1.2e-10; Accession=PF00356.11; Description=Bacterial regulatory proteins, lacI f
  Pfam annotation: Domain name=Peripla_BP_1; Domain location=63-334; Score=199.4; E_value=8.3e-57; Accession=PF00532.11; Description =Periplasmic binding proteins and sugar b
  Pfam module annotation: Pfam domain module=LacI::Peripla_BP_1; Domain location=6-31::63-334
  Subcellular localization annotation: CTP_CleavageSite=54; ConfidenceScore=5.48e-01
MSQQKITIHDVAQAAGVSVSTVSLVLSGKGRISPATAARVNQAIEQLGYVRNRSASMLRGGESGVIGLIVRDLSQPFYAAMTAGLSEVLEQQGKVLVLTQSGQHGQHLQRCFDSLAAQGADGIVLGGAVAQAESLRLQAQEQNIALICAARASSLEKVDSLRPDNSQAARMATEYLIKQGHQRIAWVGGLGSSLTRAERIGGYCATLLQYGLPFRPDWIIECDDRQQSVSALTQALLHQHPRITAILAHNASTTLGCYFGALRSGRTLGEDAVDSYYTQQLALVGFNDDPQPELNDPALTFVSSEARIVGRRAAERILQRLAQPQADVQTLIVPPQL

SEQ ID NO: 140690 - protein, 106 aa, Glycine max
  Coding DNA Sequence Number=SeqID_23912
MLGFTSDSPQISASPHQLDFAHYASSSYNAQWNAPGLLHDKHTLRLSRILGEMEVDEPWLALWIPLNYRVVMGARMIFVDNWVVGKEKICYWLSNDIVGLVGSLAR

SEQ ID NO: 140691 - protein, 65 aa, Glycine max
  Coding DNA Sequence Number=SeqID_23913
MEHLSSQTAGEWTIYPWIHSNCNSLSDSDQLRPVSIPDIHPARWACALSTLLGFKPESLIHEGLC

SEQ ID NO: 140692 - protein, 86 aa, Glycine max
  Coding DNA Sequence Number=SeqID_23914
MELEKLNVKIAFPHGRHSNAATEVSRGEESSFMNAMHQIGPSTSSQCFLDARRSVTEYGFTIGNSLGSWKETIHPTMTYPLQRKST

SEQ ID NO: 140693 - protein, 95 aa, Glycine max
  Coding DNA Sequence Number=SeqID_23915
MSILTTGGTLRVPSLRGERDKGISRHHIVHYTPQQNGVVEKMNMTFWKGLDDKDVTKLVEFESSTIRKISDQKQIEGPDETNQADETDQDLQMHP

SEQ ID NO: 140694 - protein, 231 aa, Glycine max
  Coding DNA Sequence Number=SeqID_23916
  Subcellular localization annotation: CTP_CleavageSite=36; ConfidenceScore=5.19e-01
NQLAWVSSSSPGRAHCFSSPRRAAFAPCAHFPINRRAREAKEGLEGPEGQELREEGKNKKKEEETRPKRYRIATTIILYFVSCSAFFVRAPGHSHIEPVEDTIMAEEPRRVTLEDYSSSNVPQIFTSIAQPEVQAQTITYPPSLIQLIQNNLFHGLPNVWKQCLPRVHLLGDCYTENKRGYISCGSVQVEGTSAWFFKENKGWYIPCGSLAFKGFYKVERNLGNCRLLGDW

SEQ ID NO: 140695 - protein, 108 aa, Glycine max
  Coding DNA Sequence Number=SeqID_23917
  Gene Ontology: Mol. function=hydrolase activity; Cellular component =membrane
  Homolog annotation: Hit_ID=Q69II6; Match level="QueryCoverage=52%, HitCoverage=10%, E-value=4e-19, Identity=75%"; Hit description =Putative beta-glucuronidase
MDQLGIASCYSTKVYCRQTLIGGNYGLLNTTTFALNPDYYSAVLWHRLMGKKVLAVSSDVHIKDFYLQLGNPSTWEASLRSKEGSFLGKLEEENFLEKLERGLLTPLP

SEQ ID NO: 140696 - protein, 636 aa, Glycine max
  Coding DNA Sequence Number=SeqID_23918
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=99%, HitCoverage=87%, E-value=0.0, Identity=38%"; Hit description =Tyrosine protein kinase, active site
  Pfam annotation: Domain name=LRR_1; Domain location=102-124; Score =15.4; E_value=0.21; Accession=PF00560.23; Description=Leucine Rich Repeat
  Pfam annotation: Domain name=LRR_1; Domain location=126-148; Score =15.6; E_value=0.17; Accession=PF00560.23; Description=Leucine Rich Repeat
  Pfam annotation: Domain name=LRR_1; Domain location=149-171; Score =7.5; E_value=11; Accession=PF00560.23; Description=Leucine Rich Repeat
  Pfam annotation: Domain name=LRR_1; Domain location=173-195; Score =15.2; E_value=0.25; Accession=PF00560.23; Description=Leucine Rich Repeat
  Pfam annotation: Domain name=LRR_1; Domain location=197-219; Score =12.1; E_value=1.6; Accession=PF00560.23; Description=Leucine Rich Repeat
  Pfam annotation: Domain name=LRR_1; Domain location=221-243; Score =13.4; E_value=0.86; Accession=PF00560.23; Description=Leucine Rich Repeat
  Pfam annotation: Domain name=LRR_1; Domain location=245-266; Score =18.1; E_value=0.033; Accession=PF00560.23; Description=Leucine Rich Repeat
  Pfam annotation: Domain name=LRR_1; Domain location=268-289; Score =13.4; E_value=0.86; Accession=PF00560.23; Description=Leucine Rich Repeat
  Pfam annotation: Domain name=LRR_1; Domain location=30-52; Score=7.6; E_value=11; Accession=PF00560.23; Description=Leucine Rich Repeat
  Pfam annotation: Domain name=LRR_1; Domain location=54-76; Score =10.6; E_value=3; Accession=PF00560.23; Description=Leucine Rich Repeat
  Pfam annotation: Domain name=LRR_1; Domain location=6-25; Score=6.5; E_value=17; Accession=PF00560.23; Description=Leucine Rich Repeat
  Pfam annotation: Domain name=LRR_1; Domain location=78-100; Score =10.2; E_value=3.6; Accession=PF00560.23; Description=Leucine Rich Repeat
  Pfam annotation: Domain name=Pkinase; Domain location=394-625; Score =104.3; E_value=3.7e-28; Accession=PF00069.15; Description=Protein kinase domain
  Pfam annotation: Domain name=Pkinase_Tyr; Domain location=394-629; Score=35.9; E_value=1.1e-14; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR _1::Pkinase::Pkinase_Tyr; Domain location=102-124::126-148::149 -171::173-195::197-219::221-243::...
  Pfam module annotation: Domain location=245-266::268-289::30-52::54 -76::6-25::78-100::394-625::394-629
MSMLTALESLQLAYNNFIGHLPQNICIGGTLKNFTAANNNFIGPIPVSLKNCSSLIRVRLQRNQLTGDITDAFGVLPNLDYIELSDNNFYGQLSPNWGKFRSLTSLMISNNNLSGVIPPELAGATKLQRLHLFSNHLTGNIPHDLCNLPLFDLSLDNNNLTGNVPKEIASMQKLQILKLGSNKLSGLIPKQLGNLLNLLNMSLSQNNFQGNIPSELGKLKSLTSLDLGGNSLRGTIPSMFGELKSLETLNLSHNNLSGNLSSFDDMTSLTSIDISYNQFEGPLPNILAFHNAKIEALRNNKGLCGNVTGLEPCSTSSGKSHNHMRKKVMIVILPLTLGILILALFAFGVWYHLCQTSTNKEDQATSIQTPNIFAIWSFDGKMVFENIIEATEDFDDKHLIGVGGQGCVYKAVLPTGQVVAVKKLHSVPNGEMLNLKAFTCEIQALTEIRHRNIVKLYGFCSHSQFSFLVCEFLENGSVEKTLKDDGQAMAFDWYKRVNVVKDVANALCYMHHECSPRIVHRDISSKNVLLDSEYVAHVSDFGTAKFLNPDSSNWTSFVGTFGYAAPELAYTMEVNEKCDVYSFGVLAWEILFGKHPGDVISSLLGSSPSTLVASTLDHMALMDKLDQRLPHPTKPI

SEQ ID NO: 140697 - protein, 139 aa, Glycine max
  Coding DNA Sequence Number=SeqID_23919
  Gene Ontology: Mol. function=protein binding; Cellular component =integral to membrane; Biological process=protein amino acid phosphorylation
  Homolog annotation: Hit_ID=Q9SRL7; Match level="QueryCoverage=99%, HitCoverage=76%, E-value=1e-23, Identity=41%"; Hit description =Putative disease resistance protein
MVKGMDPESLFSSRTKKSKWTKLPMEAGIGPVNSFKDKDNTLSFDKFPMLPMEAGIGPVSSFKGIDNTLSFDKFPMVKGMDPESLFSSRNKKSKWTKLPMEAGIGPVNSFKDKDNTLSFDKFPMVKGMDPENLFPSRSM

SEQ ID NO: 140698 - protein, 113 aa, Glycine max
  Coding DNA Sequence Number=SeqID_23920
  Gene Ontology: Mol. function=peptidase activity
  Homolog annotation: Hit_ID=Q2QTQ5; Match level="QueryCoverage=100%, HitCoverage=29%, E-value=2e-28, Identity=56%"; Hit description =Expressed protein
  Subcellular localization annotation: CTP_CleavageSite=49; ConfidenceScore=5.23e-01
MGAMTSSMAAKFAFFPPNPPSYGVGLDDVTGKLKMTGVATRENVDVLKLCTRRGNSVVAMYIRNPSASLTMLYSHGNAADLGQMYELFSELSLHLRVNLLCYDYSGYGQSSGK

SEQ ID NO: 140699 - protein, 68 aa, Glycine max
  Coding DNA Sequence Number=SeqID_23921
MAILVDDDFLSRGEATMWKRLTLEGEMCWSTSVRNLPSISSHRVFPNSGIKSQVHPEPSLARAVQDRG

SEQ ID NO: 140700 - protein, 149 aa, Glycine max
  Coding DNA Sequence Number=SeqID_23922
MKVFNLTAAHSSSMVRVCYLQANTFLSPQISKLEYKKTNNNDKGLYVGPCSTGFGSHTLSEKPHTVFDENGVRERFTNNGTTRPQEENSKRKKSEAETNNYESERDNSNDGNVMGRVYERQGNNGEGQGIELREGNSGEVTDTNPTLSP

SEQ ID NO: 140701 - protein, 438 aa, Glycine max
  Coding DNA Sequence Number=SeqID_23923
  Gene Ontology: Mol. function=protein binding; Cellular component =nucleus; Biological process=regulation of transcription, DNA -dependent
  Homolog annotation: Hit_ID=Q39090; Match level="QueryCoverage=74%, HitCoverage=80%, E-value=6e-28, Identity=27%"; Hit description =Protein UNUSUAL FLORAL ORGANS
  Pfam annotation: Domain name=F-box; Domain location=93-140; Score =48.4; E_value=2.4e-11; Accession=PF00646.23; Description=F-box domain
  Subcellular localization annotation: CTP_CleavageSite=61; ConfidenceScore=5.44e-01
MDCLGHSSKSGPGVCVAQSVENGGFGGDGRCCKQASPPRSGGSRNTSPMSRAGSRNTSPLRQKVVKTKPRGLDEETLATFGKVVHADVQMEDNIWAMLPEDLLHEILARVPPFLIFRLRLVCKRWNSLLQDSSFLKFHSSVPSHGPCLFTFWKNTQTPQCSVFSLPLKTWNRIPFTFLPPWAFWLVGSSGGLVCFSGHDGLTFKTLVCNPLTQTWRALPSMHYNQQRQLVLVVDRVDQSFKVIATSDIYGDKSLPTEVYDSNTDSWTVHQIMPAVNLCSSKMAYCDSRLYLETLSPLGLMMYRLDTGHWEHIPAKFPRSLLDGYLVAGTQKRLFLVGRIGLYSTLQSMRIWELDHTKITWVEISRMPPKYFRALLRLSAERFECFGQDNLICFTSWNQGKGLLYDVDKKIWSWIGGCALQSYNNQVCFYEPRFDASIY

SEQ ID NO: 140702 - protein, 663 aa, Glycine max
  Coding DNA Sequence Number=SeqID_23924
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=100%, HitCoverage=91%, E-value=0.0, Identity=38%"; Hit description =Tyrosine protein kinase, active site
  Pfam annotation: Domain name=LRR_1; Domain location=102-124; Score =15.4; E_value=0.21; Accession=PF00560.23; Description=Leucine Rich Repeat
  Pfam annotation: Domain name=LRR_1; Domain location=126-148; Score =15.6; E_value=0.17; Accession=PF00560.23; Description=Leucine Rich Repeat
  Pfam annotation: Domain name=LRR_1; Domain location=149-171; Score =7.5; E_value=11; Accession=PF00560.23; Description=Leucine Rich Repeat
  Pfam annotation: Domain name=LRR_1; Domain location=173-195; Score =15.2; E_value=0.25; Accession=PF00560.23; Description=Leucine Rich Repeat
  Pfam annotation: Domain name=LRR_1; Domain location=197-219; Score =12.1; E_value=1.6; Accession=PF00560.23; Description=Leucine Rich Repeat
  Pfam annotation: Domain name=LRR_1; Domain location=221-243; Score =11.6; E_value=1.9; Accession=PF00560.23; Description=Leucine Rich Repeat
  Pfam annotation: Domain name=LRR_1; Domain location=245-266; Score =19.1; E_value=0.016; Accession=PF00560.23; Description=Leucine Rich Repeat
  Pfam annotation: Domain name=LRR_1; Domain location=268-289; Score =13.4; E_value=0.86; Accession=PF00560.23; Description=Leucine Rich Repeat
  Pfam annotation: Domain name=LRR_1; Domain location=30-52; Score =14.2; E_value=0.48; Accession=PF00560.23; Description=Leucine Rich Repeat
  Pfam annotation: Domain name=LRR_1; Domain location=54-76; Score =10.6; E_value=3; Accession=PF00560.23; Description=Leucine Rich Repeat
  Pfam annotation: Domain name=LRR_1; Domain location=6-25; Score=4.6; E_value=39; Accession=PF00560.23; Description=Leucine Rich Repeat
  Pfam annotation: Domain name=LRR_1; Domain location=78-100; Score =9.6; E_value=4.6; Accession=PF00560.23; Description=Leucine Rich Repeat
  Pfam annotation: Domain name=Pkinase; Domain location=389-663; Score =142.6; E_value=1.1e-39; Accession=PF00069.15; Description=Protein kinase domain
  Pfam annotation: Domain name=Pkinase_Tyr; Domain location=389-663; Score=78.8; E_value=1.7e-20; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR _1::Pkinase::Pkinase_Tyr; Domain location=102-124::126-148::149 -171::173-195::197-219::221-243::...
  Pfam module annotation: Domain location=245-266::268-289::30-52::54 -76::6-25::78-100::389-663::389-663
MSMLTALNSLQLADNNFIGHLPQNICIGGKLKKISAENNNFTGPIPVSFKNCSSLIRVRLQRNQLTGDITDAFGVLPNLDYIELSDNNFYGQLSPKWGKFRSLTSLMISNNNLSGVIPPELAGATKLQRLHLFSNHLTGNIPHDLCNLPLFDLSLDNNNLTGNVPKEIASMQKLQILKLGSNKLSGLIPKQLGNLLNLLNMSLSQNNFQGNIPSELGKLKFLTSLDLGGNSLRGTIPSMFGELKNLETLNLSHNNLSGDVSSFDDMTSLTSIDISYNQFEGPLPNILAFHNAKIEALRNNKGLCGNVTGLEPCSTSSGKSHNHMIVILPLTLGILILALFAFGVSYHLCQTSTNKEDQATSIQTPNIFAIWSFDGKMVFQNIIEATENFDDKHLIGVGGQGCVYKAVLPTGQVVAVKKLHSVPNGEMLNLKAFTCEIQALTEIRHRNIVKLFGFCSHSQFSFLVCEFLENGSVEKTLKDDGQAMAFDWYKRVNVVKDVANALCYMHHECSPRIVHRDISSKNVLLDSEYVAHVSDFGTAKFLNPDSSNWTSFVGTFGYAAPELAYTMEVNEKCDVYSFGVLAWEILFGKHPGDVISSLLGSSPSTLVASTLDLMALMDKLDQRLPHPTKPIGKEVASIAKIAMACLTESPRSRPTMEQVANEL

SEQ ID NO: 140703 - protein, 145 aa, Glycine max
  Coding DNA Sequence Number=SeqID_23925
  Gene Ontology: Mol. function=protein binding; Cellular component =integral to membrane; Biological process=protein amino acid phosphorylation
  Homolog annotation: Hit_ID=Q4G2V8; Match level="QueryCoverage=99%, HitCoverage=77%, E-value=2e-32, Identity=44%"; Hit description=Hcr2 -p3
MKSKLTKLPMEAGIGPVSSFKNIYNSLSFDKFPMVKGMDPESLFLKRCMESKLTKLPMEAGIGLVSSFKDIYNPLSFDKFPMVKGMDPESLFSSRNKESKWTKLPMEAGIGPMSSLKDIDNTLSFDKFPMVKGMDPESLFRSRSI

SEQ ID NO: 140704 - protein, 154 aa, Glycine max
  Coding DNA Sequence Number=SeqID_23926
MDQMKITALSIFLLGCLLVMAVQGDSSARVLPAVTAVEVGNINKLGVSSQKEPFMRTGAGHHMRKQGLGGKKFSTNEVTSVDSKNGKGADGGETSKTSGATYSDGICDFDEKGDHKIVKCKGKKSIKPRKLKMDGFVALTDDYHGPRHHLPKHN

SEQ ID NO: 140705 - protein, 245 aa, Glycine max
  Coding DNA Sequence Number=SeqID_23927
  Gene Ontology: Mol. function=protein serine/threonine kinase activity; Cellular component=membrane; Biological process=protein amino acid phosphorylation
  Homolog annotation: Hit_ID=Q40543; Match level="QueryCoverage=100%, HitCoverage=60%, E-value=8e-86, Identity=64%"; Hit description =Protein-serine/threonine kinase
  Pfam annotation: Domain name=Pkinase; Domain location=112-245; Score=- 95.3; E_value=0.0069; Accession=PF00069.15; Description=Protein kinase domain
  Pfam annotation: Domain name=Pkinase_Tyr; Domain location=112-245; Score=-97.2; E_value=1.7e-06; Accession=PF07714.7; Description =Protein tyrosine kinase
  Pfam module annotation: Pfam domain module=Pkinase::Pkinase_Tyr; Domain location=112-245::112-245
MVDQADLVIICVSVGVALGVLIAYLIYVGIRCYKKRAHLSRSANEPSLTTIPIRTNGLETSIDFSASLTSSIATSRSPNPHKSSHSTWWSHQNKDGFASVSGILKEIQKATQNFTNTLGEGSFGTVYKAMMPTGEVVAVKMLGPNSKQGEKEFQTEKRSSQRITLIQGYCIDKGQFMLVYEFMSNGSLENLLYGEEKELSWDERLQIAVDISHGIEYLHEGAVPPVVHRDLKSANILLDHSMRAK

SEQ ID NO: 140706 - protein, 105 aa, Glycine max
  Coding DNA Sequence Number=SeqID_23928
  Subcellular localization annotation: CTP_CleavageSite=43; ConfidenceScore=5.24e-01
KLVIMGPKEYLKSTKFVVPRRIPTSTYPKSSSQYCNIAAPVVKSSLGSSSSHEQKISEETPQNSTQKDETQRFADAAKEIAYMMNKDYHGRPSHRPPINNNEPRN

SEQ ID NO: 140707 - protein, 225 aa, Glycine max
  Coding DNA Sequence Number=SeqID_23929
  Gene Ontology: Mol. function=protein serine/threonine kinase activity; Cellular component=membrane; Biological process=protein amino acid phosphorylation
  Homolog annotation: Hit_ID=Q40543; Match level="QueryCoverage=80%, HitCoverage=39%, E-value=1e-59, Identity=63%"; Hit description =Protein-serine/threonine kinase
  Pfam annotation: Domain name=Pkinase; Domain location=4-178; Score= -105.7; E_value=0.029; Accession=PF00069.15; Description=Protein kinase domain
  Pfam annotation: Domain name=Pkinase_Tyr; Domain location=4-178; Score=-170.8; E_value=0.054; Accession=PF07714.7; Description =Protein tyrosine kinase
  Pfam module annotation: Pfam domain module=Pkinase::Pkinase_Tyr; Domain location=4-178::4-178
MQHSKCSIQTRRGSQQTEHNRSHETQQRGAQQTKHNRLRERRVSDFGLSKEEVFDGRNSGLKGTYGYMDPAYISSSKFTVKSDIYSFGIIIFELITAIHPHQNLMEYIHLTDDFFFTSLFFIYCKAAMDYDGVDGILDKQLVGKCNLEEVRQLAKIAHKCLHKSPRKRPSIGEVSQGILRIKQRRLMKEDTMSFASSNFSRSVSQIEEQQVELSKITTMNHREMG

SEQ ID NO: 140708 - protein, 388 aa, Glycine max
  Coding DNA Sequence Number=SeqID_23930
  Gene Ontology: Mol. function=nucleotide binding
  Homolog annotation: Hit_ID=Q93ZR8; Match level="QueryCoverage=98%, HitCoverage=74%, E-value=1e-177, Identity=77%"; Hit description =Putative auxin-independent growth promoter
  Pfam annotation: Domain name=DUF246; Domain location=1-339; Score =680.3; E_value=1.5e-201; Accession=PF03138.5; Description=Plant protein family
MRSAICDMVAIARHLNVTLIVPELDKASFWADLSDFKDIFDVDHFITSLRDEVRIIKQLPPKVKRRVELGLFYSMPPISWSNISYYENQVLPLLLKHKVIHLNRTDARLANNGLPAEIQKLRCRVNFNALRFTTQIEELGRRIVKVLREKGPFLALHLRYEMDMLAFSGCAHGCDIKEEEELTRMRYAYPGWKEKVINSELKRKEGLCPITPEETALVLSALGIDRNVQIYIASGEIYGGEKRMASLLGEFPNLIRKEILLGPSELMYFQNHSSQMAAVDYLVSLESDIFIPTYDGNMAKVVEGHRRFLGFKKTILLDRRLLVHLIDQYYNGLLSWDEFSTAMKEAHAYRMGSPKRRVIIPDKPKEEDYFYANPQECLQLLDEPLEST

SEQ ID NO: 140709 - protein, 674 aa, Glycine max
  Coding DNA Sequence Number=SeqID_23931
  Gene Ontology: Mol. function=nucleic acid binding
  Homolog annotation: Hit_ID=Q9LI68; Match level="QueryCoverage=91%, HitCoverage=99%, E-value=0.0, Identity=59%"; Hit description=Auxin -independent growth promoter protein-like
  Pfam annotation: Domain name=DUF246; Domain location=97-441; Score =207.3; E_value=3.4e-59; Accession=PF03138.5; Description=Plant protein family
MKSKMKWVGLFGLVLSAFSIFIHFLLARFTQMGVADYESSVTIFSWRPIFEKPIPPTNTPSYRKLWGPVKRLESLYPDSNPRGYYADPVSETNGFIFVRIQGGFHEIRNSICDVVVVARLLNATLAMPEIQSTTSSKGISSQFKSFAYLYNEEQFVLSLAKDVTVVRTLPKDLKGARRKKEIPVFKVPYSASPFYYFHHVLPVLKKHSVVELVVSEGGCLKFRQEVQELSAKILQRQEEFHHHLSFKLRAPGRPFIAFDPGMTRESLAYHGCAELFQDVHTELIQHKRSWMIKRGIVKGKLSVNSAEERLKGSCPLMPQEIGILLRAYGYSKDAIIYVSGGEVFGGQRTLIPLHAMFENVIDRTSLSTPWEMIRLYGKEVNLVDTPGPPPFVEEVTKRAAWKNAGPRPRPLPPPPARPKSYNIEGWWGWVAESDNEPDSTVIELRTNAHKLLWEAIDYVICVEADVFIPGFDRDGKGHPNFASLVMGHRLYQSAASKTFRPDRSVLAKDLYDLGCQPNWDARKEVAKLLDEICDHRHHANHTWLETVRRHLTKTLLDGIIEASNKSKPLSFLSHPVPECSCSRRDSFEVSKNSSSPLTSQLWTALSVAHQCPAWMDTGPISQSKDKENEEDVDEDDSVSELFFKQNAENHEGDAEVNIKEENQFEDQEDDGGER

SEQ ID NO: 140710 - protein, 290 aa, Glycine max
  Coding DNA Sequence Number=SeqID_23932
  Gene Ontology: Mol. function=transcription regulator activity; Cellular component=nucleus; Biological process=regulation of transcription, DNA-dependent
  Homolog annotation: Hit_ID=Q9CAA4; Match level="QueryCoverage=75%, HitCoverage=61%, E-value=1e-11, Identity=29%"; Hit description =Putative transcription factor BIM2
MARSAKGHQDEFDDDDEEELLTANNTSSKVKVDEPSTGKRVNPQRSKHSETEQRWHCGNFSDLFVTMRNNHGPAENTTDPSQATQNGSVDEKNNNVSPLLPKNVQNPIESDFSMTTIQKGNIPGSTTEAVPLPMQMRLDMFDPVVSSSMATQHLLEPVSNVNMLSHTQPQLWLDKRNKGNYILPHNDTMKEQEELVNESGSDSISSAYSQGILDSLTQALHSSGVDMSQTNVSVQIDVGRQENAGLIPSASTSKGHENQSVSNPAIARSGVDYCNIDSEQSSKRLRQEAS

SEQ ID NO: 140711 - protein, 2890 aa, Glycine max
  Coding DNA Sequence Number=SeqID_23933
  Gene Ontology: Mol. function=ubiquitin-protein ligase activity; Cellular component=signal recognition particle, endoplasmic reticulum targeting; Biological process=ubiquitin cycle
  Homolog annotation: Hit_ID=Q2HSG3; Match level="QueryCoverage=99%, HitCoverage=57%, E-value=0.0, Identity=84%"; Hit description =Putative zinc finger in N-recognin, putative
  Pfam annotation: Domain name=ZZ; Domain location=397-440; Score=40.5; E_value=5.6e-09; Accession=PF00569.8; Description=Zinc finger, ZZ type
ISVFNSNPDIVMVGFRVHVGNTSASHIPSSISIFQRVVKFDEGMRSWYDIPFTVAESLLADEEFTISVGPTFNGSTLPRIDSLEVYGRAKDEFGWKEKMDAVLDMEARVLGSNSSLSGSAKKRRSMQSAPIQEQVIADGLRLITKFYSSCKQQDISRFEEARTELGKLKCKPILETIFECDREPILQASASRVLQAVFPKKEIYHQVKDTMQLLGVVKSSSLLSSRLGIGGAAGSWIIEEFTIQMHAVCKIALQRRSNLATFLETKGSEVVDVLMQVLWGILDFEQPDTQTMNNIVMSAVELIYCYAECLALHGKDAGVHSVAPAVVLLKKLLFSSNEAVQTASSLAISSRLLQVPFPKQTMLATDDAVESVVSVPGPADPSTGNNQIMIEDDTITSSVQYCCDGCSTVPIQRRRWHCTVCPDFDLCEACYEVPDADRLPPPHSRDHPMTAIPIEVDSVGDGNEFQFTADDVSDQNLLPLPADSNMQNSSPSIHVLEPNDSGDFAASLTDPVSICASKRAINSLLLSELLEQLKGWMDTTSGVQAIPVMQLFYRLSSAVGGPFIDSSKPDSLDLEKLIKWFLDEINLDRPFVGKTRSSFGEVAILVFMFFTLMLRNWHQPGSDGSIPRQSGTTDMHDKNVVQFPPSTSACAKTSVDDQQKIDFASQLLRACDSLRQQSFVNYLMDILQQLVYVFKSPVNNEGVHSNAGPGCGALLAVRRDLPAGNFLPFFSDSYAKVHRKDIFMDYHRLLLENAFRLVYTLVRPEKHDKTGEKEKVYKLSHGKDLKLDGYQDVLCTYINNPHTNFVRRYARRLFLHLCGSKSHYYSVRDSWQFSTEAKRLYKHTNKSGGFQNNPIPYERSVKIVKCLSTMAEVAAARPRNWQKYCLRHGDILSFLMNGIFYFGEESVIQTLKLLNFAFYTGKDVGHTPQKMESGDISSSKSGTISQESKKKKKGEDGGESGSEKSYLDMEAAVDVFTDKSSNILKQLIDGFLLEWNSITVRAEAKLVLFGVWHHAKPTFKETILVALLQKVKFLPMYGQNIVEYTELVTWLLGRSSDTSSKHKISELVGRCLTPDVIKCIFETLHSQNELLANHPNSRIYNTLSGLVEFDGYYLESEPCVACSTPEVPYSRMKLDSLKSETKFTDNRIIVKCTGSYTIQTVTMNVHDARKSKSVKVLNLYYNNRPVTDISELKNNWSLWKRAKSCHLAFNQTELKVEFPIPITACNFMIELDSFYENLQALSLEPLQCPRCSRPVTDKHGLCSNCHENAYQCRQCRNINYENLDSFLCNECGYSKYGRFEFNFMAKPSFTFDNMENDEDMKKGLAAIESESENAHRRYQQLLGFKKHLLKIVSSIGDSEIDSQQKDSVQQMMVSLPGPSCKINKKIALLGVLYGEKCKAAFDSVSKSVQTLQGLRKVLMSYLHQKLSDTSVGSRFVVSRSPNDCYGCATTFVTQCLELLQVLARHPNSKKQLVSAGILSELFENNIHQGAKAARVQARIVLCSLSEGDVNAVTELNGLIQKKVLYCLEHHRSMDIAVTTREELLLLSEVCSLADEFWESRLRVVFQLLFSSIKLGAKHPAISEHVILPCLRIISQACTPPKPETPDKEQSLGKSSTNTKDESNQNVSGSLTGAVTVSGTKTFPDSSERNWDATPKTRDIQLLSYSEWERGASYLDFVRRQYKVSQAVKGTGQRSRPQRHDYLAVKYALRWKRHAGKAAKSDLSVFELGSWVKELVLSACSQSIRSEMCTLITMLCTQSSSRRFRLLNLVLSLLPATLSSGESAAEYFELLFKMVDSEEALLFLTVRGCLRTICTLITQEVSNVESLERSLHIDITQGFILHKLIELLGKFLEVPNIRSRFMRDDLLSEILEALIVIRGLIVQKTKLISDCNRLLKDLLDSLLLESGENKRQFIRACINGLEIHREERKGRACLFILEQLCNVICPSKPEPVYLVVLNKAHTQEEFIRGSMTKNPYSSVEIGPLMRDVKNKICQQLDLLDFLEDDYGMELLVAGNIISLDLSIAQVYEQVWKKSNHSSNVTNSNLLSPNAVNSSRDCPPMTVTYRLQGLDGEATEPMIKELEEDREESQDPEVEFSIAGAVRECGGLEILLRMIQHLRDDFKSNQEQLVAVLNLLMYCCKIRENRRALLKLGALSLLLETARRAFSVDAMEPAEGILLIVESLTLEGNESDNISITQSALTVTSEEAGTGEQAKKIVLMFLERLSHPLGLRKSNKQQRNTEMIARILPYLTYGEPAAMDALVHHFSPYLQDWGTFDHLQKQHLDNPKDDNIAQQAAKQRFTLENFVRLSESLKTSSCGERIKDIILEKGITKTAMTHLKDSFANTGQAGFKNSAEWAQGLTLPSVPLILSMLRGLSMGHLLTQKCIDEEGILPLLHALEGVSGENEIWERAENLLDTLSNKEGKGDGFLEEKVCKLRDATRDEMKRRALRKREELLQGLRMRLEPSSDGGERIVVSQPVLAGLEDVQEEDGLACMVCQEGYSLRPADLLGAYSYSKRVNLGVGSSGSARGGECVYTTCHQEAKRTDAALKNPKKEWDGATRRNNECLCNSLFPVRGPSVPLAQYVRYVDQYWDNLNALGRADGSRLRLLTYDIVLMLARFATGASFSADCRGGGRESNSRFLPFMIQMACHLLDQGNPSQCRTMARAVSAYISSSSSDLRPSSPSGTQPMPGTEETVQFMMVNSFLSESYGSWLQHRCAFLQRGFYHAYMQHTHSRSATRAPSVTAPAQGVESGSMDQTATTETGQSDLLSIIRPMLVYTGLIEQLQRFFKVKKSTSATPPARTEGASSTIEGEDESGILEGWEVVMKERLLNVKELLEFPKEMLSWLDEINSATDLQEAFDIVGVLAEVLSGGFTRCEDFVQAAINAGKS

SEQ ID NO: 140712 - protein, 550 aa, Glycine max
  Coding DNA Sequence Number=SeqID_23934
  Gene Ontology: Mol. function=metal ion binding; Cellular component =intracellular; Biological process=metabolic process
  Homolog annotation: Hit_ID=Q2HSF0; Match level="QueryCoverage=95%, HitCoverage=80%, E-value=0.0, Identity=78%"; Hit description =Tetratricopeptide-like helical
  Pfam annotation: Domain name=PPR; Domain location=172-206; Score =20.8; E_value=0.0049; Accession=PF01535.11; Description=PPR repeat
  Pfam annotation: Domain name=PPR; Domain location=275-309; Score =34.8; E_value=3.1e-07; Accession=PF01535.11; Description=PPR repeat
  Pfam annotation: Domain name=PPR; Domain location=310-344; Score =11.0; E_value=0.37; Accession=PF01535.11; Description=PPR repeat
  Pfam annotation: Domain name=PPR; Domain location=346-379; Score =15.1; E_value=0.12; Accession=PF01535.11; Description=PPR repeat
  Pfam annotation: Domain name=PPR; Domain location=412-446; Score=4.2; E_value=2.4; Accession=PF01535.11; Description=PPR repeat
  Pfam annotation: Domain name=PPR; Domain location=67-101; Score=16.6; E_value=0.08; Accession=PF01535.11; Description=PPR repeat
  Pfam module annotation: Pfam domain module=PPR::PPR::PPR::PPR::PPR::PP R; Domain location=172-206::275-309::310-344::346-379::412-446::67-101
MESFMMLGRGMIENSLSDGLDVHRRLVSSGFDQDPFLATKLINMYYELGSIDRARKVFDETRERTIYVWNALFRALAMVGCGKELLDLYVQMNWIGIPSDRFTYTFVLKACVVSELSVSPLQKGKEIHAHILRHGYEANIHVMTTLLDVYAKFGSVSYANSVFCAMPTKNFVSWSAMIACFAKNEMPMKALELFQLMMLEAHDSVPNSVTMVNVLQACAGLAALEQGKLIHGYILRRGLDSILPVLNALITMYGRCGEILMGQRVFDNMKNRDVVSWNSLISIYGMHGFGKKAIQIFENMIHQGSSPSYISFITVLGACSHAGLVEEGKILFESMLSKYRIHPGMEHYACMVDLLGRANRLDEAIKLIEDMHFEPGPTVWGSLLGSCRIHCNVELAERASTLLFELEPRNAGNYVLLADIYAEAKMWSEAKSVMKLLEARGLQKLPGCSWIEVKRKVYSFVSVDEHNPQIEEIHALLVKLSNEMKAQGYVPQTNVVLYDLDEEEKERIVLGHSEKLAVAFGLINTEFTDPCLSGTGALTRSILGYSNSWI

SEQ ID NO: 140713 - protein, 82 aa, Glycine max
  Coding DNA Sequence Number=SeqID_23935
MSVAPHFPANVILIASSMSMLCEETEYGSFGTCIAFAAVLPAKAKEYQYYPTRYCYIPTWVAHVPPAYHVNPCKPDIYLSSS

SEQ ID NO: 140714 - protein, 174 aa, Glycine max
  Coding DNA Sequence Number=SeqID_23936
FASTTASPAVAKTERERAARPTEVLKAFEAYTSLLHDKKARPARLLLDPGMAPGEGAAMPRSSAAAGPRTMQKNRGRGLALEPWAGRPGLSLLFCSRHEKDAQKRYAQRAEDPLRVSVVSRSGANFSYLLSDLERYYESSVPDSIAAAIWFTGTTKKSHAYVTTVTDGLIILDP

SEQ ID NO: 140715 - protein, 351 aa, Glycine max
  Coding DNA Sequence Number=SeqID_23937
  Homolog annotation: Hit_ID=Q1RW53; Match level="QueryCoverage=81%, HitCoverage=73%, E-value=3e-35, Identity=34%"; Hit description =Cyclin-like F-box; F-box protein interaction domain
  Pfam annotation: Domain name=FBA_1; Domain location=186-336; Score= -39.1; E_value=0.0052; Accession=PF07734.3; Description=F-box associated
MAQDKKERKRSMKKKQNQSLTTLPQELIREILLRYRSHDFYAQSIATESVFKTCSRDVVYFPLPLPSIPCLRLDDFGIRPKILGSCRGLVLLYYDDSANLILWNPSLGRHKRLPNYRDDITSFPYGFGYDESKDEYLLILIGLPKFGPETGADIYSFKTESWKTDTIVYDPLVRYKAEDRIARAGSLLNGALHWFVFSESKEDHVIIAFDLVERTLSEIPLPLADRSTVQKDAVYGLRIMGGCLSVCCSSCGMTEIWVMKEYKVRSSWTMTFLIHTSNRISPICTIKDGEILGSNCAGTGRLEKRNDKGELLEHFMDTKGQRFSCANLQAAMYTESLLPLPTSFWETSEED

SEQ ID NO: 140716 - protein, 168 aa, Glycine max
  Coding DNA Sequence Number=SeqID_23938
MFKYQDIRKTKSGVEHGHSPSRVDNRNSPQIVVHLILPSTSTPYRDQYDDDYRDKLEILGSCRGLILLYYDRSSDLMSTMMDHISAMYKRLDDKFGADSLFNEVLQVIAILVFDLIKRSFREIPLFDHFTMEKYEVCSLRVMGECLSVCCSVQDGATDEIWVMKEYKM

SEQ ID NO: 140717 - protein, 2061 aa, Glycine max
  Coding DNA Sequence Number=SeqID_23939
  Gene Ontology: Mol. function=ubiquitin-protein ligase activity; Biological process=ubiquitin cycle
  Homolog annotation: Hit_ID=Q2HSG3; Match level="QueryCoverage=99%, HitCoverage=40%, E-value=0.0, Identity=77%"; Hit description =Putative zinc finger in N-recognin, putative
  Pfam annotation: Domain name=zf-UBR; Domain location=1443-1513; Score= 52.5; E_value=1.4e-12; Accession=PF02207.10; Description=Putative zinc finger in N-recognin (U
MALVDGINMVADMLQPTIASALVDMLPMVDDCCGSFVDDYKKCHLEGFKCSKEEKSMDWLLKTLASERVPHDRQESGFIEQTYYQYFNNFVFLSQHWAVVHGKCTPRLILLCNKLAKVKNVFDEKAMSQNFRRRLSFILRMLKILGSLLKDVPYVEYDASLMGAVATFSNTLFSLFRINFEYVNTFSVTEGSFESIILMVIEEFLHSVQVIFGNSNVSKNIQTCIIAAILESLDSSVWTYDKFAPNLKPPLAYFPRFIVYTLKLITDLKRQRHLVPFEWKDFDVELVGSSTDSQIGSPSCLVHLEPVPLLKGFTLEELLKLMFPVSSQWIANLMQLALFLHCEGLKLRPKMERSHSSLAKVAGTSEVENAVCHEDEALFGDLFSETGRSVGSTDGCEQAPVAALISSSSYQNMPTQAAIELLNFLKTCIFSAEWHPSLYVDACNKLSSRDIDILLSLLNCQGCCSEDNISDSCTPLLVDGKIGHIHDLCFDILHNLLTSHALNDSLEDYLVDKILTVENGSFSYNDRTLTLLAHTLFCRVGSSGSQLRTKICRVYVAFVVEKAKTVCINCPSINDLVGTLPSLFHIEVVLMAFHLSSEGEKAVMAKLIFSTLKEVASLILDLNSTHLTCWALVVSRLILILRHMIFHQQTCPTSLLIDVRSKLREAPLSGSSMPNKVNDHMPSWSSTAFKNIAGGLIGEEAFVSSLIGHLVDISGSSASLVREDLAIDSLTLNWGEIYCTFSLILGFWSGKMATAVEDLIVERYVFSLCWDIPYVGSEADHTIKSWDQDHPMDPSNMLHFFHFSHLLHGHPEGIGKFTISPDAILSLLQHLNDALPIPKGIEQLGWYFLRSGMWLSLVISFINVGIWRYCMDNAISGHGLTWTGNALGDDKYVKVAGSMISSMIESGQFALLVKLFSSLLNKHLQVCQNAFLDILNDKQKLAPGFSPFLLLKHTEMDQSLQDELLERSGSNAGELQSVLSLILRLDVVVDKKASGILSRASWECLLHGFPFNLCTPSSTMFSCVLSIRGIIFVLDGLLRVKEGGSISNLEDEILGQVLDAVMIIKYDRTFESVHGKCNTIYHSLSAELDFSCYEDLILMKQMEGFLKDVNAGGASDCSVREWIICKIIEILNSLRKDPSKSVIFHFYLGAENVPEKMNRLLHLHLGDCLVLIDALDSCFSESVNVKVLGFFVDLLSGEQFPDLRMRIQRKFLDRDIHCVSKWLEKRLLGSIMKSDCGVDCAKGSSISLRESTMNFILCLVSPPSEQQSKELQQHIFNSALGSLDSAFLLFDIHVAKSFFNFIVQISRGEFLMKQVLTRTAMLMEKLVANENLLPGLKFLFAFIETVLSDCGSSKISLQKTTKKSSGNSLGVGHSSAQLVGSRKNSETFILSANQEGGSTSLECDATSMDEDEDEDDATSDGEVLSIDKDDEDDANSERVLASKVCTFTSSGSNFMEQHWYFCYTCDLTVSKGCCSVCAKVCHRGHRVVYSRSSRFFCDCGAGGVRGSNCQCLKPRKFTGDSSAPVRGSNTFQSFLSFPEDGDQLPDSDSDFEEEISSDADNSLRLCIPKELQERIPLLLEELDIESRVLNLCSSLLPFILSRRDSHHSKDKKISLGEDKVISHGIDLLQLKKTYKSGSFDLKIKVDYSNAKELKSHLANGSLVKSLLSVSGRGRLAVGEGDKVAIYDVEQLIGQATIAPVTADKTNVKPLSKNIVRFEIVQLAFNPFVENYLLVAGYEDCQVLTLNPRGEVIDRLAIELALQGAYIRRVDWVPSSQVQLMVVTNRFVRIYDLSLDNISPMQYFTLQDDMIVDAVLCPASQGRMFLLVLSENGNIFRFELSVKGNVGAVPLKELVHLQGKEIHAKGSSLYFSSTCKLLFVSFQDGTTVVGRPSPDAASLVEMSFVYEEQESKLQPAGVHHWKELLAGSGLFVCLSTMKSNSALTVSMGEYEIIAQCMRHSVGSTSPIVGMIACKPLSKDKIHCLVLHDDGSLQIYSHAPAGVDSGVIAASEKVKKLGSGILNKAYAGTNPEFPLDFFEKTVCITQDLKLGGDAVRNGDSERS

SEQ ID NO: 140718 - protein, 311 aa, Glycine max
  Coding DNA Sequence Number=SeqID_23940
  Gene Ontology: Mol. function=hydrolase activity; Cellular component =spindle pole body; Biological process=ER to Golgi vesicle-mediated transport
  Homolog annotation: Hit_ID=Q2HSF1; Match level="QueryCoverage=83%, HitCoverage=58%, E-value=1e-106, Identity=73%"; Hit description=WD40- like
  Pfam annotation: Domain name=WD40; Domain location=110-148; Score =43.6; E_value=6.7e-10; Accession=PF00400.22; Description=WD domain, G-beta repeat
  Pfam annotation: Domain name=WD40; Domain location=163-203; Score =23.7; E_value=0.00068; Accession=PF00400.22; Description=WD domain, G-beta repeat
  Pfam annotation: Domain name=WD40; Domain location=207-244; Score =10.1; E_value=2.4; Accession=PF00400.22; Description=WD domain, G -beta repeat
  Pfam annotation: Domain name=WD40; Domain location=68-106; Score=3.3; E_value=15; Accession=PF00400.22; Description=WD domain, G-beta repeat
  Pfam module annotation: Pfam domain module=WD40::WD40::WD40::WD40; Domain location=110-148::163-203::207-244::68-106
MEVVLASSSVDGGIGCWDLHTGAEQLRYKSCTSPSHGLVSVAARFIASSQLREDQSAPGSVLFWSWSKPQVEVKSFPAEQIKPLATNHPGTFIAAGAPSGDIYLWEVETGRLLKKWHAHFRAVSCLVFSEDDSLLVSGSEDGSVRVWSLFMIFDDLRNQQASSLYEYSFSEHTLTVTDVVIGNGGCNAIIVSASKDRTCKVWSLSRGMLLRNIVFPSIINCIALDPAEHVFYAGSEDGKIFIAALNTESIATNNYGMHIISSFSNHSSSSRLLARVVNINHAQYRRQDILWLLVIPLKPVVSQLAAAPEVA

SEQ ID NO: 140719 - protein, 398 aa, Glycine max
  Coding DNA Sequence Number=SeqID_23941
  Homolog annotation: Hit_ID=Q1RW53; Match level="QueryCoverage=92%, HitCoverage=92%, E-value=2e-49, Identity=37%"; Hit description =Cyclin-like F-box; F-box protein interaction domain
  Pfam annotation: Domain name=F-box; Domain location=3-50; Score=37.3; E_value=5.3e-08; Accession=PF00646.23; Description=F-box domain
  Pfam annotation: Domain name=FBA_1; Domain location=226-385; Score= -47.2; E_value=0.026; Accession=PF07734.3; Description=F-box associated
  Pfam module annotation: Pfam domain module=F-box::FBA_1; Domain location=3-50::226-385
MKNDTQTLPLELIIEILMRLPVRSVLGFKCVCKSWFSLISDPQFGISHFDLAASPTHRLLQRCNHFYAESIDTEAPLKKYSSAVHFLLPPPSPPHHGEYDNYADYQDKHEILGSCRGLVLLYYKRYCDLILWNPSIGAHKRSPNFAYDITFQFLYGFGYDPSTDEYLLMMIGLYESGNYKYDNGNESEDHECKGNYQIFSFKTDSWYIDDVFVPYKDLGDKFRAGSLFDETLHWLVFSEDKKIPVILAFDLILRSFSEIPLFDHFTMEKYEIYSLRVMGGCLCVCCLVQGYENAEIWVMKEYKVQSSWTKSIVIPTSGFSPLRITKDGGILGSNTCGRLEKLNYKGELHEHLNYGGGQWLYSANLQSAVYRESLLSLPSVVRVPSKDDHGKTSEDDQQ

SEQ ID NO: 140720 - protein, 100 aa, Glycine max
  Coding DNA Sequence Number=SeqID_23942
MGYGHGGFSLLSKIIHVFLTQKPQSSKGGHGQQHGIMAVRLVNGYWYMQTTLNSGKSRLRDGIIGSIEHITCNFLKICYGQYGVSSIYGYWCCLRLTGSL

SEQ ID NO: 140721 - protein, 203 aa, Glycine max
  Coding DNA Sequence Number=SeqID_23943
  Gene Ontology: Mol. function=zinc ion binding; Biological process =ubiquitin cycle
  Homolog annotation: Hit_ID=Q1SR15; Match level="QueryCoverage=58%, HitCoverage=53%, E-value=6e-50, Identity=81%"; Hit description=Zinc finger, RING-type; RINGv
MTSTASLDNSLSDMYRSPPRPLPYDADRFFRSQRDGLVSRREKGSSHLNEESEPLRGDVDADSESLNSAGKWNDTSEDGSKEYRSKSTVRLSSAKLTTGAGVVYSSSEEEDVCPTCLEEFELVTSTTLCHKEAIYVINSGCPGCYRSSVEWPFPATSTTVAEQIKGATLFSAISVERDDNITVSVVDPLKLNANSKNALKFHH

SEQ ID NO: 140722 - protein, 770 aa, Glycine max
  Coding DNA Sequence Number=SeqID_23944
  Homolog annotation: Hit_ID=Q9FMB4; Match level="QueryCoverage=99%, HitCoverage=99%, E-value=0.0, Identity=67%"; Hit description =Arabidopsis thaliana genomic DNA, chromosome 5, TAC clone:K15E6
MQSAASSSPSPEAILEWLHKEMGYRPLGTYASGKSHLPSVDSIRRICRGNMIPVLNFLVTRAKSEKTVRNIRRNITVHGGADGGGEAKEEGRGKGARKKERALAGGGEGSETATTREAALQERDLAAKEVDRLRKVVRRQKKDLRARMLEVSREEAERKRMLDERANYRHKQVMLEAYDRQCDEAAKIFAEYHKRLCYYVNQAMDSQRSGVDSSVEMAKSEKEAVYSTVKGSKSADDVILIETTRENNIRKACESLVDHMMEKIRSSFPAYEGSGIHLNPQAETAKLGFDFDGQIPDEAITAYTLRLKSLISREIEKIDVRADAETLRYKYENNIVMDVSSSDGSSPLQYQLYGNGKIGVDVPPGGSQNQLLDRQKAHVQQFLATEDALNKAAEARDMCEKLMKRLHGGTDVSSRSLGIGSNSQNVGSLRQLELDVWAKEREVAGLKASLNTLMSEIQRLNKLCAERKEAEDSLKKKWKKIEEFDARRSELETIYMALLKANMDAASFWSQQPLTAREYALSTIIPACAAVAKASNNAKDLIEKEVSTFYRSPDNSLYMLPSSPQALLEAMGASGPPGQEAVANAEISAAMLTARAGARDPSAIPSICRVSAALHYPAGLEGSDAGLASVLESLEFCLKLRGSEASVLEDLLRAINLVYIRRDLVQSGEALLNHANLVQQEYEKTTKFCLSKAEEQEKTIMEEWLPELKNAVLSAQQSLEDCKYVRGLLDEWWEQPASTVVDWVTVDGQNVTAWHNHVKQLLAFCDKELL

SEQ ID NO: 140723 - protein, 402 aa, Glycine max
  Coding DNA Sequence Number=SeqID_23945
  Gene Ontology: Mol. function=transferase activity, transferring glycosyl groups; Cellular component=integral to membrane; Biological process=metabolic process
  Homolog annotation: Hit_ID=Q8S995; Match level="QueryCoverage=91%, HitCoverage=77%, E-value=1e-102, Identity=50%"; Hit description =Glucosyltransferase-14
  Pfam annotation: Domain name=UDPGT; Domain location=1-397; Score= -134.3; E_value=0.00074; Accession=PF00201.9; Description=UDP -glucoronosyl and UDP-glucosyl transferase
MDLLNNFNMALDLLQQPLEELLEKQRPYPSCIIADKYIMCVTDVANKLNVPRIIFDGTNCFFLLCNHNLQKDKVYEAVSGEEKFLVPGMPHRIELRRSQLPGLFNPGADLKLNAYREKVMEAAEKAHGIVVNSFEELEAEYVEECQRFTDHRVWCVGPVSLSNKDDKDKAMRSKRNSSDLESEYVKWLDSWPPRSVIYVCLGSLNRATPEQLIELGLGLEATKRPFIWVLRGAYGREEMEKWLLEDGFEERVKGRGLLIKGWVPQVLILSHRAIGAFMTHCGWNSTLEGICAGVPLVTFPLFAEQFINEKLVQVVKIGVSVGAESVVHLGEEDKSRVQVTRENVLDSIEKVMGDGQEKEEIRERARKYADMARKAIEQGGSSYLNMSLLIDHIIHLKGLDQS

SEQ ID NO: 140724 - protein, 337 aa, Glycine max
  Coding DNA Sequence Number=SeqID_23946
  Homolog annotation: Hit_ID=Q2HSE9; Match level="QueryCoverage=48%, HitCoverage=36%, E-value=7e-68, Identity=78%"; Hit description =Pollen Ole e 1 allergen and extensin
  Pfam annotation: Domain name=DUF1210; Domain location=32-264; Score= -52.8; E_value=0.049; Accession=PF06735.2; Description=Protein of unknown function (DUF1210)
  Pfam annotation: Domain name=Pollen_Ole_e_I; Domain location=32-156; Score=37.6; E_value=4.4e-08; Accession=PF01190.8; Description=Pollen proteins Ole e I family
  Pfam module annotation: Pfam domain module=DUF1210::Pollen_Ole_e_I; Domain location=32-264::32-156
MSWFLVILFLSLTFGITHSEASHDKKLPSAVVVGTVYCDTCFQQDLSTGNHFISGASVAVECKDGYGRSKPRFRKEVKTDEHGEFKVQLPFSVSKHVKRIKGCTVKLINSSEPYCAVASAATSSSLCLKSRKEGLHIFSAGFFSFKPLRQPVLCNQKPSIQNIKGPDYVKHIFPPKIDPSFPPPLQNPKTPGGLLPPIPGLPDLPPLLPPLSGILSPLVPAGIPNESPNVQPSDQKLLDPNNLIFPPNPFQPPPSVPNPLQQPPLIPNPLEPSGPSSLVPNPLQPPSTGTSPPLFPFPTVPGLTPPPPALPFPFPPLFPPPSGPGTPSVSSSKNASP

SEQ ID NO: 140725 - protein, 510 aa, Glycine max
  Coding DNA Sequence Number=SeqID_23947
  Gene Ontology: Mol. function=ubiquitin-protein ligase activity; Cellular component=intracellular; Biological process=protein modification process
  Homolog annotation: Hit_ID=Q1SAA9; Match level="QueryCoverage=73%, HitCoverage=100%, E-value=1e-128, Identity=49%"; Hit description =Regulator of chromosome condensation/beta-lactamase-inhibitor protein II
  Pfam annotation: Domain name=RCC1; Domain location=183-241; Score =27.9; E_value=3.5e-05; Accession=PF00415.9; Description=Regulator of chromosome condensation (RCC1)
  Pfam annotation: Domain name=RCC1; Domain location=20-75; Score=11.0; E_value=0.045; Accession=PF00415.9; Description=Regulator of chromosome condensation (RCC1)
  Pfam annotation: Domain name=RCC1; Domain location=244-296; Score =18.3; E_value=0.0074; Accession=PF00415.9; Description=Regulator of chromosome condensation (RCC1)
  Pfam annotation: Domain name=RCC1; Domain location=299-358; Score =10.8; E_value=0.048; Accession=PF00415.9; Description=Regulator of chromosome condensation (RCC1)
  Pfam annotation: Domain name=RCC1; Domain location=361-409; Score =0.5; E_value=0.62; Accession=PF00415.9; Description=Regulator of chromosome condensation (RCC1)
  Pfam annotation: Domain name=RCC1; Domain location=78-127; Score =43.1; E_value=9.2e-10; Accession=PF00415.9; Description=Regulator of chromosome condensation (RCC1)
  Pfam module annotation: Pfam domain module=RCC1::RCC1::RCC1::RCC1::RCC 1::RCC1; Domain location=183-241::20-75::244-296::299-358::361 -409::78-127
MDIDAIFGTIRPVSVPRKSAIYVWGYNQSGQTGRKGKEDQLRIPKQLPPELFGCPAGTNARWLDVACGREHTAAIASDGSLFTWGANDFGQLGDGTEERRKLPEKVKQLESEFVKSVSCGAHCSACIAEPHENDGTISTRRLWVWGQNQGSNLPRLFWGAFKPNTIIREVSCGAVHVVALSEEGLLQAWGYNEYGQLGRGVTCEGLQGACIISSYAKFLDEAPELVKIAKVSCGEYHTAVISDKGEVYTWGLGNMGQLGHSSLQYGDKELLPRRVVTLDGIFIKDVACGGVHTCSVTQGGALYAWGGGRSGQLGLGPQTGLFSCVANDSQTFFRNIPVLVVPKGVQLVACGYSHTLISMSDGRIHGWGYNNYGQAANEKCTYAWYPSPIDWCVGEVRKLAAGGGHSAVLTDAYSLKELCEFVLADSMTLSNAAKVEDIAYRTGSDALARLCGRLREKQEKYLRVREGTSLCGDGGGGSCGEDKLSVDESKPRVSGPLCGPSVTVFAFSFI

SEQ ID NO: 140726 - protein, 206 aa, Glycine max
  Coding DNA Sequence Number=SeqID_23948
  Gene Ontology: Mol. function=GTP binding; Cellular component=signal recognition particle, endoplasmic reticulum targeting; Biological process=SRP-dependent cotranslational protein targeting to membrane
  Homolog annotation: Hit_ID=Q5JK63; Match level="QueryCoverage=66%, HitCoverage=39%, E-value=5e-52, Identity=72%"; Hit description=Group II intron splicing factor CRS1-like
  Pfam annotation: Domain name=CRS1_YhbY; Domain location=102-186; Score=121.6; E_value=2.3e-33; Accession=PF01985.11; Description=CRS1 YhbY domain
MCVCSPLGQLVPVGEQGYGWGLRNLSYARVNLVITGGGRASKEGQVDDKEEVEDAEEEGEGEEESGQQEGPPPTRCQGEEEEAEICQCRRENQGPVVKPDELTGEERFYLKKMGQKRSNYLQIGRRGLFGGVVLNMHMHWKKHETVKVFCKPCKPGQVHEYAQELARLSGGIPLQIIGDDTIIFYRRKNYEQPEVMSPIDTLSKKK

SEQ ID NO: 140727 - protein, 355 aa, Glycine max
  Coding DNA Sequence Number=SeqID_23949
  Homolog annotation: Hit_ID=Q1SB55; Match level="QueryCoverage=50%, HitCoverage=75%, E-value=3e-24, Identity=35%"; Hit description=FAR1; tRNA-binding arm
  Pfam annotation: Domain name=FAR1; Domain location=179-339; Score =107.7; E_value=3.3e-29; Accession=PF03101.5; Description=FAR1 family
MRDNLGETENEVEYENLRAKEALLMLRNNEVALVEEQVFLFCVVVFFVLYCVGGVVVQDFKGYGANNSKLKLDVVVGVIVLHSPVFALFTFQMEVEIDGSVTVETVGNTAIGEVSSIADDNREGGSSVEPNDNQDQHDNGTQDSSGGITIPSAIPTVSVVSVEEPYVGQEFGSEAAAHAFYNAYATEVGFIVRVSKLSRSRRDGTAIGRTLVCNKEGFRMADKREKIVRQRAETRVGCRAMIMVRKLSSGKWVVAKFVKEHTHPLTPGKGRRDFYYEQYPTEQDKIRELSQQLATEKKRSAAYKRHLELIFEQIEEQNDNLSKKIQHIVDCVKEMEAKEEHSRQCEGDGSQRTTE

SEQ ID NO: 140728 - protein, 196 aa, Glycine max
  Coding DNA Sequence Number=SeqID_23950
MTKFDPDIVLEFYANAWPTEEGVRDMRSWVRGQWIPFDVDAISQFLGYPLVLEEGQECEYGQRRNRSDGFDEEAIAHLLCIPGQDFSWTAAGRRVRIMGTNMTTLTQIWMTLLLNNIQPSDHNSDLPLPKCQLVYAILTRMSIHVAQLIADAIYLFAGMAPTRHPLDPDKSNRALGFPALITGLCQSFGVPVTPSK

SEQ ID NO: 140729 - protein, 68 aa, Glycine max
  Coding DNA Sequence Number=SeqID_23951
MFSTGFFAVGENAYSFGSSCFYTLFFDNDNILHLLYDGPEVSAFTGHIHGWHLGKLIRRQCMLDGVVK

SEQ ID NO: 140730 - protein, 86 aa, Glycine max
  Coding DNA Sequence Number=SeqID_23952
MKVKHKRYATNTLDSSLHAMWYHFLVKNLVKRLGVHDRTCLTMGRPVTVTLFCENAPTMWDRHRLKEALKPDDPQGLHSEEFVRVM

SEQ ID NO: 140731 - protein, 84 aa, Glycine max
  Coding DNA Sequence Number=SeqID_23953
MDQLVDIQTKALSPSFLSFWTKWLKGILPSPHELLEEKQASLRWLYFWQIACTQTRRVAAMSVAARVSEEMGVKLGHEVGFLRY

SEQ ID NO: 140732 - protein, 147 aa, Glycine max
  Coding DNA Sequence Number=SeqID_23954
  Gene Ontology: Mol. function=ATP-dependent helicase activity; Cellular component=nucleus; Biological process=RNA-mediated posttranscriptional gene silencing
  Homolog annotation: Hit_ID=Q8VY00; Match level="QueryCoverage=99%, HitCoverage=14%, E-value=2e-60, Identity=74%"; Hit description =Putative RNA helicase
  Pfam annotation: Domain name=HA2; Domain location=1-69; Score=14.6; E_ value=0.012; Accession=PF04408.13; Description=Helicase associated domain (HA2)
MAKFPLDPMLSKMIVASENYKCSDDIISIAAMISVGNSIFYCPKDKQVHADNARLNFHTGNVGDHMACLKVYNSWKETNYSTQWCYENYIQVRSVKRARDIRDQLAGLLERVEIKLTSNDNDLDAIKKSITSGFFPHFARLQKNGSY

SEQ ID NO: 140733 - protein, 329 aa, Glycine max
  Coding DNA Sequence Number=SeqID_23955
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=58%, HitCoverage=13%, E-value=1e-104, Identity=98%"; Hit description=DNA -directed RNA polymerase beta'' chain
  Pfam annotation: Domain name=RNA_pol_Rpb1_2; Domain location=1-64; Score=-13.3; E_value=8.4e-07; Accession=PF00623.11; Description=RNA polymerase Rpb1, domain 2
  Pfam annotation: Domain name=RNA_pol_Rpb1_3; Domain location=67-177; Score=6.7; E_value=4.9e-06; Accession=PF04983.8; Description=RNA polymerase Rpb1, domain 3
  Pfam annotation: Domain name=RNA_pol_Rpb1_4; Domain location=206-285; Score=83.6; E_value=6.1e-22; Accession=PF05000.7; Description=RNA polymerase Rpb1, domain 4
  Pfam module annotation: Pfam domain module=RNA_pol_Rpb1_2::RNA_pol _Rpb1_3::RNA_pol_Rpb1_4; Domain location=1-64::67-177::206-285
IAKSKIREKEPIVWEILQEVMQGHPVLLNRAPTLHRLDFDGDQMAVHVPLSLEAQAEARLLMFSHTNLLSPAIGDPISVPTQDMLIGLYILTSGNRRGLHGLNENHSFPISTQIKIKKRQFPIIDSNPLLNRIPLSGIWRLIDHFGMAYTSHILDQVKTLGFRQATDTSISLGIDDLLTIPSKGWLVQDAEQQSFILEQHHHYGNVHAVEKLRQSIEIWYATSEYFRQEMNPNFRMTDPFNPVHIMSFSGARGNASQVHQLVGMRGLMSDPQGQMIDLPIQSNLREGLSLTEYIISCYGARTGVVDTAVRTSDAGYLTRRLVEVVQHIV

SEQ ID NO: 140734 - protein, 134 aa, Glycine max
  Coding DNA Sequence Number=SeqID_23956
MHTTLRANAPLSYPHLATLFLHHFNVLLDDEPYVKVKRSFSIGAGVVTSFGYRKDVDGQWVSKQDLPPPIPDERTPSPPPQRDASSSLLTEVLTELHDLRAFVDERFDAMDTRITRLEDDIRFIRRCFDPPGDS

SEQ ID NO: 140735 - protein, 91 aa, Glycine max
  Coding DNA Sequence Number=SeqID_23957
MALLEGGKSTKIQVPFLSNVLYSAFITISQVGFERAKLVVLGSREGSEVALSCVGALSGVDDSGSVGQNDGLGSLLGVRTIRVKVMLGGYG

SEQ ID NO: 140736 - protein, 155 aa, Glycine max
  Coding DNA Sequence Number=SeqID_23958
  Subcellular localization annotation: CTP_CleavageSite=15; ConfidenceScore=5.36e-01
MNSPPSSQSPHSSLVASSSSSSLETFLHSISLKLLSKNYILCCVANFMIYEVETLLLEHESCIDRSKKRSLVSINLTEGNFRANDSSQPLNSKLLGQVYLTSQNAIDYKAGRGGHGFGRHKCGGRSFGCGSGGRGWFADVQCQLCHKWGHEVFFC

SEQ ID NO: 140737 - protein, 212 aa, Glycine max
  Coding DNA Sequence Number=SeqID_23959
MSTEKEKSFWDLKATTSFIIACLEQVVKGEQLGTSFTKKGLLGKETGLRWDNVKNIVDAIDEWWKRKQLESLRFVFSFEWAPLFGMLPPHFGVDMNDGYCPSQKGVGIDIEEGSGDSEDASIGKKKLIALSQVAEVVSVIAKTCKSHTKDVASAFINEVVKELKVMPEVANDVDFHTNYFKFMLIKTTREMFIALQGEDVKRLHWLKYAGKT

SEQ ID NO: 140738 - protein, 60 aa, Glycine max
  Coding DNA Sequence Number=SeqID_23960
MTTIMLVVVTIDDHGGGCGCGHDNRGGNGCHKLILRYLIFYLISGGGGNNDNNHVDGGGG

SEQ ID NO: 140739 - protein, 42 aa, Glycine max
  Coding DNA Sequence Number=SeqID_23961
MTTTIMLMVAAVDDHGGGCGDDHDNCGGNGHVSDGGYDFIVK

SEQ ID NO: 140740 - protein, 66 aa, Glycine max
  Coding DNA Sequence Number=SeqID_23962
MEKLQPISVANRSENCNNVAVTERGKSSTPTAITNLECWFELTHKGMPPMDKPTQQEKFEETNLHK

SEQ ID NO: 140741 - protein, 142 aa, Glycine max
  Coding DNA Sequence Number=SeqID_23963
MKESPETRKSLANALSSKYIQRLKNIMHGAGPIWLFHGNLEQGVSSTAGSEGEDSHSYASLELGEQGGWPEESFGDLRNILVKGVGEEVNVVKCSTNLGSNREQKHVNGQKAFNVVSIGDIEQCNKVEEGVYVQEVGEKACL

SEQ ID NO: 140742 - protein, 100 aa, Glycine max
  Coding DNA Sequence Number=SeqID_23964
  Gene Ontology: Mol. function=transition metal ion binding
MQNSGVILRAESQHFASVHDDNPCVASIPYFGNTGVRTDDVGFMLVDLQKLAYHNDPFIMAEQAKHVFYVQDPCDERWSVVLHGKTGVNVEEDDSYIDTY

SEQ ID NO: 140743 - protein, 91 aa, Glycine max
  Coding DNA Sequence Number=SeqID_23965
MAWAHWKKSSRELTKTSANEELIGVAVRGSFIVGAGTIGVDEDVVASNAGWNKLAREDLRRRSPEKNMTLHAWNYHACHHLGMSVVYVNLA

SEQ ID NO: 140744 - protein, 214 aa, Glycine max
  Coding DNA Sequence Number=SeqID_23966
MAPGHLPFFFMYRCLFEVLGVILPLTTFQCALLEHLNVAHSQLHLKQLGNWARSLGSYSIGSLILPGRQRNFGAAAGLTGQMNHFVSSFDERSSRYLGWSHLTGEVGLVVVVAEVTPNIPSSVLAKRKRDDVVGLSSRKKLKAPMSLCVLSQDARLMPTAGCLPTVPDMPPAPPTVEASTAATSTSATPALSPPPIVAIQKVTPTAIEVVVPTT

SEQ ID NO: 140745 - protein, 109 aa, Glycine max
  Coding DNA Sequence Number=SeqID_23967
IAPVRHPVDPEKSNRVLRFPALITGICQFYGVHVAPNKVIRPPTNRAFIKKYFAPRQVHGETPQQPRDGRQQATDAPSPPPEPLSSSTKAGALPMTHGRPAGDQVQSQR

SEQ ID NO: 140746 - protein, 57 aa, Glycine max
  Coding DNA Sequence Number=SeqID_23968
MDSVEGCSKEFEGIGFEARVHAEEVLDVSSNTTSSTFSAKTSHSGHSSKGPKIGKKF

SEQ ID NO: 140747 - protein, 77 aa, Glycine max
  Coding DNA Sequence Number=SeqID_23969
METSGGPISFARIRERLVFPFLMFIQVRRIENPRLKLKCLLKLDKGKLQELIENSGQSSSFEAFQTMYGKEKPGRIR

SEQ ID NO: 140748 - protein, 158 aa, Glycine max
  Coding DNA Sequence Number=SeqID_23970
  Gene Ontology: Mol. function=beta-N-acetylhexosaminidase activity; Cellular component=membrane; Biological process=carbohydrate metabolic process
  Homolog annotation: Hit_ID=Q8D6E2; Match level="QueryCoverage=93%, HitCoverage=21%, E-value=2e-22, Identity=38%"; Hit description =Translation initiation factor 2
MVFLRRAGAAGRRSAADALAAAGGSDATGGQAGAGSPFVSDVAGRRSGRRAAALAPAHRTADRLDAGADGRSERRGDQGGDQGPGRHADRQHPLRRAARHGDPTAAAADRRAKYLPAAGGYPRRAALPVARRLVGFGASFPAAAGHSAPARRHGGGQA

SEQ ID NO: 140749 - protein, 53 aa, Glycine max
  Coding DNA Sequence Number=SeqID_23971
MAFIKTLCSGIKLQPDRSNAMWKQQFFHLIPDSVLACACKMKLAGCNFSVRYL

SEQ ID NO: 140750 - protein, 154 aa, Glycine max
  Coding DNA Sequence Number=SeqID_23972
MALASQVVRPGQFSCCQLLGSSNYPGKWCIDSQWHYLRTVPEHDDSSNSGHRYASGVVVIRVLTDFMKQLVVVIVAERVVEAMQLVVFNAPGEQMSDSTSTRHLATSDGTGTPTGSSALPSATTMILSIVLLAKKWMAIGATTNQPVTAWPNIM

SEQ ID NO: 140751 - protein, 85 aa, Glycine max
  Coding DNA Sequence Number=SeqID_23973
  Gene Ontology: Mol. function=amino acid binding; Biological process =metabolic process
  Homolog annotation: Hit_ID=Q9SJM1; Match level="QueryCoverage=54%, HitCoverage=11%, E-value=4e-16, Identity=78%"; Hit description =Expressed protein
  Subcellular localization annotation: CTP_CleavageSite=61; ConfidenceScore=5.64e-01
MLRPKKSMMRHKSQPRPVLSGQLTVRRVGSPSFSGGLMITTSSYSIPINNLLLVVVGGWLVAVGGVESLSREVGAKLTIYRENEI

SEQ ID NO: 140752 - protein, 80 aa, Glycine max
  Coding DNA Sequence Number=SeqID_23974
MDTLEPYTGAMKGKECHEHCTTFHYIALFHMKSAFTQIHDKGCSICIPKNHVNCIDFLHLMSNLLNLEWPALDRGRTQIK

SEQ ID NO: 140753 - protein, 63 aa, Glycine max
  Coding DNA Sequence Number=SeqID_23975
RLSRWCGVEWPLATTSPPVVEQFKGAVVVAAIAAVRGGAVAVCVAVSNENLKILVLWTSLSST

SEQ ID NO: 140754 - protein, 49 aa, Glycine max
  Coding DNA Sequence Number=SeqID_23976
MDDFSEDEDQQFFDHINEDSNDQSDDQSDDEGVGRPMTPPSPPLPYHQP

SEQ ID NO: 140755 - protein, 70 aa, Glycine max
  Coding DNA Sequence Number=SeqID_23977
MEASIPSPWELYRSSRRKNWRNLTKPLEMPLSLPENTYELCNHTTVRPFKGDEFCARGIVMGSIVETRRV

SEQ ID NO: 140756 - protein, 87 aa, Glycine max
  Coding DNA Sequence Number=SeqID_23978
MTTSTTTSCLAYMAPDIIIPPKTLAIYLLIAMCDKFCFLEWGLMEACLWSFYGGWIFELQWGPLMVIFHHGDAAEDKGKEVRGGAIH

SEQ ID NO: 140757 - protein, 127 aa, Glycine max
  Coding DNA Sequence Number=SeqID_23979
  Gene Ontology: Mol. function=chitin binding; Cellular component =extracellular region; Biological process=chitin metabolic process
  Homolog annotation: Hit_ID=Q86AI8; Match level="QueryCoverage=90%, HitCoverage=36%, E-value=3e-17, Identity=36%"; Hit description =Similar to Homo sapiens (Human). Mucin 2
  Subcellular localization annotation: CTP_CleavageSite=49; ConfidenceScore=5.49e-01
MARTCSPLKVRACSPLKVRTCSPLKVRACSPLMARTCNPLKVRAYSPLMARTYSPQKVRACSPLMARKCSPLKARASSPLKTWTCSPLKARACSPLKVRTCSPLKARTCSPLKVRACKKNFSRTRNS

SEQ ID NO: 140758 - protein, 84 aa, Glycine max
  Coding DNA Sequence Number=SeqID_23980
MPKSSPNMHVKQELSTRVKPRLLCKQSMGQNTPNKIDDGSNSHQGEKQGFQFTKCQETPISKTITHYLYITQNSKRNMQCCTKT

SEQ ID NO: 140759 - protein, 69 aa, Glycine max
  Coding DNA Sequence Number=SeqID_23981
ARIVTVGGPSPTTAANPTPGPCEGNLRAPRRFLSREEDEAASAWANMKLAGDNKSLEDWVLLLTNDAKG

SEQ ID NO: 140760 - protein, 155 aa, Glycine max
  Coding DNA Sequence Number=SeqID_23982
MLESDAKYWWNNTGESLATQEALITWDEFKEVFLEKYFPHSVRIQKEIGFLQLQQGEMIIVENVAKFESLSRKCKQWGLIDLRRRLALMGRNSITSDVAPCGACRPWIFFINEVLCFLKINGSGMEKEKDDWRRHFKEKMSQEEAHHHRKPWIRA

SEQ ID NO: 140761 - protein, 125 aa, Glycine max
  Coding DNA Sequence Number=SeqID_23983
  Subcellular localization annotation: CTP_CleavageSite=43; ConfidenceScore=5.22e-01
MDPEKPNRALGFLALVMGLCQFYRVPVPPARSSGPLLTELSSRSTAPPGRRRARHHNNLGMADSGQQTHRRHLQSPLAHLQKLECCLRPVVDQQATKFKAKGKQSTRSMTNKSSRVQLKTLKKRY

SEQ ID NO: 140762 - protein, 102 aa, Glycine max
  Coding DNA Sequence Number=SeqID_23984
MVAFVRQFFADERIKVGLKRGKFNHPAWTNEKIGANEEGENEGETHAVTAVPIWKLPHQLNKHHYSANIRPFSLPTTQSSTKAIPKSTTKPVYRISNDEHHL

SEQ ID NO: 140763 - protein, 338 aa, Glycine max
  Coding DNA Sequence Number=SeqID_23985
  Gene Ontology: Mol. function=oxidoreductase activity; Cellular component=membrane; Biological process=iron ion transport
  Homolog annotation: Hit_ID=Q44740; Match level="QueryCoverage=99%, HitCoverage=73%, E-value=1e-165, Identity=81%"; Hit description =Alcaligin biosynthesis enzyme
MAGQFAQDLRIAVAAEAQVGIGDAVAEQAAVLHEDLVAAVVDAVVARDAVAAIVGPGDAVVDGIDAAGDAARIAGGQHQAIGRMRERLAGIDVAEFQLVAAGAAVMAAGAQFGIGQQRVAVVAVVDPFIEQVVDLVDQRRVDALVQAALLGQDLAAASLGQVVEIIGVVGGNQFQRELGVLHLEKARRTGDPGQAVVVFVAVAQQVVEHLGRALAATHDGDRRPSLQLFLVPQIVGAVDVGRFAPVAAGRQHRLRAQAQHQLAAADHEAFAIDAVLAGDQVGVGLGVMQHALHVAVEAQVWQARGHPFAIAVVLGARQVVVLAHVVRVDAAGLLAVVQ

SEQ ID NO: 140764 - protein, 70 aa, Glycine max
  Coding DNA Sequence Number=SeqID_23986
LGRIDGDPALRGTRIRATWEYVSSVGGGQQGMEVWKVRLPSFIVDHRVYLRYVAGSGDLGTSVVLCPNQA

SEQ ID NO: 140765 - protein, 131 aa, Glycine max
  Coding DNA Sequence Number=SeqID_23987
MQDIDEVAARESSLTSKGVRGGGKQNKDKGFVVEEVQVIGGKVIIPNSATRMLNNDEEHKEVTESTQQAFKSLEIQVGKLAEEVTKFVAKREENFVEVEAHEESIVEEHDSKEKYEEKVRRKHNNGRSTHK

SEQ ID NO: 140766 - protein, 52 aa, Glycine max
  Coding DNA Sequence Number=SeqID_23988
MVPPVNGGVETEHSEDAPLSGSHKPQRQSRTAMMVTRRWRSQVTNDSHRSCG

SEQ ID NO: 140767 - protein, 68 aa, Glycine max
  Coding DNA Sequence Number=SeqID_23989
MASLAPINGQPRFRWPLSKDKGTMLVFLEIIEMRNKTGTKSGFATDSAASPELIPNTNNLFVGLLLFA

SEQ ID NO: 140768 - protein, 278 aa, Glycine max
  Coding DNA Sequence Number=SeqID_23990
  Gene Ontology: Mol. function=inositol or phosphatidylinositol phosphatase activity; Cellular component=intracellular; Biological process=abscisic acid mediated signaling
  Homolog annotation: Hit_ID=Q1RXP2; Match level="QueryCoverage=98%, HitCoverage=60%, E-value=1e-104, Identity=70%"; Hit description =Inositol polyphosphate related phosphatase
FTWPALVANEILNKRLGSSNFIADFPSNTEPLLSHDQSSLSSKTMLNDQKDTQKNKIFVSTWNVGGIAPDEGLNMEDLLETRNNSYDIYVLGFQEIVPLKASNVLGYQNSKISTKWNSIIREALNKNNTHVLHSFKLDEEGDDKKGIYCNNKELGNNNNNNNPGLQGPQDFECIISKQMVGILISVWAKRDLRPFIQHPSVCCVGCGIMGCLGNKGSVSVRFVLHETSFCFVCGHLASGGREGDEKHRNSNVAEIFSRTSFPRRGPMLDLPRKILDHE

SEQ ID NO: 140769 - protein, 49 aa, Glycine max
  Coding DNA Sequence Number=SeqID_23991
MENWRTALRNNFAGLQTRSGEWRIGEQRYAITSRGSRLEGGGRMNSARQ

SEQ ID NO: 140770 - protein, 271 aa, Glycine max
  Coding DNA Sequence Number=SeqID_23992
MKNKTRSALSRCKTEEPPRSTRIASTVVLSALINLSERAKRVLVALSECLLQQTGAPSAGLGLRAISLHALLFTPPLLLSSPPSALLSAPPSFYFLHPSLLPSPLIYLLFAPPIWPPVNAVPCPHQGKRPTGTLPALPQRSLGTGTQEAQMGLGAYMSTREEDRCGSEDHSPRFCRLRGQVVRFDADTINDFLDTPVILEDGEKYPAYTRYLSTHPDPDTIAATLCTPGGRFVLNADGLPWKLLKKDMTTLAQTWSVLSYYDIAPTSHTSN

SEQ ID NO: 140771 - protein, 145 aa, Glycine max
  Coding DNA Sequence Number=SeqID_23993
MRKASSNSYNLLHKEVNRMNVVILPKENVVIWFCSLHNKPDNYLKDIINRSVLFFNIFALALVSALKGLDDTQQSKSKTPARWIVVKCNRQKGSTECGYYVMHWMSTIILGNFQNNWEMYFTDPRPLEPERLKALRNQWAKYYLK

SEQ ID NO: 140772 - protein, 109 aa, Glycine max
  Coding DNA Sequence Number=SeqID_23994
MVLSRMIYFSLQKACFPFRWKNPVDRSVLPINFYLETHECHCLALFMCPPPSSLEPRECHCLALFSIILGTFRNNWETYFNDPSSLEPERLKALRIQWAHYYLRVRDQT

SEQ ID NO: 140773 - protein, 180 aa, Glycine max
  Coding DNA Sequence Number=SeqID_23995
MAEKTKKKLEETAQFRSTEGVINPPSPIRRHASQGSFIPHGRQDVLTAAIGRPQHLGRVHAARAGVTIKQYFRSAARSSCSSSSIPHEELEQLTQQIRDQLEESIREKGLALPPEPEVGPSAARVSTKGSCVDPLLTDPETGDSDKCRLYIKANPSHLVALLRVYEGSTTVHNVPLLHGQ

SEQ ID NO: 140774 - protein, 143 aa, Glycine max
  Coding DNA Sequence Number=SeqID_23996
MVLAEGETLPAYSRYCRLPTDIREIEAALCIPGRRKNCWNPDDLTVTIREARRVRTRLVEAPSTSTAPPPACTLAAPSAPAYADFQRLEAVLQNIHQGQIILLQSLQMVAPPNSIPSVEQFNEWVAWPGTQSSLHREGEGPQP

SEQ ID NO: 140775 - protein, 139 aa, Glycine max
  Coding DNA Sequence Number=SeqID_23997
MAAQFIHDRVEMECLEGAWETLEGNARCRFRGTIRFTTTSLVHPEEPACTIQRTMEWILPTPTPYRLVEPVQVIEVTSSEEDPEELPPEPAVDALDFLEGDEDPLPEVDSLEDVMSASEADSTEDSGPGEMATSGGSSS

SEQ ID NO: 140776 - protein, 94 aa, Glycine max
  Coding DNA Sequence Number=SeqID_23998
MSWALQNFHESKPSALLKTKPTFTAFQEEESKDEFQKFKNESRTLQGSRRNLISRIQNPDSRIQIPGSSFPESRSRFQIQIPESRSRFQNPEKN

SEQ ID NO: 140777 - protein, 59 aa, Glycine max
  Coding DNA Sequence Number=SeqID_23999
MEKKNRYPKPCCMKSIEFELSSEYRDVETTAQLSRSYKASTLPISMNLLRLKWFNPTQK

SEQ ID NO: 140778 - protein, 128 aa, Glycine max
  Coding DNA Sequence Number=SeqID_24000
MEGSRNFEDRRRSDYGRSSSTHQGFANSISCSFPSLQNTNDDFDNDHVGAPLRPLRAPTSIRWKINQCFMFQSLTLKVLFFLLHVVVVFDSRYSGDGGSRCLGVGGGGCFGSRCGDDGCLRCRGYGLF

SEQ ID NO: 140779 - protein, 254 aa, Glycine max
  Coding DNA Sequence Number=SeqID_24001
  Gene Ontology: Mol. function=hydrolase activity, acting on ester bonds; Cellular component=cytosol; Biological process=one-carbon compound metabolic process
  Homolog annotation: Hit_ID=P36591; Match level="QueryCoverage=68%, HitCoverage=44%, E-value=6e-14, Identity=27%"; Hit description =Dihydrofolate reductase
  Pfam annotation: Domain name=FSH1; Domain location=6-195; Score=-9.3; E_value=8.8e-07; Accession=PF03959.4; Description=Serine hydrolase (FSH1)
MEGENGKKLKILCLHGFRTSGSFLKKQISKWDPSIFTQFDMVFPDGKYPAGGKSDIEGIFPPPYFEWFQFEKDFTVYFNLEECISYLCEYITANGPFDGFLGFSQGKLLKEHPPIKFLISISGCKFRNPSICDVAYKDTIKAKSVHFIGEKDWLKLPSEDLTSAFDKPLIIRHPQGHTVPRLDEVATSQLRKWITEEVLCQPKVGISVCEHETDHEEKKSEKGTKLEPCGTNQDKGVNGVEINKGSETVEVAQA

SEQ ID NO: 140780 - protein, 691 aa, Glycine max
  Coding DNA Sequence Number=SeqID_24002
  Gene Ontology: Mol. function=protein serine/threonine kinase activity; Cellular component=membrane; Biological process=protein amino acid phosphorylation
  Homolog annotation: Hit_ID=Q5NAH9; Match level="QueryCoverage=73%, HitCoverage=67%, E-value=1e-126, Identity=49%"; Hit description =Protein kinase CDG1-like
  Pfam annotation: Domain name=Pkinase; Domain location=523-690; Score =5.9; E_value=6.5e-09; Accession=PF00069.15; Description=Protein kinase domain
  Pfam annotation: Domain name=Pkinase_Tyr; Domain location=523-690; Score=9.9; E_value=4.4e-13; Accession=PF07714.7; Description=Protein tyrosine kinase
  Pfam module annotation: Pfam domain module=Pkinase::Pkinase_Tyr; Domain location=523-690::523-690
  Subcellular localization annotation: CTP_CleavageSite=15; ConfidenceScore=5.42e-01
MITLGFGSPKQNKCGAAPVVSPALTPSRSFGWKKSGEPVSAPVYETPKPPPTIVHSHAQAPVVSPALTPSRSFNWTKGGEPVSAPPYKIPKPLPAIVHSPAQERQFHHAPEPLISSPKSPFNKDHPPASSPSTTFYKHHYTRNTVTSPAPASSHFVSPSTSKHQDGSNPPSPLPTSGQRHHAPPPMNTGSSVSPSSLHIQSPVNQVSPAPSPIFNISPHSTKIPLHPPKVSPSRPSSKIPKKPVRPRFQALPPPPPNEDCISVVCSEPYTSTPPGAPCKCVWPMKVGLRLSVSLYTFFPLVSEFASEIATGVFMKQSQVRIMGADAANQQPDKTIVFIDLVPLGEEFDNTTAFLTSERFWHKQVVIKTSYFGDYVVLYVTYPGLPPSPPLPPSSISIIDGGPYSGGGNNGRTIKPLGVDISKRQHRGGLSKGIIAVIALSVFLVVALCFAAALASFKYRDHVSQTPSTPRILPPLTKAPGAAGSVVGGGLASASTSFRSSIAAYTGSAKTLSMNDIEKATDNFHASRVLGEGGFGLVYSGILEDGTKVAVKVLKREDHQGNREFLSEVEMLSRLHHRNLVKLIGICAEVSFRCLVYELIPNGSVESHLHGADKENSPLDWSARLKIALGSARGLAYLHEDSSPHVIHRDFKSSNILLENDFTPKVSDFGLARTAADEGNRHISTRVMGTFG

SEQ ID NO: 140781 - protein, 643 aa, Glycine max
  Coding DNA Sequence Number=SeqID_24003
  Gene Ontology: Mol. function=hydrolase activity, acting on glycosyl bonds; Cellular component=nucleus; Biological process=L-arabinose metabolic process
  Homolog annotation: Hit_ID=Q7X9G7; Match level="QueryCoverage=98%, HitCoverage=95%, E-value=0.0, Identity=64%"; Hit description=Alpha-L- arabinofuranosidase
  Pfam annotation: Domain name=Alpha-L-AF_C; Domain location=449-635; Score=163.9; E_value=4e-46; Accession=PF06964.2; Description=Alpha-L- arabinofuranosidase C-terminu
  Pfam annotation: Domain name=CBM_4_9; Domain location=61-224; Score= -3.2; E_value=0.0051; Accession=PF02018.8; Description=Carbohydrate binding domain
  Pfam module annotation: Pfam domain module=Alpha-L-AF_C::CBM_4_9; Domain location=449-635::61-224
MSLSIKIFFLLYLSCLTVSCFAEQTSTLIVDAKGSVRKIPDTFFGAFFEEINHAGAGGLWAELVRNRGFEAGGPNVPSDIYPWSIIGDDSTILVSTDRSSCFERNKIALRMNVLCNQSNPCPAGGVGISNPGFWGMNIEKGQKYKAVFYVKARGGLDLDVSFVGSERGEKLASQNFRAPGHNISMWTKMETILEANDTNRNASLQITTSNTGVVWLDQVSVMPLDTFKGHGYRKDLFQMVADLKPKFFRFPGGCYVEGNYLRNAFRWKDTVGPWEERPGHFNDVWNYWTDDGFGFFEGLQFAEDVGALPAWVFNNGLSLKDEVNTSAIAPFIQEALDGIEFARGSPKSQWGSLRASMGHPEPFDLRIVAIGNEECGMSKYQANYLKFHTAIKQAYPDIQIITNCDGSEKPLDHPADLYDFHIYTNAKDMFSKSTKFDDAPRSGPKAFVSEYAVWKDDAGNGTLLAAVAEAAFLIGLERNSDVVHMVSYAPLFVNTNDRRWTPDAIVFDSHQHYGTPSYWVQHLFSASSGATLLNTTLQNSTDSLVASAIEYTNPEDKKNYLKIKVVNFGSDPQNFRFFISGLASNVQRSGAAKTVLTGPNVKEENSFSEPKRVAPQHTSLEVAHGDMNVVLSPYSVTSFDILK

SEQ ID NO: 140782 - protein, 643 aa, Glycine max
  Coding DNA Sequence Number=SeqID_24004
  Gene Ontology: Mol. function=alpha-N-arabinofuranosidase activity; Cellular component=nucleus; Biological process=L-arabinose metabolic process
  Homolog annotation: Hit_ID=Q1SJT6; Match level="QueryCoverage=99%, HitCoverage=95%, E-value=0.0, Identity=64%"; Hit description =Galactose-binding like; Alpha-L-arabinofuranosidase, C-terminal
  Pfam annotation: Domain name=Alpha-L-AF_C; Domain location=447-634; Score=153.6; E_value=5e-43; Accession=PF06964.2; Description=Alpha-L- arabinofuranosidase C-terminu
  Pfam annotation: Domain name=CBM_4_9; Domain location=59-222; Score =4.8; E_value=0.001; Accession=PF02018.8; Description=Carbohydrate binding domain
  Pfam module annotation: Pfam domain module=Alpha-L-AF_C::CBM_4_9; Domain location=447-634::59-222
MSLSFKIFLVCITCFTVCCFAEQTSTLIIDAIATRKIPDTFLGAFFEEINHAGAGGLWAELVRNRGFEAGGSNVPSNIYPWSIIGDDSTILVSTDRTSSFERNKVALSMKVLCNESNPCPSGGVGISNPGYWGMNIEKGKKYKVVFYAKADGAINLNVSFVGTEKGEKLASNNIRSYKHNVTNWTRMEVIIEAKATNHNASLQITTSKSGFVWLDQVSAMPLDTYKGHGFRKDLFQMVADLKPKFFRFPGGCYVEGDYLRNAFRWKDTVGPWEERPGHYGDVWNYWSDDGFGFFEGLQLAEDLGALPVWVFNNGISHHDEVNTSAIAPFVHEALDGIEFARGSPESRWGSLRASMGHPKPFDLRIVAIGNEDCDKFNYKGNYLKFYDAIRRVYPDIQIISNCDGSENPLDHPADLYDFHIYTNAEDMFSKSTKFDNVSRYGPKAFVSEYAVWQDDAGNGTLLAAVAEAAFLIGLEKNSDIVSMVSYAPLFVNANDRKWTPDAIAFDSYRHYETPSYWVQCLFIPSSGATLLNSTLLSSSNKSLAASAIEYTNPANKKNYLRIKVVNFGDHTENLRIFVNGLDSKVQQSGSTKIVLTAPNVREENSFSEPKKIVPQHTSLEAASEDMNVILSPYSVTSFDLLIK

SEQ ID NO: 140783 - protein, 134 aa, Glycine max
  Coding DNA Sequence Number=SeqID_24005
  Homolog annotation: Hit_ID=Q9FFD3; Match level="QueryCoverage=55%, HitCoverage=12%, E-value=9e-07, Identity=33%"; Hit description =Mutator-like transposase-like protein
MENEVEISESNVNRVLEHESSESNRKSGDDFDHSDDDIQDMGIWAGHLFDILVGKGKRILDFKFSDLKNEKSRVKAKCTVEDCPWCTHASLCPDRLTNKIKTYNVVHNYIRQTKNKDKEATSAWIAQKLESKLR

SEQ ID NO: 140784 - protein, 142 aa, Glycine max
  Coding DNA Sequence Number=SeqID_24006
  Gene Ontology: Mol. function=small conjugating protein ligase activity; Biological process=protein modification process
  Homolog annotation: Hit_ID=Q1SD71; Match level="QueryCoverage=73%, HitCoverage=43%, E-value=3e-18, Identity=49%"; Hit description =Ubiquitin-conjugating enzyme, E2
  Subcellular localization annotation: CTP_CleavageSite=77; ConfidenceScore=5.22e-01
LYTGIHAKPKPKFKSGAISESTTALNVDQTNTSVISADIKTTPASAALPAATATRGNNQEQAAAAVNGSNAAATVISAAASAPQKKEGGQAKAQVDKKKIDARKKSGVLNPAKFYKVDDAFYIHPQWFSQGGEYLPSQVLGL

SEQ ID NO: 140785 - protein, 64 aa, Glycine max
  Coding DNA Sequence Number=SeqID_24007
MWDWHKLRGSLKLGVFASKAYTPKSPLGPLPPDSVIQLVGFPQWIPSRYSSRKNSLPLKGLTIV

SEQ ID NO: 140786 - protein, 299 aa, Glycine max
  Coding DNA Sequence Number=SeqID_24008
  Gene Ontology: Mol. function=RNA-directed DNA polymerase activity; Cellular component=integral to membrane; Biological process=RNA -dependent DNA replication
  Homolog annotation: Hit_ID=Q1SFJ7; Match level="QueryCoverage=88%, HitCoverage=35%, E-value=4e-41, Identity=32%"; Hit description=RNA -directed DNA polymerase
MESESLVADFAYEEIKVVVWSCGNGKSSRPNGFNSNFFKECWSIVGKDVCDRVHEFFCNTELPKAIIASFITLIPKQDYPLGLADFHHISLISNIHKIISKLIAEMIKVLPSIIYMNAILPLSRVKGRLDGVLDANELIDWTKRNGRKVIMVKVDFQKAYDSYVDDSIIVGEESQDNLWALKAILKNYELVSGLKVNFHKSGIYGINIDGLFLQAVENFLYCNIGTLPLKFLGIPIGANARRCHTWEPIIAIFQKRLVGWRRKHLYMGGGVGLEEGYLVISYNTMQIFVAGWSKNQKTN

SEQ ID NO: 140787 - protein, 209 aa, Glycine max
  Coding DNA Sequence Number=SeqID_24009
MSSIVWSSQQDSNKLLLNRIVATYPLAGGRGKIEVSIFQKGEHAGVATNNYSRENVRKTKRRFANFKNEGSRVVYAWERGRPGSYVSSDQDKNPRDSRYIIKKISSDLGREFQIEIARGLAKKFKLKCLFQEIYSLGLRDRESLVVKKSKHKGRVVLVWFRTCKVILQDSKTLKRVAWELDIGTRALAGKPVGFFSSTSSQGGGQEETP

SEQ ID NO: 140788 - protein, 59 aa, Glycine max
  Coding DNA Sequence Number=SeqID_24010
MARRAQHRGQRGHHGLSSELKMRVTPGTQTKDPEDIRTNNTGESSEHDRVFELAHDRLD

SEQ ID NO: 140789 - protein, 198 aa, Glycine max
  Coding DNA Sequence Number=SeqID_24011
  Gene Ontology: Mol. function=DNA binding
  Homolog annotation: Hit_ID=Q2HU60; Match level="QueryCoverage=60%, HitCoverage=46%, E-value=7e-30, Identity=57%"; Hit description =Methyl-CpG binding
MGSVYLLVSEPSLLTSQHSVHALLLSDWIDAVVCNTNTAVRKNVMNFIESGSGQQWNSLRAVENFLSGENACTATPKSAVKSGTGEKRACGVRSVRKPVHKRFSAADEKMTPKYLKHSIQSALPEKPDSQKKTKLEKDNRASMHNLTAPPPAKVSWVLSGPGGFWSPSLDDSIVPESEKLKWSEAFVLSIHNDGVTNS

SEQ ID NO: 140790 - protein, 244 aa, Glycine max
  Coding DNA Sequence Number=SeqID_24012
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=41%, HitCoverage=26%, E-value=1e-28, Identity=61%"; Hit description =Integrase, catalytic region
MVSRPSQPFFCYSNGPLKLEGPHPRIPLNGDSKLLVLSIPHFIFMDKLLHSLSQNAAYVELRTPIAQNPNAHSDFTIHNNTILQQGKIWLPLVAKTLHHLQDNFRWSYMRHDVRQYVAHYDIYQQTKYETHRPTGLLQPLPIPKTIWEDLSLDFITGLPPSQGYTTILVIVDRYSKGTHLGALQPHYIVYKVPLLFIDMLVGLGSSLSMDSFASWNMNGSGMENEEREETPLQGEDKSRRSSPP

SEQ ID NO: 140791 - protein, 84 aa, Glycine max
  Coding DNA Sequence Number=SeqID_24013
  Homolog annotation: Hit_ID=Q8LNL7; Match level="QueryCoverage=78%, HitCoverage=7%, E-value=1e-07, Identity=55%"; Hit description =Putative retroelement
MKLAADNHHRDVTFSVNDWVGANFLQIAHLLLWTFPYTGTYWPSNIQAMFTSNFQNTPYFPLVYAETSPWSSTGILARVSMHQY

SEQ ID NO: 140792 - protein, 248 aa, Glycine max
  Coding DNA Sequence Number=SeqID_24014
MAAILLGSGETPNVDTIWPMYCQHPAWWKLVSPAPPSGSKGINKALHSLGKCLEEDVCDGGVGGGVWEGWAGSGKGINWYKAEILLSMVMGPSNFSHCTPRIISALHKGGEVEETSDVGLDKIMGTPTVNQNGEGIEVVKPALRGRLAGHRKKKVRSEIQAPRASPSMRYSLVVKKLGYLEYPSKRVLVIESRDFQFHVRARMRRWNGGGRGFGGGMDCGHGGKVSNCLFEPFDDGLARGVFRHGRWA

SEQ ID NO: 140793 - protein, 227 aa, Glycine max
  Coding DNA Sequence Number=SeqID_24015
  Gene Ontology: Mol. function=RNA-directed DNA polymerase activity; Biological process=RNA-dependent DNA replication
  Homolog annotation: Hit_ID=Q8H6Q8; Match level="QueryCoverage=74%, HitCoverage=45%, E-value=1e-28, Identity=37%"; Hit description=CTV.20
YNYWDYKDAWTNVFWHQNSKFKHSWLIYFKNNTVYNFPNWFLQWWNYFGPIPQIFPEEVQQGFQQFSKLFNSKESRIPTDLKYFSSFAMSWIFSWQYRYGKTENSKQYPPLQRHAFVKWWSQFDTSNAAPEQVKNWFQSNPEFLKPADPETSLFLNQKSQLAAFLASSKSKESLAQNLKEVLQLLQQEEEEEPPKKEAESSENNDDQEDDPFYQNEDDCFGISLDDD

SEQ ID NO: 140794 - protein, 92 aa, Glycine max
  Coding DNA Sequence Number=SeqID_24016
MTGTSQKTWMTQEVAPKHNLFDEEVRFEDINQNMDDWNIPKIPQDELYVPETMKDKHNFDYIIKTVENNTPLGQDIGEEFHLLSKNSIYEHS

SEQ ID NO: 140795 - protein, 277 aa, Glycine max
  Coding DNA Sequence Number=SeqID_24017
  Gene Ontology: Mol. function=drug transporter activity; Cellular component=membrane; Biological process=multidrug transport
  Homolog annotation: Hit_ID=Q1SD91; Match level="QueryCoverage=98%, HitCoverage=56%, E-value=3e-94, Identity=63%"; Hit description=Multi antimicrobial extrusion protein MatE
  Pfam annotation: Domain name=MatE; Domain location=62-213; Score =86.0; E_value=1.2e-22; Accession=PF01554.9; Description=MatE
MGFLVAMISTNFGILDSDIGQLIFITCGLVPETWKGFSFLAFKDLWPVAKLFHFIWCHVMEIGYRLILELWYSTILILLTGNMKDAEVQIDALSICINISGWEMMIAFGFMAAVSVRVANELGRENSKAAKFSIVVTVLTSFAIGEKVAYLFTSNEDVATAVGDLSPLLALSLLLNSIQPVLSGVAVGAGWQSTVAYVNIGCYYLIGIPVGIVLGNIIHLQVKGIWIGMLFGTLIQTIILIIITYKTNWDEQVIIARDRINKWSKMVLDHETITSDN

SEQ ID NO: 140796 - protein, 137 aa, Glycine max
  Coding DNA Sequence Number=SeqID_24018
MYGNHQIAISIGPFSGTQMRKLQRIYSIFCGRLGSARIHFLARASIQKLKRQQAEQVQTQTPLISWKRPPLQCIKINFDASAHNNQGTGMGLVVARDHEKLVLGAATIMVTVVYMNQGLQKLYATSGRFKWQASSIL

SEQ ID NO: 140797 - protein, 385 aa, Glycine max
  Coding DNA Sequence Number=SeqID_24019
  Gene Ontology: Mol. function=protein binding; Cellular component =nucleus; Biological process=regulation of transcription, DNA -dependent
  Homolog annotation: Hit_ID=Q52ZH8; Match level="QueryCoverage=100%, HitCoverage=81%, E-value=0.0, Identity=82%"; Hit description=FVE
  Pfam annotation: Domain name=WD40; Domain location=117-156; Score =3.5; E_value=14; Accession=PF00400.22; Description=WD domain, G-beta repeat
  Pfam annotation: Domain name=WD40; Domain location=172-211; Score =15.0; E_value=0.26; Accession=PF00400.22; Description=WD domain, G -beta repeat
  Pfam annotation: Domain name=WD40; Domain location=249-288; Score =28.5; E_value=2.3e-05; Accession=PF00400.22; Description=WD domain, G-beta repeat
  Pfam annotation: Domain name=WD40; Domain location=294-333; Score =36.2; E_value=1.2e-07; Accession=PF00400.22; Description=WD domain, G-beta repeat
  Pfam annotation: Domain name=WD40; Domain location=343-382; Score =41.5; E_value=2.9e-09; Accession=PF00400.22; Description=WD domain, G-beta repeat
  Pfam module annotation: Pfam domain module=WD40::WD40::WD40::WD40::WD4 0; Domain location=117-156::172-211::249-288::294-333::343-382
METPPPQQGVVKKKETRGRKPKPKDEHAKALKEGRKTQQQQHDQQQQQQQQHQPSVDEKYTQWKSLVPVLYDWLANHNLTDGSVPNTLVIANCEVVKPRVAAAEHISQFNEEARSPFVKKYKTIIHPGEVNRIRELPQNSKIVATHTDSPDVLVWDVESQPNRHAVLGATNSRPDLILTGHQDNAEFALAMCPTEPYVLSGGKDKTVVLWSIEDHITSAATDSKSGGSIIKQNSKSGEGNDKTADGPTVGPRGIYCGHEDTVEDVTFCPSSAQEFCSVGDDSCLILWDARVGSSPVVKVEKAHNADLHCVDWNPHDDNLILTGSADNSVRMFDRRNLTTNGVGSPIHKFEGHKAAVLCVQWSPDKSSVFGSSAEDGLLNIWDYEK

SEQ ID NO: 140798 - protein, 74 aa, Glycine max
  Coding DNA Sequence Number=SeqID_24020
MSVSKDNLALAKESAKLFACTIDRALLKLAFEFPNLSKLVSNSLIAVQQAPSKLQKMFMLDYRKPITYTSGRII

SEQ ID NO: 140799 - protein, 198 aa, Glycine max
  Coding DNA Sequence Number=SeqID_24021
  Gene Ontology: Mol. function=endopeptidase Clp activity; Biological process=proteolysis
  Homolog annotation: Hit_ID=Q7WKT7; Match level="QueryCoverage=47%, HitCoverage=91%, E-value=3e-44, Identity=88%"; Hit description=ATP -dependent Clp protease adaptor protein clpS
  Pfam annotation: Domain name=ClpS; Domain location=115-196; Score =177.6; E_value=3e-50; Accession=PF02617.7; Description=ATP-dependent Clp protease adaptor protein C
MAQPYRCAVEGNSGSGDIERLVLKPFIWMDEKWANRSSPPSSGVMKPNPFASLNHLTVPVDLGLSPWTAVAVVSDMRTASLNQCVDNAPLFFAESSMETTHFYHDLAVEKAPARAAPPPMYQVLLLNDDYTPMEFVVKVLQKFFNKNHEEATRIMLQVHHEGRGVCGVYPRDLAATRIAQVAQYARARQHPLQCVMEP

SEQ ID NO: 140800 - protein, 258 aa, Glycine max
  Coding DNA Sequence Number=SeqID_24022
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=6e-30, Identity=34%"; Hit description= UPI00006A17C9 related cluster
RTARPHLQRATRPRHQRTARPHLHRATRPHLQRTTCPHLKRATRPHLRGLHVLIFRGLHVLTLRGLRILAFVGLHALTFRGLHVLTFRGLRALAFVGLHALTFRGLHVLTFRGLRALAFVGLHALTFRGLHVLTLRGLRALAFGGLHAFTFRGLHVLTFRGLHVLTFIGLHALTFRGLHVLTFRGPCPRPHLERTTRPRLERTAHPHHQRATRPHLQRTTRPRLERTTCPHQQRVARPHLQRTTRPRLERATRPCLGY

SEQ ID NO: 140801 - protein, 95 aa, Glycine max
  Coding DNA Sequence Number=SeqID_24023
MKTLKLNGNLAKLPIISPKTQYPRKSSEKEVYPNLKFRGPTRRDALHDSENAFLSRFGAKMMTKGWSFVGASMVEEEEENGNVRERKELSEIFFG

SEQ ID NO: 140802 - protein, 107 aa, Glycine max
  Coding DNA Sequence Number=SeqID_24024
MWCYEWKKSEALRVGRLNLDSVDAIWEKLDEGKSGFRKCAAEFCISAEKCYVFAGCGKSICDDLDVELPGCWGSFGRIDGDPVLRKTRIWATWEYVSSVGGGQQGMM

SEQ ID NO: 140803 - protein, 197 aa, Glycine max
  Coding DNA Sequence Number=SeqID_24025
MGSSQKPSLKKRFYQVKIKSLEVTSLRKLGQLMGQLQRQAFAKPMGSTPHWPEFLKSPNLGAGIRPPKASRKWGGRNIEKIFGAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEESGFYLHAKDVRMFP

SEQ ID NO: 140804 - protein, 202 aa, Glycine max
  Coding DNA Sequence Number=SeqID_24026
  Gene Ontology: Mol. function=DNA binding; Biological process =regulation of transcription, DNA-dependent
  Homolog annotation: Hit_ID=Q2SGF2; Match level="QueryCoverage=74%, HitCoverage=97%, E-value=6e-45, Identity=62%"; Hit description =Predicted transcriptional regulator
  Pfam annotation: Domain name=Rrf2; Domain location=47-170; Score =135.4; E_value=1.5e-37; Accession=PF02082.10; Description =Transcriptional regulator
MWPGAMKCPTTPWWRSRIIWHFIPTKWRKSVPKPEPRRIRAWAGAKVSTSTRFAVAIHILTNITLCRGQTVRSEDIARSVNTNPTVVRRILGALAEAGLTYSQMGQGGGALLARPAEAISLLDVYRAVEDQPYFMLHRTRPNDACYIGHAITPVLEQEFARVGLALEASLAQTSIAEMAGQVERRAGYPFVPCSPQYQADTQ

SEQ ID NO: 140805 - protein, 518 aa, Glycine max
  Coding DNA Sequence Number=SeqID_24027
  Homolog annotation: Hit_ID=Q8ZH57; Match level="QueryCoverage=32%, HitCoverage=88%, E-value=2e-31, Identity=47%"; Hit description=(3R) -hydroxymyristoyl-[acyl-carrier-protein] dehydratase (EC 4.2.1.-) ((3R)-hydroxymyristoyl ACP dehydrase)
DGVVEGGGGVQIADADGNMAEHGASFPKREGKARFTVCGAGRRSIAFDARIGVSRLAGIVHLMLMQIIADQLAHHLGRGDVLLQAQFLQGFLLVRVAEFAVEQLAAAGGQAAQRAQRQRHLGRRGVNDHVAAGGDAKQYGAEYSLQAVVQQAVFVRQIVVIEHQPAPVVQPRGAVFQEGLGALLRIHGERRIEIGEDQIVARLDGRAHEVHGVGGAQADGVGGRQRKIAARDGDHRSAQLDDVEAHGRIERVQRAQQTAAAQPQNQRRARRLPGYRHQHRFDVVVDRLRGVAEAHLALFADAVKPQRAVVLVIGNDDFAPGRHGIRRAPLASGLFTGAHEIGGANAPAIDAGAAGKASDRPAPTNKSDLHQHLVAGAGSAIKPRALNGGEIVMLPLIQRPEIVVGQQTGALRQRFHQQHAGKSGEVRVAVPERRLIGGDVLDGAQPPFGNAGAGGQYAIDQQAGITMRQNRLNIVELQGAKRGARGRHPILAIECGSAFSAWSGSLYPGSPSRRRTAQ

SEQ ID NO: 140806 - protein, 72 aa, Glycine max
  Coding DNA Sequence Number=SeqID_24028
MVVAIESTNKMHYGIGGSKESMIREVGIGSGREGDVRTDNGKKEYGYRVRIRGDLYLFEWEKDSMLELKEIV

SEQ ID NO: 140807 - protein, 592 aa, Glycine max
  Coding DNA Sequence Number=SeqID_24029
  Gene Ontology: Mol. function=oxidoreductase activity; Cellular component=nucleus; Biological process=electron transport
  Homolog annotation: Hit_ID=Q84XG2; Match level="QueryCoverage=96%, HitCoverage=99%, E-value=1e-166, Identity=56%"; Hit description =Putative polyamine oxidase
  Pfam annotation: Domain name=Amino_oxidase; Domain location=15-570; Score=209.9; E_value=5.7e-60; Accession=PF01593.14; Description =Flavin containing amine oxidoreductase
  Pfam annotation: Domain name=DAO; Domain location=7-432; Score=-60.2; E_value=0.06; Accession=PF01266.14; Description=FAD dependent oxidoreductase
  Pfam module annotation: Pfam domain module=Amino_oxidase::DAO; Domain location=15-570::7-432
MVVKKPRIVIIGAGMAGLTAANKLYTATASKDLFELCVVEGGTRIGGRINTSEFGGDRIEMGATWIHGIGGSPIHKIAQEIHSLHSDQPWECMDGNTDEAITIAEGGFHLHPSIVDPITKLFNTLMEYSQGKKTLTEATSKGAELESYHKLAALAAKLASASASAYNNNNLSVGSFLRQGLEAYQVSKEQEEVKGCGNWSRKLLEEAIFAMHENNQRTYTSADDLLTLDYGAESEYRMFPGEEITIAKGYLSIIESLASVLPPGFVQLGRKVTRIEWQLDDEKRKGAVENGCCSSRPVKLHFCDGSVMSADHVIVTVSLGVLKAAISDDDDDSGMFCPPLPPSKTEAISRLGFGVVNKLFMQLSPTHGEGKHGNEHSNKGFPFLQMVFHSPQSEMGHKKIPWWMRRTATLFPIYNNSSVLLSWFVGEEALALESLKDEEIINGVSSTVSCFLQHSQWQKGSTSSHKLCNGNVNSEERSHHQNEVKFSKVMKSKWGTDPLFLGSYSYVAVGSSGDDLDTMAEPLPKDNSCQPPAASSPLQILFAGEATHRTHYSTTHGAYFSGLREANRLLQHYHCVGIYNNYLESPLISSMK

SEQ ID NO: 140808 - protein, 161 aa, Glycine max
  Coding DNA Sequence Number=SeqID_24030
  Gene Ontology: Mol. function=nucleoside-triphosphatase activity
  Homolog annotation: Hit_ID=Q1RU18; Match level="QueryCoverage=59%, HitCoverage=15%, E-value=6e-21, Identity=56%"; Hit description =Helicase, C-terminal
MARFNLKLCITDFNSRDYYVNIRKEMFMQVAHLERTGHLLDNEKQPVGALASIKLPGPQAGVAKIEFENLEMVKTLMDVAPHYYDLSNFPQCEAKCVLERLYKKREKEKEEAKSQNDVGKNRAPVFVSKLQELNNVLIVQSLTTQLIKEHFSNFQVPNSSV

SEQ ID NO: 140809 - protein, 182 aa, Glycine max
  Coding DNA Sequence Number=SeqID_24031
  Homolog annotation: Hit_ID=Q40173; Match level="QueryCoverage=24%, HitCoverage=16%, E-value=3e-14, Identity=77%"; Hit description=Myb -related transcription factor
MANDGEAQSGARSSSFLPSILNIQSERPCEGLVGEEETSNDNDNNNSSLKKNWIIAATARTVDSTTSMRISTVDSVWERDHVEALWFQHSRLQDAGSCIEIDKMKPFCAKVGLKKGPWTVEEDKKLISLILNNGQCCWRVVPKLAAFVHLHRVNIVHMMGCLATYTCAQMHMNAVGRTCPVK

SEQ ID NO: 140810 - protein, 296 aa, Glycine max
  Coding DNA Sequence Number=SeqID_24032
  Gene Ontology: Mol. function=protein dimerization activity; Cellular component=nucleus; Biological process=regulation of transcription, DNA-dependent
  Homolog annotation: Hit_ID=Q2HUH2; Match level="QueryCoverage=93%, HitCoverage=87%, E-value=5e-88, Identity=64%"; Hit description=CAMP response element binding (CREB) protein
  Pfam annotation: Domain name=bZIP_1; Domain location=247-296; Score =31.7; E_value=2.6e-06; Accession=PF00170.11; Description=bZIP transcription factor
  Pfam annotation: Domain name=bZIP_2; Domain location=248-295; Score =42.0; E_value=2.1e-09; Accession=PF07716.5; Description=Basic region leucine zipper
  Pfam module annotation: Pfam domain module=bZIP_1::bZIP_2; Domain location=247-296::248-295
VVGWFIMGSQSGATQDQEPKTGSLTRQGSLYNLTLDEVQNQLGNLGKPVGSMNLDELLKSVWTVESGTDAYMHHGGGQVVSAGSSLNPEQGSLTLSGDLSKKTIDEVWRDMQQNKSVGKERQPTLGEMTLEDFLVKAGVSTEPFPNEDGAMAMSGVDSQHNTLQHAHWMQYQLTSVQQQQQPQQQNSVMPGFSGFMAGHVVQQPIPVVLNTVRDAGYSEALPSSLMAALSDSQTAGRKRVASGNVVEKTVERRQKRMIKNRESAARSRARKQAYTQELEIKVSQLEEENERLRRQN

SEQ ID NO: 140811 - protein, 159 aa, Glycine max
  Coding DNA Sequence Number=SeqID_24033
  Gene Ontology: Mol. function=ribokinase activity; Biological process =D-ribose metabolic process
  Homolog annotation: Hit_ID=Q8H277; Match level="QueryCoverage=91%, HitCoverage=38%, E-value=3e-42, Identity=60%"; Hit description =Fructokinase
MKSYDKSWLMLVRRSCLRASQSNDLTKEDCKETSSVVVCFGEMLIDFVPLVGGVSLAEAPAFKKAPGGAPTNVAIGISRLGSSSPFIGKVGADEFGYMLANILKLNNVETSGMRFDPNARIALAFVTLRVDGEREFLFFRNPSADMLLQELELDKDFLK

SEQ ID NO: 140812 - protein, 94 aa, Glycine max
  Coding DNA Sequence Number=SeqID_24034
MCPAHPSSRFILALNRKSGCNVWWWDRQHNTKGSNQDCRNCTYILSGWFDLSIDRFLVQIVLFPLYTKSSLDIGIHKTRSKPLSLDGVKQDIHL

SEQ ID NO: 140813 - protein, 75 aa, Glycine max
  Coding DNA Sequence Number=SeqID_24035
MANYIHSAVGASGNYIGISVAACDLEGSANGQTHSNSHIYNMSLEETSFHINKVSDFLEDVGGHSSVRIQKQMSR

SEQ ID NO: 140814 - protein, 816 aa, Glycine max
  Coding DNA Sequence Number=SeqID_24036
  Gene Ontology: Mol. function=protein serine/threonine kinase activity; Cellular component=membrane; Biological process=protein amino acid phosphorylation
  Homolog annotation: Hit_ID=Q2QWY4; Match level="QueryCoverage=94%, HitCoverage=96%, E-value=1e-157, Identity=39%"; Hit description=D -mannose binding lectin family protein, expressed
  Pfam annotation: Domain name=B_lectin; Domain location=68-178; Score =116.9; E_value=5.7e-32; Accession=PF01453.15; Description=D-mannose binding lectin
  Pfam annotation: Domain name=PAN_2; Domain location=325-402; Score= -10.3; E_value=0.015; Accession=PF08276.2; Description=PAN-like domain
  Pfam annotation: Domain name=Pkinase; Domain location=527-809; Score =176.1; E_value=8.5e-50; Accession=PF00069.15; Description=Protein kinase domain
  Pfam annotation: Domain name=Pkinase_Tyr; Domain location=527-809; Score=86.8; E_value=6.7e-23; Accession=PF07714.7; Description =Protein tyrosine kinase
  Pfam annotation: Domain name=S_locus_glycop; Domain location=208-321; Score=-23.0; E_value=0.0018; Accession=PF00954.11; Description=S -locus glycoprotein family
  Pfam module annotation: Pfam domain module=B_lectin::PAN _2::Pkinase::Pkinase_Tyr::S_locus_glycop; Domain location=68-178::325- 402::527-809::527-809::208-321
MASSIFLILHLLLPLIFNNFENSYSFSLSVENFKEEVIVSSPKATFSAGFYPVGDNAYGFAIWYTTTPHTLVWMANRDRPVNGKRSMLSLLKTGNLVLTDAGQSIVWSTNTITSSKQVQLHFYDTGNLVLLDNSNAVVLWQSFDFPTDTLLPGQTLSKNTNLVSSRSQTNYSSGFYKLFFDSENVLRLMYQGPRVSSLYWPDPWLQSNDFGSGNGRLSYNDTRVAVLDHLGYMVSSDNFTFRTSDYGTVLQRRLTLDHDGNVRVYSKKDLEEKWSMSGQFKSQPCFIHGICGPNSICSYDPKSGRKCSCIKGYSWVDSEDWSQGCVPNFQLRYNNNTEKESRFLHLPGVDFYGYDYSIFRNRTYKECENLCLGLSQCKGFQHKFWQPDGVFICFPKTQLLNGHHTPGFTGSIFLRLPRNSPLSLSDSENPINYNNGFVCGGSNGGPKLLDRPYVEEEENDSVKLLLCFVTALGGIEVACIFLVWCFSFRNKNRKLHSGVDEPGYVLAAATVFRKFSYSELKKATKGFSEAIGRGGGGTVYKGVLSDSRVVAIKRLHQVANQGESEFLAEVSIIGRLNHMNLIDMLGYCAEGKYRLLVYEYMDNGSLAQNLSSSLNALDWSKRYNIALGTAKGLAYLHEECLEWILHCDIKPQNILLDSDYKPKVADFGLCKLLNRNSNLDNSSFSRIRGTRGYMAPEWVFNLPITSKVDVYSYGIVVLEMITGRSATAGTQITELEAESYHHERLVTWVREKRKKGSEVGSCWVDQIVDPALGSNYERNEMEILATVALECVEEDKNARPSMGQVAEKLQRYAHNS

SEQ ID NO: 140815 - protein, 153 aa, Glycine max
  Coding DNA Sequence Number=SeqID_24037
  Gene Ontology: Mol. function=protein serine/threonine kinase activity; Cellular component=membrane; Biological process=protein amino acid phosphorylation
  Homolog annotation: Hit_ID=Q6DU55; Match level="QueryCoverage=81%, HitCoverage=20%, E-value=7e-22, Identity=42%"; Hit description=S -locus-like receptor protein kinase
VADFGLSKLLNRNSNLDNSSFSRIRGTRGYMAPEWVFNLPITSKVDVYSYGIVVLEMITGRSATAGTQITELEAESYHHERLVTWVREKRKKGSEVGSCWVDQIVDPALGSNYERNEMEILATVALECVEEDKNARPSMSQVAEKLQRYAHTS

SEQ ID NO: 140816 - protein, 119 aa, Glycine max
  Coding DNA Sequence Number=SeqID_24038
MVKPPLALAPRMTHLQDWRYSHVDVAFSIGETGHHHVKLQGHRLAVRASAFQSELCFSPLLSFIECLRAGSIIPGCIANANSESHVACVANARGDTLLPTWPVTPMPVAASPFSPVAMA

SEQ ID NO: 140817 - protein, 445 aa, Glycine max
  Coding DNA Sequence Number=SeqID_24039
  Homolog annotation: Hit_ID=Q1RTB4; Match level="QueryCoverage=82%, HitCoverage=86%, E-value=6e-28, Identity=28%"; Hit description=IMP dehydrogenase/GMP reductase
EVFTEAVVSLAQYYDQPLRCFMFGDFQMVPTIEEFEEILGCPLGGRKPYLFSGFLPSLSKIAAVIGDSAKELDRMKQTCNGVVGLPRKCLEDKAKDMASQEKWGPFADILALLIFGVVLFPNVDGLVDLAAIDAFLAYHHSKESPVVAILADLFDTFDRSCEKNSAQIASQSIGFLVGRKARKEFFSRVGTTLMVALIGTRGCINYNPALAIRQLGYPMRGAPTEGSLSPFLVKDLDVQGLNVIQRIHKVWRSPLRKDKELRGIRNGVIGGYHGWLRIHTRGLDWLSKLKVIDEENFEAPKEDEEVRALKLELGKARLAKEKFKSAATHIRKECTELQEENAATARALEQETKRARKEEYGREKFRGALWGSNNELKLRREERDRSRVHGMILKEELVACARSKRSLAQHLEATEQSMLAIIGQYKEELNQSVAHEQKLVEDFAQ

SEQ ID NO: 140818 - protein, 72 aa, Glycine max
  Coding DNA Sequence Number=SeqID_24040
MASSSVNAIIYYDGAIITTLNLSMFVSGSPKIVQLDNKMSFDALKQATRNNIILPNVQVVKDTFSITCIICR

SEQ ID NO: 140819 - protein, 826 aa, Glycine max
  Coding DNA Sequence Number=SeqID_24041
  Gene Ontology: Mol. function=protein serine/threonine kinase activity; Cellular component=cell surface; Biological process =protein amino acid phosphorylation
  Homolog annotation: Hit_ID=Q8W054; Match level="QueryCoverage=96%, HitCoverage=94%, E-value=1e-154, Identity=37%"; Hit description=S -receptor kinase PK3-like
  Pfam annotation: Domain name=B_lectin; Domain location=66-175; Score =104.6; E_value=2.9e-28; Accession=PF01453.15; Description=D-mannose binding lectin
  Pfam annotation: Domain name=Pkinase; Domain location=530-811; Score =185.8; E_value=1e-52; Accession=PF00069.15; Description=Protein kinase domain
  Pfam annotation: Domain name=Pkinase_Tyr; Domain location=530-811; Score=100.4; E_value=5.2e-27; Accession=PF07714.7; Description =Protein tyrosine kinase
  Pfam annotation: Domain name=S_locus_glycop; Domain location=204-327; Score=-15.4; E_value=0.0005; Accession=PF00954.11; Description=S -locus glycoprotein family
  Pfam module annotation: Pfam domain module=B_lectin::Pkinase::Pkinase_ Tyr::S_locus_glycop; Domain location=66-175::530-811::530-811::204-327
MASSTLLLALVILHNFQHSTQYSFSLSVENLKEDVIVSSPKATFTAGFYPVGENAYCFAIWYTQQPHTLVWMANRDQPVNGKLSTLSLLKTGNLALTDAGQSIVWSTNTITSSKQVQLHLYDTGNLVLLDNQQNRSSNIVVLWQSFDFPTNTLLPGQILTKNTNLVSSRSETNYSSGFYKLFFDFENVLRLMYQGPRVSSVYWPDPWLQNNNFGNGGTGNGRSTYNDSRVAVLDDFGYFVSSDNFTFRTSDYGTLLQRRLTLDHDGSVRVFSFNDGHDKWTMSGEFHLHPCYVHGICGPNSYCSYEPSSGRKCSCLPGHTWVDSQDWSQGCTPNFQHLCNSNTKYESRFLRIPDIDFYGYDYGYFGNYTYQQCENLCSQLCECKGFQHSFSEANAFFQCYPKTHLLNGNSQPGFMGSFFLRLPLSSHDEYENPVQNNRSGLVCGGDVGNVKMLERSYVQGEENGSLKFMLWFAGALGGIEVMCIFLVWCLLFRNNRTLPSSADRQGYVLAAAAGFQKFSYSELKQATKGFSEEIGRGAGGIVYKGVLSDDQVVAIKRLHEVANQGESEFLAEVSIIGRLNHMNLIGMLGYCAEGKHRLLVYEYMENGSLAQNLSSNSNVLEWSKRYNIALGTARGLAYLHEECLEWILHCDIKPQNILLDSEYQPKVADFGLSKLLNRNNVNNSSFSRIRGTRGYMAPEWVYNLSITSKVDVYSYGIVVLEMITGRSPTTGVRITELEAESDHRERLVTWVREKKMKGSEAGSSWVDQIIDPALGSNYAKNEMEILARVALECVEEEKNVRPNMSQVVEKLQNHSMHTIVDGLNKE

SEQ ID NO: 140820 - protein, 571 aa, Glycine max
  Coding DNA Sequence Number=SeqID_24042
  Gene Ontology: Mol. function=protein serine/threonine kinase activity; Cellular component=cell surface; Biological process =protein amino acid phosphorylation
  Homolog annotation: Hit_ID=Q8W054; Match level="QueryCoverage=94%, HitCoverage=69%, E-value=2e-87, Identity=36%"; Hit description=S -receptor kinase PK3-like
  Pfam annotation: Domain name=B_lectin; Domain location=72-180; Score =104.5; E_value=3.2e-28; Accession=PF01453.15; Description=D-mannose binding lectin
  Pfam annotation: Domain name=PAN_2; Domain location=351-420; Score= -6.3; E_value=0.006; Accession=PF08276.2; Description=PAN-like domain
  Pfam annotation: Domain name=S_locus_glycop; Domain location=209-339; Score=-41.1; E_value=0.038; Accession=PF00954.11; Description=S-locus glycoprotein family
  Pfam module annotation: Pfam domain module=B_lectin::PAN_2::S_locus _glycop; Domain location=72-180::351-420::209-339
MQKLRMATSPLSQLLLSLILLQNFHHSHSFSLSVENHNEDVIVSSPNATFTAGFYPVGENAFCFAIWYTRPPRTVVWMANRDQPVNGKRSTLSLLGTGNLELTDAGQFIVWSTNTATPSKQNPRLHLYDTGNLVLIAILDNSEDHVLWQSFDFPTDTLLPNQPLSKSTNLVSSRSGTNYSSGHYKLFFDFENVLRLMYQGPRVSSVYWPYAWLQSNNFGNGNGRSTFNDSRVVVLDDFGKLVSSDNFTFTTIDSGTVVLRRRLTLDHDGNARVYSIRDGEDNWKVTGIFRPQPCFIHGICGPNSYCSNKPTTGRTCSCLPVHNEKIMETGYRWVDSQDWSQGCESSFQLWCNNTEKESHFLRLPEFDFYGYDYGYYPNHTYEQCVNLCLELCECKGFQHSFSEKSDSTSQCYLKTQLLNGHHSPGFKGSFSLRLPLSHDYDEKAILNNDNGLVCEGNSGGAKELERPYVEEKENGSVKFMLWNNADKQAYVLAAETGFRKFSYSELKQATKGFSQEIGRGAGGIVYKGVLSDDQVVAIKRLHEVVNQGESEFLAERESIDCWFMSTWRMVL

SEQ ID NO: 140821 - protein, 264 aa, Glycine max
  Coding DNA Sequence Number=SeqID_24043
  Gene Ontology: Mol. function=hydrolase activity; Biological process =intracellular signaling cascade
  Pfam annotation: Domain name=DUF1723; Domain location=143-192; Score =56.8; E_value=7e-14; Accession=PF08330.1; Description=Protein of unknown function (DUF1723)
MPPTKINDLDIIDWSNERLTTKVSLKKSTAYVSLIRPTHVQQRRSHRQNQWPRYHRLKQCTFNDQDPTNKINGLVLLDISTKAQKLAYTASTLLRKQNLHKFREVTNDVIQSYAQTMPSPDPRIKPLLVQARVSGVAKLEQVTINNSLVIALVERWRPESLTFHLPVGEFIITLEDVALQLGLHVDGVVPLEIALVGLTLKLKWLKEHMLTFLVEPTPQKLATHCKAYILGLIGGVLMPDKPGNRFHLMYLPLLADFDWDDWYN

SEQ ID NO: 140822 - protein, 248 aa, Glycine max
  Coding DNA Sequence Number=SeqID_24044
  Gene Ontology: Mol. function=zinc ion binding; Cellular component =intracellular; Biological process=regulation of transcription, DNA -dependent
  Homolog annotation: Hit_ID=Q1S9J1; Match level="QueryCoverage=80%, HitCoverage=83%, E-value=2e-55, Identity=56%"; Hit description=Zinc finger, B-box
  Pfam annotation: Domain name=zf-B_box; Domain location=1-47; Score =41.2; E_value=3.5e-09; Accession=PF00643.14; Description=B-box zinc finger
  Pfam annotation: Domain name=zf-B_box; Domain location=53-100; Score =54.5; E_value=3.6e-13; Accession=PF00643.14; Description=B-box zinc finger
  Pfam module annotation: Pfam domain module=zf-B_box::zf-B_box; Domain location=1-47::53-100
MKIQCDVCDKVEASVFCPADEAALCHSCDRTIHRANKLATKHARFSLHYPTSKDFPLCDICQERRAYLFCQEDRALLCRECDVPIHRANEHTQKHNRFLLTGVKLSGTCLDPASSSTNYTNNNRVTGSEGRNDARSRMNRPRSSVSNEENASNSSCKVEDNVASDTGSISTSSISEYLIETIPGYCFEDLLDASFAPNGFCKVLFNNFEPCLLLLLQKQNFDHPWAFQDQKRTSGDTMAVPFLKLVIH

SEQ ID NO: 140823 - protein, 95 aa, Glycine max
  Coding DNA Sequence Number=SeqID_24045
MARSGDLTLELEPIAFTRSWCFSSWMEFCRIRKEGATNEEITTTITLANAKKFIDKLHQEGWIFIMRDLDCNRECKCLHQASVFQLHLRAINLSY

SEQ ID NO: 140824 - protein, 90 aa, Glycine max
  Coding DNA Sequence Number=SeqID_24046
  Subcellular localization annotation: CTP_CleavageSite=37; ConfidenceScore=5.14e-01
MMMQKKKKRNTKKWRLTTFFSATILRKVEVFRNWRIRHRLRRGGVSWLGASNQRVLTSPQSLPWMNQSTDPKRRICRRIEGTRTCWLGIN

SEQ ID NO: 140825 - protein, 132 aa, Glycine max
  Coding DNA Sequence Number=SeqID_24047
MSEVESKNFLRKAELRDHNSIWHPSLHPYVKINVDGSWNEANYEMGGGGVDNNFVGREGMSLLCVNQTACMSFPCLSAANISMMSFDKQVNLVVVPTECNGIAHMLVGWGSTGQDIDLQRDHVPTFFYLLEL

SEQ ID NO: 140826 - protein, 166 aa, Glycine max
  Coding DNA Sequence Number=SeqID_24048
  Gene Ontology: Cellular component=mitochondrion; Biological process =protein complex assembly
  Homolog annotation: Hit_ID=O22958; Match level="QueryCoverage=56%, HitCoverage=43%, E-value=1e-18, Identity=59%"; Hit description =Expressed protein
  Subcellular localization annotation: CTP_CleavageSite=39; ConfidenceScore=5.32e-01
MQRVSPTSTIWRTIVSKARKNVFFINDPFAARSFSAVPVVAAAKKLHQPEIPSDFQKWGSVGFCRTSKFASGFNPLQPKPLDSIVDVHRLKDRYPEDIASVWDDISSSQHSFFILAADILSFLYGGEVDTRQCLFKTGVKDIATCPLIFMDSIVIRYANKDILIGN

SEQ ID NO: 140827 - protein, 801 aa, Glycine max
  Coding DNA Sequence Number=SeqID_24049
  Gene Ontology: Mol. function=protein serine/threonine kinase activity; Cellular component=cell surface; Biological process =protein amino acid phosphorylation
  Homolog annotation: Hit_ID=Q2QWY4; Match level="QueryCoverage=97%, HitCoverage=98%, E-value=1e-165, Identity=40%"; Hit description=D -mannose binding lectin family protein, expressed
  Pfam annotation: Domain name=B_lectin; Domain location=63-167; Score =101.1; E_value=3.3e-27; Accession=PF01453.15; Description=D-mannose binding lectin
  Pfam annotation: Domain name=PAN_2; Domain location=329-400; Score =0.1; E_value=0.0013; Accession=PF08276.2; Description=PAN-like domain
  Pfam annotation: Domain name=Pkinase; Domain location=513-794; Score =188.1; E_value=2.2e-53; Accession=PF00069.15; Description=Protein kinase domain
  Pfam annotation: Domain name=Pkinase_Tyr; Domain location=513-794; Score=105.6; E_value=1.4e-28; Accession=PF07714.7; Description =Protein tyrosine kinase
  Pfam annotation: Domain name=S_locus_glycop; Domain location=196-317; Score=-18.6; E_value=0.00086; Accession=PF00954.11; Description=S -locus glycoprotein family
  Pfam module annotation: Pfam domain module=B_lectin::PAN _2::Pkinase::Pkinase_Tyr::S_locus_glycop; Domain location=63-167::329- 400::513-794::513-794::196-317
MASLLLPFLVSLIIFHNFQHTSSFSLSVEKDVIVSSPEGTFTAGFHPVGENAYCFAIWYTQPPRTVVWMANRDQPVNGKRSTLSLLGVGNLVLTDADQFQVWSTNTLTSSKQVQLRLYDTGNLVLLNNSNGFVLWQSFDFPTDTLLPNQPLRKTTNLVSSISGTNYSSGYYRLFFDFENVLRLMYQGPRVTSVYWPFAWLQNNNFGNNGNGRSTFNDTRVVLLDDFGRVVSSDNFTFTTSDYGTVLRRRLTLDHDGNVRLYSIKDGEDNWKVSGQFRPQPCFIHGICGPNSYCTNQPTSGRKCICLPGHRWVDSEDWSQGCIPNFQPWCSNNSTEQESHFLQLPEMDFYGYDYALYQNHTYQRCVNLCSRLCECKGFQHSYSKEGGDIGQCYLKTQLLNGHRSGGFSGAFFLRLPLSLQDYDDRAILNNSNVLVCEGEVKVLERPYVEEKENAFVKFMLWFAIALGGIEFVIFFLVWCLLFKNDADKEAYVLAVETGFRKFSYSELKQATKGFSDEIGRGGGGTVYKGLLSDNRVVAIKRLHEVANQGESEFLAEVSIIGRLNHMNLIGMLGYCAEGKYRLLVYEYMENGSLAQNLSSSSNVLDWSKRYNIALGTARGLAYLHEECLEWILHCDIKPQNILLDSDYQPKVADFGLSKLLNRNNLDNSTFSTIRGTRGYMAPEWVFNLPITSKVDVYSYGIVVLEMITGRSPTTGVQITEIEAKSPHHERLVTWVREKRKKGSEMGSSWVNQIVDPALGSDYDMNKMEMLATMALECVEEEKDVRPTMSHVAERLQSHEHDS

SEQ ID NO: 140828 - protein, 77 aa, Glycine max
  Coding DNA Sequence Number=SeqID_24050
MVAQRTPNKKRCRDDHSCDSAKDHFGAIAARPGELKLSDEAVSSPRRAGTRPVAFRIGLQVHEMKVVTSTDHDQVCT

SEQ ID NO: 140829 - protein, 280 aa, Glycine max
  Coding DNA Sequence Number=SeqID_24051
  Gene Ontology: Mol. function=drug transporter activity; Cellular component=membrane; Biological process=multidrug transport
  Homolog annotation: Hit_ID=Q1SD91; Match level="QueryCoverage=99%, HitCoverage=56%, E-value=1e-129, Identity=79%"; Hit description =Multi antimicrobial extrusion protein MatE
  Pfam annotation: Domain name=MatE; Domain location=7-167; Score =131.2; E_value=2.9e-36; Accession=PF01554.9; Description=MatE
MWIVAAPAIFTRFTTFGLSVISQAFIGHIGSKELAAYALVFTVIIRFANGILLGMSSALSTLCGQAYGAKEYDMMGVYLQRSSIVLFLTALCLLPLFIFTSPILTLLGQDESIARVARNVSLWSIPILFAYIVSFNCQTFLQSQSKNVIIAFLATLSIIIHVSLSWLFTIQFKYGIPGAMISTILAYWIPNVGQLIFITCGWCPETWKGFSSLAFKDLWPVVKLSLSAGAMLCLELWYNTILILLTGNMKNAEVQIDALSICININGWEMMIAFGFMAAA

SEQ ID NO: 140830 - protein, 99 aa, Glycine max
  Coding DNA Sequence Number=SeqID_24052
MTKLGLCLSSGPPPLDDKRVRITVRMTKLGLCLSSGPPPLDDKRVRITVRMTKLGLCLSSGPPPLDDKRVRITVRYLRVSWVQNDQTWSLLVIGPAASG

SEQ ID NO: 140831 - protein, 93 aa, Glycine max
  Coding DNA Sequence Number=SeqID_24053
MGELLRARKKMDPPLEMVDQLALVQPMQVWAQEEQPRWVSIAEVPGLLCIIITSPWNKLCSIATAVWELWASGPADAEGGAGVDDEGISSTLA

SEQ ID NO: 140832 - protein, 45 aa, Glycine max
  Coding DNA Sequence Number=SeqID_24054
MATDQRHPAGYAFSVEFQPQCRTGCHDITLQNMQIRCVRMNRLNK

SEQ ID NO: 140833 - protein, 108 aa, Glycine max
  Coding DNA Sequence Number=SeqID_24055
  Gene Ontology: Mol. function=transferase activity, transferring glycosyl groups; Biological process=metabolic process
  Homolog annotation: Hit_ID=Q8W4G1; Match level="QueryCoverage=62%, HitCoverage=13%, E-value=6e-14, Identity=49%"; Hit description=UDP -glucose glucosyltransferase
MNIMIDDASNQMISVSELMLHQTRVQSIIAQLSLILYLPYANYLADRHLDSAIDWIPGLKNITLRDLAGIYRTTNPNDILLDFMVEQIKATSKASAIILPTFDAFEHE

SEQ ID NO: 140834 - protein, 91 aa, Glycine max
  Coding DNA Sequence Number=SeqID_24056
MCFREENSSRGAFVTLSRHFHEQIHEAFPPFFIVLRPLFVRSPVFNRGRQRRRGEGRHHPLGNKPWKKELHHQGCALDKKLEEDALMEEKK

SEQ ID NO: 140835 - protein, 86 aa, Glycine max
  Coding DNA Sequence Number=SeqID_24057
MLEEVLTLFMQASMCTNKNIEPSIKKLEMQVEQLANKLEAKSNNEDLPFLMDDALAITIPKEEYCAGLEACKNSLRDAILAPKGIG

SEQ ID NO: 140836 - protein, 331 aa, Glycine max
  Coding DNA Sequence Number=SeqID_24058
  Gene Ontology: Mol. function=DNA binding
  Homolog annotation: Hit_ID=Q1RUD8; Match level="QueryCoverage=97%, HitCoverage=63%, E-value=2e-39, Identity=34%"; Hit description=IMP dehydrogenase/GMP reductase
MGTNQIGKRFYQVKIKSLDVISLKELGRLMGPLQMQAFRKAYGKILDLSIAEVFTEAIVSLTQYYDQPLRCLTFGDFQMVPTVEEFEEILGCPLGGRRPYLFFGFLPSLSKIVVVVRGSARELDRVKQTRNGVVGLPWKYLEGKARDMANQEEWVPFANVLALLIFGVVLFPKVDGLVDLATIDAFLAYHHSKESPVVAILADLFDTFDRRCERSSARIVCCLPALCVWLVLHLFQQDIRHPCPLQSHRLCVKKRRLDWDQYLAGIGGRTINWFRRWKEGKEGVLFSCGDYPNIPLKGTRGCINYNPALAIRQLGYPMREAPMEESLSPFL

SEQ ID NO: 140837 - protein, 207 aa, Glycine max
  Coding DNA Sequence Number=SeqID_24059
  Gene Ontology: Mol. function=structural constituent of ribosome; Cellular component=ribonucleoprotein complex; Biological process =translation
  Homolog annotation: Hit_ID=P42353; Match level="QueryCoverage=33%, HitCoverage=50%, E-value=4e-33, Identity=98%"; Hit description =Chloroplast 50S ribosomal protein L16
  Pfam annotation: Domain name=Ribosomal_L16; Domain location=1-87; Score=110.0; E_value=7e-30; Accession=PF00252.8; Description =Ribosomal protein L16
YALQALEPAWITSRQIEAGRRAMSRNVRRGGQIWVRIFPDKPVTVRPTETRMGSGKGSPEYWVAVVKPGNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 140838 - protein, 128 aa, Glycine max
  Coding DNA Sequence Number=SeqID_24060
  Subcellular localization annotation: CTP_CleavageSite=53; ConfidenceScore=5.58e-01
MRGSGEFVPFLDTTSRGSKMPQRTFLRRRHGPSVVESPTVATYPSVGGRRVTRGMRVPRKEYARSRHQRLFEENVGKTGKDPIYELFSERFGSCIYARGRVFPFAPTYSSIWDEKIRPTWFFRNKVFC

SEQ ID NO: 140839 - protein, 143 aa, Glycine max
  Coding DNA Sequence Number=SeqID_24061
  Gene Ontology: Mol. function=helicase activity
  Homolog annotation: Hit_ID=Q1SN45; Match level="QueryCoverage=99%, HitCoverage=8%, E-value=9e-26, Identity=45%"; Hit description=AAA ATPase
MMLTVCKGPTSFEDLRTVDNVQYPTYKEACFAMGFLQDDKEFIEAIKEAKDQGSTHYIRMLFVLLLLTATMSKPEQVWDQTWHWMADDIVYNYKKIINRFSLMIELFRIRSCLKLKNCCKQIKDRLETILQCHIQRMQIVHPI

SEQ ID NO: 140840 - protein, 169 aa, Glycine max
  Coding DNA Sequence Number=SeqID_24062
AITSPGSRLIAGGSHERQSIHGAPNKSGEWRIALGNHFALLQTHWWRMHERQSIHGAPNKSGEWRIALGNHFAWLQTRWWRMHERQSIHGAPNKSGEWRIALGNHFAWLKTHWWRMHERQSIHGTPNKSGEWRIALGNHSPGSTLIGGGCMNNNQFMGLQIKVENGELH

SEQ ID NO: 140841 - protein, 218 aa, Glycine max
  Coding DNA Sequence Number=SeqID_24063
  Gene Ontology: Mol. function=transporter activity; Cellular component= integral to membrane; Biological process=auxin mediated signaling pathway
  Homolog annotation: Hit_ID=Q8H1L0; Match level="QueryCoverage=92%, HitCoverage=39%, E-value=6e-76, Identity=68%"; Hit description=PIN -like protein
  Subcellular localization annotation: CTP_CleavageSite=24; ConfidenceScore=5.30e-01
MKVLISIIWLFGDVFRSSGIEQVRVRNRVVPYSYSSSSSRVVSWSSGSREAINIVGTKVRITTNSHHGVEIGVVETGATWSRVSRGLKRVNLSIGEIGRVMVGGRKALGPSRKDVRSGSIGFSDSDMELAILFDLGISFQRVVSSVKRHDIRVDMDGDNGTGSVWELLKDQQSDTFVLEHEEHQGVPDDALEDHNLDHQTPRKMNQMMHWGSTNYKNQ

SEQ ID NO: 140842 - protein, 396 aa, Glycine max
  Coding DNA Sequence Number=SeqID_24064
  Gene Ontology: Mol. function=catalytic activity; Biological process =protein amino acid phosphorylation
  Homolog annotation: Hit_ID=Q9FM53; Match level="QueryCoverage=74%, HitCoverage=60%, E-value=7e-47, Identity=35%"; Hit description =Arabidopsis thaliana genomic DNA, chromosome 5, P1 clone:MJH22
  Pfam annotation: Domain name=DUF860; Domain location=1-305; Score =418.4; E_value=1e-122; Accession=PF05898.4; Description=Plant specific of unknown function (DUF860)
MSLKTLGKFKRDLGLDKKRRLIAVLKKFPAVFQIMEEGVFSLKFKMTPEAERLYFEETRVRNEMEELVVVKLRKLLMMSLEKRILLEKIAHLKTDLGLPQEFRDTVCHRYPQYFKVVATQRGPALELTHWDPELAVSAAELAAEENRIREMEEQNLIIDRPPKFNRVKLPKGLNLSKGEMRKIMQFRDLPYFSPYSDFSGLRPGSREKEKHACGVVHEILSLTLEKRTLVDHFTHFREEFRFSQQLRGMLIRHPDMFYVSLKGDRDSVFLREGYRDSQLVEKDRLLLIKEKLRTLVNVPRFPKGPARRIVEDSMRESDGREDESGQEEEEWSEDVDNLLSDDDWSDEDDDDLPPDFDEDGELLEIGQGKTIKQDSRQNDEMVLLPVFADGRPREQW

SEQ ID NO: 140843 - protein, 141 aa, Glycine max
  Coding DNA Sequence Number=SeqID_24065
LRNHDLRSPRTTYLPPLPYSKLKHTPRSHLIRFEESQIHTKDVDLAANTRPTAERRGGGVTEERREAKRENGQLGEEDSVSELKTKGNYLCNSTELKLVVSRTGAVNCVDADSISDLDLLMNLCDELQEGDSLVRCLSVMF

SEQ ID NO: 140844 - protein, 291 aa, Glycine max
  Coding DNA Sequence Number=SeqID_24066
MPGSIMVSVLEFIDLPLSSSTSIRASLGKIEYQVNDKGNLSFPLTSLRDDLIFKIQDAEGNEISRTGVQIKLILEKGVLEDNFPLGGGHLRLKLQFILSDEERDRIRSLRQSALKKKHELLSSGRRAEESDSRTMIGDAALPFRRNDEVSESPKKQPQQEAQLQDPAGSGDGKESDTRNNISDQYRESSSTIPVSQAVTLTRSPQKGKEPFYQSPNLNRSSSEKHPQRDIGSEEIAILFGSEKKEALTSNLIQPNLEQGGIQYSEKRTSLGRIPSNVKKMISAFEGGLAQV

SEQ ID NO: 140845 - protein, 315 aa, Glycine max
  Coding DNA Sequence Number=SeqID_24067
  Gene Ontology: Mol. function=sequence-specific DNA binding; Cellular component=nucleus; Biological process=regulation of transcription, DNA-dependent
  Homolog annotation: Hit_ID=Q9SZI6; Match level="QueryCoverage=91%, HitCoverage=89%, E-value=1e-33, Identity=33%"; Hit description =Putative GATA transcription factor 20
  Pfam annotation: Domain name=GATA; Domain location=176-211; Score =73.1; E_value=9.1e-19; Accession=PF00320.17; Description=GATA zinc finger
MIPTYRYSVSSPMPIDLNEDHTHHLFSTNHQASCSSSSLSYSILFNPDQDQGGSCSDWKSKHLQSDEEAQKIVPSSGLSEKDENKSDLKLRVWKKEDKCENFQGEDNSTKWMPLKMRMMRRLMVSDQTGSDDTEGMISNSQKIKYEEKNSPLSPLGTDDSNYNSSSNHSNITVRVCSDCHTTKTPLWRSGPKGPKSLCNACGIRQRKVRRAIAAAATSNGTNPVEAEKSQVKKGNTLHSKGMKSKTEGAQQMKKNRKLGARYRKRFGAFEDLTVRLSKNFALQQVFPQDEKEAAILLMALSYGLLHGFPTDRYIT

SEQ ID NO: 140846 - protein, 474 aa, Glycine max
  Coding DNA Sequence Number=SeqID_24068
  Gene Ontology: Mol. function=protein kinase activity; Cellular component=integral to membrane; Biological process=protein amino acid phosphorylation
  Homolog annotation: Hit_ID=Q9FL51; Match level="QueryCoverage=96%, HitCoverage=76%, E-value=1e-153, Identity=57%"; Hit description =Receptor protein kinase-like protein
  Pfam annotation: Domain name=LRR_1; Domain location=23-45; Score =13.8; E_value=0.61; Accession=PF00560.23; Description=Leucine Rich Repeat
  Pfam annotation: Domain name=LRR_1; Domain location=47-69; Score =20.4; E_value=0.0066; Accession=PF00560.23; Description=Leucine Rich Repeat
  Pfam annotation: Domain name=LRR_1; Domain location=70-93; Score=8.1; E_value=8.7; Accession=PF00560.23; Description=Leucine Rich Repeat
  Pfam annotation: Domain name=Pkinase; Domain location=192-451; Score =96.8; E_value=6.7e-26; Accession=PF00069.15; Description=Protein kinase domain
  Pfam annotation: Domain name=Pkinase_Tyr; Domain location=192-451; Score=35.1; E_value=1.3e-14; Accession=PF07714.7; Description =Protein tyrosine kinase
  Pfam module annotation: Pfam domain module=LRR_1::LRR_1::LRR _1::Pkinase::Pkinase_Tyr; Domain location=23-45::47-69::70-93::192 -451::192-451
MSIVNLSHNSLSGQIPELKKCRKLVSLSLADNSLIGEIPSSLAELPVLTYLDLSDNNLTGSIPQGLQNLKLALFNVSFNQLSGKVPYSLISGLPASFLEGNPDLCGPGLPNSCSDDMPKHHIGSTTTLACALISLAFVAGTAIVVGGFILYRRSCKGDRVGVWRSVFFYPLRITEHDLLMGMNEKSSRGNGGAFGKVYVVNLPSGELVAVKKLVNFGNQSSKSLKAEVKTLAKIRHKNVVKILGFCHSDESVFLIYEYLHGGSLGDLISRPNFQLQWGLRLRIAIGVAQGLAYLHKDYVPHLLHRNVKSSNILLEANFEPKLTDFALDRVVGEAAFQSVLNSEAASSCYIAPENGYSKKATEQLDIYSFGVVLLELVSGRKAEQTESSDSLDIVKWVRRKVNITNGVQQVLDPKISHTCHQEMIGALDIALRCTSVVPEKRPSMVEVVRGLLSLESRTCIANLHEPYEEPSIPV

SEQ ID NO: 140847 - protein, 123 aa, Glycine max
  Coding DNA Sequence Number=SeqID_24069
MAELDITSQGSGGGRVTLLLCLEDEAGITSSNFFTDIGEGKDDKKGHSCLVGVGKVLLKLSNMEVSEGELLLESGSLFGHTFSIGGHLLLEFSTPPPILAYFFFYKEIQIKTNAILIIKHYYP

SEQ ID NO: 140848 - protein, 382 aa, Glycine max
  Coding DNA Sequence Number=SeqID_24070
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q9LZV3; Match level="QueryCoverage=99%, HitCoverage=90%, E-value=1e-162, Identity=67%"; Hit description=(1 -4)-beta-mannan endohydrolase-like protein
  Pfam annotation: Domain name=Cellulase; Domain location=13-327; Score= -38.9; E_value=6.5e-05; Accession=PF00150.8; Description=Cellulase (glycosyl hydrolase family 5
MEENEWQMVQTKGNQFVVNDQPFYVNGFNTYWLMVFAADESTRGKVTEVFKHASSVVYDEDVFKALDFVVSEARKYKIRLILSLVNNWEAYGGKPQYVKWGNAAGLNLTSDDDFFSHPTLRSYYKAHTVLNRVNTFTNITYKEDPTIFAWELMNEPRCTSDSSGDVLQDWIKEMAFYVKSIDPKHLVEIGLEGFYGPSTPQKYQFNPNSYAHEVGTDFIRNHQVLGVDFASVHIYPDSWISQSVADSHLPFIKTWMEAHIEDAEKYLGMPVVFAEFGVSAKAPGYNSTYRDNLINTVYKTILNSTKKGGSGAGSLVWQLFPDGTDYMDDGYAIVLSKSPSTSSIISLQSTRLALFNSLCSKKCRWGCKKRNVLEKVLYHDEL

SEQ ID NO: 140849 - protein, 234 aa, Glycine max
  Coding DNA Sequence Number=SeqID_24071
  Gene Ontology: Mol. function=hydrolase activity, hydrolyzing O -glycosyl compounds; Cellular component=membrane; Biological process =carbohydrate metabolic process
  Homolog annotation: Hit_ID=Q2MK92; Match level="QueryCoverage=91%, HitCoverage=62%, E-value=1e-79, Identity=56%"; Hit description=Acid alpha galactosidase 1
MVRVRANTVSLPMALVPLLQWAVADYVHGKGLKLGIYSAAGYFTCANVMPGSLGYGEQDAKTFASWGVDYLKYDICNNGGTKPIDRGDMHPALWGYQVGNSWIITDDIRDNWDSMLSKADMNEVYADYARPGGWNELPQAPLIIGCDVRNMTEDTKEILSNTEVIAVNQDPLGKQGKKVRMESTLEVWAGPLSEYRVDVVLLNKYSDLRASITALWEDIGLHPSTVVESRDLWE

SEQ ID NO: 140850 - protein, 497 aa, Glycine max
  Coding DNA Sequence Number=SeqID_24072
  Gene Ontology: Mol. function=protein serine/threonine kinase activity; Cellular component=chloroplast; Biological process=protein amino acid phosphorylation
  Homolog annotation: Hit_ID=Q1RY80; Match level="QueryCoverage=95%, HitCoverage=87%, E-value=0.0, Identity=74%"; Hit description=Protein kinase
  Pfam annotation: Domain name=Pkinase; Domain location=136-478; Score =33.7; E_value=1.4e-10; Accession=PF00069.15; Description=Protein kinase domain
  Pfam annotation: Domain name=Pkinase_Tyr; Domain location=136-405; Score=-136.6; E_value=0.00044; Accession=PF07714.7; Description =Protein tyrosine kinase
  Pfam module annotation: Pfam domain module=Pkinase::Pkinase_Tyr; Domain location=136-478::136-405
  Subcellular localization annotation: CTP_CleavageSite=64; ConfidenceScore=5.34e-01
MASLLLPPTATSSTLKHNNQILKLKPNNNAHATCNVFLSNSNHYRFNSAKCHALFDDVAKGLLESSSVGVDQFQRVTEGLSDMQRWVFLVFGGLTWIYLTARPGVLVGAIDAYLLAPLQLGLDNLSGRRNLKRSDFVVGDKLGEGSFGVVYSGVLLPKNVDVDVLQKRGRAKTTQLDAKSKDKVILKKVKVGIQGAEEFGDYEEWFNYRLSRAAPETCADFLGTFVADQTNSQFTKGGKWLVWKFEGDRTLADYMKDRNFPSNLESVMFGRVLQGVDSSKRNALIIKQIMRQIITSLRKIHDTGIVHRDVKPANLVVTKRGQIKLIDFGAATDLRIGKNYVPNRTLLDPDYCPPELYVLPEETPSPPPEPIAAFLSPVLWQLNSPDLFDMYSAGIVLLQMAIPSLRSPAALKNFNLELKTCGYDMKKWRDYTRLRPDLQILDSESSRGWDLATKLVSERGSLRRGRLSAAAALRHPYFLLGGDQAAAVLSKLNLNRK

SEQ ID NO: 140851 - protein, 139 aa, Glycine max
  Coding DNA Sequence Number=SeqID_24073
  Gene Ontology: Mol. function=glutamate dehydrogenase activity; Cellular component=mitochondrion; Biological process=amino acid metabolic process
  Homolog annotation: Hit_ID=Q5F2M8; Match level="QueryCoverage=78%, HitCoverage=32%, E-value=2e-36, Identity=62%"; Hit description =Glutamate dehydrogenase 2
  Pfam annotation: Domain name=ELFV_dehydrog_N; Domain location=1-89; Score=10.3; E_value=1.1e-07; Accession=PF02812.8; Description =GluLeuPheVal dehydrogenase, dimeri
MQVDPDEVNALAQLMTWKTVVADIPYGGAKGDISCNPRELNVSELGSLTSVFFQKIDDLICIQRDVFAPDMRTNAQDLGGSLGRKVATRLRVIFATKALFVEYEKSISDMTLSSRYFFTYYDHHGSRHRYSYLIPFSCI

SEQ ID NO: 140852 - protein, 238 aa, Glycine max
  Coding DNA Sequence Number=SeqID_24074
  Gene Ontology: Mol. function=alkanesulfonate monooxygenase activity; Cellular component=intracellular; Biological process=two-component signal transduction system (phosphorelay)
  Homolog annotation: Hit_ID=Q1AV42; Match level="QueryCoverage=64%, HitCoverage=39%, E-value=7e-65, Identity=74%"; Hit description =Alkanesulfonate monooxygenase
MSKQFSFCQAFREGAAVDGEKRGMPAWTVVMQIPRDHLFAGAGFAHNQYRGVGGCEFIQQRLESQRCRVDQARISIMADSAHESINVFWFLPTHGDGRYLGTTEGGRPVDLAYLQQVALAADNLGFYGVLIPTGKSCEDSWLVAAALAPMTRRLRYLVAVRPGLQPPTLAARMAPTLDRLSEGRLLINVVTGGDPVENKGDGIFLNHSERYEVTREFLDVYSQLMSGEKVDYQGEHIQ

SEQ ID NO: 140853 - protein, 45 aa, Glycine max
  Coding DNA Sequence Number=SeqID_24075
MASKRILKVLKDLQKDPPTSCSADLEVVLFIDDGKGNDAILTVKM

SEQ ID NO: 140854 - protein, 292 aa, Glycine max
  Coding DNA Sequence Number=SeqID_24076
  Gene Ontology: Mol. function=DNA binding; Biological process=DNA integration
  Homolog annotation: Hit_ID=Q1SS72; Match level="QueryCoverage=64%, HitCoverage=15%, E-value=1e-25, Identity=34%"; Hit description =Integrase, catalytic region
  Pfam annotation: Domain name=zf-CCHC; Domain location=135-152; Score =8.4; E_value=0.041; Accession=PF00098.13; Description=Zinc knuckle
  Pfam annotation: Domain name=zf-CCHC; Domain location=159-176; Score =8.2; E_value=0.045; Accession=PF00098.13; Description=Zinc knuckle
  Pfam module annotation: Pfam domain module=zf-CCHC::zf-CCHC; Domain location=135-152::159-176
MLLPSGLIFAKGSLKAICCVLLSYNKRFTLSSKELDNFRPLTPCTCSAKDFHHQDFIIWFLKGLDERFAMVRSQILLLDPLPSANKVFSMIIQHERQHFTNISPSLDVNPFANVVSSRSRDIPQSGGGKSNSSNHKCDHCGRLGHTSDVCYQKQGNTIPKCQHCTRYGHTMDICYARFGYPPGHPKYSGQPHLPNKTGTFGGGAAGGAAVNNTTRKGNRTLHGEEHKDGSATIPGPNITQAQFQQLMALLQKTQVGGANTNDIPIRANLSHSSPKSVSDLCGNEHVEDDWFG

SEQ ID NO: 140855 - protein, 466 aa, Glycine max
  Coding DNA Sequence Number=SeqID_24077
  Homolog annotation: Hit_ID=Q5QLZ3; Match level="QueryCoverage=90%, HitCoverage=99%, E-value=3e-39, Identity=41%"; Hit description =Gastric mucin-like protein
MNSRNVNVNQHHHRRARYAHHHYCYFWIGKLSFESAKLATSGIDDLLSSTEGGKHDYDWLLTPPGTPHLPSSEGESQPTLVPPRSNLGRLMSNTNVSRLSVSQSENNNHSRPSRSGSVTRSPNRSSSILNTRPSSPITRSPSAARPSTPTSRTTSTSTSTPTPPRVLLPRSIPSPTNSSSIDINKTRTSQGSRPSQSATSRSPSRPSTPTRRHSLRPLPVVPPDFPLETPPNLRTTLPADRPVSAGRSRPGAVVTLPSKPNSEMQAPVSMSRRQPSPIANRGRLSEYTGKGRGHTNAADASEVVARRSVKCSTTASENSGLGRTISKKSLDMAIRHMDVRNSSGTLRSVPNAKLYPQSIRTSTPKTHHSRGLSVPVSMNNISGSLQRRNNNNNNMKNGREIDERQKQYLGKLSEVLDVYESYRYDSLLLKEDLNNTNWLRSVDDKCDQGPIFDNGFESLPEPFGLF

SEQ ID NO: 140856 - protein, 465 aa, Glycine max
  Coding DNA Sequence Number=SeqID_24078
  Gene Ontology: Mol. function=protein serine/threonine kinase activity; Cellular component=membrane; Biological process=protein amino acid phosphorylation
  Homolog annotation: Hit_ID=Q8S407; Match level="QueryCoverage=75%, HitCoverage=77%, E-value=1e-113, Identity=60%"; Hit description =Similar to putative receptor protein kinase from
  Pfam annotation: Domain name=Pkinase; Domain location=117-419; Score =111.4; E_value=2.7e-30; Accession=PF00069.15; Description=Protein kinase domain
  Pfam annotation: Domain name=Pkinase_Tyr; Domain location=117-419; Score=101.7; E_value=2.2e-27; Accession=PF07714.7; Description =Protein tyrosine kinase
  Pfam module annotation: Pfam domain module=Pkinase::Pkinase_Tyr; Domain location=117-419::117-419
MPLRVLQAEATSPSNESHAPQHKSGSSLFYILGGLVVLAIVLIFLYVVWKRIKRPAQTMTVASKEHQEFGKHNESAEVMKMIFSSNQQSGSKEFFSGNLRTISCFDYQTLKKATENFHPDNLLGSGGFGPVYQSFRCQQKWPTCSFTATLLIYIISKLTKETGTGKLVDGRLVAVKKLALNKSQQGEKEFLVEVRTITSIQHKNLVRLLGCCVDGPQRLLVYEYMKNRSLDLFIHGNSDQFLNWSTRFQIILGVARGLQYLHEDSHQRIVHRDIKASNILLDDKFHPRIGDFGLARFFPEDQAYLSTQFAGTLGYTAPEYAIRGELSEKADIYSFGVLVLEIICCRKNTEHTLPSEMQYLPEYAWKLYENARILDIVDPKLREHGFVEKDVMQANHVAFLCLQPHAHLRPPMSEIVALLTFKIEMVTTPMRPAFLDRRPRKGDENHPLEALSQGFTSPIYLKASD

SEQ ID NO: 140857 - protein, 106 aa, Glycine max
  Coding DNA Sequence Number=SeqID_24079
  Subcellular localization annotation: CTP_CleavageSite=44; ConfidenceScore=5.35e-01
MDMKKVTCALLIAAASMSAAVAAAEAPAPSPGPGPSSGASAPLVGSLIGASVLSFFALFHLLVEFLLNFLCGRENFTVQMIEGIGNDCCMIQITESVNQKLTLIWS

SEQ ID NO: 140858 - protein, 648 aa, Glycine max
  Coding DNA Sequence Number=SeqID_24080
  Gene Ontology: Mol. function=protein serine/threonine kinase activity; Cellular component=nucleolus; Biological process=protein amino acid phosphorylation
  Homolog annotation: Hit_ID=Q1SHY2; Match level="QueryCoverage=37%, HitCoverage=100%, E-value=1e-130, Identity=93%"; Hit description =Protein kinase
  Pfam annotation: Domain name=Pkinase; Domain location=16-270; Score =289.7; E_value=5.6e-84; Accession=PF00069.15; Description=Protein kinase domain
  Pfam annotation: Domain name=Pkinase_Tyr; Domain location=16-270; Score=63.8; E_value=2.2e-16; Accession=PF07714.7; Description =Protein tyrosine kinase
  Pfam module annotation: Pfam domain module=Pkinase::Pkinase_Tyr; Domain location=16-270::16-270
MEIENGDTRSKKMEEYQVIEQIGRGAFGSAFLVLHKSEKKRYVLKKIRLAKQTEKFKRTAFQEMDLIAKLNNPYIVEYKDAWVEKEDHICIITGYCEGGDMAENIKKARGSFFPEEKVCKWLTQLLIAVDYLHSNRVIHRDLKCSNIFLTKDNNIRLGDFGLAKRLNAEDLASSVVGTPNYMCPELLADIPYGYKSDMWSLGCCMFEIAAHQPAFRAPDMAGLINKINRSSISPLPIVYSSTLKQLIKSMLRKNPEHRPTAAELLRHPLLQPYVLRCHNASSNVLPVYPLVNPKDKTRRSNKSSGGKDHKDKEASLVNRLERIHPIEGNGDIQISNLPNDAVTISTSAEDNLETRMADLTSYIVESCTSISGSKDGSTTSESTICSVCKEDFKSRPARETANNEISSKSTQNSMHEKQRFAAKHFHKLEEDNINVATTEVEDASCNEGLDSAEAQREDSNFEDSGKSTMSSAGSSTDKDKSINEESSSLIMHPIRVEHDTESGNHSKKSKTPDVFTEVSHMNCLTSFSNDALPVKDDDMANVHILCSTHKEDDNAVEVDQAPRGVSLSVITEVDGDETIKTPVDSPCQQRADALESLLELCAQLLKQDKLDELAGVLRPFGKEAVSSRETAIWLAKSLMSAQKFNAEA

SEQ ID NO: 140859 - protein, 228 aa, Glycine max
  Coding DNA Sequence Number=SeqID_24081
  Gene Ontology: Mol. function=RNA-directed DNA polymerase activity; Cellular component=chromatin; Biological process=chromatin assembly or disassembly
MSTTYHPQSDGQIEVLNRILEQYLRAFMHNQPSQWGKFLSLVEWCYNTTTHSSTKLTPYKVTYGKPPPSVPDYMPGSSLVDAIDFMQKLEQAQASMKKTVDAHRKDVTFTMGNWVYVKLRPYRQSSVSGHKYHKLGKRYFGPYKIVERVGSVAYKLALSESSKIHHWLGLQPEDSTWEDWIELQDTYHLEDMVFLQGPRDDSNLHQSDCGHRPKCMGKKPQGREDYVY

SEQ ID NO: 140860 - protein, 422 aa, Glycine max
  Coding DNA Sequence Number=SeqID_24082
  Gene Ontology: Mol. function=RNA-directed DNA polymerase activity; Cellular component=chromatin; Biological process=chromatin assembly or disassembly
MGSFLFFFLSTLSTWVLSLPLSIANNTRFQSLAHLEEAIAILTQTWSSLHSKLDDVISRLTILESRSPNRPLPFPPLRMKLDVPCFDGANAMSWIFKISQFFNYQGTPNNDRLQVASFYLDGPALSWFQWMHSNNQMSSWSDFLQALEMPFTLSFYEDPRRALFKLTQQGTVNSYLSEFESLANRIVGLPPPFLLSCFVSSLSLDIRREEDKLNDARRPSQFRPLATSLAISPIASALPTPPPLLPALPQTIFKKLTAVEMAARREKGLCYNCDAHYSPNHKCQTKFFLLIASDDVSPDDPIPPDLVPILSEDYTATPSDDHFLAQLSLHAMADHLASTMFRVNGCINGTEVIILVDGGSTHNFIHDRLARSLHLKAQPVKRLCVMVGNGGELCCDRVCKAILVNIQGYTFMVDLFVMALEV

SEQ ID NO: 140861 - protein, 204 aa, Glycine max
  Coding DNA Sequence Number=SeqID_24083
  Gene Ontology: Mol. function=protein binding; Cellular component =integral to membrane; Biological process=defense response to fungus
  Homolog annotation: Hit_ID=Q1S6P9; Match level="QueryCoverage=54%, HitCoverage=69%, E-value=3e-28, Identity=40%"; Hit description =Leucine-rich repeat
  Pfam annotation: Domain name=LRR_1; Domain location=30-51; Score =10.6; E_value=3; Accession=PF00560.23; Description=Leucine Rich Repeat
  Pfam annotation: Domain name=LRR_1; Domain location=52-74; Score=7.6; E_value=11; Accession=PF00560.23; Description=Leucine Rich Repeat
  Pfam annotation: Domain name=LRR_1; Domain location=6-28; Score=13.3; E_value=0.87; Accession=PF00560.23; Description=Leucine Rich Repeat
  Pfam annotation: Domain name=LRR_1; Domain location=76-95; Score=2.7; E_value=89; Accession=PF00560.23; Description=Leucine Rich Repeat
  Pfam module annotation: Pfam domain module=LRR_1::LRR_1::LRR_1::LRR _1; Domain location=30-51::52-74::6-28::76-95
MGSLPNLRFLYLESNKFGGEVPSSLKNCKNLTILGLGHNNLSGVIPSWLGQNVKGLKLRFNQFSGNVPTQLCQLHSVMVMDFASNRLSGPIPNCLHNITAMLSSNASTREVGYTTHFAGSTDLSYIGNLDLCGPPLTKIYPKDEKSDNTKSMVEEDDDDKYEVYSWFYMGLGIGFAVGFLGVLGIIFFNSRCRHAYFCTECITL

SEQ ID NO: 140862 - protein, 133 aa, Glycine max
  Coding DNA Sequence Number=SeqID_24084
  Gene Ontology: Mol. function=RNA-directed DNA polymerase activity; Cellular component=chromatin; Biological process=chromatin assembly or disassembly
MVGIGNLSLIVMVLSARYILLLDQEHKGRIRAVTRPYMVTKEHLFNLGFNFVLLKIRIPIGFNVNWSRIGLNRTKGGSGGLASKEEREVEGGRMLRPGPFGSGDEPDPEWLPLDAAQFDPGESQAHRAPKMTS

SEQ ID NO: 140863 - protein, 95 aa, Glycine max
  Coding DNA Sequence Number=SeqID_24085
  Subcellular localization annotation: CTP_CleavageSite=76; ConfidenceScore=5.09e-01
MTKGADNHTVPPRATELSGRWIAKGVCRLPSSVSTCHRTLGSLDSKGCLRVTVGCLRIPPDSWVTVTKVGVVNKSRAFAPTYPQFVKRNSDLRSS

SEQ ID NO: 140864 - protein, 48 aa, Glycine max
  Coding DNA Sequence Number=SeqID_24086
MEDTSRKYKALGPTILIRSPGYYLFVWMRNLPASAPGRQAQVLNTDVS

SEQ ID NO: 140865 - protein, 57 aa, Glycine max
  Coding DNA Sequence Number=SeqID_24087
MAGLVNVMSFQQLQRHIICNRRELLRASKPPRGEGIVNVTYAYPVRKIMWASREQLP

SEQ ID NO: 140866 - protein, 47 aa, Glycine max
  Coding DNA Sequence Number=SeqID_24088
  Gene Ontology: Mol. function=phosphoric ester hydrolase activity; Cellular component=cytosol; Biological process=carbohydrate metabolic process
  Homolog annotation: Hit_ID=Q9XF47; Match level="QueryCoverage=72%, HitCoverage=10%, E-value=3e-10, Identity=88%"; Hit description =Fructose-1,6-bisphosphatase, cytosolic
MVADVHRTLLYGGIFLYPADKKSPNGKLRMLSHQFNLMEMVILGKEL

SEQ ID NO: 140867 - protein, 69 aa, Glycine max
  Coding DNA Sequence Number=SeqID_24089
MVKTANHHAFKSEKKHISNDSKNLSFNGVSKLVNNDPKKKNDSRDLEKKKCLQKANHHVFKMKKDHTFD

SEQ ID NO: 140868 - protein, 148 aa, Glycine max
  Coding DNA Sequence Number=SeqID_24090
  Gene Ontology: Mol. function=calcium ion binding; Biological process =response to abscisic acid stimulus
  Homolog annotation: Hit_ID=Q45RI1; Match level="QueryCoverage=65%, HitCoverage=90%, E-value=3e-39, Identity=79%"; Hit description =Putative calcium binding protein
  Pfam annotation: Domain name=Caleosin; Domain location=8-140; Score =181.1; E_value=2.7e-51; Accession=PF05042.4; Description=Caleosin related protein
MAHDLELIAQHKASSLKLESNKIQNLGKFPSFLFPIEIKNIQLGKHGSDTGVYDTEGRFVPSKFEEIFTKHAHTHPNALTYDELKEMLKANRETKDLKGRIGGEVEWKFLYKLAKDKNGLLQKETIRGVYDGSVFELLKKEHSSSKKK

SEQ ID NO: 140869 - protein, 153 aa, Glycine max
  Coding DNA Sequence Number=SeqID_24091
  Subcellular localization annotation: CTP_CleavageSite=23; ConfidenceScore=5.51e-01
MTKEAIHGHNFTAPRLCFSSTPCSSMGNSPRRVACLGLKFSLSPGEVDASLDKFRTRELVNATNHEWMNNLFGVDLDTPNFAASYLASLQQFDALYSFGEQGKSSSDVATHSENPKTEQQHRHHEGEPMIHERRNSRRNRRPPPYGIGHRLGR

SEQ ID NO: 140870 - protein, 149 aa, Glycine max
  Coding DNA Sequence Number=SeqID_24092
  Homolog annotation: Hit_ID=Q9FMI8; Match level="QueryCoverage=32%, HitCoverage=11%, E-value=6e-10, Identity=64%"; Hit description =Arabidopsis thaliana genomic DNA, chromosome 5, P1 clone:MHJ24
MDEIIVGEMWAGGGIDEDGYYEGYKISHYKGIPRGWCGGPVAALMKMVTSLGKLRRRQEEEWLEATKSHTTRESREGGVVRVRARLWGLRRGIEPHEGRWLRGVDVGEVDADEEGDEGEDYQVDVGVRGEEGVIEPLAEMVHSRNRMGV

SEQ ID NO: 140871 - protein, 90 aa, Glycine max
  Coding DNA Sequence Number=SeqID_24093
MAIWLVEMGGPSLPRPAFGSSGPPNNFNAKGLAHLGKLQLPQGFQGLVLEGIERIEKEEEERRGNKAEELPNHDCDRPYVISCSVFFAPV

SEQ ID NO: 140872 - protein, 162 aa, Glycine max
  Coding DNA Sequence Number=SeqID_24094
MLLDPARNLRNHLGVGGLIAEDRMLAYLITYILTLRFIDYFTIDVSNKIVDFTKASSEIIERHLKKLGIRFIDYEWIMVGELAVRNFDQMEENAKAKAPQEPGHQWSPFESIMIQNRDTMLHLHQEHLAEVHSSLENTTTRLENIETRLTLSNLLNLDEDEA

SEQ ID NO: 140873 - protein, 82 aa, Glycine max
  Coding DNA Sequence Number=SeqID_24095
  Gene Ontology: Mol. function=nucleic acid binding; Cellular component= mitochondrion; Biological process=DNA integration
MDHKNNMFNDCFLDHQEMRFGPKKTQAPKFNRLSSGSKAQLASQKVVIKIGAKGGLRCKPHEMVPLRYHNILLTATQWVLRG

SEQ ID NO: 140874 - protein, 122 aa, Glycine max
  Coding DNA Sequence Number=SeqID_24096
  Subcellular localization annotation: CTP_CleavageSite=56; ConfidenceScore=5.15e-01
MIKKITLENKINDSTTTKTSFYIGGKPASTTGPTPSLFQVSLYVDNNDIGQLAPVFVMEKTTSVARKEPVVVVIHFNDGETSMQGSIDIAANIEGEHTSTGVQKETILKRKVKKPTYLKDFV

SEQ ID NO: 140875 - protein, 96 aa, Glycine max
  Coding DNA Sequence Number=SeqID_24097
MKAYNEVLSNRQIVDKVMRILTPYFDHIVVTIKESKDLDSMKLIYEETTMPTSANEGNEGGGDPPLNGVLVPPYQNSMHTKFNHSITESLTLNYLF

SEQ ID NO: 140876 - protein, 307 aa, Glycine max
  Coding DNA Sequence Number=SeqID_24098
  Homolog annotation: Hit_ID=Q1SD87; Match level="QueryCoverage=89%, HitCoverage=53%, E-value=2e-57, Identity=49%"; Hit description =Regulation of nuclear pre-mRNA protein
MEQLENAEAARDSLLSQLKHALQEQESRQELVHTQLLVARSQIKKVVGIRKQLNQAAEATNPSQPTSVSYAPFQTTEDDSKKAAAAAVAAKLAASASSAQMLTSVLSSLVAEEAASLNGSLNSTGFSSGLPIFNPEKRPKLEKPTPAHDASNYDMANSPFYATMQQPSLANVPLAPSVGMQAVSQASQLQPAFASPPPPPLHSLANQPSNQYVQSTGLMAGGIPYGYRSNSLPPPPPPPLPPHMAIGLSMPGTQPAQQQQQSPPGFYRPPGIGFYGKSHPSTPPPVPRHMFLWEIAVKVEDFPAGAV

SEQ ID NO: 140877 - protein, 191 aa, Glycine max
  Coding DNA Sequence Number=SeqID_24099
  Gene Ontology: Cellular component=cytoskeleton; Biological process =phagocytosis
  Homolog annotation: Hit_ID=Q1SD88; Match level="QueryCoverage=77%, HitCoverage=37%, E-value=2e-39, Identity=57%"; Hit description =Engulfment and cell motility, ELM
  Pfam annotation: Domain name=ELMO_CED12; Domain location=61-171; Score=-17.8; E_value=0.0072; Accession=PF04727.4; Description =ELMOCED-12 family
MEEANVVLGSGSILGRLLSFPSAALNMQNNRMLPPSLSPLQEDRLRNLRQRLEVPFDGSKAEHQDALKLLWKLAYPDRELPSLKSDLWKEMGWQGSDPSTDFSFLCTFGTNGLQSLGMFLWHAEVASKNNGTGGGGFISLENLIFFAMKYPPYPCICKDAVSGFEPMTNKSPRHNFTAAPGLALKIVSLLS

SEQ ID NO: 140878 - protein, 609 aa, Glycine max
  Coding DNA Sequence Number=SeqID_24100
  Homolog annotation: Hit_ID=Q1SD81; Match level="QueryCoverage=84%, HitCoverage=36%, E-value=1e-144, Identity=57%"; Hit description=H+ -transporting two-sector ATPase, alpha/beta subunit, central region; TonB box, N-terminal
LPPNFVDQNGSTMAEPQVVPVSVDSNLSSDIGSIKDVTNLGLVHGQDLADYIRADSEVLHQDSVDSPDSDYQMASEKSHLSDNESVEEGALPNLESRFDNANMSTSVQDADEMFDSAASDAHHISSNGSPMAAPRDLELSPAAGPSPVVHPDSPSEETEHIEKFSSNNDDIFQIQQGKTNIHQDLDKNTVAFTSGSQHEIDVKSPSNLENDLSSSDKSVVAQSSSDHDEIQSSNAIQVESAHCFGTSNDEVGELHDAVDKFPPSISSVTSEKFETPKFRSPTGEADLEVDRHGEVENEDQNEVLETALHSEESMSQVTEENSNEEFDDMKEIDEEFLSELDTVGDFSVNDAGVSLHTGIEHEKIRDAQLSSLPKDVKTEEFEQDIPVLEARSLEDINLAFKQLQEGVDVEEVINRSTIKDQNVGGESKDHLEINSDLQVVEARSLEDINIALNQVSEGNKGELPNSLDSKDTSVKVEENEDGSAKVNEFFNVATSSEEMSRTTVDKSEDVPNSSSGIEEKSHSRKSSSSSSSMMGVWVSSLGTNHVLANGSHKSVAATAGVHGGGSPSTLLSSRKSLGSIERIEKLFSSLFIVLRFALSHIRFRALKPN

SEQ ID NO: 140879 - protein, 80 aa, Glycine max
  Coding DNA Sequence Number=SeqID_24101
MSEVDRARGVGLELEGRLKVWRVYTRKNRGVKSAAEVALGVTECSSGGERRERVSGEIIILLAAERISLFVGAELWAGEL

SEQ ID NO: 140880 - protein, 311 aa, Glycine max
  Coding DNA Sequence Number=SeqID_24102
  Gene Ontology: Mol. function=protein serine/threonine kinase activity
  Homolog annotation: Hit_ID=Q1SD87; Match level="QueryCoverage=59%, HitCoverage=36%, E-value=3e-82, Identity=81%"; Hit description =Regulation of nuclear pre-mRNA protein
  Pfam annotation: Domain name=DUF618; Domain location=53-118; Score =126.1; E_value=1e-34; Accession=PF04818.4; Description=Protein of unknown function, DUF618
MICLVPLQIPKRPPLPPTKRHNHSALSHWCISHRKRAKEIVETWDKLFNASQKEQRVSFLYLANDILQNSRRKGSEFVNEFWKVLPAALRHVYESGDEDGRKAVTRLVDIWEERKVFGSRGQGLKDDVMGKNPLPSASNGKSSNSIKIVKRDAHSVRIKLAVGGLPEKILTAFQPILDQHLNEEASLNNCSAAVREVGKVVEDVENTLAQVFPSQNQSFKLALERVVSVAAAAAADVFSGDYWVLCALRSATLSHNSRDQKGLHAPSSLGRSRAGLTPVDSPSPPKPVSALGFLFRRVGSSVLVFSLFSLH

SEQ ID NO: 140881 - protein, 123 aa, Glycine max
  Coding DNA Sequence Number=SeqID_24103
MEAPNKSDAFCSSFMHFWYAFGGAICQVINAECSVVPCLLRFFALFFMQVVPEAIFCPFELSVSVTTDDGALLRVSLMSSLLRVPLPPIKRLSSDELGHEAMTCDISPVQVSFGKLASPSATE

SEQ ID NO: 140882 - protein, 70 aa, Glycine max
  Coding DNA Sequence Number=SeqID_24104
MDLCTNLIPLLALQQCAVAPARAIGLSNSSVLFPNHVECDVVKTMGFATARVGEGVASGVERVVESVVAI

SEQ ID NO: 140883 - protein, 186 aa, Glycine max
  Coding DNA Sequence Number=SeqID_24105
MEACLWSFYGGWIFELQWGPLMVIFHYGDAAEDKGKEDRSNWLATIRFSAAFHVSKFFGGDKNITFEVDVIGPILGQRCPSRCHRTHDATEPPFGNGPSTSSFQFLIWITKNYSCSERLWQMSQQWQITMQDGVPFVAQTWFQYLSENNLMAGDKVIFFFRFDEHVCEVVFRKEVIWDDEDLSNRR

SEQ ID NO: 140884 - protein, 285 aa, Glycine max
  Coding DNA Sequence Number=SeqID_24106
  Gene Ontology: Mol. function=transporter activity; Cellular component= intracellular; Biological process=transport
  Homolog annotation: Hit_ID=Q1SD80; Match level="QueryCoverage=93%, HitCoverage=81%, E-value=1e-112, Identity=73%"; Hit description =Cellular retinaldehyde-binding/triple function, N-terminal
  Pfam annotation: Domain name=CRAL_TRIO; Domain location=99-268; Score= 43.5; E_value=7.4e-10; Accession=PF00650.10; Description=CRALTRIO domain
  Pfam annotation: Domain name=CRAL_TRIO_N; Domain location=9-79; Score= 41.6; E_value=2.6e-09; Accession=PF03765.5; Description=CRALTRIO, N -terminus
  Pfam module annotation: Pfam domain module=CRAL_TRIO::CRAL_TRIO_N; Domain location=99-268::9-79
MSFKRSKSEAEKTLSPEEQQTMIGEVRKIIGPIADKFSTLCSDASVLRYLRARNYNTKKAAKMLKGSIKWRLEFKPEKIQWDDVAQEAERGRLYKADYMDKQGRIVFVIRPGIQSASSSCAQIKYLIYCLENAIWNISSNQEEQMVWLIDFQGWSTACLSLKIVRDTAQILQAHYPERLGLAIFYNPPKVFESFWTMVKPFLEPKTYKKVIFVYPDNPRSRRMVMEEHLDMDKLESYFGGKNTVGFNYEAYAQKMKEDDKSMSDVFDSCCSSSPGFLSSEFHESV

SEQ ID NO: 140885 - protein, 138 aa, Glycine max
  Coding DNA Sequence Number=SeqID_24107
  Gene Ontology: Mol. function=protein kinase activity; Biological process=protein amino acid phosphorylation
  Homolog annotation: Hit_ID=Q9ZQR0; Match level="QueryCoverage=89%, HitCoverage=9%, E-value=6e-19, Identity=38%"; Hit description =Putative helicase
  Pfam annotation: Domain name=DUF889; Domain location=1-128; Score= -17.3; E_value=2.5e-10; Accession=PF05970.5; Description=Eukaryotic protein of unknown function (DUF889)
MCLEANTDATDREETAAFAEWILNIGDGIVGQQNDGYCSIEIPTDLLITEYDDPLYAIVNSTFPNLSHHHTNPEYFQTRAILASTNETIQQINDYILSLIPADIIFGKNIGQNVYIPRMSMSPSQSPWPFKLLRRQSQ

SEQ ID NO: 140886 - protein, 82 aa, Glycine max
  Coding DNA Sequence Number=SeqID_24108
MAPKFTCSTRILVYSLFQIGITCFIWEWSYRQAHRVTNLSWQGNSFYTEEEESREIACLQRSGDVSSTSRNLTITQKLTNLP

SEQ ID NO: 140887 - protein, 159 aa, Glycine max
  Coding DNA Sequence Number=SeqID_24109
MAIQALSLLPRTSISRDVKGSIILALLQSTWQSSGLLTLGWMDIAWSWGFTELMVESYSMVAINLILKWCSPTHQCASMVQFIILKDGNLGVSSWVHVLREETSFIPPSLSIVFRPPPIRPSAPIRIIFSNVSSHRMNKLNYVSFILTRGLPCCQDSKK

SEQ ID NO: 140888 - protein, 194 aa, Glycine max
  Coding DNA Sequence Number=SeqID_24110
  Gene Ontology: Mol. function=glutamate-5-semialdehyde dehydrogenase activity; Cellular component=membrane; Biological process=electron transport
  Homolog annotation: Hit_ID=UPI00005F7E4E; Match level="QueryCoverage =99%, HitCoverage=66%, E-value=1e-71, Identity=68%"; Hit description =COG1294: Cytochrome bd-type quinol oxidase, subunit 2
  Pfam annotation: Domain name=Cyto_ox_2; Domain location=3-194; Score =92.7; E_value=1.1e-24; Accession=PF02322.6; Description=Cytochrome oxidase subunit II
MGIDLSVIWFVIIVFATLMYIVMDGFDLGIGILFAAVRGGDERDVMVNSVAPVWDGNETWLVLGGAGLFGAFPLAYAVIIDALSVPLTLMLIGLIFRGVAFEFRFKATPSHRPFWDKAFLGGSLLATFTQGMVVGAVIHGFPVSGRSFSGGMWDWLTPFTLFCGFSLTVAYALLGASWLPVDAALPAGDRRALV

SEQ ID NO: 140889 - protein, 250 aa, Glycine max
  Coding DNA Sequence Number=SeqID_24111
  Gene Ontology: Mol. function=hydrolase activity; Cellular component =beta-galactosidase complex; Biological process=carbohydrate metabolic process
  Homolog annotation: Hit_ID=Q27U85; Match level="QueryCoverage=97%, HitCoverage=96%, E-value=1e-71, Identity=55%"; Hit description=(1-4)- beta-mannan endohydrolase
MAWELMNEIRCPSDQSGRTVQFKAPFRYILILNLQIVLSAAFMLAQAWITEMASYLKSIDGNHLLEAGLEGFYGQSKPQSNPNFNVGTDFIANNQIPGIDFATVHSYPDQWLSSSSYEDQISFLGRWLDEHIQDAQNTLHKPLLFAEFGISTKSYGGNSTPRDRLFNTVYSAIYSSASSGGAAVGGLFWQLMVQGMDSYRDGYEVVLDESPSTANLIAQESQKLNRIRKMYARLRNIEKWNEAKQIRGGN

SEQ ID NO: 140890 - protein, 532 aa, Glycine max
  Coding DNA Sequence Number=SeqID_24112
  Gene Ontology: Mol. function=glucose-1-phosphate adenylyltransferase activity; Cellular component=chloroplast; Biological process =glycogen biosynthetic process
  Homolog annotation: Hit_ID=Q9AT07; Match level="QueryCoverage=95%, HitCoverage=97%, E-value=0.0, Identity=79%"; Hit description=ADP -glucose pyrophosphorylase large subunit CagpL2
  Pfam annotation: Domain name=Hexapep; Domain location=411-428; Score =2.0; E_value=80; Accession=PF00132.14; Description=Bacterial transferase hexapeptide (three rep
  Pfam annotation: Domain name=Hexapep; Domain location=480-497; Score =18.5; E_value=0.024; Accession=PF00132.14; Description=Bacterial transferase hexapeptide (three rep
  Pfam annotation: Domain name=NTP_transferase; Domain location=84-363; Score=448.6; E_value=8.3e-132; Accession=PF00483.13; Description =Nucleotidyl transferase
  Pfam module annotation: Pfam domain module=Hexapep::Hexapep::NTP _transferase; Domain location=411-428::480-497::84-363
MDSTCAILSGRNLAKVCEGIGRNRRSGFWGESTRRSVNTRNLRNSKPGSGIAHAVLTSDINEDSMAFQGVPTFEKPEVDPKSVASIILGGGAGTRLFPLTGRRAKPAVPIGGCYRLIDIPMSNCINSGIRKIFILTQFNSFSLNRHLSRAYSFGNGITFGDGFVEVLAATQTPGEAGKKWFQGTADAVRQFIWVFEDAKNKNVEHILILSGDHLYRMDYMNFVQRHVDTNADITVSCVPMDDSRASDYGLMKIDKTGRIIQFAEKPKGSDLKAMRVDTTLLGLSPQEAEKYPYIASMGVYVFRTETLLQLLRWNGSSCNDFGSEIIPSAVNEHNVQAYLFNDYWEDIGTIKSFFDANLALTEQPPKFEFYDPKTPFFTSPRFLPPTKVEKCKIVDAIISHGCFLRECSIQHSIVGVRSRLESGVELQGYCMMSHEKFVFYMTADTMMMGADYYQTEYEIASLLAEGKVPIGVGENTKIRNCIIDKNAKIGRNVVIENIDGVQEADRAKEGFYIRSGITITLKNATIKDGTVI

SEQ ID NO: 140891 - protein, 89 aa, Glycine max
  Coding DNA Sequence Number=SeqID_24113
  Homolog annotation: Hit_ID=Q9XGW1; Match level="QueryCoverage=99%, HitCoverage=9%, E-value=2e-31, Identity=70%"; Hit description =Protein PINHEAD
MINGMTVSQWASITFSRNIQDSVAHTFCTELAQMCQELNREPVIPIYNAKPKHVEKALKHVYHVSTNKTKGKELEFLLAILPDKNGSLY

SEQ ID NO: 140892 - protein, 85 aa, Glycine max
  Coding DNA Sequence Number=SeqID_24114
  Pfam annotation: Domain name=Transposase_21; Domain location=1-81; Score=-145.6; E_value=0.035; Accession=PF02992.5; Description =Transposase family tnp2
MTLSMMISGARKPRNDIDVYPSPLIEDLRKLWDERVNVIDGNQNETFKLHTMLLSGLKTSDDYKEAAESTLIEFYTIIGGNLTHG

SEQ ID NO: 140893 - protein, 71 aa, Glycine max
  Coding DNA Sequence Number=SeqID_24115
MGGCIDLVERPLCGKLKWLKNLSISEGMLRSFNSSMGVYHLVGNSLWPQVDHLGGSYSARLGGLNKYCMVS

SEQ ID NO: 140894 - protein, 74 aa, Glycine max
  Coding DNA Sequence Number=SeqID_24116
MGQDDKRCRRRCNLACHLTSWVSTTKGAGDNVSLCASTGSFAPGRRKVWVTIRTTKSAGDDVSLCASTGSFAPG

SEQ ID NO: 140895 - protein, 71 aa, Glycine max
  Coding DNA Sequence Number=SeqID_24117
MRGYLMVARTFRQPGASEPVDAKRLTSSSASFSIQGQRVRWQAEIPYGHLCLSSTEGNEFGSIRMMLVVRC

SEQ ID NO: 140896 - protein, 59 aa, Glycine max
  Coding DNA Sequence Number=SeqID_24118
MGCNKWTQHWPMGSKIYPEVHENPRAFFNSSSLILLEPLAHGSGNWSLPREDCISKDHI

SEQ ID NO: 140897 - protein, 372 aa, Glycine max
  Coding DNA Sequence Number=SeqID_24119
  Homolog annotation: Hit_ID=UPI000044A8F0; Match level="QueryCoverage =43%, HitCoverage=99%, E-value=1e-20, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHALNFRGLHALAIRRLHVLAFRGLHVLPFRGLHAPVFRGMHVLTFIGLQVLAFRGLHVLAIRGLLALAIRGLHALTFRELHVLALRPTRLHVLTFRGLLALTIKGLHVLGFKGLHVLVFRGLHVVVFRGLHVLAFRGLHTIAFRGLHTLAFKGRHVLDFGGMHTPSPLEGYAACSFLLSTPGPPPDPGGGPTMRAQREEEGITQLLCIPGQDFTRAAAKRRVQIMRTNMTSLTQIWMTLLLSNILSSDHNVDLSLRKYQLGSPPQDTQWTRRSPTGPWGFQLWLRASVSPIGDRARKSPSGPEEVQQGLGVSSSDYKPLQAQGETPQQPGDGRQRAINAPPPPPEPFSSSTKAEALPTTRGRPTSDQVQSQ

SEQ ID NO: 140898 - protein, 76 aa, Glycine max
  Coding DNA Sequence Number=SeqID_24120
MMAHQNPPYLAFCTPGQNETKNKIQGYQRETNKNIHIFLNEHQGMKGMAFEKQHHIQHVQHLTNMQCTSSMAQNIS

SEQ ID NO: 140899 - protein, 74 aa, Glycine max
  Coding DNA Sequence Number=SeqID_24121
  Subcellular localization annotation: CTP_CleavageSite=44; ConfidenceScore=5.07e-01
MPATKEEVSYQLVTSPLVPLLSVTESNVSVAVTSSGAFLPCFVRVKRAFPLLDGKNSVIKEEPTFVLKPSDTES

SEQ ID NO: 140900 - protein, 54 aa, Glycine max
  Coding DNA Sequence Number=SeqID_24122
MGAKHLKMTKHKLHATKQRSPDEIRAPHTPVSPSSIKHERKLGSEAINRTRSVH

SEQ ID NO: 140901 - protein, 81 aa, Glycine max
  Coding DNA Sequence Number=SeqID_24123
MSSGPPPLDDKGADDHNLSLRVNGLACLWLTKGAGPLTSRVSPHATGLLDHGNKGGVVDKSRVFAPTYPQFVMRNSDLRSS

SEQ ID NO: 140902 - protein, 97 aa, Glycine max
  Coding DNA Sequence Number=SeqID_24124
MDDPFRLQIASKIDGEKAIFRALSDRDIIRSFSRSRDRSNDGAKRGRQKKIKNILTPTLKGSISKCMEVSFTGMDGICNHALKRINPRDPTIQPEMG

SEQ ID NO: 140903 - protein, 296 aa, Glycine max
  Coding DNA Sequence Number=SeqID_24125
  Gene Ontology: Mol. function=protein binding; Cellular component =ESCRT III complex; Biological process=protein transport
  Homolog annotation: Hit_ID=Q9SKI2; Match level="QueryCoverage=72%, HitCoverage=96%, E-value=2e-80, Identity=75%"; Hit description =Expressed protein
  Pfam annotation: Domain name=Snf7; Domain location=98-268; Score =230.9; E_value=2.8e-66; Accession=PF03357.11; Description=Snf7
  Subcellular localization annotation: CTP_CleavageSite=44; ConfidenceScore=5.08e-01
MGGIALLGCLSIFLLKQATLTQFIRAWVISRKLSNYATVGPTPSAARVGNDGDNGSLMIPRFNAYRIFCSISTKVVPSTSAMSFIFGKRKTPAELLRENKRMLDKSIREIERERQGLQTQEKKLIAEIKKSAKQGQMGAVRVMAKDLVRTRHQVEKFYKLKSQLQGVSLRIQTLKSTQAMGEAMKGVTKAMGQMNRQMNLPSLQKIMQEFERQNEKMELTSEMMGDAIDDALEGEEDEEETEDLVNQVLDEIGIDINQELVNAPSSAVAAPASKTKVPQVETTGNDDGGIDSDLQA

SEQ ID NO: 140904 - protein, 128 aa, Glycine max
  Coding DNA Sequence Number=SeqID_24126
  Gene Ontology: Mol. function=two-component sensor activity; Cellular component=membrane; Biological process=two-component signal transduction system (phosphorelay)
  Homolog annotation: Hit_ID=Q4KF29; Match level="QueryCoverage=98%, HitCoverage=24%, E-value=7e-33, Identity=52%"; Hit description=GGDEF domain protein
MRHFGADADADGNDAVRVALMRNFQIAHRVDNALGENQCALHVGIRQDNPHLFAAVTRQDVVAAAGQPFERLADLLQALVTGDVAVAVVVLFEIVDIQHQQRHAAVVARSPRQLVLQRDIKLAAVGQP

SEQ ID NO: 140905 - protein, 228 aa, Glycine max
  Coding DNA Sequence Number=SeqID_24127
  Homolog annotation: Hit_ID=Q67U57; Match level="QueryCoverage=91%, HitCoverage=98%, E-value=3e-40, Identity=48%"; Hit description=Major intrinsic protein-like
  Pfam annotation: Domain name=DZC; Domain location=17-41; Score=26.3; E_value=0.00011; Accession=PF08381.1; Description=Disease resistancezinc fingerchromo
MTIELTKQRQKNEKVERREIFNKWQAQRWWAENYDKVMELYNVQRLDRQAFPLPTPPRSEDEMQTSCGGSGENSNDDFGQALLISSKRESIEDFPVTPPLSRERPPCNLYRAGGRGGGGMGMGYSSSDSFDHTSMQSSRHYYDPNGVNSTPKASTISAAAKTDISSIMDADASIRSSSSREADRSGDLSISNASDFDNEWVEQDEPGVYITIRALLGGKKELRRVRFR

SEQ ID NO: 140906 - protein, 343 aa, Glycine max
  Coding DNA Sequence Number=SeqID_24128
  Gene Ontology: Mol. function=carboxyl- and carbamoyltransferase activity; Cellular component=ornithine carbamoyltransferase complex; Biological process=amino acid metabolic process
  Homolog annotation: Hit_ID=Q9SEX4; Match level="QueryCoverage=93%, HitCoverage=83%, E-value=1e-145, Identity=81%"; Hit description =Ornithine carbamoyltransferase OOCT1
  Pfam annotation: Domain name=OTCace; Domain location=225-339; Score =49.4; E_value=1.2e-11; Accession=PF00185.14; Description =Aspartateornithine carbamoyltransferase, AspOrn binding domain
  Pfam annotation: Domain name=OTCace_N; Domain location=56-221; Score =153.4; E_value=5.8e-43; Accession=PF02729.11; Description =Aspartateornithine carbamoyltransferase, carbamoyl-P binding domain
  Pfam module annotation: Pfam domain module=OTCace::OTCace_N; Domain location=225-339::56-221
  Subcellular localization annotation: CTP_CleavageSite=42; ConfidenceScore=5.30e-01
MAVIPCHCYRTVGSDKPYLSGQSLRRRAPFPAVSVSFRRRISCVASSAIAHKVGLKDFLHLDDFDKDTILKMLDRALEVKALLKSGDRSFRPFEGKTMAMIFTKPSMRTRVSFETGFTLLGGHAIYLGPDDIQMGKREETRDIARVLSRYNDIIMARVFAHKLLMFVVSEELYLHLIFVTRATGNDILDLAKYATVPVINGLTDYNHPCQIMADALTMVEHIGRFEGTKVVYVGDGNNIVHSWLLMASVIPFHFVCACPKGFEPDAKTVEKARKAGISKIEITNDPKEAVKGADVVYSDVWASMGQKEEAEYRRQAFKGFQNMLVAQLAPAEVIKTWWFFANC

SEQ ID NO: 140907 - protein, 211 aa, Glycine max
  Coding DNA Sequence Number=SeqID_24129
  Gene Ontology: Mol. function=transcription factor activity; Biological process=regulation of transcription, DNA-dependent
  Homolog annotation: Hit_ID=Q0JY80; Match level="QueryCoverage=98%, HitCoverage=69%, E-value=2e-46, Identity=45%"; Hit description =Transcriptional regulator, LysR-family
  Pfam annotation: Domain name=HTH_1; Domain location=4-63; Score=67.5; E_value=4.2e-17; Accession=PF00126.17; Description=Bacterial regulatory helix-turn-helix protein, lysR family
  Pfam annotation: Domain name=LysR_substrate; Domain location=87-209; Score=-9.5; E_value=0.0037; Accession=PF03466.10; Description=LysR substrate binding domain
  Pfam module annotation: Pfam domain module=HTH_1::LysR_substrate; Domain location=4-63::87-209
MDKLSAMKTFMRVAELGSLSAAARDLRLTQPAVSQQIAALEQRLGAQLLFRSTRAVTLTDAGSGYYQRLKPILAAVDEAEEALHGQRHQLQGNLRIHAPTGFGQLHVTPLAIAFQQRHPNLAIELLLDDRLADVIGEGIDVALRFGELHAPGMVAKRLGELQRLLVASPAYLARHGTPRSPAELAKHAHIRYSGLNDGDTLTLFGPHGPET

SEQ ID NO: 140908 - protein, 346 aa, Glycine max
  Coding DNA Sequence Number=SeqID_24130
  Subcellular localization annotation: CTP_CleavageSite=28; ConfidenceScore=5.31e-01
MPRKKQQCGFRIPWISGPSTESHSPPPKQKSKSVSTHHRPPFRPPGIASTPPQPPPNGTPKSKPQQVSNFLPSHSPAPSVIINSPVSFQPESLSTPSEPNVEELELDSTPTQNSNSNAPLETQSKPHQSKSNGNTIERKMMVATSTPSGKDIQVVPPASTSATIPLSHEENPTIQKDINDISALNPTLNVDDKTISVVTLAGDNRGVTMHVAGSHSTRPKPEGKKSASTEKDEAGKTYVNSNIQSINNSIMSNGSINGRDPGVRVILPQQPQPDVKQPCLEKPKAEVSINRVERVPYRPVVRRRCLRGLFHEPSDSEPHNPDKPRRHGCKFRCGDIDIKDKDAATK

SEQ ID NO: 140909 - protein, 159 aa, Glycine max
  Coding DNA Sequence Number=SeqID_24131
  Gene Ontology: Mol. function=catalytic activity; Cellular component =mitochondrion; Biological process=metabolic process
  Homolog annotation: Hit_ID=Q9LEV3; Match level="QueryCoverage=98%, HitCoverage=77%, E-value=5e-45, Identity=55%"; Hit description =Protein At5g10860, mitochondrial precursor
  Pfam annotation: Domain name=CBS; Domain location=20-140; Score=96.1; E_value=1e-25; Accession=PF00571.18; Description=CBS domain
MQQKGLENVTVSEVLMTKGEANVGSWLWCRVDDAVINAMKNMADNNIGSLVVLKPEGQHIAGIITERDCLKKIVAQGRSPLHTHVGQIMTDENNLITVTSNTNILQAMKIMTENHIRHVPVIDGKIVGMISIVDVVRAVMEQQSGELKRLNDYVRGEYY

SEQ ID NO: 140910 - protein, 65 aa, Glycine max
  Coding DNA Sequence Number=SeqID_24132
  Gene Ontology: Mol. function=transcriptional repressor activity; Biological process=regulation of nitrogen utilization
  Homolog annotation: Hit_ID=Q3KN67; Match level="QueryCoverage=83%, HitCoverage=17%, E-value=4e-15, Identity=69%"; Hit description =Isoflavone reductase-like protein 6
MVFLSIPRTLKATLTIKEGLAISHSVFVKGDHTNFEIDPSFGVEASQLYPYVNYTAVEEYLDTFV

SEQ ID NO: 140911 - protein, 461 aa, Glycine max
  Coding DNA Sequence Number=SeqID_24133
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=38%, E-value=4e-92, Identity=35%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=197-214; Score =24.3; E_value=9.8e-05; Accession=PF00098.13; Description=Zinc knuckle
MTFPGNLPYLDGKNWDRWRIQMKAILGSQDVSDIVEQGLSALPDGAMEEQKAAHKENKMKDCKAMAWKILERCNVGVEQLKKVKLQTLRRQYELMHMEENKRIVVYLNSITSHTNAMKSKKVEILKVKELQGSLEAHEQRLMERSMARSGDQVQQATVSKKGGYGGRSSFRNRESSNKRGTSSKWRGGRKMVDRKNLKCFDCNKIGHFSIECTAPPAQNDNRGNHHEEAHLTKEGTETNLEEKPLMLMMVTNHNPRDDERWYIDLGSSSHMTEHKNWFVNLDETKKSTVRFADNRVIEAERIGEVLIKRDDGSSAILSECLYMPNMKSNLINLGQLVEKKFHIDIHNGYVAIFEPVIEKLVIRTKMASNRTFQVSLRNLESQCMTVEILAEDTWLWHLRLGHLNFRDLSMLRNKEMVLGLPTIQIPSKVYDSFLISKQPRNSFSNFTPSRANDLLHIVYSD

SEQ ID NO: 140912 - protein, 142 aa, Glycine max
  Coding DNA Sequence Number=SeqID_24134
  Homolog annotation: Hit_ID=Q6YUB8; Match level="QueryCoverage=82%, HitCoverage=34%, E-value=1e-18, Identity=42%"; Hit description=Major intrinsic protein-like
  Subcellular localization annotation: CTP_CleavageSite=52; ConfidenceScore=5.15e-01
MLTCIARPKKPGGDSASDDPSSRSQQGVKSLTCQLKEMALKASGAYKQCGPCATAPSRPSRSGTESDSESSSSRRRWGKELEARLKGISSGEGTPSSSGRRVVMLLEDEEEPKEWVAQVEPGVLISFVSLPRGGNHLKRIRF

SEQ ID NO: 140913 - protein, 516 aa, Glycine max
  Coding DNA Sequence Number=SeqID_24135
  Gene Ontology: Mol. function=acyltransferase activity; Cellular component=mitochondrial membrane; Biological process=photorespiration
  Homolog annotation: Hit_ID=Q2QX46; Match level="QueryCoverage=99%, HitCoverage=99%, E-value=1e-126, Identity=71%"; Hit description =Expressed protein
  Pfam annotation: Domain name=Hexapep; Domain location=119-136; Score =16.1; E_value=0.12; Accession=PF00132.14; Description=Bacterial transferase hexapeptide (three rep
  Pfam annotation: Domain name=Hexapep; Domain location=142-159; Score =9.3; E_value=11; Accession=PF00132.14; Description=Bacterial transferase hexapeptide (three rep
  Pfam annotation: Domain name=Hexapep; Domain location=160-177; Score =4.3; E_value=44; Accession=PF00132.14; Description=Bacterial transferase hexapeptide (three rep
  Pfam annotation: Domain name=Hexapep; Domain location=386-403; Score =0.1; E_value=1.4e+02; Accession=PF00132.14; Description=Bacterial transferase hexapeptide (three rep
  Pfam annotation: Domain name=Hexapep; Domain location=405-422; Score =2.1; E_value=79; Accession=PF00132.14; Description=Bacterial transferase hexapeptide (three rep
  Pfam annotation: Domain name=Hexapep; Domain location=70-87; Score =8.9; E_value=12; Accession=PF00132.14; Description=Bacterial transferase hexapeptide (three rep
  Pfam annotation: Domain name=Hexapep; Domain location=91-108; Score =0.9; E_value=1.1e+02; Accession=PF00132.14; Description=Bacterial transferase hexapeptide (three rep
  Pfam module annotation: Pfam domain module=Hexapep::Hexapep::Hexapep:: Hexapep::Hexapep::Hexapep::Hexapep; Domain location=119-136::142 -159::160-177::386-403::405-422::70-87::91-108
MGTLGRAIYSVGNWIRETGQAIDRLGSRLQGGYYFQEQLSRHRTLMNIFDKAPVVDKDVFVAPSASVIGDVQLGRGSSIWYGVVLRGDVNSIRVGNGTNIQDNSLVHVAKSNLSGKVLPTIIGDNVTVGHSAVIHGCTVEDEAFVGMGAILLDGVVVEKNAMVAAGALVRQNTRIPSGEVWAGNPAKFLRKLTDEEIAFISQSATNYTNLAQVHAAENSKSFDEIEFEKVLRKKFARKDEEYDSMLGVVREIPPELILPDNVLPDKAEKALKKSGRGPNLFVLDPRNGDNSTLKCKQVRKWEALGVGRAIYSVVSRHLTLMNIFDKAPVVDKDAFVAPSASVVWYGCVLRGQLPGACCKVKFKWEGVAYNDWGYNVTVGHSAVLHGCTVEDEAFVGMGAILLLDGVIVEKNAMVAVGALVRQNTRIPSGEVWAGNPAKFLRKLTDEEIAFISQSAANYTNLAQVHAAENSKSFDEIEFEKVLLRKKFARKDEEYDSMLDVVPDNVLPDKAEKALKK

SEQ ID NO: 140914 - protein, 153 aa, Glycine max
  Coding DNA Sequence Number=SeqID_24136
  Gene Ontology: Mol. function=RNA-directed DNA polymerase activity; Cellular component=ornithine carbamoyltransferase complex; Biological process=RNA-dependent DNA replication
  Pfam annotation: Domain name=AT_hook; Domain location=66-78; Score =14.9; E_value=0.061; Accession=PF02178.9; Description=AT hook motif
  Pfam annotation: Domain name=OTCace; Domain location=34-150; Score =4.8; E_value=8.7e-08; Accession=PF00185.14; Description =Aspartateornithine carbamoyltransferase, AspOrn binding domain
  Pfam module annotation: Pfam domain module=AT_hook::OTCace; Domain location=66-78::34-150
MRMLRWMCGKTRQDKIRNEAIRERVGVAPIVEKMVENRLRWFGHVERRPVDSVVRRVDQMERRQTIRGRGRPKKTIREVIKKDLALNDLDRSMVNQNLMDLAGSKAFFMHCLPAERGVEVTDEVIEAPNSIVFPQAENRMHAQNAVMLHVLAK

SEQ ID NO: 140915 - protein, 64 aa, Glycine max
  Coding DNA Sequence Number=SeqID_24137
MICEIIALKEFTALIGDDDIAKTKTRSAKTDYGIADHAQPEIETKGVRRTEKSHKTEIAIKEVT

SEQ ID NO: 140916 - protein, 646 aa, Glycine max
  Coding DNA Sequence Number=SeqID_24138
  Gene Ontology: Mol. function=catalytic activity; Cellular component =integral to membrane; Biological process=metabolic process
  Homolog annotation: Hit_ID=Q5VNP6; Match level="QueryCoverage=95%, HitCoverage=98%, E-value=1e-166, Identity=50%"; Hit description=Acyl- CoA ligase-like
  Pfam annotation: Domain name=AMP-binding; Domain location=50-518; Score=170.6; E_value=4e-48; Accession=PF00501.18; Description=AMP -binding enzyme
MAYKYENYDPSFPDQPVVDLYLPVWARLAALKSKPAFIWAQDLSTSTLLTYQQLNSTVDVISSRLLSPPLQKRGDTVLLLCSPGLDLVELIFACQRAGLLSVPIIPPHPAFAKENYHHLIRAISQTKPKAAIAHPHYISSIRHYVSSPHNNNKLTHMLQSIHWISIDELKHGRQGNNNMVTLNNLDYRGCKADEVYLVQYTSGATGVPKPVLVTAGSAAHNVRTARRAYDLHPNSTIVSWLPQYHDCGLMFLLLTVVSGATCVLTSPTAFIKRPRLWLELLSEFKATCTPVPSFTLPLVIKRGGVHQGASPLNLSTLKNLIIINEPIYRDSVEEFFHTFSPFGLSPSSISPSYGLAENCTFVSTAWRSVNSDNDGVGAGANSSSFPDFPAHNKLLPVARLGNVEEEDVEIMVVKEETLEPAEDGVEGEIWVASPSNASGYLGHPCFTREVFHGRLRNVVSKCFLRTGDRGIVKGEKRYLFVTGRCQDVMELRNGQKVHPHYIETAAYNSCTKLLRGGCLAAFKVSSMVAVVAEMQRIKKGIEKGVLKRICEGIKEAVWENEKVEVGWVVLVESESVPKTTSGKLQRGKAKEKLLAGGMKILMEMQFGKDVSVSKIAQTKVRQVAWEENVTGSLLCVEAHSTLMSLL

SEQ ID NO: 140917 - protein, 457 aa, Glycine max
  Coding DNA Sequence Number=SeqID_24139
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=96%, HitCoverage=40%, E-value=1e-106, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVLRNSRLMKPDLKDKGIYQLDSEILKYIQIMQSQRMEIWFNTWHYWLIQNQNNTWELVSLPTEKTPTAVKWIFKLKLKSDGTIAKHKARLVAKGFMQKEGLDYSEVFAPVARFETVRLLVALASWKGWILWQLDENHHSLMPLRRKQLSQKAENLYICLYVDDLLITGSSASEIETLKESLKGEFEMTDLGVFSYFLGLEFQKHDCGLFMHQRKYLLEVLKKFKMLDCNPSKTPAEMSCKLGKCEAEPVVDCTLYRQIVGSLIFICHSRPEITFNVGVISRFMSDPRHSHMMKEKVEPQLVAYSDSDCGGDVLDRKSIMGHVLLFGGAPISWCSKKQDVVALSTCEAEYITACSIACQACWLSSLLEELGIVTTDVVKLLVDSKSAIDLAKNLVSHGRSKHIETKFHFLKDQVTKGKIKLVPCKTEIQLVDIFTKALKIDRFKELRMMMNILELYD

SEQ ID NO: 140918 - protein, 240 aa, Glycine max
  Coding DNA Sequence Number=SeqID_24140
  Gene Ontology: Mol. function=nucleic acid binding; Biological process= DNA integration
  Homolog annotation: Hit_ID=Q1S7C5; Match level="QueryCoverage=61%, HitCoverage=14%, E-value=2e-19, Identity=30%"; Hit description =Integrase, catalytic region
MDKENLAYAAWEFQDQSLLVWLQSSLSEAILSKVVGCVHAHQVWEKINNHFHAKTKAKSRYLRIELRNTRKAVGQIVSVQEQIDAILEGLPSEYESLVTAISSKIDQFEFEEIQSLLLAQEQRLEKLRESVVTPALNLTPAQTKKAEDIDSNSAPRVQFTQHIDGGRSSNSRGRGDRSGYGYRGGKNYGNNDNINYGNNDNRNFGNGDHMNYGNTDRHKIQCQVLLQVWSQCVGARKRDR

SEQ ID NO: 140919 - protein, 270 aa, Glycine max
  Coding DNA Sequence Number=SeqID_24141
  Gene Ontology: Mol. function=protein binding
  Homolog annotation: Hit_ID=Q2N091; Match level="QueryCoverage=45%, HitCoverage=63%, E-value=1e-27, Identity=47%"; Hit description =Putative elicitin protein RAM6
MAKISFVFMLLALPLCLVLGQEDWEDLLGQGGFSQDALNKAQAALGAASAQAAVNDYFGLDDSPPEAAHGEQSSLADFLDADNSTSNDKGASPTGSTTVEAPEDSPVDDVDESDDSFSPAGAPLNWPNEAPNQAPSNAPMGASLEAPELAPTETPTEAPELAPTETPTEAPELAPTETPTEAPELAPTDAPELTPTDAPTEAPESTSTNAPAKTPELAPTTNAPMQSPTVEEADEDELAPTNAPTGEPDDEDEFDDSPSALTNYDNDDDS

SEQ ID NO: 140920 - protein, 135 aa, Glycine max
  Coding DNA Sequence Number=SeqID_24142
  Homolog annotation: Hit_ID=Q1RSN0; Match level="QueryCoverage=100%, HitCoverage=20%, E-value=5e-07, Identity=27%"; Hit description=Zinc finger, CCHC-type
  Pfam annotation: Domain name=zf-CCHC; Domain location=63-80; Score =26.6; E_value=4e-05; Accession=PF00098.13; Description=Zinc knuckle
MALKALSSSIQEESDKGDLNEIEEDDDFRFFVKRFNKFLRNRGNQRRSNINPKKKGKDSSLAPKCYECNQPGHMRFNCPIFKRRMEKSNKRNFKENKEKKAYITWEDNDMDSSSDPENEIINLGLMAKDYESREE

SEQ ID NO: 140921 - protein, 106 aa, Glycine max
  Coding DNA Sequence Number=SeqID_24143
  Subcellular localization annotation: CTP_CleavageSite=68; ConfidenceScore=5.18e-01
MAHSDERIIALESSVTALKSTASALQKSLQSQGATLAYVKKKKVVIRRRKNWRRSLRQNLMTRWVGSCVQKNSSICNRLRRVNVCDWHSLVWRGTRYSSFNIGRRK

SEQ ID NO: 140922 - protein, 75 aa, Glycine max
  Coding DNA Sequence Number=SeqID_24144
MPKGIIPLDLMSIQQKSSHGWVVFNGKSNQEPNNKGYKTRSSYITQAMKAAPRYNSTHVEQNIDLKKVSDPRNTG

SEQ ID NO: 140923 - protein, 51 aa, Glycine max
  Coding DNA Sequence Number=SeqID_24145
MKQFLFLNLPDTEINCSQVDCNHSMAHSSYPYGDPILAYGPQAILYVYIKN

SEQ ID NO: 140924 - protein, 151 aa, Glycine max
  Coding DNA Sequence Number=SeqID_24146
  Gene Ontology: Cellular component=chloroplast outer membrane; Biological process=chloroplast fission
MQDKIIKRNHCSMERQTIQTQQCVERDAAIARLEQSRIVLAVRLAEHRGKKYKVIEEALAFIGDVRDAGSLVAPDIFYGQPNCSAENIATEKAKRSNILINIFISSFNFVKRSLGLDHMGGIVGNAALVAVSMIALLHLHQVLEVLELVES

SEQ ID NO: 140925 - protein, 174 aa, Glycine max
  Coding DNA Sequence Number=SeqID_24147
  Gene Ontology: Mol. function=DNA binding; Biological process=DNA integration
MDLRDIDVKIKDEDLETILLASLPPFYESFKDCPKKAKKYFVVAIIHNDSSSENDLVLAVGEQPQQHSKQWILDSGCSYHMFPHRSWFVTYEKKSSGNVLIGNNAPCKSVGIGSIKIKMYDGIVKTSTDVCHVLKLKKNLVIVGAMDSKVFSCWVEGGVMQIKGKMEVWGNAGD

SEQ ID NO: 140926 - protein, 653 aa, Glycine max
  Coding DNA Sequence Number=SeqID_24148
  Homolog annotation: Hit_ID=Q1H2L1; Match level="QueryCoverage=41%, HitCoverage=90%, E-value=1e-119, Identity=81%"; Hit description=GTP -binding protein Era
  Pfam annotation: Domain name=AIG1; Domain location=392-584; Score= -93.5; E_value=0.011; Accession=PF04548.7; Description=AIG1 family
  Pfam annotation: Domain name=ATP_bind_1; Domain location=396-557; Score=-65.9; E_value=0.03; Accession=PF03029.7; Description =Conserved hypothetical ATP binding prot
  Pfam annotation: Domain name=ArgK; Domain location=363-597; Score= -187.3; E_value=0.035; Accession=PF03308.6; Description=ArgK protein
  Pfam annotation: Domain name=Dynamin_N; Domain location=394-508; Score=-14.1; E_value=0.00022; Accession=PF00350.13; Description =Dynamin family
  Pfam annotation: Domain name=GTP_EFTU; Domain location=393-558; Score= -38.3; E_value=0.00018; Accession=PF00009.17; Description=Elongation factor Tu GTP binding domain
  Pfam annotation: Domain name=KH_2; Domain location=614-653; Score =32.6; E_value=1.4e-06; Accession=PF07650.7; Description=KH domain
  Pfam annotation: Domain name=MMR_HSR1; Domain location=392-509; Score= 132.1; E_value=1.5e-36; Accession=PF01926.13; Description=GTPase of unknown function
  Pfam annotation: Domain name=Miro; Domain location=393-509; Score =11.2; E_value=0.00044; Accession=PF08477.3; Description=Miro-like protein
  Pfam annotation: Domain name=Peptidase_S24; Domain location=1-44; Score=8.2; E_value=0.049; Accession=PF00717.13; Description =Peptidase family S24
  Pfam annotation: Domain name=Ribonuclease_3; Domain location=237-313; Score=52.5; E_value=1.4e-12; Accession=PF00636.16; Description=RNase3 domain
  Pfam module annotation: Pfam domain module=AIG1::ATP_bind _1::ArgK::Dynamin_N::GTP_EFTU::KH_2::MMR_HSR1::Miro::Peptidase _S24::Ribonuclease_3; Domain location=392-584::396-557::363-597::394 -508::393-558::614-653::392-509::...
  Pfam module annotation: Domain location=393-509::1-44::237-313
LPKRGDVFVFHYPPDTSIDYIKRVVGLPGDKIQYRDKQLTINGKVINLDFVQPYQYALNVNDESGNARAVDVTASRLSEQLGDVKHDVLIHDIMNQYGPGSLGDRLMQGETITVPEGEYFAMGDNRDNSSDSRVWGFVAEKHLVGLAYEILKDFYPTRYWLDRLFAGINGVWHIGYGRSTVNRIAHDPMLQNDSDIRKAFDRQMEVDSIHEVTGRDLEVSGGVVAMRYQKKNQLPVCAVRAVATSTYTPQLLCDRLRAKLVKESSLAEIATDLHLGDALKLGEGELKSAGWRRPSILADALEAIVGAVYLDGGFDAAQQVVALLYRDKLSTIDPKAIDKDAKSQLQEYLQSKKMELPEYQPPCGRATSGQIGHGQYSIMTELIPAADDFRCGTVAIVGRPNVGKSTLLNHILGMKLAITSRKAQTTRHRLLGIHTTEDTQFLFVDTPGFQQKHLNALNKSLNKTVTQVLTEVDVVLFVIEPMKLGEADELVLKLLPKNKPVLLVVNKADLMGDKGNLLPLIQDFDLLFDFAGIIPVSAKKNLYLDELLAAVREHLPQQPAIYAEDELTDKNERFLAAELVREKVFRLLGDEVPYSVTVEIEKFETVKNLRRIFAAIIVDKDSQKPMIIGKGGEKLKQISTEARQDMEKLFGSK

SEQ ID NO: 140927 - protein, 70 aa, Glycine max
  Coding DNA Sequence Number=SeqID_24149
MASLLTISHVARKTPVVMASSYHLQIATPSGESEHRGVATAIGNLRASCNSHQQVREEELASTGSDLRVI

SEQ ID NO: 140928 - protein, 631 aa, Glycine max
  Coding DNA Sequence Number=SeqID_24150
  Gene Ontology: Mol. function=fructose-bisphosphate aldolase activity; Cellular component=integral to membrane; Biological process=metabolic process
  Homolog annotation: Hit_ID=Q479X8; Match level="QueryCoverage=52%, HitCoverage=96%, E-value=1e-132, Identity=72%"; Hit description =Ketose-bisphosphate aldolase, class-II:Fructose-bisphosphate aldolase, class II, Calvin cycle subtype
  Pfam annotation: Domain name=FBPase; Domain location=1-314; Score =383.9; E_value=2.5e-112; Accession=PF00316.10; Description=Fructose -1-6-bisphosphatase
  Pfam annotation: Domain name=F_bP_aldolase; Domain location=300-627; Score=536.6; E_value=2.6e-158; Accession=PF01116.10; Description =Fructose-bisphosphate aldolase class-II
  Pfam module annotation: Pfam domain module=FBPase::F_bP_aldolase; Domain location=1-314::300-627
VSINHALNMLIWHIAEAGIEIAALVKQGALEGVTEKMTTTNVQGETQMQLDIRSHEIAVAQLRTSAVVAAVLSEEEDDPVLFETLDAPFLVSMDPLDGSSNLAINGVVGSIFSVLPNTGVATLGEQAFLQPGQDQRAAAYIMYGPATLLVLTIGQGTHVFTLDHSKQVFVLTQQTVNIPEETSEFAINASNQRYWQPGVQRYIAECLQGAEGPRARDFNMRWCASMVMDVHRILTRGGVFLYPRDSKQPVKAGRLRLLYEANPMSLLVTQAGGESIDGLEDVLAIRPSACHQRVPECYMALISLRQLLDHAAENSYGYPAFNINNMEQILSIMKAADEVDSAVILQASAGARGYAGESFLRKMVEAAIEQYPHIPVCMHQDHGTSPKICQMAIRSGFSSVMMDGSLKEDHKTPATYEYNVDVTRRVVEFAHAVGVSVEGELGVLGSLETGMAGEEDGVGAEGKLDESQLLTDPDEAAAFVEATKVDALAIAIGTSHGAYKFTRPPSDDTLSIERIREIHAKIPNTHLVMHGSSSVPQSLLEQIRHYGGNIKETYGVPVSQIVEGIKNGVRKVNIDTDIRLAMTAAIRAHLAQHPEDFDPRQYFKEATIAAQHLCKERFEAFGSAGQASKIK

SEQ ID NO: 140929 - protein, 164 aa, Glycine max
  Coding DNA Sequence Number=SeqID_24151
MGSFLKYLQHGALFYVGMIACKTQTAVANGEFGVKAIGNRQSNWRVPIAEGVAGLVCHGSAVQHAGARRQGQIAITIGDLPCPRIANMAGGLLQNIGFSIIKAELRECAATLPSFLCFHCFASIALLLFFISFSGCDLFHSLYVVCLVFSSSYYVTSLYLISDS

SEQ ID NO: 140930 - protein, 141 aa, Glycine max
  Coding DNA Sequence Number=SeqID_24152
MVMGDFISGLSFPACLHFSGENTETFSSLTSYPELRRSEFLIGGYVGARASLLSTTLPFVAMTQELVARGDTLRLSAPRHSVIPSVIDEQRPIWSSAPFPEMSAFSDGDFSSLTSYPELRRSEFLIGGYVGARALLLSAAP

SEQ ID NO: 140931 - protein, 39 aa, Glycine max
  Coding DNA Sequence Number=SeqID_24153
MDSPCVSLSQLSDGAVSAEVDFLEVTPKKKIEWIKDFKE

SEQ ID NO: 140932 - protein, 540 aa, Glycine max
  Coding DNA Sequence Number=SeqID_24154
  Gene Ontology: Mol. function=5-formyltetrahydrofolate transporter activity; Cellular component=membrane
  Homolog annotation: Hit_ID=Q4BVL1; Match level="QueryCoverage=75%, HitCoverage=82%, E-value=5e-31, Identity=27%"; Hit description =Biopterin transport-related protein BT1
  Pfam annotation: Domain name=BT1; Domain location=99-518; Score =330.7; E_value=2.6e-96; Accession=PF03092.7; Description=BT1 family
  Pfam annotation: Domain name=MFS_1; Domain location=89-467; Score =17.8; E_value=4.9e-05; Accession=PF07690.6; Description=Major Facilitator Superfamily
  Pfam annotation: Domain name=PUCC; Domain location=108-457; Score= -233.7; E_value=0.092; Accession=PF03209.6; Description=PUCC protein
  Pfam module annotation: Pfam domain module=BT1::MFS_1::PUCC; Domain location=99-518::89-467::108-457
  Subcellular localization annotation: CTP_CleavageSite=56; ConfidenceScore=5.71e-01
MIYAISSQNPLVRSMPRIHKHRKKPSLPPNLRPITCFQNYSNPNSNSAVNNRPTFTANTVTRHVFVKEKYEEKEREFVGYCNSSNRQMMLLCGLGYWVQGFRCFPWLALNFHMAGNLNLHPSTLQLVQNFANIPMVAKPLYGILSDAIYIKGAHRIPYVVIGGLLQVFSWSLLALVPVAHKVLPNLIASVLLSNFGASITEVAQDALVAEYGKKHKIGGLQSYAFMALAAGGILGNLIGGYFLLKLPPRIIFFIFSSLLSLQLAISFSTREESLGIAQLSAQNLAKRSISENIKNQVSDLVMAISDKSISKPLVWIVGSIAMVPMLSGSIFCYQTQRLYLDPTVIGCSRVIGQFALLSGTVLYNHYWKKIPPRRLIGMVQVLYASSLLLDLVLVNQINLKWGIQNDVFALCFSGLAEVVAQFKLLPFSVLFANLCPKGCEGSLAAFLASALCVSSIASAFLGVGLASCLGITSGDYSGLTRGILVQFIAALVPLRWIHSLPMTQLVEKRRRRSMSRKARRNRRVGKVVLGYVNVYRPERE

SEQ ID NO: 140933 - protein, 417 aa, Glycine max
  Coding DNA Sequence Number=SeqID_24155
  Gene Ontology: Mol. function=RNA-directed DNA polymerase activity; Cellular component=chromatin; Biological process=chromatin assembly or disassembly
MRFRSQRIVVEIKGGPQLSRTLVSAQTLLKLPEIEEACRLWDCAQVFVERKRLPPTREVDHRIPVKLGIDPVNVWSYRYPYLQKNGIENQVVEMLTLGIIRSNNCPYSSLVILVKKKNGSWRFCIDYRALNKLGGAFGHLRFVLTLQILNEFFANFKRCSFGRKKVEYLGHIISGAGVTMDRKKVDVVLKWLVPKTVKLVKGFLGLAGYYRRFIEGYGRITRPLTNLLKKEGFKWGKDSAEAFTQLQKALTTAPVPTLPDFSQPFTIECDASSKGIGVMFSLNKKVVAYFSKRLSEASLRKSVYEKKVNGFSFGYSSLEVIFGGQKIYNIYLSKEFKIFTRSKDNYSKPTELVAKLLGYEFDIVYKTGATNKVADALSRREKDKELQRVIKPYLQGVNNIDREVEADPILSKIKEDL

SEQ ID NO: 140934 - protein, 305 aa, Glycine max
  Coding DNA Sequence Number=SeqID_24156
  Gene Ontology: Mol. function=RNA-directed DNA polymerase activity; Cellular component=chromatin; Biological process=chromatin assembly or disassembly
  Pfam annotation: Domain name=rve; Domain location=31-187; Score =120.0; E_value=6.9e-33; Accession=PF00665.16; Description=Integrase core domain
MKQSEMIIAFHICQRSKYLTSPVELLQPLPIPNVVWEDISMDFIIGLPKSKGFDSILVVMDKLSKYGHFLLLKHPYSARSVADVFVTEIIRLHGIPASIVSDRDSIFLSKFWQELFKMQGTKLKMSTRYHHQSDGQIEVLNKILETYLRCFSSKQPKAWADFIPWVEYWYNTTYQGAAKCTPFEIVYGKVPPFLCQIYSRGDEVLQQLKFHLGRAQDHMIKCANAYRIPSRIKEGDLVYLKIRPHRQVSMPSRLHPKSTARFYGPYLVVKKIGTVAFELQLPAEAQIHLVFHVSQLKLAIGTYIA

SEQ ID NO: 140935 - protein, 273 aa, Glycine max
  Coding DNA Sequence Number=SeqID_24157
  Gene Ontology: Mol. function=protein binding
  Homolog annotation: Hit_ID=Q9FLR4; Match level="QueryCoverage=74%, HitCoverage=45%, E-value=1e-37, Identity=46%"; Hit description =Arabidopsis thaliana genomic DNA, chromosome 5, P1 clone:MBK20
  Subcellular localization annotation: CTP_CleavageSite=85; ConfidenceScore=5.56e-01
MPNKQQNPKNTNATNTTLLSSSCLLPIGNAKLLNNNTTITKTLFYSVETMSLHPNPSLTPPPATPALKPWLNTTATTEPLNPMVLAMHLSDPKSKTLIPNSTLIIMDRTLLLSDELLLRILSKLPNSQQQRNSNSLVCKRWLNLQGRLVRTLRVLDWNFVLSGRLIIRFPNLNHVDLVPGSFTSSVYSSIVVSHRLVSMHVDSAWRIGVEKNLLPVETVDAGLKSLAGGCPNLRKLEVAGCSEAGISTIGAECVTLQELELQRCDDAVLGGVA

SEQ ID NO: 140936 - protein, 47 aa, Glycine max
  Coding DNA Sequence Number=SeqID_24158
MARTPNEIKFIDGSRETLKLAVRITNLWFVGTPNKSEQAEMVIVDSD

SEQ ID NO: 140937 - protein, 158 aa, Glycine max
  Coding DNA Sequence Number=SeqID_24159
MESKSVDLRASAAHLQRWGGGETVGGFVVKGGGRKRRKGLVVGGGARSGKMLLTVMVVKVEGARDEERATLRMEQPIVRVRVKQSVSGHGGARSGKMLPVMGVRAGLYWNKDQGNIVNGKGTRGRKGDIENGRAYRESESEAECEWVKHGSTFPRNKE

SEQ ID NO: 140938 - protein, 58 aa, Glycine max
  Coding DNA Sequence Number=SeqID_24160
MAARVSIRFGTKERRLLEYLESEQRLEKWYSLNPFGTAMAVVGLVACRAYAVKKNSSG

SEQ ID NO: 140939 - protein, 495 aa, Glycine max
  Coding DNA Sequence Number=SeqID_24161
  Homolog annotation: Hit_ID=Q10LQ3; Match level="QueryCoverage=94%, HitCoverage=92%, E-value=1e-52, Identity=32%"; Hit description =Expressed protein
  Pfam annotation: Domain name=DUF827; Domain location=30-358; Score =150.6; E_value=4.1e-42; Accession=PF05701.2; Description=Plant protein of unknown function (DUF827)
MEAADVVETTTNQSERDSEKKCLRTEIDTSAPFESVKEAVTMFGVDIRNPFTYLIHSSDMWWSLWTNAATIVVVVVAETPKFAAEIVHHAEELGAEKLEEQAMLLEKELILKERETLDVLKELEIVDENEEKENQVNQLNVLQPSGEGFIPYPSSTPGLILMKLKQAKLNLTKTTNDLADISSLEEELNQTRLRLQIEKDAEIKGAPDDPSDITRELQRLSSEAENFKRMGESAKSEVLRTMSEIEQTKTMIRIAEIRLVVARKMKEAARATEAFALAEINVLSNHDSSPGNQVTLSFEEYTALTGKARDAEEQSKKRVASSMLEVDETSLSNMDILKRVEEATEEVKTSKKALEEALEGVEAANRDKVAVEEALRNWRSEGQKRRSSIHNSTKFKNCCLSHHWRDPRLLDVNGLHLVNDEAKPVKPTLSIGQILSRKLLQPQEFEAGEGISMKQNVPLGQMLDKQNNDRPVDRQVEKETGHKLFSTKRKKFGFA

SEQ ID NO: 140940 - protein, 340 aa, Glycine max
  Coding DNA Sequence Number=SeqID_24162
  Gene Ontology: Mol. function=heat shock protein binding; Biological process=protein folding
  Homolog annotation: Hit_ID=Q9FK56; Match level="QueryCoverage=65%, HitCoverage=68%, E-value=4e-38, Identity=42%"; Hit description =Arabidopsis thaliana genomic DNA, chromosome 5, P1 clone:MRG7
  Pfam annotation: Domain name=DnaJ; Domain location=116-151; Score =12.2; E_value=0.00029; Accession=PF00226.21; Description=DnaJ domain
  Subcellular localization annotation: CTP_CleavageSite=18; ConfidenceScore=5.23e-01
MAQKGVMLQFFSLLSISKASLCFSLLLSLSFHYSIGSPLHSSFHHGIISTTNSTTNSLGDAIGVADPARFSRQHTRLATVAPVEEEEKEEHIFDDEKQDTGKTLEFEIVILFKESLYHPDVSKDPHAAELFKSIHHAYEVLSNEATRVQYDQELQFGHKPYREKWSYSTEFEDQARFYRWDRMRKKMDRERYWENYNVNEDYYTSETDEEEDEVVDLDEERGSFVEVLRSAFMSLFLLQTLGSRFSLTFSSLMALFDKKLDTGYKMGYVIAWILGGRGGILLTLCLSFASWVCGKTSSSVVALVVVALWVGSYLARYAPLPQGALLALLYMSIKLQSDLI

SEQ ID NO: 140941 - protein, 1022 aa, Glycine max
  Coding DNA Sequence Number=SeqID_24163
  Gene Ontology: Mol. function=translation elongation factor activity; Cellular component=cytosol; Biological process=translation
  Homolog annotation: Hit_ID=Q1SCD5; Match level="QueryCoverage=99%, HitCoverage=100%, E-value=0.0, Identity=78%"; Hit description =Elongation factor Tu, domain 2; Translation elongation factor G
  Pfam annotation: Domain name=EFG_C; Domain location=880-968; Score =94.1; E_value=4.1e-25; Accession=PF00679.14; Description=Elongation factor G C-terminus
  Pfam annotation: Domain name=GTP_EFTU; Domain location=14-355; Score =198.9; E_value=1.2e-56; Accession=PF00009.17; Description=Elongation factor Tu GTP binding domain
  Pfam annotation: Domain name=GTP_EFTU_D2; Domain location=440-521; Score=31.8; E_value=2.3e-06; Accession=PF03144.15; Description =Elongation factor Tu domain 2
  Pfam module annotation: Pfam domain module=EFG_C::GTP_EFTU::GTP_EFTU _D2; Domain location=880-968::14-355::440-521
MEEESSNCIDNERDLIRNICILAHVDHGKTTLADHLIAAAGGGVVHPKLAGRVRFMDYLDEEQRRAITMKSSSILLRYAGRYAVNLIDSPGHIDFCSEVSTAARLSDGALLLVDAVEGVHIQTHAVLRQCWIERLTPCLVLNKLDRLITELKLTPSEAYTRLLRIVHEVNGIVSAYKSEKYLTDVDSLLAGTGNGTTTGETLEDYDDNEDVFQPQKGNVIFACALDGWGFGIREFAEIYASKLGASVNALLRALWGQRYYNPKTKMIVGKKGVGGNKKPMFVQFVLEPLWQVYQGALEGDKGLVEKVIRTFSLSVPQRELQNKDVKVVLQAVMSRWLPLSEAVLSMVVRCLPDPVTAQAFRISRLIPKKEVIGDVEGVEGLVEEAELARNSVEECDCRDEAPCVAFVSKMFAVPVKMLPGHRVEVGNGYGDEGESESDECFLAFARIFSGVLHAGQRIFVLSALYDPVKGESMQKHIQEAELKSLYLMMGQGLKVVTSARAGNIVAIAGLGQHILKSATLSSTKNCWPFSSMAFQVAPTLRVAIEPSDPADVGALLKGLRLLNRADPFVEVTVSGRGEHVLAAAGEVHLERCIKDLKERFAKVSLEVSPPLVSYKETIEGDVLNVMENLKVLSRRSSDYVEKTTPNGRCVVRVQVMKLLPSLTKVLDESSDLLGDIIGVKSGQRPSILENDNPVEVLKKRILDAVEGDILSRNENDKDHAEKCKLKWLKILRRIWALGPRQIGPNLLFTPDIKAQSTNSSVLIRGSPRISERLGFVADSSINDSVDETSSNANSALYMDAEHLESSVISGFQLATSAGPLCDEPMWGLAFVVEARLSPFPGQHDESETHQQSEQYGIFAGQVIATVKDACRAAVVQNKPRLVEAMYFCELNTPTEYLGPMYAVLSRRRARVLKEEMQEGSPFFTVHAYLPVSESFGFADELRRWTSGAASALLVLSHWEALPEDPFFVPKTEEEIEEFGDGSSVLPNTARKLINAVRRRKGLPVEEKVVQHGTKQRTLARKV

SEQ ID NO: 140942 - protein, 622 aa, Glycine max
  Coding DNA Sequence Number=SeqID_24164
  Gene Ontology: Mol. function=sugar binding
  Homolog annotation: Hit_ID=Q1SM40; Match level="QueryCoverage=22%, HitCoverage=97%, E-value=1e-74, Identity=97%"; Hit description =Thioredoxin domain 2
  Pfam annotation: Domain name=DIM1; Domain location=75-207; Score =330.7; E_value=2.5e-96; Accession=PF02966.7; Description=Mitosis protein DIM1
MAASREKRRASLEETLQQLRHVTNSTAVAASMSWASAVPSTMTAEGDGGVEHHMLTFDGPGSDNWARKKKKMSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWALKDKQEFIDIVETVYRGARKGRGLVIAPKDYSTKLFPFLFLLLVLLFNYGFSESGVGAGYQLMVAVPVEYEVNFKGRAFLVETNQTAPNFRVALSIEAINGKYSCSLEVFLGDVKVWDSGHYSRFYITEKCLLELTMDGDLRLKGPKERVGWKTGTSGQGVKQLDVATRLTSSQSNSSLFYFSFEIEDKKVALYLNYGKLRYSYWGFQPTMNRSITYIKLSSRGLLLFDVKYKKIAQIPSEGIHPLRFLALNNETGNLGLYHYSPEKGKFEASFQALNSTCDLPISCRPYGICTFSNSCSCIQLLANENKGGADCSGGITGGFCNGKEAEMLEIDNISSVLKNVTRVDCKCAAALYFGNASTDEAECYLYRLVLGLKQVEKGTGFSYMVKVPKGTVKSHERHNVKRWVLIVAGGVDGLIVLLLVGGFGYWLVKRRSYSLHSRAGTT

SEQ ID NO: 140943 - protein, 401 aa, Glycine max
  Coding DNA Sequence Number=SeqID_24165
  Gene Ontology: Mol. function=DNA topoisomerase (ATP-hydrolyzing) activity; Cellular component=endoplasmic reticulum; Biological process=DNA topological change
  Homolog annotation: Hit_ID=Q9FJB4; Match level="QueryCoverage=81%, HitCoverage=90%, E-value=1e-154, Identity=76%"; Hit description =Arabidopsis thaliana genomic DNA, chromosome 5, P1 clone:MOK9
MSDHEDHADYADNESFAKRRFRDRSKEALSKQAVKLAKQAEEHERFINKVTHLLGVLGFGWFCFIFGARPQAVPLVYCLFYVVFVPLRWIYYRFKKWHYYLLDFCYYANTIFLVYLLFYPSNEKLFLVCFSFAEGPLAWALIVWRCSLVFSSVDKIVSVLIHLLPGLVFFTIRWWNPATFEALRPVGTARRSTWPYIEDKSYLWMWLFLVPLAVYILWQVLYFLIVNVLRRQRFLRDPEVMTSYRELSKKAQKANNIWWRLSGLLGDQNRLLMYIVLQGIFTVATTALTVPIFLSYELSVVFQLLKISASVWNGGSFLIDVMPRQILTNFSAHVLTACNVPATYLCPYKSCFKIYKEIDIDIIRSILKISSMCGRSKSFIHEGKFHNFWLENGILPSINPP

SEQ ID NO: 140944 - protein, 293 aa, Glycine max
  Coding DNA Sequence Number=SeqID_24166
  Subcellular localization annotation: CTP_CleavageSite=34; ConfidenceScore=5.15e-01
EITVELDDHEFTTIRSPAAGSSRRRRSLPSVKTRSERKSDRRKSTVKREMAMIWASVLSNQRKKKKKQKTKNNENQDPQYDDNADELTNNTTVPPPPPPPPPLPSVFHSLFRKGLGKSKKIHSVSAPPPPPPPPPSKRKSQTPPPPEPPQRRNSGRPPLPNRTVTFNDETLNAGNQSPLIPVPPPPPPFKMKAMKFVVRGDFVKIRSNQSSRCSSPEREDIINASETTINNDAVTDAVNDTVNDSVMDPNVFCPSPDVNAKAATFIARLRGEWRLEKLNSLKEKDNNGSLPCS

SEQ ID NO: 140945 - protein, 61 aa, Glycine max
  Coding DNA Sequence Number=SeqID_24167
MGRERGKEGVATKGRDVVSVGVLLKKGCCYKGVNERVTPALARDRFLTCPCLSRGNMGTYK

SEQ ID NO: 140946 - protein, 46 aa, Glycine max; identical to SEQ ID NO: 121406
  Coding DNA Sequence Number=SeqID_24168

SEQ ID NO: 140947 - protein, 195 aa, Glycine max
  Coding DNA Sequence Number=SeqID_24169
MPRRRSWHSSPPLLSPPLLIILFPIVILTLLFLAVPPILSAVTRLLRSASSDVKTSWDSLNILLVVFAILCGVFARRNNDDEQTPNNHVHQHDDDAVSDRNAAFRRLHSEGQSQWFGFAEERKVYGNDTPLNQLQSLDTGGNRLRMRRNSSSYPDLRQWETGDDRYKFRFYDDFEIDKPFRSPAREHFPAVEHRK

SEQ ID NO: 140948 - protein, 84 aa, Glycine max
  Coding DNA Sequence Number=SeqID_24170
MHLIVMLANIPKDNEYELVGCKVFKVFLESLQVCLAMTVEKCRMLQWRTQWWWCQRAQTEERPVVGSWKGWQRSKMSESKTQWQ

SEQ ID NO: 140949 - protein, 109 aa, Glycine max
  Coding DNA Sequence Number=SeqID_24171
MSSVKEKKILGRQENEKFDDILGRKRPGFKLVLGQWMLTKDDGEKFMFSYLKPIKGGIVAFGGMGKGKITGIGKIGDVAPSRACMPWILFINGVLCFLKINGSGMEEKR

SEQ ID NO: 140950 - protein, 100 aa, Glycine max
  Coding DNA Sequence Number=SeqID_24172
MATSSSMDTLEMLSEASNSFICTFKALDELFLSSRLELVSPVLSFGKDPETKPRLKGKKSFLQYFIVSFAQASNQLIKASEVSSNLSKELACVSAACLGE

SEQ ID NO: 140951 - protein, 205 aa, Glycine max
  Coding DNA Sequence Number=SeqID_24173
MDKSLKLAQASLWLTWAPKLLQGEGTRLPGQTNYFRSKHQLELANSSSPGRAAITPSAHFPINRRAREAEGRREGLVLEGIARIKREEEERRVNEAEALPNPNCDQSLCCSLFGVLCMTIAVSRICPLDLMMKSVQFQLSLAHQWAKRASNVKRSFSALSAREESGRASISRPRAKCEISALSASVVLSQAQGTIGAKLKSIYSC

SEQ ID NO: 140952 - protein, 122 aa, Glycine max
  Coding DNA Sequence Number=SeqID_24174
  Homolog annotation: Hit_ID=Q2HS45; Match level="QueryCoverage=85%, HitCoverage=16%, E-value=3e-08, Identity=31%"; Hit description=RNA -directed DNA polymerase
MMSSFWWGSNNYSSFWWEKISMKKEHRDIGKQGLENLTDANLINQANLEWNKPSIKDLFNNEDAENILKIPLLFTDDVGCILKRHNIEGTYIVKTAYHSIMEDILDIDHLKMLSQRTFMFER

SEQ ID NO: 140953 - protein, 299 aa, Glycine max
  Coding DNA Sequence Number=SeqID_24175
  Gene Ontology: Mol. function=oxidoreductase activity; Cellular component=proton-transporting two-sector ATPase complex; Biological process=flavonoid biosynthetic process
  Homolog annotation: Hit_ID=UPI000034EE1D; Match level="QueryCoverage =91%, HitCoverage=73%, E-value=1e-85, Identity=58%"; Hit description =oxidoreductase, acting on paired donors, with incorporation or reduction of ...
  Homolog annotation: Hit description=molecular oxygen, 2-oxoglutarate as one donor, and incorporation of one atom each of oxygen into both donors
  Pfam annotation: Domain name=2OG-FeII_Oxy; Domain location=221-296; Score=78.8; E_value=1.7e-20; Accession=PF03171.10; Description=2OG -Fe(II) oxygenase superfamily
MALNEQKGKDDIPKSQYQKGVKHLCEKGHLNAVPKKYILPVSERPTKSSVEHSNVVKQNLQLPIIDFSELLGSNRPQVLRSLANACQHYGFFQLVNHCISEDVVRRMIDVNGRFFDLPLEERAKYMTTDMRALIRCGTSFSQTKDTVLCWRDFLKLLCHPLPDLLLHWPASPVDIRKVVATNAEETKHLFLAVMEAILESLGIVEANQEEDDNILKEFENESQMMVASFYPPCPQPDLTLGMPPHSDYGFLTLLLQDEVEGLQIQHQDKWVTVQPIPNAFVVNVGDHLEYDNFYSLLVL

SEQ ID NO: 140954 - protein, 65 aa, Glycine max
  Coding DNA Sequence Number=SeqID_24176
MGTHLGNYIGEFMEYDEKNNVGGRYLICESRNYFISLLVKTLCDLYEIRKPINGTSILKYKPCIY

SEQ ID NO: 140955 - protein, 930 aa, Glycine max
  Coding DNA Sequence Number=SeqID_24177
  Gene Ontology: Mol. function=RNA-directed DNA polymerase activity; Biological process=RNA-dependent DNA replication
MVACYCIRVTHGVVACSSICVTHGVACSGDMGIVCPGFWRDSPRADLRYDELVELEKDDGSHKPRGGGLWLNLCVVSPCCSKFGSFFYDPDYFLDFVCCIELYPHVFFILLLLEQQSLGRWFPDLNGNHGVCVICESGPEDDFIGCLCLVVGLKMFDRGEKVFNAYPRQEVFIGMSFELGVIVDDNGLWQWSQYVHFPHGKRSRGAQTIEIVRRGGHPVWFLLLSNHNFFSVYGGSLECLLDDSLEVSDHFSGCQLEEHVCFGVALPRLLAPTSLASFRPAMSRCFPFSSKKAKLTASSATERYRSRGNLGLGRLWIGGRNLDRDASLQFHFWTSWTLVGAHVIFAELSKDFFQICHVLGYALRLHDHVVDIDLDVSSDMFLENLVDQSLSKRPGSSTPGTRTRHQLALKCWVEYLTSLMKLALRSLSTSSLTAFHRSSLIFFFIFCDTYLALGQMACLWKIMLGLILGMSDDCQANKSMFLCKTSTMCLCSWLVRSFATWIYIKFIIQPCLADSQGSNKRPLVHAHDLSTFDHCGVRLGRLPVMTSPAKVGNFIFKSPRELVLTEGGHKVEIASSLYSLPHEAKETLDTMKLVIMMETTMGRLVDVNVSDGVEVVLVGLVVERVLVNCVFVFLDLLLYLLFCLHHGSHVDPPTASNPDLGGFIKGSLMGTSKLKVSLRIVEKLALVRLVPLVRLVWFVLGASFLLVALLSDFVPESGHFFHLDVVFGSFAQLVHALGIWTTMCPNLSMNLWRDSSSTCCKLARSPSYQVNVSPLRDMGKTQHKIASSLVYRFSWVRKASRCSSRSLVPSYRSRLSGFHPRGMGVIPLGCAQVMCERSARHPRGLQLIVVSLQLSKSLLMASLHLCNAVFKLLESISIWHDYYGRIGAFERSLAFEARPSANHGSTMGVKCTYQNPKLAHVRVDVAKEGS

SEQ ID NO: 140956 - protein, 258 aa, Glycine max
  Coding DNA Sequence Number=SeqID_24178
  Gene Ontology: Mol. function=RNA-directed DNA polymerase activity; Cellular component=chromatin; Biological process=chromatin assembly or disassembly
MVLQKLLDTYQPIFQPPTTIPLTRLHEHQIHLLPNSQLVHVKLYRYPYFQKHEIELWVEDMLCCHLIRPSRSPYSSPVLLVKKKDGTWRFCMDYRALHAVTVKDRFLLPTIDELLDDLHNAQWFSRLDLAQGFHQIRMLPTDIPKTTFHAHNGHYEYNVMPFDLCNAPPTFQVTMNDLFWPFVRKFVLAFFDDILVYSRNFEEHLLHLESVLRALCREQFFVKLSKCAFGQQCIDYLGHIVLAKVIRLAILCRIAEAS

SEQ ID NO: 140957 - protein, 294 aa, Glycine max
  Coding DNA Sequence Number=SeqID_24179
  Gene Ontology: Mol. function=RNA-directed DNA polymerase activity; Biological process=RNA-dependent DNA replication
MDNEVNELERILEVMSKAVLQDILTYVMRAYLLPKLFTVDLECMLNFYWWGTNGKGVKWMRWEKITVQKELGGMNFRDLFDFNLALLGKQGYFYQGGYDLMESLEEKERKIVEYQDKFVSRRANMVGHSLARNALDNPYLPAKGTPMIKSVEPVVFEYVNVMIKTYLEVAVEGHELSTCQIPRLNELLKELLKRLDQGLFGAFSGAEVFKEMERRGEGQKRDNIVGGGKRPKKNRGSKFSPITIPGYEWVSAKINLYPTQFQTHESIERLKQKVDVIALDDTELLIVEPCSTEE

SEQ ID NO: 140958 - protein, 355 aa, Glycine max
  Coding DNA Sequence Number=SeqID_24180
MEIACDANQLDADVLLPPRKRLLAGLKKQGSDSDATASPSPVAASCVTDAASPSSSLFSSEFEARLKHLLSCHSNNPNLTPEEVVEASKVAAIATTKAAEAARAAAEEKAARAAKAVAAAKRALDLVASFSEEAAGKERNMKKNKSKKHLPVQLLYKKNQRIENCGTDEELAHKLHRAMNSSPRISKSSPNSDSKGSKHKKPRSSSSFEMTEGSESGVALRQDCLSLNDEHAIAGMIDSEGSIQEVCSSKKDKVVKYHRPSQLGIDNGEAELSQSKGKKFEDSSSIGKKRGRVKLKKLPLSICTSKDRVQLKEEIRVRSYSLTGTNTGNNPINTMSLFTAESSSDRVMPIEATSM

SEQ ID NO: 140959 - protein, 85 aa, Glycine max
  Coding DNA Sequence Number=SeqID_24181
MASAEDEIANMKKTIEKMEGFKKAHIQVKVLLPSFDSAQVDVNCDIVDGEIVREMQLCSESKGEEERKEELLEKVDVGIQPLRVA

SEQ ID NO: 140960 - protein, 96 aa, Glycine max
  Coding DNA Sequence Number=SeqID_24182
  Homolog annotation: Hit_ID=Q9FFG8; Match level="QueryCoverage=57%, HitCoverage=8%, E-value=7e-09, Identity=48%"; Hit description =Selenium-binding protein-like
MEPKIAGNYVLLSNIYAAAGKWDKVAKMRTFLRESGLKKTLSCRWLELNRDGQKRKLVTVPWASVCNPVHEGSSGLRSIRRINEVVVLHLGVEVWV

SEQ ID NO: 140961 - protein, 138 aa, Glycine max
  Coding DNA Sequence Number=SeqID_24183
MAQYCRELATRVALAFLKIVGYKDQETHGSLIWFSLLFMHCCKSFKKPIFLKLKSTFRFSLKIEINSTNILYKRTHTQCLKFCFTSIAPIVVHGDALENVVDFDFPCLTCNYHHGVYFEKVFQSWSNHYNCSKVIAAC

SEQ ID NO: 140962 - protein, 104 aa, Glycine max
  Coding DNA Sequence Number=SeqID_24184
  Subcellular localization annotation: CTP_CleavageSite=50; ConfidenceScore=5.20e-01
MQNYQHAKRCDSAKARTNIKRVMQHKRHGHAQSSSQPTVNCTSEYNMIVSDSSKSENSESTQGSGSNFMTPFEDCQSPTNQPVINTEGYSDLGDQLIQCRYCNA

SEQ ID NO: 140963 - protein, 515 aa, Glycine max
  Coding DNA Sequence Number=SeqID_24185
  Gene Ontology: Mol. function=sequence-specific DNA binding; Cellular component=nucleus; Biological process=regulation of transcription, DNA-dependent
  Homolog annotation: Hit_ID=Q9C519; Match level="QueryCoverage=87%, HitCoverage=82%, E-value=1e-100, Identity=48%"; Hit description=WRKY transcription factor 6
  Pfam annotation: Domain name=WRKY; Domain location=265-325; Score =142.0; E_value=1.6e-39; Accession=PF03106.6; Description=WRKY DNA -binding domain
  Subcellular localization annotation: CTP_CleavageSite=55; ConfidenceScore=5.57e-01
MEWSLTLDSSHSSSSTTNHNMFPTLGFPVNLSPSSDHNRTVLGEVDFFSGARNISSSHTNNDHGTPLKCDPHVNTGLQLLTANAGSDQSTVDDGASSDAEDKLVKITELARLQEDLRRMNAENQKLKEMLSHVSSNYANLQMHLAAVLQQQHNQRTENTEQEVVQGKAEERKHGGMVPPRQFLDLVPSGTTEIDDQVSNSSLGERTRSTTPPSCNKNDDKDKKETTDIPHSGKLLNHTTDPSTSPEAAMRKARVSVRARSEAPMISDGCQWRKYGQKMAKGNPCPRAYYRCTMAVGCPVRKQVQRCAEDRTILTTTYEGTHNHPLPPAAMAMASTTAAAASMLLSGSMTSADGIMNPNLLTRAILPCSSMATLSASAPFPTVTLDLTHNQNAFQNYQRPQTPLFPSQPQDFIAGSTPPQLPQLIAQALYNQSKFSGLQLSQDVGPNNSQAPRPFLQPSQQVSLTDTISAITADPNFTAALVSAISSIIGGANPNNNSANNSSSNPNVINSATINQ

SEQ ID NO: 140964 - protein, 37 aa, Glycine max
  Coding DNA Sequence Number=SeqID_24186
MEAWTVRYLRGHFVGSLPIVVAYDGACQGPLEQCPYE

SEQ ID NO: 140965 - protein, 270 aa, Glycine max
  Coding DNA Sequence Number=SeqID_24187
  Homolog annotation: Hit_ID=Q6H6J8; Match level="QueryCoverage=69%, HitCoverage=46%, E-value=1e-29, Identity=40%"; Hit description=F-box- like
  Subcellular localization annotation: CTP_CleavageSite=50; ConfidenceScore=5.30e-01
MASLQTTATLSYSSSLRKVKDAIHVPKPARVTYSVPKVTRRKLQVEELINGSVDSTPLEKNAITTHIYEGLFSPSKKSNMATVQLYSILEAVADRIEMHKNICEQRNNWNTLLLNSINMITLTATAMAGVAAATSGDTTPLLALKLSSALLFSAATGMSLITNQIQPSQLTEEQRNATRLFKQLHTQIQNIIALGNPTEEDVKGSMEKVLALDRAYPLPLLGAMLDKFPEKYEPAVWWPSSQFQRRSRTQESNNGWSEDLEMEMREVIEV

SEQ ID NO: 140966 - protein, 422 aa, Glycine max
  Coding DNA Sequence Number=SeqID_24188
  Homolog annotation: Hit_ID=Q6H6J8; Match level="QueryCoverage=79%, HitCoverage=80%, E-value=3e-71, Identity=43%"; Hit description=F-box- like
  Subcellular localization annotation: CTP_CleavageSite=23; ConfidenceScore=5.67e-01
MASLQTTSIFSSSSFSSSLRKVNASIHVPNPPRVTYSVPKAPTRKLQVEELINGSVDSTPLEKNAFTTHIYEGLFSPSKKSNMATVQLYSILEAVADRIEMHKNICEQRNNWNTLLLNSINMITLTATAMAGVAAATSGDTTPLLALKLSSALLFSAATGMSLIMNQIQPSQLTEEQRNATRLFKQLHTQIQNIIALGNPTEEDVKGSMEKVLALDRAYPLPLLGAMLDKFPEKYEPAVWWPSSQFQRRSRTQESNNGWSEDLEMEMREVIEVVKKKDIEDYERLGNIALKVNRSLAIAGPLLSGIAAVGTSFVGNGSWAALVPLMAGSLASVVNAFEHGGQIGMVFEMYRNCGGFFTLLEQTIQATLEEKNLDKRENGEVFEMKVAMKLGRSVSELRRLASKSASCCMKGITVDEFASKLF

SEQ ID NO: 140967 - protein, 306 aa, Glycine max
  Coding DNA Sequence Number=SeqID_24189
  Gene Ontology: Mol. function=aspartic-type endopeptidase activity; Cellular component=lysosome; Biological process=sphingolipid metabolic process
  Homolog annotation: Hit_ID=Q94IA2; Match level="QueryCoverage=99%, HitCoverage=57%, E-value=1e-164, Identity=91%"; Hit description =Aspartic proteinase 1
  Pfam annotation: Domain name=Asp; Domain location=1-305; Score=90.9; E_value=3.9e-24; Accession=PF00026.14; Description=Eukaryotic aspartyl protease
  Pfam annotation: Domain name=SapB_1; Domain location=177-215; Score =67.5; E_value=4.3e-17; Accession=PF05184.5; Description=Saposin-like type B, region 1
  Pfam annotation: Domain name=SapB_2; Domain location=106-148; Score =40.8; E_value=4.6e-09; Accession=PF03489.7; Description=Saposin-like type B, region 2
  Pfam module annotation: Pfam domain module=Asp::SapB_1::SapB_2; Domain location=1-305::177-215::106-148
MVDQGLIKEPVFSFWFNRKPEEEEGGEIVFGGVDPAHYKGKHTYVPVTRKGYWQFDMGDVLIGGKPTGYCADGCSAIADSGTSLLAGPTTVITMINHAIGASGVMSQECKTVVAEYGQTILDLLLSEILAYDHEWTQPKKICSRIGLCAFDGTRGVDVGIKSVVDENERKSSGGHHGAACPACEMAVVWMQNQLSRNQTQDQILSYINQLCDKMPSPMGESAVDCGNISSLPVVSFTIGGRTFELSPEEYILKVGEGPVAQCISGFTAIDIPPPRGPLWILGDVFMGRYHTVFDFGKQRVGFADAA

SEQ ID NO: 140968 - protein, 176 aa, Glycine max
  Coding DNA Sequence Number=SeqID_24190
  Gene Ontology: Cellular component=integral to membrane; Biological process=defense response to Gram-negative bacterium
  Homolog annotation: Hit_ID=Q9LTR7; Match level="QueryCoverage=59%, HitCoverage=69%, E-value=9e-32, Identity=58%"; Hit description =Arabidopsis thaliana genomic DNA, chromosome 5, P1 clone:MHM17
MEETVDLRNGVELAASVSDKHLDLLRPSARNYSIFRGQAMDVADHEKGNYTLIRGPEDFQTGLYDKPLPCYGCGIGWFSFLFGFLCPPLWYYATILYFGNYYRKDPRERAGLGASAIAPYPCICKEAVSGFEPMTNKSPRHNFTAAPGLALINHNYALICSVALLIVGAILMLRSP

SEQ ID NO: 140969 - protein, 256 aa, Glycine max
  Coding DNA Sequence Number=SeqID_24191
  Homolog annotation: Hit_ID=Q6Z8A8; Match level="QueryCoverage=98%, HitCoverage=73%, E-value=9e-30, Identity=30%"; Hit description=F-box family protein-like
MSTKQLYAILEVVADRVEMHKNIATTVGSGAPLLALKLSSTLLFSAATGISFIMNKIQPSQLAEEQRNATRLFKQLQTQIQTTIALGNLTEEYVKSSIEKFQRKNKTHQGKASSKGNNGWNEELERELREVVEVVKRKDIEDYERLGNIVLKINKSLAIAGSLLTGIEAVGSAFVGNGSLAAIVAVMAGSLAAAINGLEHGEQVGMVFEVYRNCGGFFKLLEETIEDEVEEKDFERRQNGELFEMKMALLLGRSVT

SEQ ID NO: 140970 - protein, 363 aa, Glycine max
  Coding DNA Sequence Number=SeqID_24192
  Gene Ontology: Mol. function=hydrolase activity, hydrolyzing O -glycosyl compounds; Cellular component=membrane; Biological process =carbohydrate metabolic process
  Homolog annotation: Hit_ID=Q1RXT3; Match level="QueryCoverage=93%, HitCoverage=67%, E-value=1e-159, Identity=84%"; Hit description =Glycoside hydrolase, family 17
  Pfam annotation: Domain name=Glyco_hydro_17; Domain location=43-360; Score=243.2; E_value=5.6e-70; Accession=PF00332.9; Description =Glycosyl hydrolases family 17
MANSKLNIILIHILFLSFSSFAEALDSQLKQQNQDEEERVPFVGVNIGTDVSNLPAASDLVAFLQLQKITHVRVYDANQDILKALSGTKIRVIISVPNNQLLAIGSSNSTAASWIDRNVVAYYPQTLVSGISVGDEVLTSVPSSAPLILPALESLYNALVASNLHQQIKVSTPHAASIILDPFPPSQAYFNQSLVSVILPLLQFLSRTGSPLMMNLYPYYVFMQNKGVVPLDNALFKPLTPNKEMVDPNTLLHYTNVLDAMVDAAYFSMKNLNITDVVVLVTETGWPAKGDSKEPYATKDNADTYNSNLIRHVFDRSGTPLHPETTSRLKVSAAVGGELGFVLWEHYAGLSASCVWNWDFFGQ

SEQ ID NO: 140971 - protein, 182 aa, Glycine max
  Coding DNA Sequence Number=SeqID_24193
  Gene Ontology: Mol. function=protein binding; Cellular component =paraspeckles; Biological process=mRNA processing
  Homolog annotation: Hit_ID=Q6ZIV4; Match level="QueryCoverage=78%, HitCoverage=65%, E-value=5e-47, Identity=64%"; Hit description =Putative cleavage and polyadenylation specific factor
  Pfam annotation: Domain name=NUDIX; Domain location=29-157; Score =5.0; E_value=0.036; Accession=PF00293.18; Description=NUDIX domain
MGEGCCTQPYPCICKEAVSGFEPMTNNLPKIDILLLPPEVELFKHPHLLLLQIRNSIYKLPGGRLRPGESDTDGLKRKLARKLSIIEDGDGSEWEVGECLEMWWRPDFETLVFPCLPPNVKQTKECIKVFLVKLPESRKFIVPKNMRLLAVPLCQVHDNHQDIWENYIRGPTVAVKILFQHD

SEQ ID NO: 140972 - protein, 527 aa, Glycine max
  Coding DNA Sequence Number=SeqID_24194
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O81709; Match level="QueryCoverage=99%, HitCoverage=99%, E-value=1e-101, Identity=42%"; Hit description =Protein phosphatase 2C
  Pfam annotation: Domain name=PP2C; Domain location=228-510; Score =288.6; E_value=1.2e-83; Accession=PF00481.12; Description=Protein phosphatase 2C
MEEITSTVAVPFTLGNLIQKEQAVTTHMEITGLKLRANTSSSLILNPAIESEKHTDIGPQTQIEVSSEAKENPVGAGLVSEMVSQGDNNGLYSESLNQAIKENESLLAKDSQCDRHISQSAAGGKSSPCREESSVLRTNCERNSPITIKVDDNIIDGKSGSTKLPHAREHESDDGSGSDESNKKTFDVRCEMPEKPTCLELSGNTTSTTPLWGCSSVCGRRKEMEDAIAVKPHLFQVTSRMLVDDHVSENTKYSPAHFFGVYDGHGGIQVANYCREHLHSVLLDEIEAAKSSLDGKKEMDNWEEQWKKAFSNCFHKVDDEVGGVGEGNGVSVEPLASETVGSTAVVAILTQTHIIVANCGDSRAVLCRGREALPLSDDHKPNRDDEWERIEAAGGRIIQWNGYRVLGVLAVSRSIGDRYLKPWVIPEPEVKCLQLDKNDECLILASDGLWDVMTNEEACDIARKRILLWHKKNGNNSSSEQGQEGVDPAAQYAAEYLSRLALQRGTKDNISVIVVDLKPQRKIKKKE

SEQ ID NO: 140973 - protein, 137 aa, Glycine max
  Coding DNA Sequence Number=SeqID_24195
  Gene Ontology: Mol. function=transferase activity; Cellular component= chloroplast; Biological process=cell redox homeostasis
  Homolog annotation: Hit_ID=Q5JC58; Match level="QueryCoverage=79%, HitCoverage=55%, E-value=5e-47, Identity=86%"; Hit description =Putative adenosine 5'-phosphosulphate reductase
  Pfam annotation: Domain name=Thioredoxin; Domain location=2-114; Score=4.3; E_value=7.4e-05; Accession=PF00085.10; Description =Thioredoxin
PNVVNLSRTGIENLAKLEDRKEPWLVVLYAPWCPYCQAMEESYVDLADKLAGSTGMKVGKFRADGEQKEFAKSELQLGSFPTILFFPKHSSRPTIKYPSEKRDVDSLMAFRVPSLCYYVYIPFVYRFFCELVGSGNG

SEQ ID NO: 140974 - protein, 148 aa, Glycine max
  Coding DNA Sequence Number=SeqID_24196
  Gene Ontology: Mol. function=lactoylglutathione lyase activity; Biological process=carbohydrate metabolic process
  Homolog annotation: Hit_ID=Q1RXT4; Match level="QueryCoverage=93%, HitCoverage=86%, E-value=6e-47, Identity=55%"; Hit description =Glyoxalase/bleomycin resistance protein/dioxygenase
MRQFSYGIIFAQALGMKVVRKVDKPEYKVEFLLTYILALYLLAGTFSCYTIAMLGYGEEHETTVLELTYNYGVTEYSKGNAYAQIAIGTDDVYKSAEVVNQVIKEVGGKITRQPGPIPGLNTKTTSFLDPDGWKTVLVDNVDFLEELK

SEQ ID NO: 140975 - protein, 197 aa, Glycine max
  Coding DNA Sequence Number=SeqID_24197
  Gene Ontology: Mol. function=oxidoreductase activity, acting on sulfur group of donors, disulfide as acceptor; Cellular component =chloroplast; Biological process=sulfate reduction, APS pathway
  Homolog annotation: Hit_ID=Q8W1A1; Match level="QueryCoverage=87%, HitCoverage=36%, E-value=1e-69, Identity=82%"; Hit description =Adenosine 5'-phosphosulfate reductase
  Pfam annotation: Domain name=PAPS_reduct; Domain location=112-197; Score=-46.7; E_value=0.0022; Accession=PF01507.9; Description =Phosphoadenosine phosphosulfate reductase family
  Subcellular localization annotation: CTP_CleavageSite=57; ConfidenceScore=5.31e-01
MRSDGSDEAKGSLPSSSPRPKTRPVPQIGSIRISERPIGGAVNFNLSQRRSLVKPVNAEPPRKDSIVPLAATTIVASASETKEEDFEQIASDLDNASPLEIMDRALDKFGNDIAIAFSGAEDVALIEYAKLTGRPFRVFSLDTGRLNPETYQLFDAVEKHYGIRIEYMFPDAVEVQALVRSKGYSLSTRMGTKSVAG

SEQ ID NO: 140976 - protein, 376 aa, Glycine max
  Coding DNA Sequence Number=SeqID_24198
  Gene Ontology: Cellular component=endoplasmic reticulum
  Homolog annotation: Hit_ID=Q6KA74; Match level="QueryCoverage=87%, HitCoverage=54%, E-value=1e-92, Identity=53%"; Hit description =Ankyrin repeat protein-like
  Pfam annotation: Domain name=Ank; Domain location=15-45; Score=0.1; E_ value=30; Accession=PF00023.20; Description=Ankyrin repeat
  Pfam annotation: Domain name=Ank; Domain location=75-107; Score=27.4; E_value=5.1e-05; Accession=PF00023.20; Description=Ankyrin repeat
  Pfam module annotation: Pfam domain module=Ank::Ank; Domain location =15-45::75-107
MARSTTPPTIKPENYGHSPVHYAVALGDHTTLSRITSSLPRLPDPSLIQTESDSLAQEKIADQISLVLDRRDVPYRETPLHLAVRLNDLFAARALATAGADVSLQNSAGWNSLQEALCRRASDIALVLLRLHHRNAWSKWRRRLPRVIAALRRMRDFYMEISFHFESSVIPFVGKIAPSDTYKIWKRDGNLRADTSLAGFDGLKIQRADQSFLFLGDVDHTHDVPSGSLLVLNRDDRKIFDAFENAGGPMNESDVAGFCSQTSVYRPGMDVTKAELVGRTNWRRQEKIESVGEWKAKVYEMHNVVFSFRSRKVAGGDSDVAGSEQVLPLELDEDDDGFLVAENPNFGFPMPDKRRHSSFVREEREWVPMGRKSVDL

SEQ ID NO: 140977 - protein, 179 aa, Glycine max
  Coding DNA Sequence Number=SeqID_24199
  Homolog annotation: Hit_ID=Q6KA74; Match level="QueryCoverage=85%, HitCoverage=22%, E-value=4e-22, Identity=42%"; Hit description =Ankyrin repeat protein-like
MPQTKEKEYVRSLRPSVWLTEQFPLKTEELLPLLDILANKVKAVRRLRELLTTTFPPGTFPVKWVQVAIPVVPTVRVVITFTKFVELQPLEQFYTPFSSPRHLLLSASRGGDEQQSKAENRCSSSSSSTWLRRNNSVSNKQRCMALDSDPFAIPAGYTWTSVDDKSRKMKKSKSVRKSK

SEQ ID NO: 140978 - protein, 1418 aa, Glycine max
  Coding DNA Sequence Number=SeqID_24200
  Gene Ontology: Mol. function=DNA binding; Cellular component =intracellular; Biological process=DNA integration
  Homolog annotation: Hit_ID=Q1SS72; Match level="QueryCoverage=99%, HitCoverage=99%, E-value=0.0, Identity=44%"; Hit description =Integrase, catalytic region
  Pfam annotation: Domain name=rve; Domain location=554-714; Score =161.4; E_value=2.4e-45; Accession=PF00665.16; Description=Integrase core domain
  Pfam annotation: Domain name=zf-CCHC; Domain location=220-237; Score =12.7; E_value=0.0078; Accession=PF00098.13; Description=Zinc knuckle
  Pfam annotation: Domain name=zf-CCHC; Domain location=256-273; Score =11.5; E_value=0.012; Accession=PF00098.13; Description=Zinc knuckle
  Pfam module annotation: Pfam domain module=RVT_2::rve::zf-CCHC::zf -CCHC; Domain location=918-1173::554-714::220-237::256-273
MNEVSINNTESYLYLHPSENPAIALVSPVLDSTNYHSWSRSMVTALSAKNKVEFIDGSAPEPLKTDRTYGAWRRCNNMVVSWIVHLVATSIRQSILWMDKAEEIWRDLKSRYSQGDLLRISDLQQEASTMKQGSLSVTECSCAAFTIITQRKLEDRAMQFLRGLNEQYTNIRSHVLLMDPIPAISKIFSYVAQQERQLLGHAGPNINFEPKDISINATRTTCDFCGRIGHVESACYKKHGVPASYDGRNKNNNGRKTCTHCGKFGHTVDVCYRKHGYPPGYKPYSGRTTVNNVITMEDKATNDEAQQHESQEVVHFSPEQYKALLALIQQPPAGSTAQSKQVASVSSCTVNTPLNPGNSLSTQTHHTSWILDSGATDHVTCSLHNLHSYTQIHPITVKLPNGNLVHATHTGTVHLSSNLILHNVLYIPTFTFNLISISKLVSSNNYELIFSSTSCVLQEANNHMKIGIVEAKHGLYHLIPNQITTKAIYSTLTHPRCSIIPIDLWHFRMGHPSNERLQCMKNYYPLLSNDKNLVCNTCHYAKHKKIPFSSSNSHASHSFDLLHMDIWGPCSKLSMHGHKYFLTIVDDHSRFTWIHLMKSKAETRHIIINLIAFIERQYNGKVKTIRSDNGVEFLMHEYYASKGIVHQTTCVETPEQNGIVERKHQHLLNVTRALLFQANLPPAFWCYALPHAAFLINCIPTPFLNNISPYEKLHKHPCDISNLRVFGCLCYINTIKANRQKFDPRAHPCIFIGFKTHTKGYLVYDLHSHDVAISRNVTFYENHFPYLPETQHLNLDNSIPSPSPKPFSGKELDPPEESHSSQPIIPIHSCDEHSTKQDPSHPRRSTRSRHSPTYLQDYHRVLASSTPEASVIVRYPLSSVLSYSRLSPAHRNFVMTISPATEPSSYAEASRHDCWVKAMKAELQALQMNNTWRLTLLPPHKAAIGCRWIYKIKYRADGSIERYKARLVAKGYTQMEGLDYLDTFSPVAKLTTVRVLLALAAQNQWHLRQLDVNNAFLHGELEEEVYMKIPPGLEVENPKLVCRLQRSLYGLKQASRQWFTKLSSFLVSHGFQQSNSDHSLFLKVTKSATTILLVYVDDIILTGNSMLEIQDITTLLDQEFKIKDLGDLKFFLGLEIARTNDGIHLCQRKYALDILSDSGMLGCKPHSTPMDYSMKLQMHSGNSLSDESSSSYRRLIGRLIYLTNTRPDIAYTVQQLSQYMSAPTTTHLQAAFRILRYLKGSLGSGLFFAATGTPQLRAFSDSDWAGCKDSRKSTTGFLVYLGSSLISWQSKKQSTVSRSSSEAEYRALASTACELQWLTYILQDIGVAFIQPATLYCDNQSAIQIATNPVFHERTKHIEIDCHIIRHKVTAGLVKLLPVSSSMQLVDIFTKALRPATFQHLCNKLGMMNIHSQLEGGS

SEQ ID NO: 140979 - protein, 133 aa, Glycine max
  Coding DNA Sequence Number=SeqID_24201
  Gene Ontology: Mol. function=galactosyltransferase activity; Cellular component=membrane; Biological process=protein amino acid glycosylation
  Homolog annotation: Hit_ID=Q6F2F5; Match level="QueryCoverage=97%, HitCoverage=39%, E-value=1e-22, Identity=39%"; Hit description =Putative glycosyltransferase
MSMKSKGACVEVSGRNVLHRKWALLLCVASFCAGMFFTNRIWSMAEYKEISRASTEIERIKLNSEGCNLNLVVRPSSNYSQVEVSNTQNVVKKPKTFESTPRKKYFMVIGINTAFSSRKHRDTVHATWMPQGD

SEQ ID NO: 140980 - protein, 200 aa, Glycine max
  Coding DNA Sequence Number=SeqID_24202
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=94%, HitCoverage=37%, E-value=7e-45, Identity=45%"; Hit description =Glucosyltransferase-13
MLELSILCWVHKKSDGCTKQLPLVLYVSFGSVCALTQQHINELASDVDVKNDDPLEFLPHGFLERTKEQGLVITSWAPQTQILSHTSTGGCVTHCGWNSIVESIVAVVPMITWPLCAKQRMNDALVTEGLKVGLRPKFRETDGIVEKEEIARVVKDLMLGDEGKGIHQRIGKLKDAAADALKEHGSSPRALSQFGTDLEN

SEQ ID NO: 140981 - protein, 399 aa, Glycine max
  Coding DNA Sequence Number=SeqID_24203
  Homolog annotation: Hit_ID=Q1SP02; Match level="QueryCoverage=33%, HitCoverage=29%, E-value=7e-12, Identity=43%"; Hit description=IMP dehydrogenase/GMP reductase
  Pfam annotation: Domain name=DUF1723; Domain location=151-200; Score =46.5; E_value=8.9e-11; Accession=PF08330.1; Description=Protein of unknown function (DUF1723)
MPLSLSATICALPPVFATVVAFTIVVSLYLPLVVDNGIVSEIIGRALGREVSCDEVEAPQQRRPTVSTRRQREAALVPEYVEHVVMQLTRQAPRHISFDDYVHHLAVTEHFELKLSSHGRKVEKLGRPTSEIEGLVVVIGLSPLIACSLNTGDRGLISIFVERWHKETSSFHLPVGDVNITLDDVALLLHLPIIGTFHSFEALHVDEVVFLLVGLLEVSSKEEELGHYNAMGHMFSYPGCETFIVATCWIYEYFPTVASFIAIEDYHERKPRTCRWKSGKALSVLTYRKRLDRLMHDAMCWIPYERVVHQFGYVQTIPPYPAAPSLYYMEWFYMISHPFMSLTQPGDPPKHPFVVHDEILWKQCLPRLKIQESSFKNQDSRIIKIKIQDTRFKKQEKTQ

SEQ ID NO: 140982 - protein, 215 aa, Glycine max
  Coding DNA Sequence Number=SeqID_24204
  Homolog annotation: Hit_ID=Q1SJX1; Match level="QueryCoverage=30%, HitCoverage=37%, E-value=5e-09, Identity=55%"; Hit description =Ankyrin
MDEWSSSLGHALVYGFFEPQSIHHAKDQYAECEHYIQTWLKESQRKVYLEAYLNHAMKTLKTTVDGKNDQGTPKWIEVMSHVQSGDYECGYYVMHWMLNIVSGGLKNDWSMGNKKVFKVTRRVTSLRYKTFVVEGMGAAKANTTLQAHPEMTSENIEALLDERKEKKSYAERYDDMDDVKSLEPDGVPLDSKDEQGMTVLLIIVRDRLMIEGRVC

SEQ ID NO: 140983 - protein, 461 aa, Glycine max
  Coding DNA Sequence Number=SeqID_24205
  Gene Ontology: Mol. function=protein kinase activity; Cellular component=intracellular; Biological process=protein amino acid phosphorylation
  Homolog annotation: Hit_ID=Q69XF8; Match level="QueryCoverage=98%, HitCoverage=81%, E-value=1e-134, Identity=37%"; Hit description =Pentatricopeptide (PPR) repeat-containing protein-like
  Pfam annotation: Domain name=PPR; Domain location=115-149; Score =16.8; E_value=0.076; Accession=PF01535.11; Description=PPR repeat
  Pfam annotation: Domain name=PPR; Domain location=181-215; Score=8.0; E_value=0.84; Accession=PF01535.11; Description=PPR repeat
  Pfam annotation: Domain name=PPR; Domain location=279-313; Score =54.3; E_value=4.2e-13; Accession=PF01535.11; Description=PPR repeat
  Pfam annotation: Domain name=PPR; Domain location=314-348; Score=9.3; E_value=0.58; Accession=PF01535.11; Description=PPR repeat
  Pfam annotation: Domain name=PPR; Domain location=350-384; Score =11.3; E_value=0.35; Accession=PF01535.11; Description=PPR repeat
  Pfam annotation: Domain name=PPR; Domain location=416-450; Score =11.2; E_value=0.35; Accession=PF01535.11; Description=PPR repeat
  Pfam annotation: Domain name=PPR; Domain location=78-112; Score=25.1; E_value=0.00026; Accession=PF01535.11; Description=PPR repeat
  Pfam module annotation: Pfam domain module=PPR::PPR::PPR::PPR::PPR::PP R::PPR; Domain location=115-149::181-215::279-313::314-348::350 -384::416-450::78-112
MLGQAIEPNAFTLSSILKACSQLENLHLGKTLHAVVFIRGFHSNNNVVACALIDMYGRSRVVDDARKVFDELPEPDYVCWTAVISTLARNDRFREAVRVFFAMHDGGLGLEVDGFTFGTLLNACGNLGWLRMGREVHGKVVTLGMKGNVFVESSLLDMYGKCGEVGCARVVFDGLEEKNEVALTAMLGVYCHNGECGSVLGLVREWRSMVDVYSFGTIIRACSGLAAVRQGNEVHCQYVRRGGWRDVVVESALVDLYAKCGSVDFAYRLFSRMEARNLITWNAMIGGFAQNGRGQEGVELFEEMVKEGVRPDWISFVNVLFACSHNGLVDQGRRYFDLMRREYGIRPGVVHYTCMIDILGRAELIEEAESLLESADCRYDHSRWAVLLGACTKCSDYVTAERIAKKMIQLEPDFHLSYVLLGNIYRAVGKWNEALEIRKLMEERGVKKVPGKSWIESEKQK

SEQ ID NO: 140984 - protein, 99 aa, Glycine max
  Coding DNA Sequence Number=SeqID_24206
MEVGSLSFNEEEGASPPRIALDKKLEEDALMEEKKERMGEHEIEGIKEGKKWNFEVYLIRLSFIKVTTSVTHASIYRLGSFLLEKTSLRSFFEKTSLRS

SEQ ID NO: 140985 - protein, 188 aa, Glycine max
  Coding DNA Sequence Number=SeqID_24207
MTSEAAKATAYRIISDFYLSASKGSFVAHGHQDVTTAIGQPEHPDRVHVAGAGVTIKQYFGPTLRSSHTYMSMAPEELEQLTQKIKDQLEDSIIEKLQMQSQGHTLPPEPEVGPSIAHVSIKESCVNPSGQDPDTGSITVHNVLLGNDQVKDKHGAEGPTKHVDRSDPNVDPLYPMTLTIPQLFLMPL

SEQ ID NO: 140986 - protein, 293 aa, Glycine max
  Coding DNA Sequence Number=SeqID_24208
  Gene Ontology: Mol. function=oxidoreductase activity; Cellular component=endoplasmic reticulum; Biological process=electron transport
  Homolog annotation: Hit_ID=Q7X9I4; Match level="QueryCoverage=78%, HitCoverage=64%, E-value=2e-55, Identity=66%"; Hit description =Endoplasmic oxidoreductin-2 precursor
  Pfam annotation: Domain name=ERO1; Domain location=33-291; Score =275.8; E_value=8.4e-80; Accession=PF04137.6; Description=Endoplasmic Reticulum Oxidoreductin 1 (ERO1)
HHAVADEATKDDEHHAVPALSKLLPLRLIRNGHQAGSQLNPLVTLVKLWCDCPFWPDDGMCRLRDCSVCECPESEFPESFKKPDHRLSMTDLVCQEGKPQAAVDRTLDSKAFRGWTEIDNPWTNDDETDNDEMTYVNLQLNPERYTGYTGPSARRIWDAVYSENCPKYYLEQAEYDTGNPNEDLTTQSLIKQLLYNPKLQAACPIPFDEANLWKGQSGPELKQKIQQQFRNISAMMDCVGCEKCRLWGKLQVLGLGTALKILFSVDGQENSSHTVTNTLYVSLDDLSAAAAKE

SEQ ID NO: 140987 - protein, 159 aa, Glycine max
  Coding DNA Sequence Number=SeqID_24209
MKNVRYEEESVAKDLATFDEGFKFVLVSQGGTDNHSGCVPLDGHVYAHPTIDPIWSIRDVTTEVGVVVVHAAVAEKQAEGHGDLGFKESKTYFACYQGVVISELFNIKCCYQGIVLMVICRTCGVVSELSWHLGLKLSKAKEIPCIIWPLILICEEKRE

SEQ ID NO: 140988 - protein, 88 aa, Glycine max
  Coding DNA Sequence Number=SeqID_24210
MWVGGKITRAHGQALSMAPNRAFGEVLEDMAMATNTATRAITSQSHRLVLQPFFSISAVTITQFPNVGASETKHRAFHRPRRKSLKEH

SEQ ID NO: 140989 - protein, 456 aa, Glycine max
  Coding DNA Sequence Number=SeqID_24211
  Gene Ontology: Mol. function=protein serine/threonine kinase activity; Cellular component=spindle pole body; Biological process =protein amino acid phosphorylation
  Homolog annotation: Hit_ID=O81783; Match level="QueryCoverage=96%, HitCoverage=95%, E-value=1e-163, Identity=67%"; Hit description =Protein kinase - like protein
  Pfam annotation: Domain name=Pkinase; Domain location=38-427; Score =176.6; E_value=6.3e-50; Accession=PF00069.15; Description=Protein kinase domain
  Pfam annotation: Domain name=Pkinase_Tyr; Domain location=38-425; Score=-76.3; E_value=8.6e-08; Accession=PF07714.7; Description =Protein tyrosine kinase
  Pfam module annotation: Pfam domain module=Pkinase::Pkinase_Tyr; Domain location=38-427::38-425
MSCSSSSGSEEEDEGFDSYRKGGYHAVRVADQFAGGRYIAQRKLGWGQFSTVWLAYDTTTSAYVALKIQKSAAQFVQAALHEIDVLSSLADGVDMDSKCVVHLIDHFKHTGPNGQHLCMVLEFLGDSLLRLIKYNRYKGLPLDKVREICKCILIGLDYLHREHGIIHSDLKPENVLLVSTIDPAKDPVRSGLTPILERPEGNINGGGVTSLIEKKLKRRARRAVAKISGRSSPIGGIEAPKSDRNLDGIDVRCKVVDFGNACWADKQFAEEIQTRQYRAPEVILQAGYSFAVDMWSFACIAFELATGDMLFTPKVGQGFSEDELPYISLLLMQKGSKLEETYGSPCPDDGTPWKDAPEAKSKDFFDRHGDLKRIRRLKFWPLSKLLIDRYKFSERDACEFSEFLLPLLDFAPEKRPTAQQCLQLPWLQGIESTPNEMRNESSVEKVGVGMSNLQIK

SEQ ID NO: 140990 - protein, 87 aa, Glycine max
  Coding DNA Sequence Number=SeqID_24212
  Homolog annotation: Hit_ID=Q2QUQ9; Match level="QueryCoverage=53%, HitCoverage=6%, E-value=3e-08, Identity=55%"; Hit description=Pre -mRNA splicing factor cwc22, putative, expressed
MARLMEDANPQRQATTIPGGVYTHPFKMAKMIKEVLDKNLVEQEDHHKISLDEEIDPEISLDIFKPDPNFLEKEKRYEEVKKTILSR

SEQ ID NO: 140991 - protein, 121 aa, Glycine max
  Coding DNA Sequence Number=SeqID_24213
MEAFRKIYAFPVASKQFLEKLREKKNTLQPISPNTTDLGPPSHESFSPNLLSTCKSQGKLQGEKGSPRKLNQFVEFHKMKPYNTLYDNTDSHKQCRWRERIVNCISGEEEGEKCLCGSDVM

SEQ ID NO: 140992 - protein, 1101 aa, Glycine max
  Coding DNA Sequence Number=SeqID_24214
  Gene Ontology: Cellular component=cytosol
  Homolog annotation: Hit_ID=Q10JI7; Match level="QueryCoverage=98%, HitCoverage=98%, E-value=1e-78, Identity=27%"; Hit description =Expressed protein
MAAKLLHSLADDNPDLQKQIGCMTGIFQLFDRHHVLTARRISQKRLASGNSPFSEGSLERDSDIILHQQTATDTSLNKGVNERQRISTESSRASFSSCSSSVSSLDCKAEAEAPYDRILFPETPSRDAVMNQSTISPHFGCNSLDLRDVVKDSMYREARGLSLRTTAKEESAINATKHRDSPRPIQLSKSVDGSYRVGIDGKQSVPIDLKESIRVLAKLREAPWYYAETKELPRSSHEVKDGHWHSISKGAPWFPYEGKEISRLSFESRETIKSTPKLKELPRLSLDSKEGSLRSYSTDSKATHHSRNIYSGTSTSNDKFPTLQQPSATPSRPPSVVAKLMGLEALPDSSLAGDGQSSSTETYSAQDNGQFPRSSKNGLTRPLRVSNSPKMSLKDPTSPRRKNHDLVMKPIRSSRVPIEPAPWKQQDGNQSSQKQNLRGVKAPTRAPDSFPSVYSEIEKRLKDLEFKQSGRDLRALKQILEAMQEKGLLESRKEEQAPNVVGSQSDYEPKATNQNQNTRSVRQQNTQRNNFLSSTVKGSDSARAFESSIVIMKPAKLVETTVIPASSVIPIGGLSGSQKHQNGAVYVDNKTSTSTTRVAKDKSPRNIHRDVSASSIDKKASSSKTTRLIQSQSRSQQLPKENRQSSVKHSGSVSPRLQQKKLELEKRSRPPAPPSDSNKPRRQSGKKATESGSPGGRQRPKSLNVPHGDEQLSEISNEPRSLSFQGDEISLQSNSLTVNSKMDMEVTSSLQTVEIDDSQSPSLKAVKQLISETVQKKSTPRLDEDETVAELATDTPEHPSPISVLDGSVYRDDMPSPVKQISEDSKGEDAQESKENEIKDQWNPADSLSFNCTGSLEINRKKLQNIDHLVQKLRRLNSSHDEARIDYIASLCENTNPDHRYISEILLASGLLLRDLSSELLTFQLHSSGHPINPELFLVLEQTKASSLLSKEESSPGKDANMKLNKEKFHRKLIFDSVNEILGAKFGSSPEPCFQPNSNRLTKKTLSAQKLLKELCFEIEKIQAKKPECCLEDDHDGLKNMLCEDVMHGSESWTDFHGYLPGVVLDVERLLFKDLVDEVVIGESSGLRVKPSVRRRKLFGK

SEQ ID NO: 140993 - protein, 337 aa, Glycine max
  Coding DNA Sequence Number=SeqID_24215
  Gene Ontology: Mol. function=protein serine/threonine kinase activity; Cellular component=phragmoplast; Biological process =protein amino acid phosphorylation
  Homolog annotation: Hit_ID=Q5SNF8; Match level="QueryCoverage=91%, HitCoverage=56%, E-value=1e-132, Identity=75%"; Hit description =Putative serine/threonine kinase 38
  Pfam annotation: Domain name=Pkinase; Domain location=108-333; Score =89.6; E_value=9.9e-24; Accession=PF00069.15; Description=Protein kinase domain
  Pfam annotation: Domain name=Pkinase_Tyr; Domain location=108-306; Score=-51.2; E_value=2.5e-09; Accession=PF07714.7; Description =Protein tyrosine kinase
  Pfam module annotation: Pfam domain module=Pkinase::Pkinase_Tyr; Domain location=108-333::108-306
MENQKVGESVHVREEEDDVAVEKEEDHGDVGSSMTLERVAAAKKFIENHYKSQRKHIQERKERRLMLEKKLASSQAPEEEQINLLKDLELKETEYMRLKRHKICVDDFDLLTIIGRGAFGEVRLCREKKSGNIYAMKKLKKSEMLSRGQVEHVRAERNVLAEVACDCIVKLYYSFQDAEHLYLIMEYLPGGDIMTLLMREETLTETVARFYVAQSVIAIESIHKHNYIHRDIKPDNLLLDQYGHMKLSDFGLCKPLDCSSLSSISENEILDDENLNDTTDVDGALSNGRNGRRWKSPLEQLQHWQINRRKLAFSTVGTPDYIAPEVLLKKGYGVECD

SEQ ID NO: 140994 - protein, 118 aa, Glycine max
  Coding DNA Sequence Number=SeqID_24216
  Gene Ontology: Mol. function=protein serine/threonine kinase activity; Cellular component=phragmoplast; Biological process =protein amino acid phosphorylation
  Homolog annotation: Hit_ID=Q84PF6; Match level="QueryCoverage=69%, HitCoverage=41%, E-value=7e-38, Identity=83%"; Hit description =Protein kinase GhCLK1
MFYFFCLGDEYLQIVHWKNHLKFPEEARLTPEAKDLICKLLCGVPHRLGTRGAEEIKAHPWFKDVMWDRLYEMEAAFKPQVNGELDTQNFMKFDECALSTPVLVPNKRSRCTEVVVRL

SEQ ID NO: 140995 - protein, 54 aa, Glycine max
  Coding DNA Sequence Number=SeqID_24217
MAIISETRRKGKKHHITLRGEKIRPYCYISNRKINAGKIRDEDRLGYSEKQQSC

SEQ ID NO: 140996 - protein, 150 aa, Glycine max
  Coding DNA Sequence Number=SeqID_24218
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=Q06ZW8; Match level="QueryCoverage=90%, HitCoverage=34%, E-value=5e-54, Identity=77%"; Hit description =Lycopene epsilon cyclase
  Pfam annotation: Domain name=Lycopene_cycl; Domain location=1-147; Score=-137.3; E_value=3.6e-05; Accession=PF05834.3; Description =Lycopene cyclase protein
MRSGVQRFLSKQLMVENNPYDPNLMVFMDYRDYMKQNVQCPEANFPTFLYAMPMSRTRVFFEETCLASKDAMPFDLLKKKLFSRLNTMGIRITKTYEEVRYWKCQEWSYIPVGGSLPNTEQKNLAFGAAASMVHPATGMTSTHFDLRDTV

SEQ ID NO: 140997 - protein, 88 aa, Glycine max
  Coding DNA Sequence Number=SeqID_24219
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=Q1T796; Match level="QueryCoverage=95%, HitCoverage=14%, E-value=5e-23, Identity=70%"; Hit description =Lycopene epsilon-cyclase
MFECPQCPAAELELIQKERMLSGVSFLEAKGYSKLKGKKNSNAYTNRFSFLLSCVIMSLAWPSFKIVAITEAYFGASDKDLTTEYPIG

SEQ ID NO: 140998 - protein, 192 aa, Glycine max
  Coding DNA Sequence Number=SeqID_24220
NSEGLCGTIEVISPSYDTVPWRKQGFHECPCGEVALRDIILTPAMKLLLMTRLGISTEEEARAMTTTCSRVRLTWLTAVSPESLQWHTYMTISPMRASTPTSRLESWAFAHLPNVGYFEPKIDDLNDLIANKWKPTQVGLFSYFIKCEIDVWSYLSERGFKVGCNLERQRKRTAKAKDKDGGKGNKGGRGGL

SEQ ID NO: 140999 - protein, 383 aa, Glycine max
  Coding DNA Sequence Number=SeqID_24221
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9ZQG9-2; Match level="QueryCoverage=89%, HitCoverage=91%, E-value=1e-141, Identity=66%"; Hit description =Isoform 2 of Q9ZQG9
  Pfam annotation: Domain name=Glyco_hydro_17; Domain location=10-328; Score=361.6; E_value=1.2e-105; Accession=PF00332.9; Description =Glycosyl hydrolases family 17
LFARIHGLGFGINYGQIGNNLPLPSQVAVLIKSMNVSRIKLYDADPDVLQAFSQYNVEFIIGLGNEYLENMTNPYKAQTWIQQHVQPYLSQTKITCITVGNEVFNSNDTQQMLNLLPAMQTVHDALVNLGLDQQVTVTTAHSFNILSNSYPPSSGAFREDLVQYIQALLDFHAQINSPFLINAYPFFAYKDNPDEVSLNYVLFQPNEGMADPNTNFHYDNMLYAQIDAVYAAIKQMGHDDVQVRISETGWPSNGDPEEVGATPQNAALYNGNLIKRIEQKQGTPAKPSVPIDIYVFALFNENLKPGPASERNYGLYYPNGSPVYNIGLKGYLPEMPLAAKSNIVYFDRVVFNASIVLNLQTLSVNFLVCIITCLIFALELSRW

SEQ ID NO: 141000 - protein, 240 aa, Glycine max
  Coding DNA Sequence Number=SeqID_24222
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=Q1XIT2; Match level="QueryCoverage=74%, HitCoverage=34%, E-value=2e-72, Identity=73%"; Hit description =Lycopene epsilon cyclase
  Pfam annotation: Domain name=Lycopene_cycl; Domain location=113-240; Score=-163.5; E_value=0.00064; Accession=PF05834.3; Description =Lycopene cyclase protein
  Subcellular localization annotation: CTP_CleavageSite=54; ConfidenceScore=5.57e-01
MECVAARNLAAMAFCVSPSSSRLRLRRKKLWRRRAASSSSSCGGGRGVRWLKVEAKAGSESCVATKEDFADEEDYVKAGGSELVFVQMQQKKAMEMQSKLADKLPPIGDDILDLVVIGCGPAGLALAAESAKLGLKVGLIGPDLPFTNNYGVWEDEFKDLGLEGCIEHVWKDTIVFLDNKDPIFIGRSYGRASRHLLHEELLRRCVESGVSYLSSRVESIIEATNGHSHVVCEYDIVVPS

SEQ ID NO: 141001 - protein, 151 aa, Glycine max
  Coding DNA Sequence Number=SeqID_24223
  Gene Ontology: Mol. function=sequence-specific DNA binding; Cellular component=intracellular; Biological process=regulation of transcription
  Homolog annotation: Hit_ID=Q9ZQH2; Match level="QueryCoverage=64%, HitCoverage=35%, E-value=2e-30, Identity=65%"; Hit description =Putative CCAAT-binding transcription factor subunit
  Pfam annotation: Domain name=CBFD_NFYB_HMF; Domain location=5-75; Score=19.3; E_value=0.0026; Accession=PF00808.13; Description =Histone-like transcription factor (CBFNF-Y) and archaeal histone
MSEAEELPRSIMRRVVKYKLSRCSEDGEISVSKDGLLAFSESGRIFIHYLSATANDICKESKRQIINVENVFKALEETEFPEFVCPLKASLEEFRKKNARKKVVVSKGKEDEPKKKRKLEGESSDKGEGSEKGEDNDKGEDSDKGVSGDDQ

SEQ ID NO: 141002 - protein, 90 aa, Glycine max
  Coding DNA Sequence Number=SeqID_24224
MSGKGGVCIWEKETKAAQLSFHLPKENPTLRMMLAEIMRTAVYICTGMSVAPPPLSSLPQPSYTTGIATSPNDNNRLITVIDNNALMKKI

SEQ ID NO: 141003 - protein, 179 aa, Glycine max
  Coding DNA Sequence Number=SeqID_24225
  Gene Ontology: Biological process=DNA packaging
  Homolog annotation: Hit_ID=Q2T6F9; Match level="QueryCoverage=77%, HitCoverage=73%, E-value=8e-13, Identity=37%"; Hit description =Conserved hypothetical phage protein
  Pfam annotation: Domain name=Terminase_2; Domain location=3-160; Score=-21.6; E_value=0.0034; Accession=PF03592.6; Description =Terminase small subunit
MALTDKKRRFVDALLSGLSGAKAAIHAGYSENGAAQAAARLMRDKHVLAALGRVAEVNKTVNKKAVNKKGKTQPPVGETPQADVALPAPADESSMGGIGLKALGLTSDPRAVLVAIMNDAREEPKLRLEAAKALMPFTHGKVADQGKKDAQKAAANKVAAGGRFNAPPPPTHLRVVGKG

SEQ ID NO: 141004 - protein, 79 aa, Glycine max
  Coding DNA Sequence Number=SeqID_24226
MVRVNVNGRRENSEGVQKLLLQLDNHAYLSSCYNGGERWRLQTKHWNRMKASNRVALSKYCRWLSFATQAMMSLTRLAT

SEQ ID NO: 141005 - protein, 317 aa, Glycine max
  Coding DNA Sequence Number=SeqID_24227
  Gene Ontology: Mol. function=nucleic acid binding
  Homolog annotation: Hit_ID=Q2HS59; Match level="QueryCoverage=54%, HitCoverage=23%, E-value=1e-42, Identity=57%"; Hit description=RNA -binding region RNP-1
  Pfam annotation: Domain name=RRM_1; Domain location=112-183; Score =60.5; E_value=5.6e-15; Accession=PF00076.12; Description=RNA recognition motif. (a.k.a. RRM, R
MTEDQDNGELKIAAPAEGNTLTNVGWIVTAVGGRGACWRLQPQVAGKTRILVACARIWQREGKISLQQLVLLVRGAKLDIKRSPRGAGERGRGKKYPHHGSGDGEQGKVKAVYVKNLPKNVTQEQLKKLFERHGKITKVVLPPAKSGQEKNRIGFVHFAERSNAMKALKNTERYELEGQLLECSLAKPQADQKSGGSNTQKPGPGLLPSYPPHVGYGLVGGAYGALGAGYAAPGLAQPLLYGGGQTPAGMAMMPMLLADGRIGYVLQQPGMQPQAPPSHHRGGRGGGGSGSGNRNAGSSSKGRHNNDGGHGRRYRPY

SEQ ID NO: 141006 - protein, 319 aa, Glycine max
  Coding DNA Sequence Number=SeqID_24228
  Gene Ontology: Mol. function=nucleic acid binding; Cellular component= ribonucleoprotein complex; Biological process=mRNA processing
  Homolog annotation: Hit_ID=Q2HS59; Match level="QueryCoverage=64%, HitCoverage=28%, E-value=1e-81, Identity=71%"; Hit description=RNA -binding region RNP-1
  Pfam annotation: Domain name=RRM_1; Domain location=131-201; Score =75.8; E_value=1.3e-19; Accession=PF00076.12; Description=RNA recognition motif. (a.k.a. RRM, R
  Pfam annotation: Domain name=RRM_1; Domain location=210-285; Score =28.1; E_value=3.1e-05; Accession=PF00076.12; Description=RNA recognition motif. (a.k.a. RRM, R
  Pfam module annotation: Pfam domain module=RRM_1::RRM_1; Domain location=131-201::210-285
MPWGKAISSSAAKSSKPEEPVESDEKVDFEEANDPEEAMEEEIEYEEVEEEEEVEEIEEEVEEVEEEEEVEVEEEEEEEEEEEEEEEVEVEEVEEDDAMQNHSSDEAKVEDEDEKRKHAELLSLPPHGSEVYIGGIPHASDEDLKSLCERIGEVAEVRIMKGKDSSENKGFGFVTFTSVELASKAIEELNNTEFMGKKIKCSKSQAKHRLFIGNVPRSWGVEDLKKIVTEIGPGVTGVELVKDMKNTNNNRGFAFIDYYNHACAEYSRQKMMSPTFKLGENAPTVSWADPKNAESSAASQVLTHMSSFFLAQLIIDGYG

SEQ ID NO: 141007 - protein, 61 aa, Glycine max
  Coding DNA Sequence Number=SeqID_24229
MWHWDIDGVTSSAGFYSSSEDIEATFSTMISPRLVLPESWIPPRVDLVNLVFEDEGRGYIY

SEQ ID NO: 141008 - protein, 440 aa, Glycine max
  Coding DNA Sequence Number=SeqID_24230
  Gene Ontology: Mol. function=protein binding; Cellular component =intracellular; Biological process=signal transduction
  Homolog annotation: Hit_ID=Q0PKR6; Match level="QueryCoverage=86%, HitCoverage=89%, E-value=1e-108, Identity=53%"; Hit description =RhoGAP1
  Pfam annotation: Domain name=PBD; Domain location=94-140; Score=53.3; E_value=8.1e-13; Accession=PF00786.18; Description=P21-Rho-binding domain
  Pfam annotation: Domain name=RhoGAP; Domain location=157-294; Score =113.9; E_value=4.6e-31; Accession=PF00620.17; Description=RhoGAP domain
  Pfam module annotation: Pfam domain module=PBD::RhoGAP; Domain location=94-140::157-294
  Subcellular localization annotation: CTP_CleavageSite=31; ConfidenceScore=5.31e-01
MTEVLHFSSSSSPATCSSDGILQEAPPPPPPSSSVSAVVDGFSTVTDCDGCGVTFTDRTQQQEEELSLLAILVTLLRKSLIACNKSEEGHGAMEIGWPTNVRHVAHVTFDRFNGFLGLPREFEPEVSTRPPSASATVFGVSTESMQLSYDTRGNSVPTILLLMQRHLYALGGLQEEGIFRINADNSQEESVRDQLNRGLVPEDVDIHCLAGQIKAWFRELPTGVLDSLSPEQVMQCQTEEDCTELAGQLPHTEASLLDWAINLMADVAQEEDLNKMNARNIAMVFAPNMTHMADPLTALMYAVQPSDENGDHSLLESCQQDDIATENEEAGETFVYEKTELDCSPESLQSKYSTEGECGSLIGSPENLVCEEDLYCEFPPKGNIEKSKSGQSSNSSAKKGSKRTRGLLQPVIHATVAVDKKGISNLSRIDSRSERIEAWR

SEQ ID NO: 141009 - protein, 145 aa, Glycine max
  Coding DNA Sequence Number=SeqID_24231
  Gene Ontology: Mol. function=zinc ion binding; Cellular component =COPII vesicle coat; Biological process=ER to Golgi vesicle-mediated transport
  Homolog annotation: Hit_ID=Q9ZQH3; Match level="QueryCoverage=90%, HitCoverage=17%, E-value=3e-48, Identity=68%"; Hit description =Expressed protein
  Pfam annotation: Domain name=zf-Sec23_Sec24; Domain location=49-86; Score=42.9; E_value=1.1e-09; Accession=PF04810.5; Description =Sec23Sec24 zinc finger
MAVRSTVSRFPMDTDAREGSGLLWGVTVTPFAATDENTRAPSYGSGGDLLPRCENCWAYFNTYCELEQWSWSCSLCGNLNGLSSDAIDRYSRPQSCAEMMSSFVDLELPSQESAEVAAMQACPVYVAAVDLSCKIPCILRHKAAS

SEQ ID NO: 141010 - protein, 506 aa, Glycine max
  Coding DNA Sequence Number=SeqID_24232
  Gene Ontology: Mol. function=zinc ion binding; Cellular component =COPII vesicle coat; Biological process=ER to Golgi vesicle-mediated transport
  Homolog annotation: Hit_ID=Q9ZQH3; Match level="QueryCoverage=93%, HitCoverage=63%, E-value=0.0, Identity=80%"; Hit description =Expressed protein
  Pfam annotation: Domain name=Sec23_BS; Domain location=278-389; Score= -9.8; E_value=0.011; Accession=PF08033.2; Description=Sec23Sec24 beta- sandwich domain
  Pfam annotation: Domain name=Sec23_helical; Domain location=401-506; Score=-18.3; E_value=0.067; Accession=PF04815.5; Description =Sec23Sec24 helical domain
  Pfam annotation: Domain name=Sec23_trunk; Domain location=31-276; Score=7.3; E_value=1.1e-11; Accession=PF04811.5; Description =Sec23Sec24 trunk domain
  Pfam module annotation: Pfam domain module=Sec23_BS::Sec23 _helical::Sec23_trunk; Domain location=278-389::401-506::31-276
MLIIIPNKSAADIPYLQSISLICIEGCNDQASEEFLELIKSALLAALEALAPGSLFGLATFSHKLGLYDVQGPIPVVKNVFIPPDAEGTLPIELEDVMPLLQFLAPVETCKDRIASALETLRPTTSWERTTAAGQGLDGVLIGGRGFGMAMEALCNYLGSEYGNTFALARVFAFLSGPPDYGAGQLDTRRYGEQYASKGEDADRALLPEQTPFYKDLAAVAVQAGVCVDIFAVTNEYTDLASLKFLSIESGGSLFLYTSTEDSTLPQDMYRMLSRPYAFGCVLRLRTSTEFKPGNSYGHFFPDPQYENVQHIICCDSYATYAYDFVFENNVGFSRTKSDVPTIQIAFQYSVVVPPQELSISNSGGVSTNRTKHSLQRRLRIRTLQFGVAQNIHELYDSCDPEVVLSLLVHKVILASLEEGVREGRILLQEWLVILTAQYNDAYKLIQYNNGSSVRSQIDVAFSQCPQLQPLPRLIFALLRNPLLRFHEEGVHPDYRIYLQCLFRQP

SEQ ID NO: 141011 - protein, 53 aa, Glycine max
  Coding DNA Sequence Number=SeqID_24233
MNTKFKIITGSKHKQHMGRRPVRVTLFCENAPTMWDRHGLEGALKPGVFTLKA

SEQ ID NO: 141012 - protein, 211 aa, Glycine max
  Coding DNA Sequence Number=SeqID_24234
  Gene Ontology: Mol. function=RNA-directed DNA polymerase activity
  Homolog annotation: Hit_ID=Q0KIN0; Match level="QueryCoverage=44%, HitCoverage=6%, E-value=7e-21, Identity=45%"; Hit description =Integrase core domain containing protein
MDMQTYLGNMDRLIAEYSTLMPFTTDAETFYKQHGQFFMVVALVGLTPDLEALLRLSIPHTFGPSSTSTGNSSALVSHSSHHGGLGIHYHYYNNWGHAEAKVFGPLVIHRIMQRSKKQKTVAISSVEVEYRAMAVATCEITWLRQLLQQLKFGDTQDTKLICDNQVLLGEIITDFVSSSDQLADMFIKSLKGSRVDNICNKLGSYDIYAPA

SEQ ID NO: 141013 - protein, 172 aa, Glycine max
  Coding DNA Sequence Number=SeqID_24235
MKIVAEAEPFGSDENVIDGGEEGVVEICVPDHGGKHNGKGEAEVGGKDAAARGLHAEPVTGSPEGVGGGCVLPWEGEGGMVSAGGGGFAKEEDGKSWLVTLGSRGGMVSAGGGDFAEEEDGEDCLGTMVFNFRRMTSSLESMEAWAAASLAMAASRRSTQAAESSASAIEER

SEQ ID NO: 141014 - protein, 162 aa, Glycine max
  Coding DNA Sequence Number=SeqID_24236
  Gene Ontology: Mol. function=protein serine/threonine kinase activity; Cellular component=cytoplasm; Biological process=protein amino acid phosphorylation
  Homolog annotation: Hit_ID=Q8LR51; Match level="QueryCoverage=79%, HitCoverage=27%, E-value=1e-63, Identity=90%"; Hit description =Casein kinase I-like
  Pfam annotation: Domain name=Pkinase; Domain location=1-162; Score= -94.2; E_value=0.006; Accession=PF00069.15; Description=Protein kinase domain
MVTARILLENVKTKHPQLLYESKLYRVLQGGTGIPDVRWFGVEGDYNVLVMDLLGPSLEDLFNFCSRKLSLKTVLMLADHMINRVEFVHSKSFLHRDIKPDNFLMSLGWQVYCIDFGLAKKYRDSSTHQHIPYRFMFLAINSGYKDENYALEGLDGCLYKKG

SEQ ID NO: 141015 - protein, 300 aa, Glycine max
  Coding DNA Sequence Number=SeqID_24237
MVSFRGPQPSNFVPFTPNKWENFERRKENQGFKNLYIKIVRQSQLLISIDHLPLSSVTNGSLIKLHLFPFLTTLLFALQITVRDSQFFSKVTHFDKDNVKVTELPNKEAPEVNKPEQQPPFIPETMAYMTEFENSNNKNYNNDAYNTRFSETSYNNKYYNKDSYEGNQYELSDTKYTEEGYNNKYHNSYQNNYNNDAANEKYSYNNNNNKNYNAHNNRYNTYNSNAVSRYNGERQGISDTRFLEGGKYFYDVGMEMYNPTNYGDSSREVNTNNWYNNRGVNYNGYQNQEEFEDEHENFEP

SEQ ID NO: 141016 - protein, 85 aa, Glycine max
  Coding DNA Sequence Number=SeqID_24238
  Homolog annotation: Hit_ID=Q2HTL5; Match level="QueryCoverage=83%, HitCoverage=34%, E-value=4e-07, Identity=42%"; Hit description =Ribonuclease H
MVNGTLVILYDSTYIYAALVNHIRNLFTRDWNFSIQHIYKEGNCCADLLTRKGSSSDKLVIVDQCPPFLILALLSDACCTLHVRS

SEQ ID NO: 141017 - protein, 50 aa, Glycine max
  Coding DNA Sequence Number=SeqID_24239
RTPIQEFLHAHREDGRLKLHFVQPEDEEKEEDGDDEDYDEVESVVEEEHV

SEQ ID NO: 141018 - protein, 141 aa, Glycine max
  Coding DNA Sequence Number=SeqID_24240
  Gene Ontology: Mol. function=heat shock protein binding; Cellular component=cellular_component; Biological process=protein folding
  Homolog annotation: Hit_ID=Q1RY14; Match level="QueryCoverage=97%, HitCoverage=41%, E-value=6e-59, Identity=76%"; Hit description=Heat shock protein DnaJ
  Pfam annotation: Domain name=DnaJ_C; Domain location=21-139; Score =19.0; E_value=5.2e-08; Accession=PF01556.9; Description=DnaJ C terminal region
KTLPVEEILTIDIKPGCKKGTKITFPEKGNEQPNVIASDLVFVIDEKPHPVFTRDGNDLVVTQKVSLEEALTGYIIHLTTLDGRVLKIPINNVIHPTYEEVVPREGMPIPKDPLKRGNLRIKFPAKLKSEQQAGFKKLLPH

SEQ ID NO: 141019 - protein, 73 aa, Glycine max
  Coding DNA Sequence Number=SeqID_24241
MGKEENDENEKKDGEDGDEDENAQEEDEEDISDDDYNQMNLPIRYQYGECSSAHPVTAIQAWTVAPLILQFGS

SEQ ID NO: 141020 - protein, 97 aa, Glycine max
  Coding DNA Sequence Number=SeqID_24242
MSLELGNQKCSKEEFLLLQKPHLHFFQNVNKGCNQTAMRVIAALTCMTSPQNCSTSGDDGQYADRVVKGSVKGGAKGTRVLLHIRGIEKQRVRDEKA

SEQ ID NO: 141021 - protein, 131 aa, Glycine max
  Coding DNA Sequence Number=SeqID_24243
MASSDDDDDVAYDGDALSTNENVIKCGMTTMEKVVRLRNKGITFKEIGLKDTSMSRYDLWKSARVNKLEVVDNENVKQKRKRKDDDLSLKEQIAFPIGKVKELESMLHAKKVDGQPNSTTNNMKDSCMLLS

SEQ ID NO: 141022 - protein, 220 aa, Glycine max
  Coding DNA Sequence Number=SeqID_24244
MRVSSIRQIAMNNTEKTWYKEEGEWTTSQGGVCGARLMVYSIVTTSSFLPFAFSTILSHRLLTCLRDWERFWQRSKLDKKCRLGQVVIDDANDRVWHLEGVECVKQQREKDNSKNKNGCSAICNGEKEGAAIEDGEKVAYLAYLERAASGTGETPADVVISPLAPARHANVIHVACADGGTCQHGQSRHWLLRDQAGRDLGYQARACSCFFRKTRALLCR

SEQ ID NO: 141023 - protein, 73 aa, Glycine max
  Coding DNA Sequence Number=SeqID_24245
MSNPSFIGQPNEDLLIGIDTSSELCSLTCVTSKSHQSTLKCLAFQPYFLLISMWDLDYFQHTPSRQALLGLDA

SEQ ID NO: 141024 - protein, 77 aa, Glycine max
  Coding DNA Sequence Number=SeqID_24246
MESEQHPPQQSPPIIINIHDEGLEPHAQSYEFTLQPHHHQEDYGYNPQFFIASKEDFMSNLMDIDLRTPESAYAYMQ

SEQ ID NO: 141025 - protein, 97 aa, Glycine max
  Coding DNA Sequence Number=SeqID_24247
  Gene Ontology: Mol. function=ionotropic glutamate receptor activity; Cellular component=integral to membrane; Biological process=ion transport
  Homolog annotation: Hit_ID=Q84W41; Match level="QueryCoverage=98%, HitCoverage=10%, E-value=4e-27, Identity=57%"; Hit description =Glutamate receptor 3.6 precursor
MEQLSSPVKGIESLATSNERIGFLSGSFAKNYLTEELNIPRSKLIPLNSPSEYEKALKNGAANRGVTAIIDERAYMELFLATKYEYGIIGQEFTKMG

SEQ ID NO: 141026 - protein, 67 aa, Glycine max
  Coding DNA Sequence Number=SeqID_24248
MARDIGKIQRVHLMLFIDIKVQGNQEKGHKKIDCGKFMAWLENNKKSGGVQKSKGAQFEGKQAKSRK

SEQ ID NO: 141027 - protein, 195 aa, Glycine max
  Coding DNA Sequence Number=SeqID_24249
  Gene Ontology: Mol. function=nucleic acid binding; Biological process= DNA integration
MFKIFKTEVKKQLGKIIKIVRSDFGGKYYGKYGVIGQHMGLFTLCLQDCGIVQQYTMLGTPKQNGVTKRHNKTLKDIRSRCNLSEFLWGEALKTTLYILNRVPKSMNAKFLELDVPNPGVPSNNIDVKSPESVSLPLLVQVVSVLSIFPIKTGVQIVPTETTVSIVPIVTTVATREITSSQANDMLDPPVVDENA

SEQ ID NO: 141028 - protein, 199 aa, Glycine max
  Coding DNA Sequence Number=SeqID_24250
  Gene Ontology: Mol. function=nucleic acid binding; Cellular component= nucleus; Biological process=DNA integration
MGCKWILKKKSGSSTEEVIHYKTHIVAKGYNQKEEMDYNEIFSLVVGHSSIRVLLTLVANLNMELEQLNVKTTFLHGRLEEEILMQQPKGFEVEGKEIFFCRLKRSLYGLKQSPRQWYKRFDEFIVSHGYIRSPNDSCVYYSKVEVGSHIYVLFYMDDMLITSQIFLAIQRLKSLHNSAFEMKDMGVAKKILGMEIKRG

SEQ ID NO: 141029 - protein, 262 aa, Glycine max
  Coding DNA Sequence Number=SeqID_24251
MVVDMRDNIDVAECIIKLIPQWRSFGDRITLDGNKSVPRLPPDSMPVVDLVASDQEMELYPLGKVLGLGELHWNDEVVWGIWSLIMSGVITQLGYSFPITRADNIGSCSVEYPGDDDRICSQGWKENVEVLKPKPTNSYVVKEKSLTPTKKEALKRITDPSKEFEYYVPYKLILISSTESEKLMLRGKLRNLIRMLRALRKSNEVVEANFMMMNQAILMMPKAQVIDSSLIQDFKIKHQESNPVFKIQEKKSRSNKSRLHIG

SEQ ID NO: 141030 - protein, 44 aa, Glycine max
  Coding DNA Sequence Number=SeqID_24252
MEIVDYWTVDDRDRVDDNVGHLNALTCSSCPSKMPHKAPKKTIE

SEQ ID NO: 141031 - protein, 95 aa, Glycine max
  Coding DNA Sequence Number=SeqID_24253
MDVSTDLGHKSASELFTPDQYQSLLALIQQNHKPSSSDVHASNMVQSSTSNYVLENFHMIPSVNKVGVCDGSDDDPKGDWGGEGLDQHRNSQGRE

SEQ ID NO: 141032 - protein, 86 aa, Glycine max
  Coding DNA Sequence Number=SeqID_24254
  Subcellular localization annotation: CTP_CleavageSite=36; ConfidenceScore=5.14e-01
MVPFCKLIPQMGSFWNNFRHGALFYVGCMHFACKTQARMVTSWAEDTSKPNPPVLLATSRGSLSRQHCWRLHGCAEIAALTGDFRG

SEQ ID NO: 141033 - protein, 688 aa, Glycine max
  Coding DNA Sequence Number=SeqID_24255
  Gene Ontology: Mol. function=endoribonuclease activity, producing 5' -phosphomonoesters; Cellular component=endoplasmic reticulum; Biological process=protein amino acid phosphorylation
  Homolog annotation: Hit_ID=Q1SZQ5; Match level="QueryCoverage=98%, HitCoverage=77%, E-value=0.0, Identity=60%"; Hit description=Protein kinase; PUG; Quinonprotein alcohol dehydrogenase-like
  Pfam annotation: Domain name=Pkinase; Domain location=334-620; Score =158.8; E_value=1.4e-44; Accession=PF00069.15; Description=Protein kinase domain
  Pfam annotation: Domain name=Pkinase_Tyr; Domain location=334-620; Score=-0.7; E_value=2e-12; Accession=PF07714.7; Description=Protein tyrosine kinase
  Pfam annotation: Domain name=Ribonuc_2-5A; Domain location=625-686; Score=-42.4; E_value=0.021; Accession=PF06479.2; Description =Ribonuclease 2-5A
  Pfam module annotation: Pfam domain module=Pkinase::Pkinase _Tyr::Ribonuc_2-5A; Domain location=334-620::334-620::625-686
MRISESIAEYVARTPTFSDDGAVTLGSKRSTLFEVDAKTGSIIKIHAMSDIDNASAPWSDGNQGVTNILNVNDKDLADPMKLNSPQPLLKIFRTDYSLKSVGPSSGIVLWTMAVAELEAVLLCQHTSFDLEDEYASDSSLNFRMPYPCQEINQVIRLKKNFQFEPSLTERLLVDYHENDMLSIPNSNLILPSQPNIDRLFNGHDDNIMLPQQPLVEITTPGEVYLNRTSEWPTPLPLILFTVFLVAFSVIYPLVIKNQDVMKDQNSESELKSSPAKKKKTRKSGKKNDTIDKREKHLSPENKDVLTQKGNYREVWQHFNQVDESVDGRRIGKLFVSNKVIAKGSNGTIVLEGIYEGRAVAVKRLVKAHHDVAYKEIQNLIVSDQHPNIVRWHGVEYDSDFVYLALERCTCNLDDLIQIYSDISENSVLMKDQGFRCLIKSQMEMEKYNTQCLWKENRYPSPLLLKLMRDIVSGVVHLHELGMIHRDLKPQNVLIIKEKSLCAKLSDMGISKCLLENMSSLGNNATGGGSSGWQAPEQLVEGRQTRAVDIFSLGCVLFFCVTGGKHPFGERIERDINILKNKMDLFLVEFIPEAKDLISRLLNPNPDVRPKATEVLYHPFFWSSEMRLSFLRDTSDRVELENRETNSDLLVTLESIATVALGGKWDERMEPAFIANIGLATWWVGVGFC

SEQ ID NO: 141034 - protein, 932 aa, Glycine max
  Coding DNA Sequence Number=SeqID_24256
  Gene Ontology: Mol. function=ionotropic glutamate receptor activity; Cellular component=integral to membrane; Biological process=ion transport
  Homolog annotation: Hit_ID=Q84W41; Match level="QueryCoverage=98%, HitCoverage=98%, E-value=0.0, Identity=54%"; Hit description =Glutamate receptor 3.6 precursor
  Pfam annotation: Domain name=ANF_receptor; Domain location=56-419; Score=320.0; E_value=4.1e-93; Accession=PF01094.18; Description =Receptor family ligand binding region
  Pfam annotation: Domain name=Lig_chan; Domain location=600-880; Score= 277.6; E_value=2.4e-80; Accession=PF00060.17; Description=Ligand -gated ion channel
  Pfam annotation: Domain name=SBP_bac_3; Domain location=481-839; Score=-34.2; E_value=8.3e-06; Accession=PF00497.10; Description =Bacterial extracellular solute-binding proteins, family 3
  Pfam module annotation: Pfam domain module=ANF_receptor::Lig _chan::SBP_bac_3; Domain location=56-419::600-880::481-839
  Subcellular localization annotation: CTP_CleavageSite=61; ConfidenceScore=5.20e-01
MAFQRETTTMIGVWLVVLMVLSKGLSSTGVVPDNFTIPSFVNIGVLYSFNTSVGRMVKTAVQAAVDDVNSDPSILANTKLKASLQEDTKYRGFLSIAEALQLMATQTVAIIGPQTSTTAHVISHIANELQVPLLSFTATDPTLSSLQFPFFIRTAFSDIYEMTAIADFVNYFGWREVIAVYGDDDHGRNGIGALGDKLSERRCKISFKAPMTPEATREEITDVLVQAALEESRVVVLHTSTAWGPKVLSVAKSLGMMENGYVWITTTFLSTWLDIGSPLSSDATDDMQGVITLRMYIPDSERKRWFFSRWKNLTTGKTANGSQGLSTYGIFAYDTVYALAHALDAFFKQGNQITFSRDPKLSQLRGDNIHLDAVKIFNEGKLLHKYIYEVNMTGVSGLFKFTSDGDLVNPAYEIINVIGTGTRRVGYWSNYTGLSIVPPEALYSKPPNRSSASQKLLPVLWPGETTHKPRGWVFPNNGRMLKIGVPKRVSYREFVSQVQGTDMFKGFCIDVFLSAVNLLPYAVPYKFVSYGDGDSNPSNTELARLITAGVFDAAVGDITITTERTKMVDFTQPYIESGLVVVASVKKTDSNAWAFFTPFTPMMWTVTAVFFLLVGAVVWILEHRLNDDFRGPPKQQMVTILWFSFSTMFFAHRENTVSTLGRFVLLIWLFVVLIINSSYTASLTSILTVKQLSSPVKGIESLRSSKEPIGYLQGSFTRNYLIDEIGIDESRLVPLKTPEETAEALKKGPQKGGVAAYVDERAYIELFLSSRCDYSIVGQEFTRNGWGFLLTLEVVPDQDSENEVAFPRDSPLAVDLSTAILELAENGDLQRIHDKWLLSSACLSQGAKLEVDRLNLRSFWGLYLVCGLACVLALLIYCIQTMRQYSKHRPEELESSGHGSGSSCLRTFLTFIDEKEEIVKSRSKRKKMEGIS

SEQ ID NO: 141035 - protein, 125 aa, Glycine max
  Coding DNA Sequence Number=SeqID_24257
  Gene Ontology: Mol. function=nucleic acid binding; Biological process= DNA integration
  Homolog annotation: Hit_ID=Q1SS72; Match level="QueryCoverage=87%, HitCoverage=7%, E-value=5e-30, Identity=53%"; Hit description =Integrase, catalytic region
MREKVEQTPSMDSCLYLHPSENPAVALVSPILDSSNYHSWSRSMMTALSAKNKVEFINGSVPEPPKTDRTHGAWRRCNNMVVSWIVHLVSTSIRRSILWMDKAEEIWHDLKLRYSQGDLLRISDL

SEQ ID NO: 141036 - protein, 131 aa, Glycine max
  Coding DNA Sequence Number=SeqID_24258
  Gene Ontology: Mol. function=heat shock protein binding; Biological process=protein folding
  Homolog annotation: Hit_ID=Q9SIL3; Match level="QueryCoverage=82%, HitCoverage=37%, E-value=7e-27, Identity=51%"; Hit description =Putative heat shock protein
MGFGCYRELRDFGCHLKGQVSNDEYGEEGLKGQVPPPDAGGHTFFQTGDGPTTFRFNPRNADDIFAEFFGFSSPFGGGGCGNGMRGGRTMSQQGPRKPHPIEKTLPCTLEELYKGTAKKMKISREIADASG

SEQ ID NO: 141037 - protein, 85 aa, Glycine max
  Coding DNA Sequence Number=SeqID_24259
  Gene Ontology: Mol. function=phospho-N-acetylmuramoyl-pentapeptide -transferase activity; Cellular component=integral to membrane; Biological process=peptidoglycan biosynthetic process
  Homolog annotation: Hit_ID=O49730; Match level="QueryCoverage=86%, HitCoverage=22%, E-value=8e-13, Identity=52%"; Hit description =Phospho-N-acetylmuramoyl-pentapeptide-transferase homolog
MKKTTPTLGGLLFIPVGVVVAHVFAGSSSIEVSGAAGATIGFAAVGLLSDILSLTKNHWRGLPALTEVLLEGLFGRKEVGEKLGG

SEQ ID NO: 141038 - protein, 256 aa, Glycine max
  Coding DNA Sequence Number=SeqID_24260
  Gene Ontology: Mol. function=nucleic acid binding; Cellular component= ribonucleoprotein complex; Biological process=RNA processing
  Homolog annotation: Hit_ID=Q5JM05; Match level="QueryCoverage=89%, HitCoverage=59%, E-value=2e-41, Identity=44%"; Hit description =Putative RNA-binding protein homolog
  Pfam annotation: Domain name=RRM_1; Domain location=49-135; Score =15.1; E_value=0.0058; Accession=PF00076.12; Description=RNA recognition motif. (a.k.a. RRM, R
MNCIAIYTSSPKQKILPWGLQVVSGDGRRVKRLNPLRFNESRDHKLYTVLVENLPEDHSKKNIQQIFHEAGNIKRITIHDPHSTSESAKQHNKQEMLISNKLHALVEYETMEAAEKAVAMLNNEQDWRNGMRVKLLKGMGKYGHKKQAWKGHHSEKNSSRPEQTGDEENHGSNDHHEDTHEEEDGDHLSKDKGGQRYRNQGRSRKHKYRAGNGMGHGSAPSTHAAEASKSPPGPRMPDGTRGFAVGRGRPPVPASN

SEQ ID NO: 141039 - protein, 194 aa, Glycine max
  Coding DNA Sequence Number=SeqID_24261
  Subcellular localization annotation: CTP_CleavageSite=29; ConfidenceScore=5.10e-01
MPSHSCILNHHRHRSLPLPLPLHLSRRKRLSLPPTPSLIYSPSSRFDCATLELHPSIIPQNECCFPRNVAPTRAFDDFHCGVTLTVRNSTRYSVEVLDALKDSFDIPMLDYWDADDNSSAYMLSSSDGEDSDGEIFLTPVNDLDLPSVSASNNDALTVAAHRFANLGRGRKKSRQKFGMIYVALALHVEAVSKC

SEQ ID NO: 141040 - protein, 132 aa, Glycine max
  Coding DNA Sequence Number=SeqID_24262
  Gene Ontology: Mol. function=phospho-N-acetylmuramoyl-pentapeptide -transferase activity; Cellular component=integral to membrane; Biological process=peptidoglycan biosynthetic process
  Homolog annotation: Hit_ID=O49730; Match level="QueryCoverage=78%, HitCoverage=32%, E-value=4e-21, Identity=51%"; Hit description =Phospho-N-acetylmuramoyl-pentapeptide-transferase homolog
  Pfam annotation: Domain name=Glycos_transf_4; Domain location=1-88; Score=-61.5; E_value=0.0052; Accession=PF00953.11; Description =Glycosyl transferase
MGHGVKLADALDGLAGGIAALAFTGMSIAVLPICSDLAIFGASMAGSCVGFLLHNRYKASVFMGNIGSLALGGALAAMAACTGMFFPLLISSGFFIVESLSVIIQAFCIFFYFMSSSDLGFDSLKRSLEYVY

SEQ ID NO: 141041 - protein, 204 aa, Glycine max
  Coding DNA Sequence Number=SeqID_24263
MEHATRGTARRTRQQQGSAPDADASDSALLLGATGTWVVPASGALPVAPSDRALPVAPSGRALPDAPVSGALPCCLVRRAVPRVACSMEAPSWGALCNKKTDPLGDFRCYMCHFHSYKSLLHWLIQFLGLIPLPPKPPRRRTRGGRKRKCLRGKSRVDLVAYGSVACGDGTEDGAGWCGTNIQTNEEVAIKLVGFYPGVLNVID

SEQ ID NO: 141042 - protein, 70 aa, Glycine max
  Coding DNA Sequence Number=SeqID_24264
  Gene Ontology: Mol. function=protein serine/threonine kinase activity; Cellular component=cytoplasm; Biological process=protein amino acid phosphorylation
  Homolog annotation: Hit_ID=Q8LR51; Match level="QueryCoverage=90%, HitCoverage=13%, E-value=5e-29, Identity=98%"; Hit description =Casein kinase I-like
MDLLGPSLEDLFNFCSRKLSLKTVLMLADHMINRVEFVHSKSFLHRDIKPDNFLMGLGRRANQVADPVYL

SEQ ID NO: 141043 - protein, 375 aa, Glycine max
  Coding DNA Sequence Number=SeqID_24265
  Gene Ontology: Mol. function=nutrient reservoir activity; Cellular component=anchored to membrane
  Homolog annotation: Hit_ID=Q43557; Match level="QueryCoverage=89%, HitCoverage=89%, E-value=2e-93, Identity=48%"; Hit description =Unidentified precursor
  Pfam annotation: Domain name=CBM_4_9; Domain location=22-181; Score= -17.0; E_value=0.081; Accession=PF02018.8; Description=Carbohydrate binding domain
  Pfam annotation: Domain name=DUF642; Domain location=39-361; Score =702.0; E_value=4.2e-208; Accession=PF04862.3; Description=Protein of unknown function, DUF642
  Pfam module annotation: Pfam domain module=CBM_4_9::DUF642; Domain location=22-181::39-361
MGPEQKTFVILVNLGMGNDPIVRLVANGDFEATPRNGFPNEAIVEGPSEVPNWKSNGNVELVESGQKQGGMILIVPQGRHAVRLGNDAEISQELPVEKGSIYSLTFCAARTCAQFESINVSVLPASQTIDLQTLYNVQGWNPYAVSFNADQDTFRLLFKNPGMEDDPTCGPIIDNIAIKKLFTPLKPKDNAVINGDFEEGPWMFRNTSLGVLLPTNLDEETSSLPGWIVESNRAVRYIDSDHYSVPQGRRAIELLSGKEGIISQMVETKPDMLYSLTFSLGHADDKCKEPLAVMAFAGDQAQNIHYTPNSNSTFQTANVNFTAKAERTRIAFYSIYYNTRSDDMSSLCGPVVDDVRVWFSGSNGLHGLGLGRLGL

SEQ ID NO: 141044 - protein, 163 aa, Glycine max
  Coding DNA Sequence Number=SeqID_24266
  Gene Ontology: Mol. function=nucleic acid binding; Cellular component= mitochondrion; Biological process=DNA integration
MNLLLDHLHLLFAGSQLPDPETYRRLIGRLLYLTISRPDICYTVHKLSQFVSDPRSGHMNAANILLRYLKHIVGQWVLFKAKLDTSLHSYVDADWVVYRDNKAATHIATNPTYHERTKHLEIDMHYVKEQVDKGALKLIHPIKGKAPAPFQFQFQNLFDKFPS

SEQ ID NO: 141045 - protein, 119 aa, Glycine max
  Coding DNA Sequence Number=SeqID_24267
  Homolog annotation: Hit_ID=Q8L701; Match level="QueryCoverage=45%, HitCoverage=18%, E-value=7e-09, Identity=50%"; Hit description =Putative Ap2 domain protein
  Pfam annotation: Domain name=AP2; Domain location=1-55; Score=1.9; E _value=0.00034; Accession=PF00847.10; Description=AP2 domain
MEYYDAIDGSWEAYKVHLWLGTYGIAEEAAMVYYDVVIRLHGPDALTNFTPPQRDSPSPSPLPAVAETLAEVCEMKVIAILDKLKNDKSQNKELLDSSPNEDDDDWDGEDPEEGIIYVE

SEQ ID NO: 141046 - protein, 146 aa, Glycine max
  Coding DNA Sequence Number=SeqID_24268
  Gene Ontology: Mol. function=UTP:glucose-1-phosphate uridylyltransfera se activity; Biological process=metabolic process
  Homolog annotation: Hit_ID=Q9LKG7; Match level="QueryCoverage=93%, HitCoverage=46%, E-value=2e-25, Identity=39%"; Hit description=UTP- -glucose-1-phosphate uridylyltransferase
VAPKTLADVKGGTVISYKGRVSEIKSIKKFKIFNTNNLWVNLEAIKSLVEADDALKMEIIPNPESYLYTLQDGLVIRNQARANPKNPSIELGPEYKKVVNMSLTFPISFTRKNKFLAKLVVKLEIPHGAVIKDKGKNKKAVYAKDV

SEQ ID NO: 141047 - protein, 444 aa, Glycine max
  Coding DNA Sequence Number=SeqID_24269
  Gene Ontology: Mol. function=nucleic acid binding; Biological process= metabolic process
  Homolog annotation: Hit_ID=O64851; Match level="QueryCoverage=95%, HitCoverage=77%, E-value=1e-158, Identity=65%"; Hit description =Expressed protein
  Pfam annotation: Domain name=IQ; Domain location=38-58; Score=16.9; E_ value=0.072; Accession=PF00612.17; Description=IQ calmodulin-binding motif
MEIMGSDRSEQLQHKPVPVLSLPKEVVFSSPRPVSELDAAATKLQKVYKSYRTRRNLADCAVVVEELWWKALDFAALKRSSVSFFDVEKQETAVSRWARARTRAAKVGKGLSKDDKAQKLALQHWLEAIDPRHRYGHNLHMYYDIWFESQSTQPFFYWLDVGDGKEINLEKCPRSILQRQCIKYLGPKEREEYEVIVEKGKLVYKQDGRLVDTDGKSKWIFVLSTTRSLYVGRKQKGAFQHSSFLAGAATTAAGRLVAQQGVLEAIWPYSGHYHPTEENFKEFISFLDEHNVDLSNVKKCAIDDDAPSIVGSNSFIDINESQQINKGPTLSSSNYVNNNSVTINAAINKEIEKKVVAPVLDVPKRLTCKWSTGAGPRIGCVRDYPGHLQTRALEQVNLSPRPASARPYSYGPIPSPRPSPKVRMSPRLAYMGLPSPRISIPAAS

SEQ ID NO: 141048 - protein, 113 aa, Glycine max
  Coding DNA Sequence Number=SeqID_24270
  Homolog annotation: Hit_ID=Q10PS3; Match level="QueryCoverage=32%, HitCoverage=5%, E-value=2e-12, Identity=91%"; Hit description=HEAT repeat family protein, expressed
MVPFTVLRSEYTLLQTNVKWQLGWPVGGYPGPQINEFVKLGGDQLVPYYADILGAILPCIADKEEKIRVVGDTLSDIGLYLLTSLKGTPSKTVLTSARLRRSAFKDDANISTS

SEQ ID NO: 141049 - protein, 232 aa, Glycine max
  Coding DNA Sequence Number=SeqID_24271
MQSISGYVLLIQLWAWERCPKLVPSIVPPQQQNNPLGYRWLQNRNPRMASDSVEHCRFKLDTMKKGEGEIIETMQFMLSPYGRRVSNLEDLASCLDKMTLLAEEEDRIIEAREETSPSIPQFESQQFDMLGRSVETQGLGQRRESMDAEAHVIPAMPERQHGMYYTPDQSTQESSQMSPLYSYPYQRYSTTVEYGLQRRWMTVVDSNIVECRNLQRRCNNDCLRSRSFQRSS

SEQ ID NO: 141050 - protein, 174 aa, Glycine max
  Coding DNA Sequence Number=SeqID_24272
MNGSLRVIHRLESRLSFLFACLYVFVDVCECEVVLRKWMMDKGTLGCSGWRGSKNLGKLASGDYLTFGANHQDLGGLVAVIGPYCELSVIVTCLGCESVERRTHSYNNNFQVLTMSSTLSRLRAQCSLQRERVTEDRGDHSDISSEEIKEYRELLRQLESTFEEESDDSFEGTS

SEQ ID NO: 141051 - protein, 278 aa, Glycine max
  Coding DNA Sequence Number=SeqID_24273
  Gene Ontology: Mol. function=voltage-gated ion-selective channel activity; Cellular component=mitochondrial outer membrane; Biological process=anion transport
  Homolog annotation: Hit_ID=Q5CZ53; Match level="QueryCoverage=91%, HitCoverage=99%, E-value=2e-72, Identity=53%"; Hit description=Pom30 protein
  Pfam annotation: Domain name=Porin_3; Domain location=24-271; Score =76.5; E_value=8.5e-20; Accession=PF01459.12; Description=Eukaryotic porin
MEKEGFTRCWWWCFCAEAKMSGKGPGLFSAIGKIGRDILMKDYNSDQRFTFSSSSTNSGLDLKSTLVKSRGLSSGDVAAAFKYKNKAVNVKVDTESNVLTTFTVSDVVPSVKTIALIRLPDYNSGKVLRLSWDKRYTPLGLNRSPAIDFSGMMGTPSIVIGAQISFSTRMGKFTKYKGDKGDSMKVSYLYQLERLNGGAVVGEISRRFSTNENTLTVGCLYVVDSQTALKAKLNNHGNLGALLQHELTRKSFLTISSAFETKDLDKSPKFGFTLLLKP

SEQ ID NO: 141052 - protein, 240 aa, Glycine max
  Coding DNA Sequence Number=SeqID_24274
  Gene Ontology: Mol. function=nucleic acid binding; Biological process= DNA integration
  Homolog annotation: Hit_ID=Q1SFD6; Match level="QueryCoverage=85%, HitCoverage=13%, E-value=4e-32, Identity=38%"; Hit description =Integrase, catalytic region
MKGEAKRLASRMEGHALIEAWLSPRYRFFNTRSTANNLVTVDSKVIDDQTQHHESQEVHFSPEQYKALLALIQQPSHGNSASTSSNVKQIASVSSCSIDPASITGKFLPSVNHTHTLTSWILDSGATDHVSASLTHFHSYNQLNPPIMVKLPNGHYVLATHSGDICLSASIILSDVLYIPLFTFNLISISKLVSSTNCKLIFFSTSCILQDTNTQVRIGTVEVRNGLYHLTPNHITTPTV

SEQ ID NO: 141053 - protein, 351 aa, Glycine max
  Coding DNA Sequence Number=SeqID_24275
  Gene Ontology: Mol. function=nucleic acid binding
  Homolog annotation: Hit_ID=Q1SL28; Match level="QueryCoverage=85%, HitCoverage=31%, E-value=7e-55, Identity=68%"; Hit description=RNA -binding region RNP-1
  Pfam annotation: Domain name=SPOC; Domain location=258-339; Score= -12.0; E_value=0.1; Accession=PF07744.3; Description=SPOC domain
  Subcellular localization annotation: CTP_CleavageSite=23; ConfidenceScore=5.06e-01
MDSLMCGGWLRIAISSKANSFYVVSYKPGNQIAVPFSVKPENNSMELVSPRINSENHNLPQSNWHFPGSREMSELGARKPDGYDNLSQDPHQGGIVPHSHSGAHGPSIPPPQQIQSSPFVRPVYVPPNGPWDRRGINNHLPVSQFKTGVMPNNFHGNAVVSPFIPASVTPLAQIQGTPMHPYNQQVPPSIIPPPLSSLPPPQPEMPPPLPPSPPPLPQVQPPLVPPLPSSPPPPPPPPLPVQEAVDMECSGQSLLYQWQGNLCKSGVNYCTIYACKADSNICRYSNAIPEPAEWPSKLDMTKRTDLRHVKSTFAATPSHRVDMGSHHLSPMSKVGHLEPGDCRTDLGKSWS

SEQ ID NO: 141054 - protein, 93 aa, Glycine max
  Coding DNA Sequence Number=SeqID_24276
MAQDMWGMKRWFFKRLRKQALRTMKLLRSAFKGKKLYSPLSFMDYVIFKIMSAKMESNGTLPSAPEINTIKSDSGNERAMQTTFNNNKPYPTR

SEQ ID NO: 141055 - protein, 346 aa, Glycine max
  Coding DNA Sequence Number=SeqID_24277
  Gene Ontology: Mol. function=protein transporter activity; Cellular component=nuclear pore; Biological process=protein import into nucleus, docking
  Homolog annotation: Hit_ID=Q1RYT8; Match level="QueryCoverage=94%, HitCoverage=75%, E-value=1e-97, Identity=50%"; Hit description=IMP dehydrogenase/GMP reductase
MQAELHALQMNNTWTLTTLPPHKTAIGCRWVYKIKYNADGSVERYKARLVAKGYTQMEGLDFLDTFSPVAKLTTVRFLLALATLHGWHLRQLDVNNAFLHSELNEEVYMQLPPGLLVDNPHQATMGDPLSAEASSSYRRLVGRLIYLTNTHPDIAHVVQQLSQYMAHPTTAHSQAASRVLRYLKGTLGSGIFFSATGSLQLKAFSDSDWAGCHDTRRSIIGFSVYLDNSIISWCSKKQPTLSRSSSEAEYRALASTTCELQWLTYLLQDLRVSYVQPTNLYCDNQSAIQISFNQVFHERTKHIDLDCHIVREKVQSGLLKLLPISSLMQLADIFTKPLPPTMSQLL

SEQ ID NO: 141056 - protein, 134 aa, Glycine max
  Coding DNA Sequence Number=SeqID_24278
  Gene Ontology: Cellular component=integral to membrane
  Homolog annotation: Hit_ID=Q1SZN9; Match level="QueryCoverage=83%, HitCoverage=43%, E-value=9e-17, Identity=61%"; Hit description=Auxin Efflux Carrier
MGDLPVVIIPAICDQKGGPFGAPDDCRIRALSYSFCSLALVDQGPYIVMKNIERSFCHRMMETLGQILAEPMSPPTIATFLGFLYGGVKWTRNLIIGHDAPLKVIQDSIQLLGLKGQPEKSKKGGMNENIKMNV

SEQ ID NO: 141057 - protein, 271 aa, Glycine max
  Coding DNA Sequence Number=SeqID_24279
  Gene Ontology: Mol. function=nucleic acid binding
  Homolog annotation: Hit_ID=Q1SL28; Match level="QueryCoverage=99%, HitCoverage=27%, E-value=1e-112, Identity=74%"; Hit description=RNA -binding region RNP-1
MDIGLGTRGAMNGVAVGSSSHIYVGNIPSQWARDEIMHETRKVIHKGPLAFIDLSCEFALLMEFETPEEAATVMLHLRQLRRERSNYNQHFGPGTVNVGIGHAYMDGGRPIPAPPPPPPPPNLDLKVNNPAGSPHARTLSGSPADSSRTRMSHLSTLLASLRTKYNINQNLGLSDNYTIGNNCPPMREEDMVPSSTLCITIPRSSSLFLTDDELMAICNLAIGNSGSIVQLTQTNLQMGCSWFVECSNVDGAVSVLKNLRGCPGLFFQIEF

SEQ ID NO: 141058 - protein, 574 aa, Glycine max
  Coding DNA Sequence Number=SeqID_24280
  Gene Ontology: Mol. function=nucleic acid binding
  Homolog annotation: Hit_ID=Q1SL28; Match level="QueryCoverage=53%, HitCoverage=28%, E-value=1e-82, Identity=54%"; Hit description=RNA -binding region RNP-1
  Pfam annotation: Domain name=RRM_1; Domain location=509-574; Score =7.8; E_value=0.027; Accession=PF00076.12; Description=RNA recognition motif. (a.k.a. RRM, R
MVFAWLISRLYKSNKTCCMSVQRIVADLIPRYACHCPTALEAAAKVVINMHNLSLALISRGEDSSGIAFETARACICGLADVCCDASSVAPTLAVIRGICEAVFQNVLTFFIALFEGKDVLQMVDKNFLNMQDTPEAFSELKQKILDEDESSLTKLSKLRVLCLLRIFFSCPKDLLAACLDLFGSATKEATNAEGQRFLSLVTSTFDDDKAVHLFERAIGGSKSCTDSTGSGIRDNEAGEAIMTEDNHVSGGDSSVGKSCLLMQVLDKDPLLRKWMLCRCKKLLDLLSDVSLEITSVLQGILGMFPRQTDLEDCQADSDEDKSDSSIYMNRNYMVPRISEEHESIGESSGKGSSLRVHVGSSDGFTDKYVMDHSSAVPLDHVPVLKVGSHYDNGVSKPMSIGVGEEGNMPTPRDSVSHQMFSPAVRTPVDFRSNSFEGRNDFLNVEKNHVLNMNFNSPPLRSSSGSVSNSLASPNHHFMSPTASTKGQIVWCCDGDPAAMDIVSASKQLWIGYVGPDVPENHIRFHLERFGTIEQFIFFPVKGFALVEYRRIIDAIKTRHCLPGCFPCRVNSWI

SEQ ID NO: 141059 - protein, 547 aa, Glycine max
  Coding DNA Sequence Number=SeqID_24281
  Gene Ontology: Mol. function=calmodulin binding; Cellular component =integral to membrane; Biological process=cell death
  Homolog annotation: Hit_ID=Q1SZN5; Match level="QueryCoverage=96%, HitCoverage=94%, E-value=1e-173, Identity=60%"; Hit description=Mlo -related protein
  Pfam annotation: Domain name=Mlo; Domain location=9-483; Score=794.1; E_value=7.8e-236; Accession=PF03094.6; Description=Mlo family
MSVSNESSIGSKDLDQTPTWAVACVCTVFILISITLEKSLHKVGTWLREKHKKALLEALEKVKAELMVLGFLSLLLTFGQSYIVRICIPADVADKLLPCPYVGTHKGSSGEEEHRRKLLSYERRYLSDDATPYQCKERHQPLLSGNGLHQLHILIFFLAVLHVFYSAVTMLLGRLKVGWNCAREYNNNHIQAQTQLRFEDGKHGRRRLHLMGMSLPMGCFFRQFYRSVGKADYLALRNGFITVHLAPGSKFNFQKYIKRSLEDDFKVVVGVSGNLFDIHAHYVVDSPVLWASFVVFLLLNVNGWHAMFWASLIPVVIILAVGTKLQATLANMAIEITERHAVVQGIPLVQGSDRYFWFGRPQLVLHLIHFALFQYSFGLRNCFHADYKLAIVKVALGLGVLCLCSYITLPLYALVTQMGSRMKKSIFDEQTSKALKKWHMAVKKKQGVKLGNSRVRALDGSSTASTIHSSGPTLHRYKTTGHSTHFTPNYDDQDDYHSDTELSPISPTANLIVRVDHDEEEAKENEHPTANNQEVPLRLTSLERSMK

SEQ ID NO: 141060 - protein, 309 aa, Glycine max
  Coding DNA Sequence Number=SeqID_24282
MTKLKTTLSPETKAVAPKWIEVKSHVQTGCYECGYYIMHWMWNIITSDIKSDWSMWFVDETPLDIDNITTIRKKWATYFLKTTINVLPRSFPLQQLSERMKCPRSLDGCLVEGIIVFASVMATLGLEILIESASQVILKMILSFDLAFALIPLLKFTSSKMTSSTSIEEVCFLLVCGLMNYKDCRHANGRRPGDENYDSRELLRSLSNAQGSGRFCTKVNSDWPERMQILSLGQDKRLVPISMNSNGSTQLYTGFDKRGTTSTTVLNKTRLYRFLCQQRRVRRPPALKLQRTTTVYSPTDVDILSNNVE

SEQ ID NO: 141061 - protein, 177 aa, Glycine max
  Coding DNA Sequence Number=SeqID_24283
MGFFKPLPKVVQWPVQFPKSNEDLTQLCLKTNAIRKCGHEHFYIRRVERMGAQGSAESMDIDELRVLNVFNCLCSVVEIERGFHLQLEENAKIIFWPYINNFDFCRVWGCEIYRNSRQCQFRMEVYFVAVNELEDNKLLVLHGAMGISIFNIIAITRSVILELVLVAEPSILIRVIR

SEQ ID NO: 141062 - protein, 67 aa, Glycine max
  Coding DNA Sequence Number=SeqID_24284
  Gene Ontology: Mol. function=oxidoreductase activity; Biological process=protein modification process
  Homolog annotation: Hit_ID=Q1RVE5; Match level="QueryCoverage=85%, HitCoverage=10%, E-value=3e-22, Identity=89%"; Hit description =Ubiquitin family, putative
  Pfam annotation: Domain name=UBA; Domain location=23-62; Score=36.6; E_value=8.6e-08; Accession=PF00627.21; Description=UBATS-N domain
MFGGLAAGSLAVPNRSNEPPEQLYATQLSQLQEMGFFDTQENIRALIATSGNIHAAVELEGHPEELG

SEQ ID NO: 141063 - protein, 54 aa, Glycine max
  Coding DNA Sequence Number=SeqID_24285
MASSSMSTTRSWSTKDNKTFERALAIYNKDTLDRWNYREDTQGFIQWFSMHTRA

SEQ ID NO: 141064 - protein, 114 aa, Glycine max
  Coding DNA Sequence Number=SeqID_24286
MQSTGSLRQCGIHHVSKPCADKVCRQGCITPISFPGNIVNQPPVSCATEQKGKAAYEDAEMDPEIQHLIETLFWEIDICPPNLIGDITLQVNKTEKARPPPKKLQRVYKIEDMC

SEQ ID NO: 141065 - protein, 157 aa, Glycine max
  Coding DNA Sequence Number=SeqID_24287
  Homolog annotation: Hit_ID=Q40487; Match level="QueryCoverage=37%, HitCoverage=17%, E-value=3e-07, Identity=44%"; Hit description =Cationic peroxidase isozyme 40K precursor
MKFNDKSGAITVLTDWRHLPMLQKVDFGWKEAVNTMSLFLRVCAGSYEMYVCMIPLDIAYTERRSGAADQESALVTQQQSEDIAKELVDEDKFFTEFAQSMKRMRAIDVLTDSAGEIRNKCSGEIKEENSYGERFRYTFKLPLFQFDRWLCVIRKGG

SEQ ID NO: 141066 - protein, 94 aa, Glycine max
  Coding DNA Sequence Number=SeqID_24288
MCSIHRGQAEKEFRVEVEAIAKKTKNQRKTKWRRKKQRKKKKKEKEKKSQESKDDKESKEESAPPEHRSFSLVYVNSGNLEQWLHGAISQERDT

SEQ ID NO: 141067 - protein, 82 aa, Glycine max
  Coding DNA Sequence Number=SeqID_24289
MALPAQEIQTHLFHLPKVHHSYCGAPRRGAHWDKVGLCDYLNQLPYSHRVIICKNLNSDSNRDRGRIVMRETWEEFQKLGEK

SEQ ID NO: 141068 - protein, 158 aa, Glycine max
  Coding DNA Sequence Number=SeqID_24290
MALAKDQTIPRDSSLSSKVQNCVFSETSVEVTSMTVHRVNEYHKSVLEDREDGSPTTNGLSNDSAITHFPPLCGSVKGYAYKGTNYQLEEAEPLINLKGYSNLIQGGGSLLGFQQNKMIPKNCYMKENDQKERNNMAKVHQGCSTQHQLFLMLVASTR

SEQ ID NO: 141069 - protein, 168 aa, Glycine max
  Coding DNA Sequence Number=SeqID_24291
MGTIYVLVLNCRKDINWSTSDPVDPGVFKSKKYLKFIDSKKVDGLNNCKLASEELGTEATFRYAAISTKKKNALLPSLSHNLTCFSLFVLISVIVQVQVTNLLINKQVKMACSIYCSLCEVDRVVLVLKVRAFALLMPELIDLQDDLQKYLLIQFSCPLNLNGEDVIG

SEQ ID NO: 141070 - protein, 68 aa, Glycine max
  Coding DNA Sequence Number=SeqID_24292
MLKREIIQPSTSPFSLPIMLVKKRDGTWIKEDKVQVVDVSLSEADPLSEWHPLSEAYSSLSGLGNPRR

SEQ ID NO: 141071 - protein, 77 aa, Glycine max
  Coding DNA Sequence Number=SeqID_24293
MACTHIPLSKLPHVWHLLSMSGFTRDSPQISASPHQLDLAPYASGPYNAQWNAPGLLHDKHTLRSSHFSGKMEVEET

SEQ ID NO: 141072 - protein, 574 aa, Glycine max
  Coding DNA Sequence Number=SeqID_24294
  Gene Ontology: Mol. function=voltage-gated potassium channel activity; Cellular component=integral to membrane; Biological process=potassium ion transport
  Homolog annotation: Hit_ID=Q93YI7; Match level="QueryCoverage=99%, HitCoverage=73%, E-value=1e-178, Identity=58%"; Hit description =Inward rectifying potassium channel
  Pfam annotation: Domain name=Ion_trans_2; Domain location=1-98; Score= 49.5; E_value=1.2e-11; Accession=PF07885.6; Description=Ion channel
  Pfam annotation: Domain name=cNMP_binding; Domain location=192-281; Score=55.6; E_value=1.6e-13; Accession=PF00027.19; Description =Cyclic nucleotide-binding domain
  Pfam module annotation: Pfam domain module=Ion_trans_2::cNMP_binding; Domain location=1-98::192-281
VTLFTVHCAGCFNYLIADRYPDSKRTWIGAVYPNFKEESLWDRYVTAIYWSIVTLTTTGYGDLHAENTREMLFDIAYMLFNLGLTSYIIGNMTNLVVHWTSRTRNFRDTVKAASEFASRNHLPHRIQDQMLSHICLRFKTEGLKQQETLNDLPKAIRSSIAHHLFFPVVQKVYLFQGVSHDFLFQLVSDMEAEYFPPKEDVILQNESSTELYVLVSGVVDLVRYIDGHDHVHGKAAAVDAFGEIGVLYHIPQPFTVRTTELSQILRINKTSLMNVLHANPGDAQIIMDNLLMRLKGREGFGFEYPCTDSGRFPHEVLQGGNTRGGPSHECTNNSLEHSLMHEGECIYIGNSETSLHKGTNDDHLVSKHNMIPEHGRRDIHAPANKGNLDIVEILLERDAYPIPNSLGMTQKAQVKRPKNKSICAQKMSCENEKLDEFRIQIAEPKILDLDRNGSTRNRRQDGIRSIKFPLEKTNTNSNSRNSNCPSDRESARLTKKRVTIHLLHSGSTSRGQHGKLIILPDSLEELLQIAGDKFGGFNPTKVINTENAEIDDINVIRDGDHLFLQCSNNEDLSS

SEQ ID NO: 141073 - protein, 64 aa, Glycine max
  Coding DNA Sequence Number=SeqID_24295
MTIIKGFRTVELRVDSESVVRSISGGEEEKEIEVQILWLSIACVADEGLMMFEQPTSFEIIAFR

SEQ ID NO: 141074 - protein, 73 aa, Glycine max
  Coding DNA Sequence Number=SeqID_24296
  Subcellular localization annotation: CTP_CleavageSite=38; ConfidenceScore=5.15e-01
MYDNDYISCSIGRYNCSNCLSAFIMKTKWKFRRQSNSRVSRDRKRVGSVYVLGKVRVQQQLCSVFIRNTDSLV

SEQ ID NO: 141075 - protein, 68 aa, Glycine max
  Coding DNA Sequence Number=SeqID_24297
  Homolog annotation: Hit_ID=Q1S7C5; Match level="QueryCoverage=97%, HitCoverage=5%, E-value=4e-09, Identity=41%"; Hit description =Integrase, catalytic region
MIEEYLCKIKGFVDELAGIGVRVLHEEYVDALLEGLPSNYALVVSIIESKKRTPFIEEIEALLYGHET

SEQ ID NO: 141076 - protein, 337 aa, Glycine max
  Coding DNA Sequence Number=SeqID_24298
  Gene Ontology: Mol. function=nucleic acid binding; Cellular component= oxygen evolving complex; Biological process=DNA integration
  Subcellular localization annotation: CTP_CleavageSite=40; ConfidenceScore=5.34e-01
MGTISGTKLPIHSLINLLKPFSSTTSQLPNDSSGNVPNSLSDYVVSMPLLDFPYFAPNDDTSIFAYSVSTTTIDVVLPPITDASTHDVATNEAFVPVISEQLPSLKRSSKITKANNTWSLVPLPANKHCIGCKWVYKFKHKANGTRDIYRAKLVAKGYTQQVGIDFSDTFSHVAKLTSIIVLLDVATAKIWCLQQLDVNNAFLNGNLFEEVYMDLPQGYKSPKLGLVCKLNKSLYGLRQASRQWFCKSSLVVLLVYVDDIILAGHSSTCVAKRKNALPLLDDIGYLGCKPAFLPMDPNLKLTLLDGESILDPSLYRRLIGRLVYLTISRPGITIVVH

SEQ ID NO: 141077 - protein, 224 aa, Glycine max
  Coding DNA Sequence Number=SeqID_24299
  Gene Ontology: Mol. function=nucleic acid binding; Cellular component= mitochondrion; Biological process=DNA integration
  Homolog annotation: Hit_ID=Q1SRN1; Match level="QueryCoverage=71%, HitCoverage=10%, E-value=1e-48, Identity=60%"; Hit description =Integrase, catalytic region
  Subcellular localization annotation: CTP_CleavageSite=72; ConfidenceScore=5.90e-01
MSPADTTFVPLVPPGFSPLPTHSPNTTIFVPQNSTSFVSVSIQPQSSKSTTLATSSSESISIPNYVPPKTVKQALANTNWLTTMQQEYDALLKNMTWDLVSLPPNRQSIGCKWVFKENVDGSINRFKARLVAKGFHQVHGFDFHETFSHVINPVTIQIILTFALSHKWKLFQLDVNNVFLNWSLEETVFRAQPPNFEVADKSLVSKLNKAIYGLNRPQDNGLTG

SEQ ID NO: 141078 - protein, 92 aa, Glycine max
  Coding DNA Sequence Number=SeqID_24300
MGLERKLDNIWIGLYKLRANVARFIHGRTQMGLGSQMDLCGRNQNKKIWKPKEKIACNKNGDEEWKGRSFTVKEDDMKWLEQCYVGLVNSPE

SEQ ID NO: 141079 - protein, 87 aa, Glycine max
  Coding DNA Sequence Number=SeqID_24301
MLLCPSPSYWTDCPNFGGIWHWDLRVLTFKFNSTWRYLQAATDMLQHTLQDLFNDYSHKEGGTFIGESLFTGFRTDLKTCTKSLVAL

SEQ ID NO: 141080 - protein, 106 aa, Glycine max
  Coding DNA Sequence Number=SeqID_24302
  Subcellular localization annotation: CTP_CleavageSite=29; ConfidenceScore=5.48e-01
MSLYLVKANRHKMVLLQKSQACPCPSHVPLSMSMSCPTSYLNSCFLALHSPLTSSIHESKVAQAPMFSQHQAKSIKCKSSSLVPPKLIFLFIYSHRRKRHSSSSIV

SEQ ID NO: 141081 - protein, 52 aa, Glycine max
  Coding DNA Sequence Number=SeqID_24303
MERENDWGMPERQSDVEKLRIKDRTAIYDMHDACLGVAILEIKLKIQRQLRE

SEQ ID NO: 141082 - protein, 127 aa, Glycine max
  Coding DNA Sequence Number=SeqID_24304
MGSPSMRRKRRRGKMTLAFVWLERSSQTNLMKEIEDGLRLTPSQRSEDLRGWWTIPMSRWKEIGTCFGKQKFLQKSNCLRKKHFVSTSGGIRHVDSNSPTPLASPPGAATCPTRQPHWRVPFKNRPP

SEQ ID NO: 141083 - protein, 330 aa, Glycine max
  Coding DNA Sequence Number=SeqID_24305
  Gene Ontology: Mol. function=oxidoreductase activity, acting on the CH-OH group of donors, NAD or NADP as acceptor; Cellular component =mitochondrion; Biological process=tricarboxylic acid cycle
  Homolog annotation: Hit_ID=Q1RYR4; Match level="QueryCoverage=93%, HitCoverage=86%, E-value=1e-167, Identity=93%"; Hit description =Isocitrate dehydrogenase NAD-dependent, mitochondrial
  Pfam annotation: Domain name=Iso_dh; Domain location=10-326; Score =429.4; E_value=5e-126; Accession=PF00180.10; Description =Isocitrateisopropylmalate dehydrogenase
MPWLCNLLSALIISSWLLLKIFQAADVPIEWEEHYVGTEIDPRTQSFLTWESLESVRKNKVGLKGPMATPIGKGHRSLNLTLRKELNLYANVRPCYSLPGYKTRYDNVNLITIRENTEGEYSGLEHQVVRGVVESLKIITRQASLRVAEYAFHYAKAHGRERVSAIHKANIMQKTDGLFLKCCREVAEKYPEITYEEVVIDNCCMMLVKNPALFDVLVMPNLYGDIISDLCAGLIGGLGLTPSCNIGEGGIALAEAVHGSAPDIAGKNLANPTALLLSGVTMLRHLDLHDKAEQIQKAILNTIAEGKYRTADLGGSSKTTEFTKAIIDHL

SEQ ID NO: 141084 - protein, 39 aa, Glycine max
  Coding DNA Sequence Number=SeqID_24306
VILIKEALFTTEGEYMVAIQACEDAIWLQRIFEELGYKN

SEQ ID NO: 141085 - protein, 127 aa, Glycine max
  Coding DNA Sequence Number=SeqID_24307
MDEDEGGLFYHGCRQQYWRETRAAIVNGKKLGDVEGAAIVNGETADMDVVSLLPMARGLPQLCMQTRAEPCRLGLDIVGLNHLQASWVTCIATVQGSHGYSVPVKWPEDFGENWLHGHALMACVVFV

SEQ ID NO: 141086 - protein, 73 aa, Glycine max
  Coding DNA Sequence Number=SeqID_24308
MTSITQRLKDLSETNENDEEAKRQEELSRPHISWTIRKTKKGPFARNGTSEDIILEEGALVDTNFQTPTNASY

SEQ ID NO: 141087 - protein, 157 aa, Glycine max
  Coding DNA Sequence Number=SeqID_24309
  Gene Ontology: Cellular component=nucleus; Biological process =transcription
MNKGSLDYWRNYFGAANSDIFGIIDHAIMVAASDCPKEFRLRRDGIAERLFSCRLSRCLGCERVELAVPVDDDDDGGGEGCKSGFDGDGDEFKFEAGASKESKVNSARDYPGEMNTNQVSNYSYGEAEALTDEIEKESQYVEEVFRIKDIFLNYEEE

SEQ ID NO: 141088 - protein, 75 aa, Glycine max
  Coding DNA Sequence Number=SeqID_24310
MEMERLSLSQGNVLIDVTSRHWETYSIVLALDNLAQVMANQGGGGGEVVYHGLDCFQRNDPLTFKGGYDPKGVEA

SEQ ID NO: 141089 - protein, 94 aa, Glycine max
  Coding DNA Sequence Number=SeqID_24311
MKVKLMRYATITLDSSLHAMRYHFSVKNLVRCLGVHDQTCSQWGDQSGSRCFARMLQPCGIGTGLQEHSNRMIPKACTPKSPSGPLPPDSVRLK

SEQ ID NO: 141090 - protein, 79 aa, Glycine max
  Coding DNA Sequence Number=SeqID_24312
MVINLSDKVVPNRVTCPQVQVFSLMINYKPWIFFINGVLCFLKINGSGKERRKGDWRHNLKEKMSQEKAHHHRKSWIRA

SEQ ID NO: 141091 - protein, 292 aa, Glycine max
  Coding DNA Sequence Number=SeqID_24313
MPLPNACKTRVMSEIEEVQEWMKADMEAMKKKMATMMEPMMSMKKIMEVNVATVVATSVVAKVDPTPPFGLNQRNPPTSDMVGQGGKELGSMGDPHFVQVQNKHAFSPYRLPLNYIPPNVAHTPYENVNNSTPILIKSQQPQSDHPHVSQPMGETHEPRLRYVTEGQAVGGVPLPNTLEGPQFHPQPQPLHFAVGRVPPAMVERKKLDHIEERLWAIEGGKDYVFVNMEKLLLVPNMAIPRKFKTLDFDKYKGTTCPKNHLKMYCWKMGVCAKDEKLLMHFFQESLTGAIIT

SEQ ID NO: 141092 - protein, 186 aa, Glycine max
  Coding DNA Sequence Number=SeqID_24314
  Gene Ontology: Mol. function=molecular_function; Cellular component =membrane; Biological process=auxin mediated signaling pathway
  Homolog annotation: Hit_ID=Q9C9F2; Match level="QueryCoverage=50%, HitCoverage=28%, E-value=2e-15, Identity=41%"; Hit description=MtN21- like protein; 91922-89607
  Pfam annotation: Domain name=K-box; Domain location=116-178; Score= -10.2; E_value=0.0031; Accession=PF01486.8; Description=K-box region
MTLIAAIQAIVYAFCFETDLSQWKLGSGIRLLIALYTGIVATGLVNIATSWCVPNRGPLLASIFYPLCPVLVAFASSLLLQEHLYLGSNLQEIYISLASFYLHNYFTPSSEKLLKYNCSAVETTCPINDTQEPIRGRSCPNDLEQLENQLEAALRNIRSTKTQFMLDQLSDLHHRVDVCFFFLRTF

SEQ ID NO: 141093 - protein, 89 aa, Glycine max
  Coding DNA Sequence Number=SeqID_24315
MDARNGQLSSWQGLLHALEAPFSPSQYNDPSSTLFKLTQRGTVNEYLTKFESLANHIISLPPAFLINCLIFGLTPEICQEVKASQPLTM

SEQ ID NO: 141094 - protein, 131 aa, Glycine max
  Coding DNA Sequence Number=SeqID_24316
MPTLALPYKKEAMGLKGGRAGRGQRQRMRTGFKVRDLLTKVLQFGGQTGNGILDAVDVGFRSGGVSHLNESTKMTRWRQKDKRNIRKEDIRTKCNCNKLNQFEDAPTTNRITNIYYPPLQQALTECPFVDK

SEQ ID NO: 141095 - protein, 191 aa, Glycine max
  Coding DNA Sequence Number=SeqID_24317
MGNPLGSFSESMQVRTKHVEKSSVSLWGQSLILEVGKADCKECELLRSKQSGMLQMVSDKPSGSWWACNTTEKSHQNERDLETIQVRDCTFEDNLKELIGTTYINKMHLLFSSPSHKNFTVKCAWLGIVMRWAELIIEVLEKATYEVSGGLSKPQHKPLRVGNSATLVFIRQYLTEITNDASERAPINNIG

SEQ ID NO: 141096 - protein, 182 aa, Glycine max
  Coding DNA Sequence Number=SeqID_24318
  Homolog annotation: Hit_ID=Q1SAV4; Match level="QueryCoverage=39%, HitCoverage=18%, E-value=6e-13, Identity=48%"; Hit description =Integrase, catalytic region
MSYNTSIHFATSISPFEITFDRKPPSIPQYLIGSAQVIVVDELPTNGETVFASLQKKLLKSQACMKNLADTHRTEDVIGNETHLMVLIQWEGLHSDETLWEDWASLKEAYHLEDKVLPNGDMTKSKGKDPLEGLGGPMTRARARKAKEALQQVLFILFEYKPKFQGEKSKVVSCIMAQMEED

SEQ ID NO: 141097 - protein, 113 aa, Glycine max
  Coding DNA Sequence Number=SeqID_24319
MQIKMNIDIRLPLKNESRPRENGGEEEEQTQAAGWKKEMKHTMPKPLTALEVVATEATTEAMVTNPYQLVVVTKTQPRGDKEGTMEEERVGEKRRKMNGKDLNITHSKKEPRG

SEQ ID NO: 141098 - protein, 161 aa, Glycine max
  Coding DNA Sequence Number=SeqID_24320
MYLDAHLLNLIAFIADHLPIILYYDVDINVRHKYSFKFENAWLNEEGLIEVVQNGWLKNPTGDVTEKISKKNDSSSRDLKPYGLKMAIKTFLVQHNNSWASQLLSYWPDADVYQGRDASVQQDVYQITWSVPHPDFVKCLSRKRCIGSTRCLLDYMECASF

SEQ ID NO: 141099 - protein, 56 aa, Glycine max
  Coding DNA Sequence Number=SeqID_24321
MTFKKAIRPGQTKLLKRLGSSLSKPGLAWPILTPSGVEGDDYHGILLHTSKKIGED

SEQ ID NO: 141100 - protein, 124 aa, Glycine max
  Coding DNA Sequence Number=SeqID_24322
  Gene Ontology: Mol. function=pseudouridylate synthase activity; Biological process=tRNA processing
  Homolog annotation: Hit_ID=Q47417; Match level="QueryCoverage=97%, HitCoverage=41%, E-value=2e-25, Identity=45%"; Hit description=tRNA pseudouridine synthase C
MRGKYVLTNLIAHRLHHHHFLFAIKPAAVHQPARRFIHRNQPCILINDLQHQASGGANSASSWLSVSSSAAWHGVDPLQPFERLQGIETERLRAIKGFRRRGVRLPVAVFAHHRFDLLQPLNNQ

SEQ ID NO: 141101 - protein, 117 aa, Glycine max
  Coding DNA Sequence Number=SeqID_24323
VPDSALTLRKHELSSDLFSCLIFNELEAFNPRDQLAFAFVRDHMKPKLKLNIYEVEVFEQVTMEYRHNLKPSDLYIAKKLSMTRKTVRAEPDLLYENGSCCSRCHHYLTTMWGDSHQ

SEQ ID NO: 141102 - protein, 147 aa, Glycine max
  Coding DNA Sequence Number=SeqID_24324
  Subcellular localization annotation: CTP_CleavageSite=40; ConfidenceScore=5.07e-01
MSPVACGDALWLSTPCHLETPSLIDKPRPMWSSTPFPEMSTSSGRDRKKFSLLLSRLEETNVVICTLPGDVSVFWPRPRNSLTSAIATRGSGSMRRYLMVIRTFRQLEASKLVDTQRPMWSSAPFPEMSASSGRDRKKVSLLLLRLE

SEQ ID NO: 141103 - protein, 86 aa, Glycine max
  Coding DNA Sequence Number=SeqID_24325
MVWHHQKQAPGQATCSSNSSMLIMDGKPKPCRLCMIMDCPLWMLWSMECSIWDVNIKFDGPTDKGDGRTDVDANGTDGIGAGAEEG

SEQ ID NO: 141104 - protein, 109 aa, Glycine max
  Coding DNA Sequence Number=SeqID_24326
MNKKVTAIGNNQSDLIPIDLEINATCRRHNQERIRKFLQDLEVATIPEVEPQSFKASSSFPIAEHSHLDPIEDYIMVEELRRVTLEDYSSSNVPQFFTSIALLDRVAFE

SEQ ID NO: 141105 - protein, 215 aa, Glycine max
  Coding DNA Sequence Number=SeqID_24327
  Gene Ontology: Mol. function=transcription factor activity; Biological process=regulation of transcription, DNA-dependent
  Homolog annotation: Hit_ID=Q75PX9; Match level="QueryCoverage=99%, HitCoverage=70%, E-value=2e-81, Identity=67%"; Hit description=LysR -family transcriptional regulator HexS
  Pfam annotation: Domain name=LysR_substrate; Domain location=2-197; Score=112.6; E_value=1.2e-30; Accession=PF03466.10; Description=LysR substrate binding domain
MYSNIQGVLTIGASDDTSDTILPFLLNRVTSVYPKLAIDVRVKRNPFMMEMLNQGEVDLVVTTSSPGNFTYQVLRTSPTLWYCAADYIFQRGEAIPLVLLDEPSPYRDMAIDHLNEAGIPWRISYVASTLAAVRAAVKAGLGVTARPVEMMSPELRVMGAAEGLPVLPDTQYLLCRNPDSDNELALAIFNAMQSTNDPYNLSANPDGTLLLDDEE

SEQ ID NO: 141106 - protein, 99 aa, Glycine max
  Coding DNA Sequence Number=SeqID_24328
MTVRLLPAAGHRQATVVFSPCACLETQNFLMKARLPLFTTFSPNHYPCNLYLRATLRYENPAHSLSITLPCLQTNQRHTRDCSLNNRDQLHTLEINSTH

SEQ ID NO: 141107 - protein, 77 aa, Glycine max
  Coding DNA Sequence Number=SeqID_24329
MGIAPTKTPSGPEEVQQGPGVSSSGYGPLSALQGAPFPPACSCRCGIGIVPARHLVDSKKANRVFELPALNTGLCQF

SEQ ID NO: 141108 - protein, 73 aa, Glycine max
  Coding DNA Sequence Number=SeqID_24330
MARTKKTGQMTYEAVKEIANKIDVLTVAIGRLEHPGRVRAAGAGITIKQYFGPAPRTSRMSSSVALEDLEQVM

SEQ ID NO: 141109 - protein, 88 aa, Glycine max
  Coding DNA Sequence Number=SeqID_24331
MSRNLTDCATIPSLTSGMLQNFTDCETMLPFNSRHVAELHELPNDGCQVPRSGQAKILLCAKHAEAALSGGYALSPTVELNLTATFCN

SEQ ID NO: 141110 - protein, 101 aa, Glycine max
  Coding DNA Sequence Number=SeqID_24332
MDDWELMVILVTALIRGEEVKCENGFLGAENDIGTKYSNNGAFDLECVLNHVLKYGNMWSLMWNGKVNRLAVEKTAMMTKLKSHVSSRVGSSSHVRNRRGA

SEQ ID NO: 141111 - protein, 152 aa, Glycine max
  Coding DNA Sequence Number=SeqID_24333
MDILVHFMEKIGEEPCMIHNQDRNKFGIFCAHGDVYHFADELKLSLCNLYTLWFKSAVNAGDVGVGATMSETISVNATIGEVMNEVLNDVFNENVSLNEDLSEKNVAENGKVAHENVEGQDEVFVNDENETFNGPLNVNGSLDNEYDPLSYE

SEQ ID NO: 141112 - protein, 99 aa, Glycine max
  Coding DNA Sequence Number=SeqID_24334
MVLDINCEWDQTYMDCDMFGSDDRRNGDNEAEKSVGSKGEAGKQHSLEVHNVPLNGAKCVFGILSLFFIINFYCVQLPFSTTLPSTIANQYGFTQCGKG

SEQ ID NO: 141113 - protein, 107 aa, Glycine max
  Coding DNA Sequence Number=SeqID_24335
MAGLIIVNRKLPFLHYITRLGRLVESWLKLSLAMRRLPEKINDRGGRKINDRGGKQEKGGIKAFCTKPQFKTFLLSTTFQIEDYTLEGPWNIRFLATSCPYLRYYCT

SEQ ID NO: 141114 - protein, 93 aa, Glycine max
  Coding DNA Sequence Number=SeqID_24336
MVLDSSSPSMLMFSSIVIGFSRVIDGTRMLGFILCILSWYHYRACKVCADLVHDAKGKRLRVKAPVRSHLICNPSRPLVTHLICTSLPGSPFV

SEQ ID NO: 141115 - protein, 424 aa, Glycine max
  Coding DNA Sequence Number=SeqID_24337
  Gene Ontology: Mol. function=nucleic acid binding; Biological process= DNA integration
  Homolog annotation: Hit_ID=Q10FV1; Match level="QueryCoverage=21%, HitCoverage=16%, E-value=8e-41, Identity=90%"; Hit description=Myb -like DNA-binding domain, SHAQKYF class family protein, expressed
MTQINNAGSNAYSYKPLVEASDEDLIEVVTTNTLGLMICCREAIKMMVNQPRGGHIFNIDGAGSDGRPTPRFAAYGATKRSVVHLTKSLQSISRELQYSTALSTKKIVKGLKIPSMKCGSSRIKFFLRGCNRCFLCRSFLEFLVQLIHTKSGSRFTIIFICKCEPLRVSSELTSERRCLAESQCEHIDSILEGLSPKYHSIIAIIESKFELLPIAQVEALLLVHESRLNKFKQSLFESPSVTSMLKQCPTNMSLKVFLIFVVDLAAVVVFSEGFNRSDGQHGGAGTDASGGTSGGGRGHGSGRFANFQSQVCFKCGHTASACHFFVLMQIINQTHLLCSMIPHLRATVPHSQNSSNSGQQTCAGHSQEPFFVLMQIINQTHLLCSMIPHLRATVPHSQNSSNSGQQNSDNSGQQTCGGHSQERN

SEQ ID NO: 141116 - protein, 126 aa, Glycine max
  Coding DNA Sequence Number=SeqID_24338
  Gene Ontology: Mol. function=nucleic acid binding
  Homolog annotation: Hit_ID=Q9FF84; Match level="QueryCoverage=56%, HitCoverage=6%, E-value=3e-25, Identity=70%"; Hit description=ATP -dependent RNA helicase A-like protein
MGEGCCTQPYPCICKEAVSGFEPMTNKSPRHNFTAAPGLALPICYSVRVVTMDALSKSSFEKYSSKARESLASWAPDCIGFNLIEAVLCHICRKERPGAVLVFMTGWENISSLRDQLKQSSFRRSQ

SEQ ID NO: 141117 - protein, 169 aa, Glycine max
  Coding DNA Sequence Number=SeqID_24339
  Gene Ontology: Mol. function=nucleic acid binding; Biological process= DNA integration
  Homolog annotation: Hit_ID=Q1S7C5; Match level="QueryCoverage=92%, HitCoverage=15%, E-value=1e-17, Identity=29%"; Hit description =Integrase, catalytic region
MAFAHSNSVSQSFPNSIAEKLDDSNYLHWHQHIVLVIKSHRLQRFIVNPVIPPCYLTEDDRIDDHVNPDYEGSNAPVMAAIHSFKIGIIACSWLKSFLSITLDGKTIEECLHKIKGFVDELASVGVPVRYEEYVDALIEGLPSNYALVVSVIESKKRTPSIAKIEALFY

SEQ ID NO: 141118 - protein, 370 aa, Glycine max
  Coding DNA Sequence Number=SeqID_24340
  Gene Ontology: Mol. function=ATP-dependent helicase activity; Cellular component=intracellular
  Homolog annotation: Hit_ID=Q9FF84; Match level="QueryCoverage=77%, HitCoverage=29%, E-value=1e-131, Identity=70%"; Hit description=ATP -dependent RNA helicase A-like protein
  Pfam annotation: Domain name=DUF1605; Domain location=21-172; Score =35.0; E_value=2.6e-07; Accession=PF07717.6; Description=Domain of unknown function (DUF1605)
  Pfam annotation: Domain name=dsrm; Domain location=271-333; Score =44.4; E_value=3.8e-10; Accession=PF00035.15; Description=Double -stranded RNA binding motif
  Pfam module annotation: Pfam domain module=DUF1605::dsrm; Domain location=21-172::271-333
MSDSHTAESSRTLLPPFQFILKLYSILSNNLLPAPHLPRVQDLTMQFPRMITNHIPFIVDKSLQSSLPFPFFLFHILVITGCKDAEREGSAYEYCWRNFLSAQTLQHRETSMSFKTMDDGQVLLYANSVNARYQTIPYPWLVFGEKVKVNAVFIRDSTGVSDSILILFGGALSNGIQAGHLKMLDGYVDFFMDHNLADSYVKLKEELNKLIQKKLEDPSIDIHKEGKYLMLAVQELVSGDQCEGRFVFGRESRKPKASNDENKFTKDGTNPKSLLQTLLMRAGHSPPKYKTKHLKTNEFRALVEFKGMQFVGKPKRNKQLAERDAAIEALAWLTHTSDNNQHEDDKSPPDITDNMLKLLGKRRKSKQGHG

SEQ ID NO: 141119 - protein, 69 aa, Glycine max
  Coding DNA Sequence Number=SeqID_24341
  Gene Ontology: Mol. function=transferase activity
MVTFKRSGHLEVIGYSDSDSVGCVDRRKSTLGYVFLLARGAISWKSAKQLVVVSSTMEAKFVACCEATI

SEQ ID NO: 141120 - protein, 116 aa, Glycine max
  Coding DNA Sequence Number=SeqID_24342
MARSVFCSLPLFGNLGQYLGVSNNYSPTIHNSHGCFLEVSSLKIIILWRYGIPAVATYPSAGGRRVTRGMRVPRKEYARSRHQRLFEESVGKTGKVAIYELLSERFGSCIYARGRY

SEQ ID NO: 141121 - protein, 520 aa, Glycine max
  Coding DNA Sequence Number=SeqID_24343
MPSRAKRSHPELSVIPCAPHSYAKRYSLRWLQEKGKARLPGPNLAMIQGGLPQKKPRTDTPTTSSAGTSFRRGTRNLHKRLTNLADGSIDVAVVKEIYANLYDPEDNSPKQVRVRGHLIKFDADTLNTFLETLVVLEPGETIPTYSRFCRLRMDPQEIAARLCIPGGGFVLNVEGMLWKLLRRDLTTLAQTWSVISYSNLAPTSHTSDLNLDRAQLVYGLVTRMDMNIGALISGQISLIAQSNSSRARARVAEIPSSSTPQDPLIPTSAPPPAPAHPGPSIDLIMVMLESLYRGQYLLMQNFQNLALYQPFISLEEFTRQVAWPGAQPSPIGVGEASATQEPQPHQDESSSSSEPETVAPEPFIYEADPGTTLEETQEAATPKITPQQAAEPSTPVLDLSSHSHPRSHLHLSWACHPPLLHQQAPQCFTSQMKRRILWTRTNQKTSVSLSLVYALSEYVPLSEAPARSVRHKNLEENLSCKHAKHEIGAKPQFTNRANLEATEQTKGGILKSFEGVFERL

SEQ ID NO: 141122 - protein, 75 aa, Glycine max
  Coding DNA Sequence Number=SeqID_24344
MQTHHHHLIRPIPAGSLGMERYLQRLVHQQAANHRGQFRDEVAWPGDWPEAQAEEACMDEEMTDLLGFLGGSGAT

SEQ ID NO: 141123 - protein, 123 aa, Glycine max
  Coding DNA Sequence Number=SeqID_24345
MDIEIEMTTQILEAIMTNSKVKAEEGILKSLGWSAIDVIVEAKLHGESKVMTKSSKNNSSESKINQRTTQVNQEQFKSKSQESRFKVQDLKNQDQDSRLKIQESREGLIKISMKSFSQKLSST

SEQ ID NO: 141124 - protein, 53 aa, Glycine max
  Coding DNA Sequence Number=SeqID_24346
MVTDSPSFICSISKSFLKIQQLANTLLTGKSSPWHVLMVIVTIKTRNGSLHKI

SEQ ID NO: 141125 - protein, 96 aa, Glycine max
  Coding DNA Sequence Number=SeqID_24347
MPRCEQRRRRPSVGQATTSPSNLSNMRDILQTHKEWESLKRDYNLEDKVVLEACRDVMNHPESAITKRNSEPRTKQNKEEGPGAKRRNNRPRYLDD

SEQ ID NO: 141126 - protein, 190 aa, Glycine max
  Coding DNA Sequence Number=SeqID_24348
  Gene Ontology: Cellular component=cytosol
  Homolog annotation: Hit_ID=Q10JI7; Match level="QueryCoverage=61%, HitCoverage=12%, E-value=8e-08, Identity=31%"; Hit description =Expressed protein
MKLNTKKWQRKLIFDAVNEIPGEKLGSFLEPCLKPNELVAMKFVSAQKLLKELCFEVQKLQYVKPDCSLEDEGDELKSMLREDVMCHSENWTGFSIQLPGVVLDVERQIFKDLIDELVIDEMASLKVKSGRHSILKSLFWNMFVISEFGFCNCKATNFLAMKALTDLCCPEGVQMHGTLMKAFDCIATRY

SEQ ID NO: 141127 - protein, 133 aa, Glycine max
  Coding DNA Sequence Number=SeqID_24349
  Subcellular localization annotation: CTP_CleavageSite=46; ConfidenceScore=5.42e-01
MYLWSGFVFSQREAMIIASPPASPPPPPPSPPHPPPSDASASLSVVKQTRKASCLRSLSTRLPGAERPMVHVDPATDKADGPHRKKLRTYLGIMARDKAEFEIPEAFDSRTKRKLLQTVGERWRQFKSDLTRK

SEQ ID NO: 141128 - protein, 87 aa, Glycine max
  Coding DNA Sequence Number=SeqID_24350
MTNANCPQESLHSVSNRNLRLLDWRGMILKQQSCLAIVDSMEFVESNPLFQNPKSMSYFMLLLKLGVGLAFGGLICKDKFGCAGNSS

SEQ ID NO: 141129 - protein, 540 aa, Glycine max
  Coding DNA Sequence Number=SeqID_24351
  Gene Ontology: Mol. function=transporter activity; Cellular component= periplasmic space; Biological process=transport
  Homolog annotation: Hit_ID=Q6DB26; Match level="QueryCoverage=97%, HitCoverage=97%, E-value=0.0, Identity=72%"; Hit description=ABC -type transporter, substrate binding protein
  Pfam annotation: Domain name=SBP_bac_5; Domain location=74-454; Score= 227.3; E_value=3.5e-65; Accession=PF00496.12; Description=Bacterial extracellular solute-binding proteins, family 5
MKTHFHLRALSLALLTGIFSAHAAETPVKGGTLIYLEQQAHTNLYPPAGGFYPNGGILNQITDKLTWQNPKTLQVEPWIAESWSSNADKTEYTFKIRPGVTFSDGTPLDANAVAKNFDTYGLGNKAQRLPVSEVINNYERSEVIDPQTVKFYFKQPSPGFLQGTATIGSGLVSLSTLQRSFDQLGDARHIIGSGPFVVSDEKLGREVDLTARKDYQWGPKNSTQQGPANLAGIKFIVTPEDSVRIGALLAGQADFIRQVQAYDEKQAQQQAFPVYAAPTRGVNDSISFRPDNPLVSDLRVRQALLHATNAQQVVQTLFSPNYPQATSVLAASAAGYVNLADKLKYDPARAGQLLDEAGWQPGSDGIRAKAGQKLALTVYESLPQPQNKEVLQLVAQQWRQVGVQLTVKAGDAGSRTLDNLDPLKTPLTVSEVGRADPDVVKSMFYPANRDALLQKGGSSDKVRHFRDDQLNKLLVAISAEVDPAKRLALTGDAQRYLLDQAYVIPIFEEPQVFAGAPWLKGVSFEAVGRPSFYGAWLEKH

SEQ ID NO: 141130 - protein, 85 aa, Glycine max
  Coding DNA Sequence Number=SeqID_24352
MEFAFATNVLAVKASPLDPFPSGARKLVWNSALKGFDDAPQPKSKAPARWIVVKYFNDPRPLEPERLKALWIQWAQYYLRVRAES

SEQ ID NO: 141131 - protein, 406 aa, Glycine max
  Coding DNA Sequence Number=SeqID_24353
  Gene Ontology: Mol. function=monooxygenase activity
  Homolog annotation: Hit_ID=Q6DB30; Match level="QueryCoverage=59%, HitCoverage=79%, E-value=2e-49, Identity=49%"; Hit description =Putative monooxygenase
  Pfam annotation: Domain name=ABC_tran; Domain location=1-122; Score =67.9; E_value=3.3e-17; Accession=PF00005.17; Description=ABC transporter
  Pfam annotation: Domain name=oligo_HPY; Domain location=125-197; Score=28.1; E_value=6.6e-07; Accession=PF08352.2; Description =Oligopeptidedipeptide transporter, C-
  Pfam module annotation: Pfam domain module=ABC_tran::oligo_HPY; Domain location=1-122::125-197
TLFNIIEEPLRNFGSLSAAARQQRVHEVAQRVALPLDLLTRKPRELSGGQRQRVAIARALIPQPAILVLDEATSALDVTVQAQILQLLQQLQRELGLTYLFITHDLATVRRLAHSVTVLRAGEVVEQGDTVTLFNAPQHPYTRALIDAIPVFRPLIKERAALTAGVSCSRGRAHPSYPPRHRHHHPAAGKCPARGEDAAVLDLLSDGRLEMGLGSGGTPTSFLPSYAAQRVARRHAGPSGQSSLSAGSGAGAARVDRHLFRCRRDACRPGRSRADVIAHPAAAGGSAGPVAAAAAKPDDRCLSRGAAVGRCAPHPRLTHRRQAEQFRKAGHDITGSTLESHARQLDAHIGDADAVLASLLADSTLTRATDITFQVHSIDPPHADTLRSVALIAEHIAPTLRALGTA

SEQ ID NO: 141132 - protein, 82 aa, Glycine max
  Coding DNA Sequence Number=SeqID_24354
MVSPQGRNTWTFDDHVPYVEKITILSEEQERITKPVAHGHHTDMSASEHSFGGVAETHPHFLWPTMIPSQQHDAPMATPTPH

SEQ ID NO: 141133 - protein, 352 aa, Glycine max
  Coding DNA Sequence Number=SeqID_24355
MASRKRKSIGTRPTSQYDTRRFHSFEAWTRYTNNVLGRHILPERKVEIYHTELDEFKAKLERCNFHKRLTNLIDISIDLALVKEFYANLYFPEGPSPKEVRVRGHVVKIDADSLNTFLETPVVLAEGRGFVLNAEGHPRKIHRKDLTTLAQVWSVLSYSNLAPTSHTSDLTVDRARLIFGLVSQMDMNVGALISGQITSMAQCNSSRLGFPALIIALCKSKGVASGSLVFERLSLVINLAYIKKNCWNPDDMTITIREARRARTRPAEAPSTSTAPPLERTLAAPSASSPADFQHFEAMLQSIHQGQIILLQSLQMVAPPDSIPLVEQFNECVAWPGTQSSLHREDEGPIAQ

SEQ ID NO: 141134 - protein, 40 aa, Glycine max
  Coding DNA Sequence Number=SeqID_24356
MHWHVHVLICHGGLSALTLSDDPDMGDKRGKESKHFRGDA

SEQ ID NO: 141135 - protein, 140 aa, Glycine max
  Coding DNA Sequence Number=SeqID_24357
MLQAPGGLVDNDRRREALCVRFTADGEANVSEVGGREGRGGGGGGGGRVEAGRKPMIFYTMTYKIRLMKRGSAISFFWKTKKTKRGTSNNLKVVHSGTKEFKITSNKRDLFLGFSKHQERLRKKLALEEGRIFAANEQLS

SEQ ID NO: 141136 - protein, 88 aa, Glycine max
  Coding DNA Sequence Number=SeqID_24358
MEAMKEQMTIMMEAMMSMRKMMVVNIATIVAVSTTTEVNLTHPSRPNQVQSKHFFPPYGLPPNYTPPNVAHAPNENVDNSVPIPIESQ

SEQ ID NO: 141137 - protein, 55 aa, Glycine max
  Coding DNA Sequence Number=SeqID_24359
MSSSPKTMIKCPSTTNFNFWWSVEDVGSNLNWEINLPPYVSAAAVKSPQDHGART

SEQ ID NO: 141138 - protein, 232 aa, Glycine max
  Coding DNA Sequence Number=SeqID_24360
  Homolog annotation: Hit_ID=Q9JKS4-3; Match level="QueryCoverage=33%, HitCoverage=11%, E-value=1e-09, Identity=41%"; Hit description =Isoform 3 of Q9JKS4
MSSPSEGYTPSPLEDYKSSPSEGCTPSPSKGYIPSPLEGYMPSASEDYTSSPSEGYTPLPSGGYMHSPSEGYTSSTTMPISPYGRSRPQDTQWTRRSPTGPWGFQLWLWASVNPTGCSSPQQGIVPARHPVDPKKSNRILGFPALITGLCQFYGVSVAPNMVIEPPINRTFIKKYCAPRQAQGEIPQQPGDGRQWAIDALPPPPEPLSSFTKARALPTTHGQPAGDQVQSQR

SEQ ID NO: 141139 - protein, 71 aa, Glycine max
  Coding DNA Sequence Number=SeqID_24361
  Gene Ontology: Mol. function=dihydroneopterin triphosphate pyrophosphohydrolase activity; Cellular component=cytosol
  Homolog annotation: Hit_ID=Q9CA40; Match level="QueryCoverage=65%, HitCoverage=31%, E-value=5e-09, Identity=61%"; Hit description=Nudix hydrolase 1
MENKNNNSGESELRVVVVIFLLKGRSILLGRCRSAVGNATFTLLGGHFEFGHSLTLSHIMFFFPSNILKTK

SEQ ID NO: 141140 - protein, 115 aa, Glycine max
  Coding DNA Sequence Number=SeqID_24362
MKDWGNFLHQILEEDYEDSTLITTFFLCGGSAASRGGSWWPPVVMGGGEEGVRVWVGVWRGGEGEHCVFHAKEGIHNLQISLSELISLSRSPLFALSTTIRAECNSLCTNCHSVR

SEQ ID NO: 141141 - protein, 207 aa, Glycine max
  Coding DNA Sequence Number=SeqID_24363
  Homolog annotation: Hit_ID=Q9FNL3; Match level="QueryCoverage=94%, HitCoverage=91%, E-value=2e-51, Identity=50%"; Hit description =Arabidopsis thaliana genomic DNA, chromosome 5, P1 clone:MCL19
  Pfam annotation: Domain name=DUF679; Domain location=36-202; Score =293.5; E_value=4e-85; Accession=PF05078.3; Description=Protein of unknown function (DUF679)
  Subcellular localization annotation: CTP_CleavageSite=99; ConfidenceScore=5.10e-01
MDVHVTTQEPLLENAPTPLLLPQKTPKTPTQRTMRKAFKGTSHLAKLLPTGTVLIFQTLSPLFTHQGQCQTLTSKTMTTCLLTLCSISCFLLSFTDSFRDERGKVRYGVASLKGLWVLDASIRVPVDEAEKYRLRFIDFFHAFMSILVFLAVALLDGSVVSCFFPKPSEEAKELLVTLPIGIGIVCSVLFVAFPSQRHGIGFPLSRN

SEQ ID NO: 141142 - protein, 1607 aa, Glycine max
  Coding DNA Sequence Number=SeqID_24364
  Gene Ontology: Mol. function=sequence-specific DNA binding; Cellular component=nucleus; Biological process=regulation of transcription, DNA-dependent
  Homolog annotation: Hit_ID=UPI0000162EFD; Match level="QueryCoverage =70%, HitCoverage=61%, E-value=0.0, Identity=48%"; Hit description=HB- 1; transcription factor
  Pfam annotation: Domain name=DDT; Domain location=360-418; Score =86.3; E_value=9.7e-23; Accession=PF02791.7; Description=DDT domain
  Pfam annotation: Domain name=TolA; Domain location=111-375; Score= -155.5; E_value=0.091; Accession=PF06519.2; Description=TolA protein
  Pfam annotation: Domain name=U79_P34; Domain location=21-245; Score= -101.5; E_value=0.059; Accession=PF03064.7; Description=HSV U79  HCMV P34
  Pfam module annotation: Pfam domain module=DDT::TolA::U79_P34; Domain location=360-418::111-375::21-245
MGQHRQCGGPFEAKIYEQLDKDVSRTLHEYQFIPEKPSVRNETYERVAPSIHYSSLDGIPHSRTLLSSGRSFLNGNESAPYGYGIQGHLPGLNLLSRQGRQNHLLPSASGENDGIPRKNPFVDVTADIHNGAHPITLIDSPLMPSDGRVIHVEELSRLQRKRKNDDTKMQQELEAQERKNRKELEKQDILRQKREEQTKKEMERHERERQKEEERLLRERQKEEERLLRERQREEERYQREQRREQERRQKFLQKESIRAEKLRQKEELRREKEAARIKAANERAIARRIAKESIELIEDERLELMELAASKKELSSILALDYETIQNLEFYRDGRASFPPKSVQLKRIFSIKPWSDSDENVGNLLMVWRFLITFADVLGIWPFTVDELIQAFHDHDPRLLGEIHIALLKSIIKDIEDVARTPSTGLGCNQHSVTNSGGGHPQVVEGAYLWGFDIRNWQRHLNPLTWPEILRQFALSAGFGPQLKKLSIEQVHPCNNNEGNDGRDIISNLRSGAAVENAVAIMQEKGLSNPRRSRHCLTPGTVKFAAFHVLSLEGSKGLNILEVADKIQKSGLRDLTTSKTPEASISAALSRDTKLFERTAPSTYCVRPAYRKDPADSEAIYSGARERIRMFKSGFVEAEAADNGERDEDSESDMEEDPEIDDLGTETNAKKESSNYEGFNADSEMRNRKDSVEVLQTHDTSLEKVGEDLASIVAKDFNEHKDVSTSSGIAVCNNDVVDPNVKGIAVDESIPGEPWIQGLTEGEYSDLSVVERLHALVALIGVATEGNSIRVVLEERLEAANALKKQMWAEAQLDKRRIKEDYFAKMQSVSYLDKTNELTVVFPSADSKHSPVLIADDKNSKALLNSHDLHEQSIELQENQNHLQSSPLKVNKQMQDCSTGPDNYSFQHSGYVVEKSRSNLKSYIGHLAEQTYMYRSLPLGLDRRRNRYWQFTTSAQNDPGCGRIFVELNDGRWKLIDSEEGFDALLASLDVRGIRESHLHMMLQRIETYFKEFVRKNAQNVNMRMQNGDPVERLKTESVEMASNQDCSANIHGSSSVCIDNLDASETSTSFVVQLGRNEADNKDACMRYWDFEKWMRKECLNFSVLSAMKFGKKWCHQLQSICDLCLHAYFSGGAPCSSCCRTFSACKSNPSSSKHIVHSEGKVKIDIDCFHASSSLSLRIRLLKILLSIVEVSVYCLFEFTGADSVWLWVLGNPSPRSSATSLERQLQEILEYKAGCFLIKRRPSSGYNLILTALEGAIKREYLDSNYETTFELLGLFSASGCHTKDSIDGERMSVLPWVPYTSAAVALRLLQLDACIFYTSQQKLESEKDKKIGIVMKLPSKHASARKSYNAGAIETSHQAERAVENWVDLGAGLTSCSRGQRTQQGRGRSHGGRTSSKRRVVSSRSGSKKRSTTSRSRKMGKLLEWKGRPCRQGGNARGPRSIRSWQKSEAKVDVITGERDTPKDVMEEAAGIFVQEEINEGEMEAAALNASSSERSGYEDDVYQEIGDEYDYLVDNNDGYQGVFSGKSENLLHGSHYNVVGKEDMDIDDNVDDDDDDNGKIDLDVEGYIIGGNSDARDRKEENAEQNMDLDGVGSTSSDYSD

SEQ ID NO: 141143 - protein, 207 aa, Glycine max
  Coding DNA Sequence Number=SeqID_24365
ASEEDEEVQALRAELEQAQTVKERFKSAALKIRKENAELRDINIATTKALEQETKRVRREEHGRNKFRGALWGSNNELKLRREERDQSRVDSLILKDELKTNMLAIVSKYQEELNLATTHEHKVADEYAQVYAEKEARGMVIDSLHQEATMWMDRFSLTLSGSQELPRLLAKAKAMADTYSAPEEIHRLLGYCQHMIDLMAHIIRNR

SEQ ID NO: 141144 - protein, 117 aa, Glycine max
  Coding DNA Sequence Number=SeqID_24366
GSLATFFRDMVEEKANALTPTAPTPSPKAGYLPEYNKRKAKKRRKRRMQKKVGTRFVGSTPLSKRSVGIRLYRTELSSHTYNLRCSPVSLLSYSTALGTDARLSAFHRYGYPAYLTT

SEQ ID NO: 141145 - protein, 107 aa, Glycine max
  Coding DNA Sequence Number=SeqID_24367
MTLLSLYGFLTVENRRTHSQSQVRIHFHQPDLPLNKNGSNKAHQIKELWVILPTKAEVLNQHSISALRLGYETKAKGPQGIRSSSERDGRVNFIQLRKGQMRMPLSK

SEQ ID NO: 141146 - protein, 237 aa, Glycine max
  Coding DNA Sequence Number=SeqID_24368
  Gene Ontology: Mol. function=protein disulfide oxidoreductase activity; Biological process=glycerol ether metabolic process
  Homolog annotation: Hit_ID=Q1H234; Match level="QueryCoverage=45%, HitCoverage=90%, E-value=3e-19, Identity=36%"; Hit description =Thioredoxin-related
  Pfam annotation: Domain name=Thioredoxin; Domain location=117-216; Score=41.3; E_value=3.4e-09; Accession=PF00085.10; Description =Thioredoxin
CRRRICERGLAGLKDGRNAAANTSGWRQKAEDAAPELVRLVETDDSLCLAHGGKMVSLQLTEAALPVQEGPVEVWVDRWFMQVQTADHTKHVLTSDKPETELGCSHSIAGPQHWTLATIKRLPQQFNQYVAGHDFVVLLFTAKWCDPCQAFYPAFNEVASQYPSISFAIADIDVATDLAANFQVAQVPALMVLRERVIIDRVTGAMHAHELQHHLQMWQAFDMTAINEHFSQSTSNA

SEQ ID NO: 141147 - protein, 132 aa, Glycine max
  Coding DNA Sequence Number=SeqID_24369
MVAWPRTQPSLHMEDEGPTAQVPQHLEDESSEATIPEPFDIGQEVEETQVRQVATATPERSLEATSEPSALVVNLPSPQPAADPSTPLLEMLEDPTTPFLAMDTSPPTTSVLHLTDEEDGQTQDTPDQSQEF

SEQ ID NO: 141148 - protein, 392 aa, Glycine max
  Coding DNA Sequence Number=SeqID_24370
  Gene Ontology: Mol. function=transporter activity; Cellular component= integral to membrane; Biological process=cell division
  Homolog annotation: Hit_ID=Q9I0V6; Match level="QueryCoverage=99%, HitCoverage=37%, E-value=1e-107, Identity=54%"; Hit description =Probable Resistance-Nodulation-Cell Division (RND) efflux transporter
  Pfam annotation: Domain name=ACR_tran; Domain location=1-392; Score= -443.1; E_value=8.9e-05; Accession=PF00873.9; Description =AcrBAcrDAcrF family
  Subcellular localization annotation: CTP_CleavageSite=37; ConfidenceScore=5.26e-01
MLAIALVIMVIFLFLKTLAGTLIPSLAVPLSLLGTFSVMYFAGFSVNNLTLMALTIATGFVVDDAIVMIENISRHIEEGASPMQAALQGSREIGFTIISLTFSLIAVLIPLLFMQDVVGRLFREFASTLAIAILISGIVSLTLTPMLSARLLKRADARHTAAWQHWLEQRFIALTHGYARSLRWVLAHQAQALAVTLVTLLLTFWLVWWVPKGFFPIQDNGLIQAAIEAPQSWSFHQVSEKHHAIVEQLLQDADVDIISSVVGVDGMNKTLNEGRLLIKLKPLEQRTTRIQQVIERLQQSVPEDQGFTLRMQPVQDLTVETRTGPTSYQLTAVSLDAVALRQSLPTLVHALQQLPSLKDVTSSEQSAGLKLYLDVNRDAASRLGISMAAIDD

SEQ ID NO: 141149 - protein, 193 aa, Glycine max
  Coding DNA Sequence Number=SeqID_24371
  Gene Ontology: Mol. function=protein transporter activity; Cellular component=membrane; Biological process=protein secretion
  Homolog annotation: Hit_ID=Q8XQM5; Match level="QueryCoverage=91%, HitCoverage=39%, E-value=2e-49, Identity=58%"; Hit description =Putative membrane fusion protein
VKPGTIHVYHQALGNVTSFATVAVKSRVNGQLTAIHFREGQLVKAGDLLARIDAKPFEAQLAQIQGQQLKDKALLSNALADLDRYQTLLKQDSIAGQQVDAQVSLVQQYKGAVLSDTGAVENAQLQVAYTRIVAPISGRIGLRQIDGGNNITTADTLAVINQISPIAVTFTLPENMAQEVSRLLDQRTHSGLP

SEQ ID NO: 141150 - protein, 289 aa, Glycine max
  Coding DNA Sequence Number=SeqID_24372
  Gene Ontology: Mol. function=transferase activity, transferring phosphorus-containing groups; Cellular component=membrane; Biological process=peptidyl-histidine phosphorylation
  Homolog annotation: Hit_ID=Q08WW5; Match level="QueryCoverage=91%, HitCoverage=58%, E-value=1e-79, Identity=60%"; Hit description =Periplasmic sensor signal transduction histidine kinase
  Pfam annotation: Domain name=HAMP; Domain location=7-76; Score=53.5; E_value=6.9e-13; Accession=PF00672.15; Description=HAMP domain
  Pfam annotation: Domain name=HATPase_c; Domain location=178-288; Score=118.3; E_value=2.2e-32; Accession=PF02518.16; Description =Histidine kinase-, DNA gyrase B-, and HSP90-like ATPase
  Pfam annotation: Domain name=HisKA; Domain location=80-138; Score =27.8; E_value=3.7e-05; Accession=PF00512.15; Description=His Kinase A (phosphoacceptor) domain
  Pfam module annotation: Pfam domain module=HAMP::HATPase_c::HisKA; Domain location=7-76::178-288::80-138
MPLARWLPVVLLAQLALLILCAWLAVRLAIRPLTQLAGAADAMSPDRRSPRLAEDGPAEVAQASAAFNAMQDRIAAHLAERMQILGAISHDLQTPITRMKLRSEFMDDSADRDKLAHDLQEVEQLVRDGLAYARSAGAATEPPARIDLDAFLDSLVCDYTDIGKPVTLQGQCPGPWLTRPRALRRILGNLIDNALKFGGAAEVLIGPAEDGHGVSIRVLDRGPGIPEQELQAVLQPFYRLEGSRNRDSGGTGLGLAIARQLADVIDGELRLRNREGGGLEAQVLLRPAA

SEQ ID NO: 141151 - protein, 469 aa, Glycine max
  Coding DNA Sequence Number=SeqID_24373
  Homolog annotation: Hit_ID=Q6YZ61; Match level="QueryCoverage=23%, HitCoverage=17%, E-value=2e-18, Identity=42%"; Hit description=MYB transcription factor-like
  Pfam annotation: Domain name=Myb_DNA-binding; Domain location=298 -348; Score=25.8; E_value=0.00015; Accession=PF00249.21; Description =Myb-like DNA-binding domain
MEVEHLLAEPRNDHASLDGSLDSHTTLNGKDDLELEALDGLLDDVEINDLEGTVGFPGDFGFADKFEEVLGSGPFVGSLLQNSSSESHSSGLSGSSIVDGVLESTEVPIAQSECKNDSLDETITYESHGAFRNNPSQPSKVNCRYNISLDIQHLQDLDNNRHLAGGILTCKKEKGPVEKGQPAALREKRFRKPTQRYIEEFSNSRSKEKAPTAGTKTKYLSDSSCDDVLHIRIKAFKKSPSEKSSIENRDVMLPELQVHKGRPKKEKLEYDNESFPLESEDEWLTSKRSRRKDRRKHQKMWTLPEVLKLVEGISEYGVGRWTDIKRFLFSSTSYRTPIDLRDKWRNLLRASSAQKSTREAEQNDELALRPLPFNVVHRVQELAKIHPYPRERGSKKLRVSQAGSSVIAKDSPPLSLSKRNEPEASRGWVIESHIPSYPKALDCATLEPGAHDAHHDWGKQCCVLHLAAF

SEQ ID NO: 141152 - protein, 172 aa, Glycine max
  Coding DNA Sequence Number=SeqID_24374
  Gene Ontology: Mol. function=structural constituent of ribosome; Cellular component=intracellular; Biological process=translation
  Homolog annotation: Hit_ID=Q8LDI6; Match level="QueryCoverage=86%, HitCoverage=80%, E-value=1e-45, Identity=62%"; Hit description=30S ribosomal protein S16
  Pfam annotation: Domain name=Ribosomal_S16; Domain location=9-65; Score=63.8; E_value=5.5e-16; Accession=PF00886.9; Description =Ribosomal protein S16
MVVRIRLSRLGCKNKPFYRVMAADSRSPRDGKHLEVLGYYNPLPGQDGGKRMGLNFDRVKYFVQVKWVRSLEPSNPPYIYRSARLPSGLAMPVDNMVNEKYWLSVGAQPSEPVERLLFRAGMLPPPPMVAMGRKGGPRDTRPVDALTGRVLNQEKAANANNNEQQHDTPENP

SEQ ID NO: 141153 - protein, 274 aa, Glycine max
  Coding DNA Sequence Number=SeqID_24375
  Gene Ontology: Mol. function=nucleic acid binding; Cellular component= intracellular; Biological process=chromatin modification
  Homolog annotation: Hit_ID=Q9STM3; Match level="QueryCoverage=98%, HitCoverage=21%, E-value=1e-107, Identity=65%"; Hit description =Putative zinc finger protein
  Pfam annotation: Domain name=JmjC; Domain location=213-274; Score =13.5; E_value=4.2e-05; Accession=PF02373.13; Description=JmjC domain
  Pfam annotation: Domain name=JmjN; Domain location=22-63; Score=43.3; E_value=8.1e-10; Accession=PF02375.7; Description=jmjN domain
  Pfam module annotation: Pfam domain module=JmjC::JmjN; Domain location=213-274::22-63
MGVVSEGNGDVLPWLKSMPVAPEYRPSAAEFQDPISYIFKIEKEASKYGICKIIPPFPPSSRKTAIANLNRSLAETGSTFTTRQQQIGFCPRRPRPVQRPVWQSGDRYTFTEFESKAKSFEKTYLKRHAKKASGLGPGPLETETLFWKATLDKPFSVEYANDMPGSAFSPKCRRVGDPSSLADTQWNMRAVSRAKGSLLQFMKEEIPGVTSPMVYVAMLFSWFAWHVEDHDLHSLNYLHMGAGKTWYGVPRDAAVAFEEVVRVHGYGGEINPLG

SEQ ID NO: 141154 - protein, 298 aa, Glycine max
  Coding DNA Sequence Number=SeqID_24376
  Gene Ontology: Mol. function=transporter activity; Cellular component= membrane; Biological process=transport
  Homolog annotation: Hit_ID=Q1H128; Match level="QueryCoverage=76%, HitCoverage=60%, E-value=1e-93, Identity=73%"; Hit description =Binding-protein-dependent transport systems inner membrane component
  Pfam annotation: Domain name=BPD_transp_1; Domain location=178-298; Score=-1.6; E_value=0.0083; Accession=PF00528.12; Description =Binding-protein-dependent transport s
MAFFTGSLLIETLFSLDGLGLLSYESINSRDYPVVLGTLYLFTLVGLFIKLLGDFAYVLVDPRIKFDSQDSLAGEVISNDRPLVVRYEQQWYFPLFSEYPESVFGGNLPIKADYHDPFIKAQLSKAGNFAIYPLNPYYYDTLNYFSKAEHYPGKPDDENLLGTDIAGYDILARLLYGFRVSVTFALGLTVVGVVLGIFFGAVQGYFAGKTDLVIQRLIDIWGSMPELYLLIIFASIFDHSLLLLFGLLSLFGWITLSDYVRAEFLRNRQLEYVKSARALGLSNWQIIWRHILPNSLTP

SEQ ID NO: 141155 - protein, 106 aa, Glycine max
  Coding DNA Sequence Number=SeqID_24377
SRDLANMSLETLFGKLQEHKMELMRLNQHEENDKKKKGIALKASSSIQEESDREDLNEIEKDDDFSFFVNKFNKFLRNKGNQRRTNFNPKKKGEDSPCVPKCYECN

SEQ ID NO: 141156 - protein, 141 aa, Glycine max
  Coding DNA Sequence Number=SeqID_24378
MVRIRGLRLVLGRVIRRALRTQATATVVEDVEHIDHPTDEDFLDKPHNTFVSTDYVYHMTTTIWTGEEHPELKLFFHGRKVQKFGRSTPGIEGIVALTGLSPLIACSLDTCDMGLIYVFAERWCFYNFDALCRRPCTGAAS

SEQ ID NO: 141157 - protein, 550 aa, Glycine max
  Coding DNA Sequence Number=SeqID_24379
  Gene Ontology: Mol. function=nucleic acid binding; Cellular component= nucleus
  Homolog annotation: Hit_ID=Q9STM4; Match level="QueryCoverage=66%, HitCoverage=82%, E-value=3e-93, Identity=42%"; Hit description =Putative zinc finger CCCH domain-containing protein ZFN-like 6
  Pfam annotation: Domain name=zf-CCCH; Domain location=225-251; Score =39.0; E_value=1.6e-08; Accession=PF00642.15; Description=Zinc finger C-x8-C-x5-C-x3-H type (and similar)
  Pfam annotation: Domain name=zf-CCCH; Domain location=307-333; Score =43.3; E_value=8.2e-10; Accession=PF00642.15; Description=Zinc finger C-x8-C-x5-C-x3-H type (and similar)
  Pfam annotation: Domain name=zf-CCCH; Domain location=443-469; Score =37.5; E_value=4.7e-08; Accession=PF00642.15; Description=Zinc finger C-x8-C-x5-C-x3-H type (and similar)
  Pfam annotation: Domain name=zf-CCCH; Domain location=489-515; Score =40.5; E_value=5.8e-09; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH; Domain location=225-251::307-333::443-469::489-515
MEPIESESVSSSAKDQQLGEPSSTVHPLDHDPQPSDLNRVTPVDDALGEEFQNKLDLKDGGESENNGSNLEDGGEKLSEDKGSNLEDASEKLGDEGAAAPEGGKGEGCDGDVGGVANDYGVIGDDVVVAEDGGVVRDDLVVVDEDDDDGVAVRDDLVVVDEDDDDDGVVRNDVVVVVDVDGWNGSDEGCDWIENENVNESESDKVGVEYKDERSSGKAQQYPLRPEAEDCAFYLKTGTCKFGFNCKFNHPLRRKNLAKNENAGEREEQEERSGQTECKACKFNHTRGKSSSASSTAELNFLGLPIRVGEKECHYYMRTGSCKFGANCRFNHPDPTAIGGGDSPSGYGNGSSISLQGVSQSSISSWSSTRPLNEPAPFVPVILSHNPGVSPQSSEWNGYQAPVYLSERSLHPPSTYVMNNPAIESNVYMHHQKQMQVEEFPERPGEPECSYFLKTGDCKFKSNCKFHHPKNRIARLPPCNLSDKGLPLRPEQTVCTYYRRYGICKFGPACKFDHPPPSTMAGLDQQSSYTNSAGVDVAENGDADDGNQQSV

SEQ ID NO: 141158 - protein, 184 aa, Glycine max
  Coding DNA Sequence Number=SeqID_24380
  Gene Ontology: Mol. function=nucleic acid binding; Cellular component= nucleus
  Homolog annotation: Hit_ID=Q9STM4; Match level="QueryCoverage=60%, HitCoverage=59%, E-value=1e-28, Identity=45%"; Hit description =Putative zinc finger CCCH domain-containing protein ZFN-like 6
  Pfam annotation: Domain name=zf-CCCH; Domain location=144-170; Score =24.7; E_value=0.00033; Accession=PF00642.15; Description=Zinc finger C-x8-C-x5-C-x3-H type (and similar)
  Pfam annotation: Domain name=zf-CCCH; Domain location=98-124; Score =35.6; E_value=1.8e-07; Accession=PF00642.15; Description=Zinc finger C-x8-C-x5-C-x3-H type (and similar)
  Pfam module annotation: Pfam domain module=zf-CCCH::zf-CCCH; Domain location=144-170::98-124
  Subcellular localization annotation: CTP_CleavageSite=45; ConfidenceScore=5.07e-01
MMSERENTISYTRLTSFLRKDTSFLSPWSWPVRNRNAAAVNIETSSSRNVEQYLLQPGSYFESIWPPIFESRRNLRPPSTIYMHFHYNKQIEELPERPGEPECSYFLKTGHCKFKSDCKFHHPKSWIERLPPCNLNDKSLPLRPERKVCRYYGRYRICKFGRVCMFHHPQLCKTSSKARELKLC

SEQ ID NO: 141159 - protein, 219 aa, Glycine max
  Coding DNA Sequence Number=SeqID_24381
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q5VS25; Match level="QueryCoverage=93%, HitCoverage=11%, E-value=1e-85, Identity=69%"; Hit description =Putative beta 1,3 glucan synthase
NCIALSINSVQCNRLEVALLLIVYIAYGYAEGGAVTYVLLTLSSWFLVISWLFAPYLFNPSGFEWQKTVEDFDDWTSWLLYKGGVGVKGENSWESWWDEEQMHIQTWRGRILETILSARFFLFQYGVVYKLHLTGNDTSLAIYGFSWAVLVGIVLIFKIFAYSPKKAANFQVVLRFAQGVASIGLVAAVCLVVAFTQLSIADLFASILAFIPTGWGILS

SEQ ID NO: 141160 - protein, 177 aa, Glycine max
  Coding DNA Sequence Number=SeqID_24382
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q5VS25; Match level="QueryCoverage=82%, HitCoverage=8%, E-value=7e-62, Identity=82%"; Hit description =Putative beta 1,3 glucan synthase
MTVTHLRWFVHVRRRLIEAPKISFNSTLRLGNVTHHEYIQVGKGRDVGLNQIALFEGKVAGGNGEQVLSRDIYRLGQLFDFFRMLSFFFTTVGYYVCTMMTVLTVYIFLYGRAYLAFSGLDEAVSEKAKLQGNTALDAALNAQFLVQIGVFTAVPMIMGFILELGLLKASTSGTEST

SEQ ID NO: 141161 - protein, 423 aa, Glycine max
  Coding DNA Sequence Number=SeqID_24383
  Gene Ontology: Mol. function=transferase activity; Biological process= guanosine tetraphosphate metabolic process
  Homolog annotation: Hit_ID=Q5H231; Match level="QueryCoverage=96%, HitCoverage=53%, E-value=0.0, Identity=78%"; Hit description=ATP:GTP 3'-pyrophosphotranferase
MGTATVAHVVTVDVEHVGVFLGDQVGDVLQQPAAVDRSDHHVHFVAAAGLAPLHRQDALRAGGCQPGQRGTVCTMHGDTTATGQVADDRLASHRLAAACQLHQQVAHALHGELGLAQVLAARGRPRQGRRGRRLARCTFGFQQGTADLVRAGIAQRHLDVEIVNAVGMELLRRHRQVRVLQAQTLQLALKQFAPGLHVARAVQLVEPAAYLFARAVAGQEAVGRHQPVAAGVGLLAGQDLDAVAAAQAIGQRHDATVDLGAPAAVAHHGVHLVGEIERRGALRQIQHLILRAECIDPVFGQLGIERPSQLIALPVLRLLQQLAHPGDLAVEGLLRALATLLVLPVRGHAQLGLRVHLMGTDLHFDGAPFRADHGGMQRAIVVGLGPGDVIVELARHRRPQCMHHAQRGVARGDVVDHHAHRTD

SEQ ID NO: 141162 - protein, 247 aa, Glycine max
  Coding DNA Sequence Number=SeqID_24384
  Gene Ontology: Mol. function=protein-N(PI)-phosphohistidine-sugar phosphotransferase activity; Cellular component=intracellular; Biological process=phosphoenolpyruvate-dependent sugar phosphotransferase system
  Homolog annotation: Hit_ID=Q8CXW9; Match level="QueryCoverage=100%, HitCoverage=46%, E-value=3e-91, Identity=67%"; Hit description =Putative transcriptional Antiterminator
  Pfam annotation: Domain name=PRD; Domain location=86-177; Score=55.2; E_value=2.1e-13; Accession=PF00874.10; Description=PRD domain
MMYRITRGNALPRREQGHPLFDESIFRIAQNMLQKIEARIAHPLPEDESWFIYQYIISSGMLVEERDDVSMLRNIRSSDEARQITSRLIALFSSVVDIDLTHDTALYEGLLIHIKPLLNRLNYRIYIRNPLLEDIKGELTEVWPLTLRVVNQVFAAWGENAVSEDEVGYLTVHFQAAMERQVARKRVLLVCSTGIGTSHLLKSRVLRAFPDWTIVGVLPAGSLHTLQRQDDIELVISTIHLPEIALP

SEQ ID NO: 141163 - protein, 52 aa, Glycine max
  Coding DNA Sequence Number=SeqID_24385
MAITESYRAPNEVIPKRRERTRVEMIGRKKSLFPARATHKGCESPLIQPGCS

SEQ ID NO: 141164 - protein, 432 aa, Glycine max
  Coding DNA Sequence Number=SeqID_24386
  Gene Ontology: Mol. function=transcription regulator activity; Cellular component=nucleus; Biological process=regulation of transcription
  Homolog annotation: Hit_ID=Q5Z610; Match level="QueryCoverage=78%, HitCoverage=61%, E-value=2e-17, Identity=27%"; Hit description=Basic helix-loop-helix protein-like
  Pfam annotation: Domain name=HLH; Domain location=206-255; Score =32.0; E_value=2.1e-06; Accession=PF00010.16; Description=Helix-loop -helix DNA-binding domain
  Subcellular localization annotation: CTP_CleavageSite=72; ConfidenceScore=5.38e-01
MSQVDIQTALRSLFPEDFSTRVQSQQIDQNPPTSSSSSLRSISTGSPEYSSLIFSIPGTSQPHFPPETLGASSSRVEPTMQPVPNSPHQRAIDIQALTEVPSLTQFPTPETEHDAIMRAILHVISPTTSYHHEQQHHQNLPYSNNFLPVVRPDASAFQRYRQDLGSNMASNFRRQSLMKRSLVFFRNMNFMRMRERVQATSRPTNTQLHHMISERRRREKLNENFQALRALLPPGTKKDKASILIAAKETLRSLMAEVDKLSNRNQGLTSLLPAKESTAEETKVASLSPNERLSVRISHVPESSTSEERMVELQVNVRGQVSQTDLLIRLLKFLKLAHHVSLVSMDANTHIAEGNNALHQLTFRLRIIQLRRRNFESAVLIAKVVWFGVLCHHPQMIQITFNSKKGSEWDESAFEEAVRRVVADLAQYQMDQ

SEQ ID NO: 141165 - protein, 217 aa, Glycine max
  Coding DNA Sequence Number=SeqID_24387
  Homolog annotation: Hit_ID=Q6ZBP8; Match level="QueryCoverage=26%, HitCoverage=9%, E-value=3e-15, Identity=71%"; Hit description =Putative cleavage and polyadenylation specific factor
MDKGEGRYGESSEPMDQFHHNEAISAIVDEGFLAEEEGVGGGGGSEVMESGVLRRVDGFHNQGFRRNEKPHGGVVGILGNEGLVREGQGGGGRGNVNRVDGNGEVWWTTDVKLETELSKYKYRPVKEVKFFYEKASEKLKGYCQVLFFDPFAATACKERMNGRGGGRDVHCLRASARRCPSCWCLSPPFVPVLVATVGSSLLGAGVELLIGGGLRSD

SEQ ID NO: 141166 - protein, 84 aa, Glycine max
  Coding DNA Sequence Number=SeqID_24388
MPLFECNATKKTILFRCGVTQMQFATVEHQSHTVIDRGLYNDVVPHCWKVVAFCLQMGDGRLCLESNLNPFAESMNKKVESEPG

SEQ ID NO: 141167 - protein, 72 aa, Glycine max
  Coding DNA Sequence Number=SeqID_24389
MGVISQLKKAMGIDNWESQLNFIPTLGTRLNMKGVIYLMDILIFYTIMSAIVGGVSGARARLGEVFGFQSGI

SEQ ID NO: 141168 - protein, 67 aa, Glycine max
  Coding DNA Sequence Number=SeqID_24390
MEIGVIWRLISSKPPMDPADPDTSPPAATSRLLLLDLPRATKSLWVGTTYVHHSCSNLLLEKGKGQN

SEQ ID NO: 141169 - protein, 79 aa, Glycine max
  Coding DNA Sequence Number=SeqID_24391
MDYEIQNNFLFFLNITINFIYKDKTKTISIISQVDHNDGTNEVEEEGWHHGDGRMSARRSPSSLVARVVEVSPDQFLHY

SEQ ID NO: 141170 - protein, 316 aa, Glycine max
  Coding DNA Sequence Number=SeqID_24392
  Gene Ontology: Mol. function=RNA-directed DNA polymerase activity; Cellular component=intracellular; Biological process=RNA-dependent DNA replication
MVEGNCSVVIQRILPQKFKDPKSVTIPCSIGVVSVGKALIDLGASINLKSLSMCRRIGNLRITPTRMTLQLVNHSITRPYGVVEDVLVKVRQFTFLVDFVIMDIEEDFEIPLILGRPFMLKTKCIVDIGNGNLEMSVEDQKANLVVQSLTFHSPLERAFMNVIDCLTKEKEKDLKACLEDLDRLKEIPFREYAFEELKKDSTTEKPKVDLKILPAHLKYVILEENDVKPMVISNDLSFDEESRLVEVLKKHKAAIGWHIFDLKGISPSYCMHKIIMSQCHTRSRSHSRDTKTSVGTIILSLTLAHDLGVTLTLALT

SEQ ID NO: 141171 - protein, 139 aa, Glycine max
  Coding DNA Sequence Number=SeqID_24393
  Homolog annotation: Hit_ID=Q9AWW1; Match level="QueryCoverage=61%, HitCoverage=26%, E-value=3e-12, Identity=39%"; Hit description =Esterase/lipase/thioesterase family protein-like
MFQTTAYFPTYGRNSVAWCKMGGSFSIYTALYVLKFLSSEVDDLHAVAQHFPESNRAISANVGHRSDVVLLFASKYSDIKTIVNLSEHYDMKAGIGEPFGKDYLERIRKDGFIDVKKRRSGNLSFTQCYSLVNVVRHMF

SEQ ID NO: 141172 - protein, 497 aa, Glycine max
  Coding DNA Sequence Number=SeqID_24394
  Gene Ontology: Mol. function=DNA binding; Cellular component=oxygen evolving complex; Biological process=DNA integration
  Homolog annotation: Hit_ID=Q1SS72; Match level="QueryCoverage=80%, HitCoverage=33%, E-value=2e-89, Identity=41%"; Hit description =Integrase, catalytic region
MTITRSMGTHLDTNFTSVIKSSQDEWILDSGATDHVTTFPHLFSLCKKIKPVMVRLPNGHTVMNDKCFIQDMNQQKIGTIEMVEELYRLKMIPIKSKYKSDFAANRKKLDPRAATSVFLGFKPNTKGFIMFYLKAKAISVSRNVIFYEDCFPFIGQDKPNVFTVLPILSSHAIDQPDGVSSELPVDNIMLVPNNVDSNPLTLEQSSNTTRRSLRQTHKPSKYKDFHVSYPSSTIASYSAASKDPVWVEAMNAKIKALELNDTWILIDMPQHKNVIGCKWVYKIKHRSDGSVERHKARLVAKGYSQVEGQDYLDTFSPVAKLTTVRLLLALTAINKWYLKQLDVNNVFLHGDLNEEVYMMLPQGMQVAKPGQVCKLQRSLYGLKQASRQCYYTVVDNAFKIKDLGDLRYFLSFEVARKPIGINICQRKHALDILSDTGMLGSKPISTPSDYATKLHQQSGAPLSLEDASSFRMLIGRLIYLTNTRPDIDITYVVQHLS

SEQ ID NO: 141173 - protein, 130 aa, Glycine max
  Coding DNA Sequence Number=SeqID_24395
MVKVVGAITTAKDDVVITIKGLKECDRKKLLNLTNENREGSSKRKGDFQVVDEFSRNGNLGLIGEYGHVEQNMIIVNVYSPCKERVDVRGSSNGDTRDINGFNDFIDDMELRDIPIEGRRFTWYQSGGYA

SEQ ID NO: 141174 - protein, 114 aa, Glycine max
  Coding DNA Sequence Number=SeqID_24396
  Homolog annotation: Hit_ID=Q1T5K4; Match level="QueryCoverage=53%, HitCoverage=6%, E-value=1e-07, Identity=35%"; Hit description=RNA -directed DNA polymerase
MAGLVNCKVMEIPFSFLSIPMRANPKREVTCQPMISKVKAKLATWRGKHLSFGVLRDQYGAEMLGMCVKKVGRRTGFAIIYVESYTMEEQATDAWYWKDGTRNTYVVKEVYSSF

SEQ ID NO: 141175 - protein, 100 aa, Glycine max
  Coding DNA Sequence Number=SeqID_24397
MEKYMEGDPEEFEEEGHNLRLKENIPMTTGKISEVDNNRWPNSFIVHKEANIGKSSSFMEDENKAIITGEELEKVSEFEIHMGKGKTNVHQYRELSGNNR

SEQ ID NO: 141176 - protein, 543 aa, Glycine max
  Coding DNA Sequence Number=SeqID_24398
  Gene Ontology: Mol. function=cytokinin dehydrogenase activity; Cellular component=endoplasmic reticulum; Biological process =electron transport
  Homolog annotation: Hit_ID=Q9LTS3; Match level="QueryCoverage=87%, HitCoverage=87%, E-value=1e-162, Identity=57%"; Hit description =Cytokinin dehydrogenase 3 precursor
  Pfam annotation: Domain name=Cytokin-bind; Domain location=263-541; Score=597.0; E_value=1.7e-176; Accession=PF09265.1; Description =Cytokinin dehydrogenase 1, FAD and cyto
  Pfam annotation: Domain name=FAD_binding_4; Domain location=78-231; Score=81.7; E_value=2.2e-21; Accession=PF01565.13; Description=FAD binding domain
  Pfam module annotation: Pfam domain module=Cytokin-bind::FAD_binding _4; Domain location=263-541::78-231
MVAENYPSPTYFILLFITITRLISTVGKTSQWTKALSLTPELASVSLDDTIFCKLRDDPEALQGRASRDYGNLVREVPLAVFHPASASDIARLIKLSYNGSVPFKIAARGQGHSTRGQAMAREGVVVDMAGFRERGNGVGIRVVSSVDPNNKNGYYYYADVGGEQLWIDVLHATLEHGLAPMSWTDYLYLTLGGTLSNAGISGQTFRYGPQITTVREMDVITGKGEFVTCSQQTNSELFHAVLGGLGQFGIITRARIALAPAPKRVKWVRLLYNDFSAFTKDQEQLISVTGRKQNVSLDYLEGLLLMHQGPINNWRSSFFPLADHARIISLVTKHSVLYCLEVAKYYDGQNENNVDKELQVLLQGLSYIPGFYYEKDVSYFEFLNRVRSGELKLQSQGLWDVPHPWLNLFIPKSQIMEFDSGVFKNIILKRNITTGPVLVYPMNRNKWDNRMSASIPDEDIFYTVGFLHSSGFDNWKAYDAQNKEILQFCNVAGIKVKQYLPHYRTQEDWANHFGPKWRTFVERKHQFDPRMILSPGQRIFNN

SEQ ID NO: 141177 - protein, 267 aa, Glycine max
  Coding DNA Sequence Number=SeqID_24399
  Gene Ontology: Mol. function=DNA binding
  Homolog annotation: Hit_ID=Q1SFS3; Match level="QueryCoverage=82%, HitCoverage=40%, E-value=3e-22, Identity=30%"; Hit description =Lambda repressor-like, DNA-binding
MLPKRCIQEGDNFSSSRIRKLHLCHMHFFMHSSIPPMIDVGVLIRTRFYFTLVKHGIKSKAFAKKRFYQVKVKGLDTTNIKELGRLMEPLQMQAFCKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPRKYLEDKARGIANQGDWVSFMDVLALLIFGVVLFPNVDGLVDLAAIDAFLAYHHSKESPVVAVLADLFDTFDR

SEQ ID NO: 141178 - protein, 616 aa, Glycine max
  Coding DNA Sequence Number=SeqID_24400
  Gene Ontology: Mol. function=unfolded protein binding; Cellular component=chloroplast; Biological process=cellular protein metabolic process
  Homolog annotation: Hit_ID=P08927; Match level="QueryCoverage=91%, HitCoverage=91%, E-value=0.0, Identity=87%"; Hit description=RuBisCO large subunit-binding protein subunit beta, chloroplast precursor
  Pfam annotation: Domain name=Cpn60_TCP1; Domain location=70-598; Score=589.0; E_value=4.5e-174; Accession=PF00118.14; Description=TCP- 1cpn60 chaperonin family
  Subcellular localization annotation: CTP_CleavageSite=45; ConfidenceScore=5.77e-01
MASSSTFTAMSACKLSSSAAISSFPSRRRSNAVVLSRRSRAARVSAMAKELHFNKDGTAIKKLQSGVNKLADLVGVTLGPKGRNVVLESKYGSPKIVNDGVTVAKEVIIVKTDKLIIHGESWLDDCVKLSLCQRVELEDPVENIGAKLVRQAAAKTNDLAGDGTTTSVVLAQGLIAEGVKVVAAGANPVLITRGIEKTAKALVSELKQMSKEVEDSELADVAAVSAGNNYEVGNMIAEALSRVGRKGVVTLEEGKSADNSLYVVEGMQFDRGYISPYFVTDSEKMAVEYENCKLYMITNARDLINILEDAIRSGHPILIIAEDIEQEALATLVVNKLRGSLKIAALKAPGFGERKSQYLDDIAILTGGTVIREEVGLTLDKAGKEVLGYASKVVLTKDTTTIVGDGSTQEAVNKRVAQIRNLIEAAEQEYEKEKLNERIAKLSGGVAVIQVGAQTETELKEKKLRVEDALNATKAAVEEGIVVGGGCTLLRLASKVDAIKDSLDNDEEKVGADIVKRALSYPLKLIAKNAGVNGSVVSEKVLSSDNPRYGYNAATGKYEDLMSAGIIDPTKVVRCCLEHAASVAKTFLMSDCVVVEIKEPEAIPAGNPMDNSGYGL

SEQ ID NO: 141179 - protein, 345 aa, Glycine max
  Coding DNA Sequence Number=SeqID_24401
  Homolog annotation: Hit_ID=Q10KX7; Match level="QueryCoverage=38%, HitCoverage=89%, E-value=5e-22, Identity=42%"; Hit description=OB -fold nucleic acid binding domain containing protein, expressed
MELKLQGQRRIRYMMQSQEIVTGKGAGHTVTCRWAKLQFRCCEQHHVDRCGATQIQWVVAEKVTGKFPKKVVDVASVSRKCARNKENRQRRRKKIAGKCAASIKVHRKKGNQQKGSPRTIGRQKSDGGQQWPEKSPEKKKRVVEKRKQWRLRRRIRRRWRQDVVTVASQQDAIEAVEDLRVGVSLDRDVGDSHLQRSPEAAEPASHSGHRAELDERGEARSEFVAAAAGDGGRVGVVEPEHAGDAGGAVVDGEAEEAIMLEIGIPLRKNDVVASEEGKGDWVRERRSKAKSFTCVLCSATALVLVLVAFCISEKSRQQKIAISAGDGGCCGDTLRSGKVSACASD

SEQ ID NO: 141180 - protein, 867 aa, Glycine max
  Coding DNA Sequence Number=SeqID_24402
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=86%, HitCoverage=36%, E-value=0.0, Identity=52%"; Hit description=CCHC -type integrase
  Pfam annotation: Domain name=B_lectin; Domain location=77-181; Score =55.2; E_value=2.2e-13; Accession=PF01453.15; Description=D-mannose binding lectin
  Pfam annotation: Domain name=Pkinase; Domain location=524-796; Score =121.9; E_value=1.8e-33; Accession=PF00069.15; Description=Protein kinase domain
  Pfam annotation: Domain name=Pkinase_Tyr; Domain location=525-796; Score=120.5; E_value=4.8e-33; Accession=PF07714.7; Description =Protein tyrosine kinase
  Pfam annotation: Domain name=S_locus_glycop; Domain location=211-334; Score=-35.6; E_value=0.015; Accession=PF00954.11; Description=S-locus glycoprotein family
  Pfam module annotation: Pfam domain module=B_lectin::Pkinase::Pkinase_ Tyr::S_locus_glycop; Domain location=77-181::524-796::525-796::211-334
  Subcellular localization annotation: CTP_CleavageSite=21; ConfidenceScore=5.02e-01
MASTLLPFLFLSMVLLPFQTIAQTKSNIAIGESHTAGASTSPWLVSSPSGDFAFGFLPLEDTPDHFMLCIWYAKIQDKTIVWFANRDQPAPKGSKVVLTADDGLVLITAPNGHMLWKTGGLTLRVSSGVLNDTGNFVLQDGHSKTVWESFKDYRDTLLPYQTMEKGHKLSSKLGRNYFNKGRFVLFFQNDGSLVMHSINMPSGYANENYYQSGTIESNTNTSTSAGTQLVFDGTGDMYVLRKNNEKYNLSKGGSRASSTTQFYYLRATLDFDGVFTLYQHPKGSSGSGGWSQVWSHPDNICKDYVASAGSGVCGYNSICSLRDDKRPNCRCPKWYSLVDPNDPNGSCKPDFVQACAVDKLSNRQDLYDFEVLIDTDWPQSDYVLQRPFNEEQCRQSCMEDCMCSVAIFRLGDSCWKKKLPLSNGRVDATLNGAKAFMKVRKDNSSLIVPPIIVNKNNKNTSILVGSVLLGSSAFLNLILVGAICLSTSYVFRYKKKLRSIGRSDTIVETNLRRFTYEELKKATNDFDKVLGKGAFGIVYEGVINMCSDTRVAVKRLNTFLMEDVHKEFKNELNAIGLTHHKNLVRLLGFCETEEKRLLVYEYMSNGTLASLLFNIVEKPSWKLRLQIAIGIARGLLYLHEECSTQIIHCDIKPQNILLDDYYNARISDFGLAKLLNMNQSRTNTAIRGTKGYVALEWFKNMPITAKVDVYSYGVLLLEIVSCRKSVEFEAEDEEKAILAEWAYDCYIEGTLHALVEGDKEALDDMKTFEKLVMIALWCVQEDPSLRPTMRNVTQMLEVTEKHARKGQRQNRQPKSSSPENKRQVEGGGQKHTEKDGCRIGSQSSLPENEWQAEGSTGLNPHKNQQMP

SEQ ID NO: 141181 - protein, 183 aa, Glycine max
  Coding DNA Sequence Number=SeqID_24403
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=3e-19, Identity=29%"; Hit description= UPI00006A17C9 related cluster
GLYVLPLRGLHVLAFGGLHALAFRGLHALANRGLHVLTSRGLHVLTFGGLHTLIFRGLDVLPLRGLRVLAFGGLHALAFKRLHVLAIRGLHVLAFIGLHVFTFRGLHTLIFRGLYVLPLRGLHVLAFGGLHALAFRGLHVPLFRRLHALAFRGGHVLAFGGLHTPSPFEGYASSLSDGSTSAP

SEQ ID NO: 141182 - protein, 105 aa, Glycine max
  Coding DNA Sequence Number=SeqID_24404
MGGKCAESPPTFIRGKRRKNRKRCGLRTLSVKGSGVVFRYHGSMRLFLGNGEQVTDAQDFGWQSKGEDHLRSWARFMVSWDFGSRLVEWMDMIYVRVLVWPVVQG

SEQ ID NO: 141183 - protein, 143 aa, Glycine max
  Coding DNA Sequence Number=SeqID_24405
MATMVEATMSMKKIMEANAVTVAATSTVAKTHEIPHHNLTDFKPCLGYATEGKAVVGIPLQNTLDGPRYHPQPHWKNCSLCPNVVIPKFKVLDFDKYKGTTCPKNHLKMYCRKYQYNSDMTPDRMQLQNMCKKGHESFKEYAQ

SEQ ID NO: 141184 - protein, 66 aa, Glycine max
  Coding DNA Sequence Number=SeqID_24406
MVAQKHLLLVSATLRNFTDRSVDIVATRRVVTGWFVGGGISVCVGGGRSVWEKVVCDEGLRQSVLD

SEQ ID NO: 141185 - protein, 111 aa, Glycine max
  Coding DNA Sequence Number=SeqID_24407
MEREMITMIVDMLSVFYYEKMVGYTPSSFVGLVFTGKRIEVGLRRGNFNYPALTNKKPGANRENEKEEGTHALTFVSTWPNFPPTQQYQYSANISPSHYLPPYQPRTLNHP

SEQ ID NO: 141186 - protein, 63 aa, Glycine max
  Coding DNA Sequence Number=SeqID_24408
MEYIKLEEAGIQWIEKSKEDQTEQEEATEKPESFWVDDASKDGQAHEKRLDAMEHHMWMIYDP

SEQ ID NO: 141187 - protein, 169 aa, Glycine max
  Coding DNA Sequence Number=SeqID_24409
MAEKKKRIKSIGHRPTTPITKKEKEPTKEHYESSYKFSYAKKEMIQPKYVNLAWLRSEGFAFPELIEYRVLKKLVEMKSTYYTDLVWSNTIGQSSEGIMANQLGLKEVGFSFNKVKKYKSMMKNPSVYDVIVTKAKGNKCFGTGPLMPEHKLLAYVVSLIITPRGNNDA

SEQ ID NO: 141188 - protein, 589 aa, Glycine max
  Coding DNA Sequence Number=SeqID_24410
  Gene Ontology: Mol. function=transcription regulator activity; Cellular component=nucleus; Biological process=regulation of transcription
  Homolog annotation: Hit_ID=Q9FK20; Match level="QueryCoverage=51%, HitCoverage=93%, E-value=5e-56, Identity=45%"; Hit description =Similarity to helix-loop-helix DNA-binding protein
  Pfam annotation: Domain name=HLH; Domain location=103-154; Score =54.9; E_value=2.7e-13; Accession=PF00010.16; Description=Helix-loop -helix DNA-binding domain
  Pfam module annotation: Pfam domain module=HLH::RVT_2; Domain location=103-154::381-536
MEPQKSPLMDESLCDVSHDTEFGDTHFGGGDLFSILESLEDLKDFPSTNNEAAVIGPTFKENEQNSKKVSISSRAPQDSETEPEISPKSKRQKLSPTLVEEPQKVSHITVERNRRKEMNENLSILRSLMPFFYVKRGDQASIIGGVIDYINELQQLLQCLEAKKQRKVYNEVLSPRLVSSLRPSSLSPGKPPLSPRINLPISPRNPQPGSPYKLRLQPGYLSPTIANSPTSSASSSINDNINELFANSKSIIADVEVKFSSPHVLLKTVSLPIRGQAMRIISALEDLALEILHVNISTADETMLNSVTIKIPLYDDDDVRSPKESSPTSEKVVNNNPFEEHPLQQNSLHKEWKALNDLSIDNIIEPSTIEEVLVDEHWLMAMHDELNQFKRNEVLELVPRPTKLLAKGYKQQEGIDFGETYALIARLEALRLLLAFACIMEFKLYQMYVKSVFLNGYIEEEVYVSQPSSLDHKNPTHVYKPEKALYGLKQAPTMGEFEMPMMGELNYFLGLQDCKELLKKLDMDKSKEAATPMATNCYLGVNKKRKLIDQTKYRRTIGSLIYLNANRSDIMFSVYMCACYQSCPKGSHF

SEQ ID NO: 141189 - protein, 113 aa, Glycine max
  Coding DNA Sequence Number=SeqID_24411
  Subcellular localization annotation: CTP_CleavageSite=52; ConfidenceScore=5.22e-01
MVRGSHSTRSMEFRLAQGTVTLFSNFTPQRGIGGGVVFCACFFFFNGAEECVTDSVESLGFRGVDESFGDTTHWFVFHSQTPPHAQINTPSCWTPIQVERRIEFNEHWKVGFD

SEQ ID NO: 141190 - protein, 109 aa, Glycine max
  Coding DNA Sequence Number=SeqID_24412
  Pfam annotation: Domain name=Rick_17kDa_Anti; Domain location=55-100; Score=2.1; E_value=0.1; Accession=PF05433.5; Description=Rickettsia 17 kDa surface antigen
MGSYDDNSGNSPIPGGSLAKPVLIALGALLIGKMLKGHSDDTADAPAQPVPDQSQAGGGLLGGILGGLGGLLGGAAAGNASAAPTAPGPLGGGLGGLLDQLKQAGLGDK

SEQ ID NO: 141191 - protein, 195 aa, Glycine max
  Coding DNA Sequence Number=SeqID_24413
  Homolog annotation: Hit_ID=Q8YFL8; Match level="QueryCoverage=56%, HitCoverage=55%, E-value=1e-34, Identity=70%"; Hit description =ALKALINE PHOSPHATASE LIKE PROTEIN
  Pfam annotation: Domain name=SNARE_assoc; Domain location=86-195; Score=-3.0; E_value=0.00054; Accession=PF09335.1; Description=SNARE associated Golgi protein
  Pfam annotation: Domain name=Transgly_assoc; Domain location=32-82; Score=48.6; E_value=2.1e-11; Accession=PF04226.4; Description =Transglycosylase associated protein
  Pfam annotation: Domain name=UPF0126; Domain location=4-86; Score= -21.7; E_value=0.074; Accession=PF03458.4; Description=UPF0126 domain
  Pfam module annotation: Pfam domain module=SNARE_assoc::Transgly _assoc::UPF0126; Domain location=86-195::32-82::4-86
MSVISWIILGLIAGFIGSKIVNKSGQGLFLDIALGIVGAIVGGVISSQLFGRGVTGAFDPISLVIAIIGSIIVLWVYHAITGKRSIASSLLALHGTLNIETVLIAVFVGAVLGDCTGYLIGRFGGRRLILRYGHLVKLTPERLDQFEKLFESKGIYVVATARFVVLLRQLNGIVAGSMKMDPLHFLAANIIGAAG

SEQ ID NO: 141192 - protein, 475 aa, Glycine max
  Coding DNA Sequence Number=SeqID_24414
  Gene Ontology: Mol. function=ubiquitin thiolesterase activity; Biological process=ubiquitin-dependent protein catabolic process
  Homolog annotation: Hit_ID=Q9LUK9; Match level="QueryCoverage=64%, HitCoverage=52%, E-value=7e-30, Identity=31%"; Hit description =Similarity to ubiquitin specific protease
  Pfam annotation: Domain name=UCH; Domain location=16-119; Score= -68.7; E_value=0.029; Accession=PF00443.19; Description=Ubiquitin carboxyl-terminal hydrolase
MTRRLRLVRRDSGDRMAARGLHAPEWARAGGGTWLGCWPRDLQGCVMLLKAHPTPNSPDPQPEYKLFGTIVHSGYSPESGHYYAYIKDAMGRWYCCDDSCVTVATLQEVLSEKVYILFFSRTNQRPVSSSNSLASNGVKPHSNGSQTSECPKVGVPPKAVHAKSNSELSSWKDIPRVSKTAKAPSSSRVKFDINGSSSSKRNSAPVSVNGKVDVCRNQPSAVNGHVKDSASLENGKEDSSLPTRNGIDENKVSVDKLKRKESTVSNGHTGNQTVDIHSVKSDLKEDTDRSRIIAGRVPDNFKQESNGLNNKPTILGNKRKLQGDPCILLAHDGQSQARVQELKDILGKEAKSVLRSIGWTDKVYEFMRSKKLRAQEAGNLTNGDEISVMLEETWLRIMLLATWHVWLSDCEDWNFLAFVGTKGRASLGTMGKIAYNDLPSYLRIARSPWALGCKDEEESMQIGTVKAASYRRIIR

SEQ ID NO: 141193 - protein, 112 aa, Glycine max
  Coding DNA Sequence Number=SeqID_24415
MKKKGKSLKKPWEPKGSSPASTPSQEKILRDDFSTHDMVQTLRDDFSSAAWRVQFYVSPCPQEIDTVGAKTVFLEEEDHRRERRVASSRMRFRKPSRERERMKIIKEIHKPF

SEQ ID NO: 141194 - protein, 286 aa, Glycine max
  Coding DNA Sequence Number=SeqID_24416
  Gene Ontology: Mol. function=nicotianamine synthase activity; Biological process=nicotianamine biosynthetic process
  Homolog annotation: Hit_ID=Q9XGI7; Match level="QueryCoverage=91%, HitCoverage=83%, E-value=2e-72, Identity=50%"; Hit description =Nicotianamine synthase
  Pfam annotation: Domain name=NAS; Domain location=12-286; Score =416.6; E_value=3.4e-122; Accession=PF03059.6; Description =Nicotianamine synthase protein
MAAFQSINNIETQQIPPELLISQIMQLHASISKLESLRPCKQVNSHFTHLVKLCTLPSTIDIEALPKEVQDMRDSLINLSGHAEGLLELEFSTFISLTPEPMKNVTLFPYYGNYVKLANMESKILKENGVLSPKKVAFVGSGPMPLTSIVMATHHMESTHFDNFDIDEKANEVARKIVASDSALEKRMKFETQDVMEVRERLGQYDCIFLAALVGMSREAKVKILGHIRKYMKEGGTLLVRSAKGARAFLYPIVEERDMVNFEVLTIFHPTNDVINSVVLLRKPKA

SEQ ID NO: 141195 - protein, 277 aa, Glycine max
  Coding DNA Sequence Number=SeqID_24417
  Gene Ontology: Mol. function=ubiquitin thiolesterase activity; Cellular component=nucleus; Biological process=ubiquitin-dependent protein catabolic process
  Homolog annotation: Hit_ID=Q9LUK9; Match level="QueryCoverage=98%, HitCoverage=43%, E-value=1e-104, Identity=68%"; Hit description =Similarity to ubiquitin specific protease
  Pfam annotation: Domain name=UCH; Domain location=21-275; Score=54.8; E_value=2.8e-13; Accession=PF00443.19; Description=Ubiquitin carboxyl- terminal hydrolase
  Subcellular localization annotation: CTP_CleavageSite=61; ConfidenceScore=5.43e-01
MALQMTWQPSLLSQKRKTGTGPPLGLRNLGNSCYLNSVLQCLTYTPPLANFCLRLQHSSLCDSSGSSCPFCILEKQIARSLRLDLTHDAPSKIQSCIRIFAENFRCGRQEDAHEFLRYVIDACHNTCLRLKKLRRKGAEANGGGDEAGGSTVVKEIFGGALQSQVKCLCCGYESNKVDEIMDISLDVFHSNSLKDSMQKFFQPEVLDGNNKYKCDSCKKLVAAKKQMSILQAPNILVIQLKRFEGILGGKIDKAVAFEEVLVLSSFMCKASQMEISR

SEQ ID NO: 141196 - protein, 336 aa, Glycine max
  Coding DNA Sequence Number=SeqID_24418
  Gene Ontology: Mol. function=sugar porter activity; Cellular component=membrane; Biological process=transport
  Homolog annotation: Hit_ID=Q6YYC6; Match level="QueryCoverage=90%, HitCoverage=86%, E-value=1e-106, Identity=64%"; Hit description =Phosphate/phosphoenolpyruvate translocator protein-like
  Pfam annotation: Domain name=DUF6; Domain location=20-152; Score= -3.3; E_value=0.1; Accession=PF00892.11; Description=Integral membrane protein DUF6
  Pfam annotation: Domain name=TPT; Domain location=161-305; Score =106.8; E_value=6.5e-29; Accession=PF03151.7; Description=Triose -phosphate Transporter family
  Pfam annotation: Domain name=UAA; Domain location=10-278; Score= -172.1; E_value=0.082; Accession=PF08449.2; Description=UAA transporter family
  Pfam module annotation: Pfam domain module=DUF6::TPT::UAA; Domain location=20-152::161-305::10-278
MADLKNRNFLTYAYILLYITLSSGQIFFNKWVLSSKEINFPYPLGLTLLHMVFSSVLCFVLTKILKVMKVEEGMTPEIYATSVVPIGAMFAMTLWLGNTAYLYISVAFAQMLKAIMPVAVFVLGVAAGLEVMSYKMLLIMSVISFGVLVASYGEININWIGVVYQMGGVVGEALRLIFMEIFVKRKGLKLNPLSVIAICLFLPWIFLEKPKMDEHGPWNFPPVLLILNCLCTFALNLSVFLVITHTSALTIRVAGVVKDWVVVLLSAVLFADTKVRVESDAQSSTFCLPLPVGPRAIAGVAAYNNCKLKKETSRDTSDDSDPESSQMQESQPLTSR

SEQ ID NO: 141197 - protein, 277 aa, Glycine max
  Coding DNA Sequence Number=SeqID_24419
  Gene Ontology: Mol. function=O-methyltransferase activity; Cellular component=integral to membrane; Biological process=protein prenylation
  Homolog annotation: Hit_ID=Q84ZM2; Match level="QueryCoverage=84%, HitCoverage=64%, E-value=9e-75, Identity=70%"; Hit description =Putative O-methyltransferase
  Pfam annotation: Domain name=Methyltransf_3; Domain location=30-248; Score=214.6; E_value=2.2e-61; Accession=PF01596.8; Description=O -methyltransferase
MEPFMSHQKGGTAVLLLVASVSGNADAGGNELSEAAPPILRQLRQETASMRGSQMQQSHLPSLLSVMLHIVIPLAYQEVSPDQAQLLAMLVQILGAERCIEVGVYTGYSSLAIALVLPESGHLVACERDAKSLDVAKKYYQLAGVSHKVDVKLGLAMDSLESLILNGEAGSYDFAFIDAEKKMNEKYFELLLQLVRVGGLIVIDNVLWHGKVSDPLVNDPKTISIRNFNEKLMEDKRVSISMMNSVKLIYNLLTLLESPGTYWRWDDNLSKKMTIFE

SEQ ID NO: 141198 - protein, 71 aa, Glycine max
  Coding DNA Sequence Number=SeqID_24420
MGEMSKLRSARLTMEVAPPRYVSVTRCRVKKMLDTIKEEENDFAADKRFSSPSCGSSSLSLIERPVFLKNF

SEQ ID NO: 141199 - protein, 214 aa, Glycine max
  Coding DNA Sequence Number=SeqID_24421
  Gene Ontology: Mol. function=RNA-directed DNA polymerase activity; Cellular component=extracellular region; Biological process=RNA -dependent DNA replication
MKDSIPISFRNILYKFISKTLANLLKPFLEKCVSKEQSNFVEGHSILDNALIALEIIHHMRSKTKASLEDQLQKMMSSFQWGNKSDSSRGINWLNWEKLTMKKDFGLGFHHLHGFNLAMLGKQAWKFTPNEDAIITKVLIKNGLKWRVGNGHLINVWNQPWLKHGSNSHVTTPTPSGLENHTVASLIHHENSSWRSIQSKIFSQWKIFGYPFKE

SEQ ID NO: 141200 - protein, 43 aa, Glycine max
  Coding DNA Sequence Number=SeqID_24422
MMLNVSNSITHEKVALNLTIGAAIVATRCGVTSRHQVMDNVSE

SEQ ID NO: 141201 - protein, 79 aa, Glycine max
  Coding DNA Sequence Number=SeqID_24423
  Subcellular localization annotation: CTP_CleavageSite=18; ConfidenceScore=5.02e-01
MGRTACGHQSPLGGKKRRATRRWKLRVRNLALRSHSHGNDSNNNNNKQQQQQQKELKEVVFQIPKNKVAAKPLNGTRAI

SEQ ID NO: 141202 - protein, 361 aa, Glycine max
  Coding DNA Sequence Number=SeqID_24424
  Gene Ontology: Mol. function=transferase activity; Cellular component= cytoplasm; Biological process=metabolic process
  Homolog annotation: Hit_ID=Q9FQE2; Match level="QueryCoverage=99%, HitCoverage=93%, E-value=2e-87, Identity=61%"; Hit description =Glutathione S-transferase GST 16
  Pfam annotation: Domain name=GST_C; Domain location=268-350; Score =23.8; E_value=0.00063; Accession=PF00043.15; Description=Glutathione S-transferase, C-terminal domain
  Pfam annotation: Domain name=GST_C; Domain location=45-157; Score =50.3; E_value=6.5e-12; Accession=PF00043.15; Description=Glutathione S-transferase, C-terminal domain
  Pfam annotation: Domain name=GST_N; Domain location=178-247; Score =43.9; E_value=5.4e-10; Accession=PF02798.10; Description=Glutathione S-transferase, N-terminal domain
  Pfam annotation: Domain name=GST_N; Domain location=3-76; Score=78.3; E_value=2.4e-20; Accession=PF02798.10; Description=Glutathione S -transferase, N-terminal domain
  Pfam module annotation: Pfam domain module=GST_C::GST_C::GST_N::GST _N; Domain location=268-350::45-157::178-247::3-76
MGNEVILLNFWLSPYGMRVRIALEVKGIKYENREENLSNKSPLLLQMNPVHKKIPVLIHNGRSICESLIAVEYIDEFWTTEGEEKEAAKEEFLECLKLFEEQLGDKPYFGGDNLGLLDVALVPLICYFYTYNLYGNFINEDKYPKFIAWAKRCTQKESVSKCFPEEHRVKEFISKKKKNLNRFGIFGMTAKIALAEKVIKYKYMEQDLTNKSPLLQEMNPVHKKIPVLIHHGRPICESLIIVEYIDIVWHNNCPLLPSALYHKAQARFWADFVDQKVYHASRKIWISRGYEQEEFHGDKPYFGGDTFRFVDVALIPFYCWFYTYETFGNFKVEGKCPKLISWAKRCMQKESVSETLADERE

SEQ ID NO: 141203 - protein, 122 aa, Glycine max
  Coding DNA Sequence Number=SeqID_24425
  Gene Ontology: Cellular component=membrane
  Homolog annotation: Hit_ID=Q9FL09; Match level="QueryCoverage=95%, HitCoverage=35%, E-value=7e-14, Identity=34%"; Hit description =Nodulin-like protein
MEKLDWKASSTRAKSIGTLVTIAGTLIMSLYKGQAVINNNPPFKLFPQKLVSSMQFDWAFGALLLAAHSCFLTISYILAIRIVREYPAELVGVLIRITLISILSVPVALVSVKDLKAFETGI

SEQ ID NO: 141204 - protein, 83 aa, Glycine max
  Coding DNA Sequence Number=SeqID_24426
KTVTAWVVWVWVFDAVLVVGGRVSEWVTVFAWVSVLTFRFLGKEMNSMGKMILGGRVAVEWWLGRWWWFAEGESGGSEWWLVV

SEQ ID NO: 141205 - protein, 331 aa, Glycine max
  Coding DNA Sequence Number=SeqID_24427
  Gene Ontology: Mol. function=molecular_function; Cellular component =membrane; Biological process=auxin mediated signaling pathway
  Homolog annotation: Hit_ID=Q8L9I2; Match level="QueryCoverage=99%, HitCoverage=97%, E-value=2e-52, Identity=36%"; Hit description =Nodulin MtN21-like protein
  Pfam annotation: Domain name=DUF6; Domain location=169-298; Score =2.3; E_value=0.049; Accession=PF00892.11; Description=Integral membrane protein DUF6
  Pfam annotation: Domain name=DUF6; Domain location=7-129; Score=4.5; E_value=0.036; Accession=PF00892.11; Description=Integral membrane protein DUF6
  Pfam module annotation: Pfam domain module=DUF6::DUF6; Domain location=169-298::7-129
MKELGLVSMMLMAELLDVIVNTLSKAAMKKGMNDFVFIMKRTLPPLSCNTLGLFLVVGMLSCINQSIKFFGIGYSSPTLASALSDLVPAFTFILAVIFRMEKLDWKANSTLAKSIGTVVSIAGALLLSLYKGQVIINNNPPFKLFPQKLVSSMQFDWVFGALLLAAHSCFLSINYILLTRIVREYPAELVVVLSRIALTSILSVPAALISVKDLKALRLGFNMELIAIGCSAIFVLSFRGVIHIWIMGKRGPVYVAMFKPLEIVFAVILGVTFLGDSLYIGSVIGAAIIVVGFYAVIWGKSQEKVEEDCTVCSSESYDNEVPLLQNKRTGE

SEQ ID NO: 141206 - protein, 181 aa, Glycine max
  Coding DNA Sequence Number=SeqID_24428
  Gene Ontology: Mol. function=molecular_function; Cellular component =integral to membrane; Biological process=biological_process
  Homolog annotation: Hit_ID=Q6NLY8; Match level="QueryCoverage=70%, HitCoverage=64%, E-value=5e-43, Identity=58%"; Hit description=HVA22- like protein k
  Pfam annotation: Domain name=TB2_DP1_HVA22; Domain location=33-139; Score=124.8; E_value=2.4e-34; Accession=PF03134.9; Description =TB2DP1, HVA22 family
MALPEVVRSDILFVFIITRQAVSVCVLIHTDHMQVGLRLLLSPVTSNLLLRTACCSIGLALPVYSTFKAIENNDPYEQQRCLLYWAAYGSFSAAEMFAEKLFSWIPLYHHMKFAFLVWLQLPTLDGARQMYSSHLQPFLLKHQARMDLIVEFVYGAMSKIISAYKPELELARTLAVKFLMT

SEQ ID NO: 141207 - protein, 409 aa, Glycine max
  Coding DNA Sequence Number=SeqID_24429
  Gene Ontology: Mol. function=unfolded protein binding; Cellular component=endoplasmic reticulum; Biological process=protein folding
  Homolog annotation: Hit_ID=Q01B04; Match level="QueryCoverage=67%, HitCoverage=32%, E-value=5e-48, Identity=38%"; Hit description =Homology to unknown gene
MTFFPGLVDPEDKTAQVWLISLRRDKALSWFISKTVILFKNSAGCESSDRVNMLKSEFVAVSEKNAELKKQVRELTERLQLAEQGKDQAQKQFLTLGKQPKAGPFGTVKGLRTNPTVVPDQSVNPRLAKILEKVAVKQELIVCLANTNVKEMLEVWFTNIKRVGITNYLVAALDDETAKFCESNQVPVYKRDPDDGVDTIGRTGSNHAVSGLKFRILREFLQLGYSVLLSDVDIVYLQNPFDHLYRDSDVESMSDGHDNMTAYGYNDVFDEPTMGWARYAHTMRIWVYNSGFFYIRPTIPSIELLDRVATRLSKEQAWDQAVFNEELFYPSHPGYDGLHAARRTMDRYQFMNSKVLFKTVRNDASLSKLKPVIIHVNYHPDKLPRMKAIVEYYVNGKQEALKPFPDGSD

SEQ ID NO: 141208 - protein, 126 aa, Glycine max
  Coding DNA Sequence Number=SeqID_24430
  Homolog annotation: Hit_ID=Q45NM4; Match level="QueryCoverage=35%, HitCoverage=23%, E-value=1e-09, Identity=62%"; Hit description=BURP domain-containing protein
RQQLKCFKVSLGAENGDNKIETLGVCHLDTSDWNPNHIIFTRLGIKPGKAPVNLSSDDYVPFVELSFYVCLACALFYPQFFQDSCYYISTNLASDLLLVVVKAQTTVEDSHYKSERLFLHVEISEV

SEQ ID NO: 141209 - protein, 556 aa, Glycine max
  Coding DNA Sequence Number=SeqID_24431
  Gene Ontology: Mol. function=ice binding; Cellular component=cell outer membrane; Biological process=pathogenesis
  Homolog annotation: Hit_ID=Q45NM4; Match level="QueryCoverage=33%, HitCoverage=98%, E-value=8e-74, Identity=68%"; Hit description=BURP domain-containing protein
  Pfam annotation: Domain name=BURP; Domain location=285-504; Score =245.6; E_value=1e-70; Accession=PF03181.6; Description=BURP domain
MKVELRDEKQDEWYKATSVSNDESYGQGYITTSESAEPNYLASYTATKRNHNHEKFHQPYIAGYTTSNAANKANQHIAGYRTKTYDSNTPYIAGYRTTSASHKAQESNTPYIAGYRTNTYDSNAPYIAGYTTSAHMANNQPNYIAGYRTRTTRDSNTPYIAGYRTRTTHDSNTPYIAGYRTRTTHDPNAPYIAGYRTRTTHDPNAPYIAGYTTTTAKKAPKEPFHDDTTEPYIAQYGETKPKKDLKESSHDDTTKPYITQYGGTGTKNDPKESSNIVDHTEAFKTGFFALDDLHVGNVMTLQFPIQEVSHFLPKKEAESIPFSISQLPSVLQLFSISEDSPQANAMRDTLDQCEAEPITGETKICATSLESMLEFVGKIIGLETKHNIITTTLPTASGVPLQKFTILEVSEDINASKWVACHPLPYPYAIYYCHFIATGSKVFKVSLGSENNGDDDKIEALGICHLDTSDWSPNHIIFRQLGIKPGKDSVCHFFTIKHLMWVPQPLQATIYGAIEGKKGYPPITPTVMTPGGPLDLSSVFFWNHIIKGRTEDVRRQ

SEQ ID NO: 141210 - protein, 175 aa, Glycine max
  Coding DNA Sequence Number=SeqID_24432
  Gene Ontology: Mol. function=electron carrier activity; Biological process=electron transport
  Homolog annotation: Hit_ID=Q2SQ47; Match level="QueryCoverage=60%, HitCoverage=56%, E-value=1e-22, Identity=49%"; Hit description=Thiol- disulfide isomerase and thioredoxins
  Pfam annotation: Domain name=AhpC-TSA; Domain location=70-169; Score=- 4.7; E_value=0.0017; Accession=PF00578.11; Description=AhpCTSA family
  Subcellular localization annotation: CTP_CleavageSite=59; ConfidenceScore=5.57e-01
MALRLRLKVSSIGSPFLQLGSSATAAFSFSQPCSLPKLAFHPPRLQLNKNSHPIRFLVRAGRTESKGVTLGFRAPQFQLPEPLTGKVWTLEDFEAYPALLVMFICNHCPFVKHLKKDIVKLTKFYVEKGLAVIAISSNSVATHPQDGPEFMAEDAKLFDYPFPYLYDEMPMQLYA

SEQ ID NO: 141211 - protein, 156 aa, Glycine max
  Coding DNA Sequence Number=SeqID_24433
MREDRSKTSRISKIKHNSKNKTRETVGQNIGNSQSTIITEVMKIVMRPKSRNSKKKQKGGVFDENKTWVLDPARGIWRLGATESETKKPLGNKKAKPHPIRTPIATEVRTRDLRREGNSNETIKVVVVRKSIHSPLNFESDADCVTSFSDSSFTLT

SEQ ID NO: 141212 - protein, 115 aa, Glycine max
  Coding DNA Sequence Number=SeqID_24434
MVSSARVYEKADTISTPKEEDLLHRSTKKIEELLKAMLKDLPYLLWISYWNLSEKEKSQWSWKKTLHAKRGISDHALFVHHVLSAHARAIWLPKWLLALSEGGALSECEALSETL

SEQ ID NO: 141213 - protein, 242 aa, Glycine max
  Coding DNA Sequence Number=SeqID_24435
MDLKKTRCYKNLKERLTRIKYEKTVVISGNEGEARSKFDAMSINEIPPINNKIATVNNSKSGAIAAGTIGGSSSKVAGEPKSRNNVVYTKQKKGALIQNLTARMVKANISKDDKEKTGVDIVASAKLKISKNEVHEVSKKNESLLLLNMNIPTLENKGYEEHFVHVHVDQEVVEFVARRRQFEEDSKLSMAKFHMDISSTVLMENEDSNGESDSQSPNQPLIPYEYYNLEIVVAQLRVDLVF

SEQ ID NO: 141214 - protein, 218 aa, Glycine max
  Coding DNA Sequence Number=SeqID_24436
MGDSDKCGLYVYDNPPQLVVLGRFYKGSTTIHNVPLSNNQLKVDVEEVRDANACNFVPTKEVSWDATMFGVHNDNFPLYIKQEHLSEIAHDGQCLSISVIQLWILHMTETSMRAGNIDVYGFLEPYSIQKFGQSQFESEDYIKKWMQNSLRDVYLGAYLNGALKGFNNSHGSKSKGVARWILVKYFTDQRPLESERMKAICIQWARYYLKVKNQTLGV

SEQ ID NO: 141215 - protein, 183 aa, Glycine max
  Coding DNA Sequence Number=SeqID_24437
SIIERYIAKEAIEFCFKYIEKAKLVGVPESRPDERVRGENEWMEKYLKVCAKSESGLSMTTNRPPLPMANIDPGIGSNISKTVKENKEQARSSPKEKMSGVATNVYLRKTLEKPKEGEARLKGASSKKGKCTRVATNVYSRKTLEKPKRGPQLLRIRAQELFTCGEAFVVDKSVALAPTYPQV

SEQ ID NO: 141216 - protein, 33 aa, Glycine max
  Coding DNA Sequence Number=SeqID_24438
MEGLGGAVESPEVPWRHWPTTVILVALCLKGFG

SEQ ID NO: 141217 - protein, 84 aa, Glycine max
  Coding DNA Sequence Number=SeqID_24439
MWKRIWRVELVLWMRWWLQNDELLKPKRRWMNPYISIGEIKRKMKKKKIASYRSRFDEEMSKIGRFGGLGMEERRKGKRLRRGF

SEQ ID NO: 141218 - protein, 75 aa, Glycine max
  Coding DNA Sequence Number=SeqID_24440
IEREKIIDSLESLDDENAVLREELHARTIECERIEKENNALLFFQDSCYYISTNLASDLAQSTDSVAGGGQGSNS

SEQ ID NO: 141219 - protein, 311 aa, Glycine max
  Coding DNA Sequence Number=SeqID_24441
  Subcellular localization annotation: CTP_CleavageSite=61; ConfidenceScore=5.49e-01
MASLPQMSTTLGACMSSNKTINPRPCIAQLNNNNNNKRSTPFSNLIANHQIVNGTLFPFALVGQKKPIIELWKQCQNEKWKARAGKNPEFLPHSDVESVVKEFYDAFNKKDIEKLKQLVSDDCEYQDYLFYNPYKGKEVMDALGPNIKIAVGKGDIRVEEDVRVEDVKESKPMATVFWHLGLGERWLGFVRERNGKNGKVTGLEELPLKPGEIVLDQTSSSKEFPKGFLEAEFTHSASNIVIELPFVSTKDCPSDGLPEFALLAAPTSENPRSSTPSAKKNCVLNVRHVVISSVLKLESLHEEVGLRREDL

SEQ ID NO: 141220 - protein, 107 aa, Glycine max
  Coding DNA Sequence Number=SeqID_24442
  Gene Ontology: Mol. function=electron carrier activity; Biological process=electron transport
  Homolog annotation: Hit_ID=Q5KZG6; Match level="QueryCoverage=91%, HitCoverage=39%, E-value=6e-17, Identity=53%"; Hit description =Hypothetical conserved protein
SQDVAQDFGAVCTPEFYLFKKDGRRPFELVYHGQFDDSRPSNNVPLTGRDLSLAIDRVLSGQPVPSEQKPSLGLYYFHVLKVIVFLCMKCWMQHKVAPKEEVLIDKL

SEQ ID NO: 141221 - protein, 280 aa, Glycine max
  Coding DNA Sequence Number=SeqID_24443
  Gene Ontology: Mol. function=metal ion binding; Cellular component =nucleus; Biological process=regulation of transcription, DNA -dependent
  Homolog annotation: Hit_ID=Q0GLC8; Match level="QueryCoverage=28%, HitCoverage=76%, E-value=4e-43, Identity=97%"; Hit description=Dof23
  Pfam annotation: Domain name=zf-Dof; Domain location=30-92; Score =132.0; E_value=1.6e-36; Accession=PF02701.6; Description=Dof domain, zinc finger
GGDAGLPQMLHPRHMVTPMEEQQRSRWKPSVEVAPNCPRCASTNTKFCYYNNYSLSQPRYFCKGCRRYWTKGGSLRNVPVGGGCRKNRRGKSSSSSRLQHQSHQRAFSCENTESSSVGDDAQQNNNVSRDIDMALVFAKFLNPKPTTGEDNNGSPSSNNYLTPESVEIENDAVVQSQNKASSDPVIVESENLSLVEIDELERLLGVCGDEDGLWSDATLSSSVTWEPPLKESEYSMPLNEDDGDQLLPIIISASTMSDTCWSNWSSFDLSTMDALSSSPS

SEQ ID NO: 141222 - protein, 1089 aa, Glycine max
  Coding DNA Sequence Number=SeqID_24444
  Gene Ontology: Mol. function=protein serine/threonine kinase activity; Cellular component=integral to membrane; Biological process=protein amino acid phosphorylation
  Homolog annotation: Hit_ID=Q9LHP4; Match level="QueryCoverage=99%, HitCoverage=96%, E-value=0.0, Identity=48%"; Hit description =Receptor protein kinase-like protein
  Pfam annotation: Domain name=LRRNT_2; Domain location=24-66; Score =41.0; E_value=4e-09; Accession=PF08263.3; Description=Leucine rich repeat N-terminal domain
  Pfam annotation: Domain name=LRR_1; Domain location=118-140; Score =15.6; E_value=0.17; Accession=PF00560.23; Description=Leucine Rich Repeat
  Pfam annotation: Domain name=LRR_1; Domain location=142-164; Score =10.4; E_value=3.2; Accession=PF00560.23; Description=Leucine Rich Repeat
  Pfam annotation: Domain name=LRR_1; Domain location=166-188; Score =10.9; E_value=2.6; Accession=PF00560.23; Description=Leucine Rich Repeat
  Pfam annotation: Domain name=LRR_1; Domain location=190-213; Score =5.7; E_value=25; Accession=PF00560.23; Description=Leucine Rich Repeat
  Pfam annotation: Domain name=LRR_1; Domain location=215-237; Score =2.2; E_value=1.1e+02; Accession=PF00560.23; Description=Leucine Rich Repeat
  Pfam annotation: Domain name=LRR_1; Domain location=239-261; Score =8.8; E_value=6.5; Accession=PF00560.23; Description=Leucine Rich Repeat
  Pfam annotation: Domain name=LRR_1; Domain location=263-285; Score =8.5; E_value=7.3; Accession=PF00560.23; Description=Leucine Rich Repeat
  Pfam annotation: Domain name=LRR_1; Domain location=287-309; Score =11.3; E_value=2.2; Accession=PF00560.23; Description=Leucine Rich Repeat
  Pfam annotation: Domain name=LRR_1; Domain location=311-333; Score =11.3; E_value=2.2; Accession=PF00560.23; Description=Leucine Rich Repeat
  Pfam annotation: Domain name=LRR_1; Domain location=335-357; Score =9.2; E_value=5.5; Accession=PF00560.23; Description=Leucine Rich Repeat
  Pfam annotation: Domain name=LRR_1; Domain location=359-381; Score =11.4; E_value=2.1; Accession=PF00560.23; Description=Leucine Rich Repeat
  Pfam annotation: Domain name=LRR_1; Domain location=383-405; Score =6.0; E_value=22; Accession=PF00560.23; Description=Leucine Rich Repeat
  Pfam annotation: Domain name=LRR_1; Domain location=407-429; Score =20.2; E_value=0.0075; Accession=PF00560.23; Description=Leucine Rich Repeat
  Pfam annotation: Domain name=LRR_1; Domain location=431-453; Score =9.6; E_value=4.6; Accession=PF00560.23; Description=Leucine Rich Repeat
  Pfam annotation: Domain name=LRR_1; Domain location=455-477; Score =12.9; E_value=1.1; Accession=PF00560.23; Description=Leucine Rich Repeat
  Pfam annotation: Domain name=LRR_1; Domain location=479-501; Score =15.9; E_value=0.15; Accession=PF00560.23; Description=Leucine Rich Repeat
  Pfam annotation: Domain name=LRR_1; Domain location=503-525; Score =17.0; E_value=0.067; Accession=PF00560.23; Description=Leucine Rich Repeat
  Pfam annotation: Domain name=LRR_1; Domain location=527-549; Score =15.6; E_value=0.18; Accession=PF00560.23; Description=Leucine Rich Repeat
  Pfam annotation: Domain name=LRR_1; Domain location=551-573; Score =11.6; E_value=1.9; Accession=PF00560.23; Description=Leucine Rich Repeat
  Pfam annotation: Domain name=LRR_1; Domain location=575-597; Score =17.6; E_value=0.045; Accession=PF00560.23; Description=Leucine Rich Repeat
  Pfam annotation: Domain name=LRR_1; Domain location=602-622; Score =0.4; E_value=2.4e+02; Accession=PF00560.23; Description=Leucine Rich Repeat
  Pfam annotation: Domain name=LRR_1; Domain location=624-645; Score =14.4; E_value=0.43; Accession=PF00560.23; Description=Leucine Rich Repeat
  Pfam annotation: Domain name=LRR_1; Domain location=647-668; Score =12.7; E_value=1.2; Accession=PF00560.23; Description=Leucine Rich Repeat
  Pfam annotation: Domain name=LRR_1; Domain location=94-116; Score =12.3; E_value=1.4; Accession=PF00560.23; Description=Leucine Rich Repeat
  Pfam annotation: Domain name=Pkinase; Domain location=763-1038; Score= 114.3; E_value=3.5e-31; Accession=PF00069.15; Description=Protein kinase domain
  Pfam annotation: Domain name=Pkinase_Tyr; Domain location=763-1038; Score=63.9; E_value=2.2e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=Pkinase::Pkinase_Tyr; Domain location=24-66::118-140::142-164::166-188::190-213::215 -237::239-261::263-285::287-309::311-333::335-357::359-381::383 -405::407-429::431-453::...
  Pfam module annotation: Domain location=455-477::479-501::503 -525::527-549::551-573::575-597::602-622::624-645::647-668::94 -116::763-1038::763-1038
MSSNALTLFILFLNILCPSISGALNHEGLSLLSWLSTFNSSNSATAFSSWDPTNKDPCTWDYITCSEEGFVSEIIITSIDIRSGFPSQLHSFGHLTTLVISNGNLTGQIPSSVGNLSSLVTLDLSFNALSGSIPEEIGMLSKLQLLLLNSNSLQGGIPTTIGNCSRLRHVEIFDNQLSGMIPGEIGQLRALETLRAGGNPGIHGEIPMQISDCKALVFLGLAVTGVSGEIPPSIGELKNLKTLSVYTAQLTGHIPAEIQNCSALEDLFLYENQLSGSIPYELGSVQSLRRVLLWKNNLTGTIPESLGNCTNLKVIDFSLNSLGGQIPVSLSSLLLLEEFLLSDNNIFGEIPSYIGNFSRLKQIELDNNKFSGEIPPVMGQLKELTLFYAWQNQLNGSIPTELSNCEKLEALDLSHNFLSGSIPSSLFHLGNLTQLLLISNRLSGQIPADIGSCTSLIRLRLGSNNFTGQIPSEIGLLSSLTFIELSNNLLSGDIPFEIGNCAHLELLDLHGNVLQGTIPSSLKFLVGLNVLDLSLNRITGSIPENLGKLTSLNKLILSGNLISGVIPGTLGLCKALQLLDISNNRITGSIPDEIGYLQELDILLNLSWNSLTGPIPETFSNLSKLSILDLSHNKLTGTLTVLVSLDNLVSLNVSYNSFSGSLPDTKFFRDLPTAAFAGNPDLCISKCHASEDGQGFKSIRNVILYTFLGVVLISIFVTFGVILTLRIQGGNFGRNFDEGGEMEWAFTPFQKLNFSINDILTKLSESNIVGKGCSGIVYRVETPMKQMIAVKKLWPIKKEEPPERDLFTAEVQTLGSIRHKNIVRLLGCCDNGRTRLLLFDYICNGSLFGLLHENRLFLDWDARYKIILGAAHGLEYLHHDCIPPIVHRDIKANNILVGPQFEAFLADFGLAKLVSSSECSGASHTVAGSYGYIAPEYGYSLRITEKSDVYSYGVVLLEVLTGMEPTENRIPEGAHIVAWVSNEIREKRREFTSILDQQLVLQNGTKTSEMLQVLGVALLCVNPSPEERPTMKDVTAMLKEIRHENDDFEKPNFLHKSMVTTNPKAAVHCSSFSRSCEPLIIESTSSSSV

SEQ ID NO: 141223 - protein, 276 aa, Glycine max
  Coding DNA Sequence Number=SeqID_24445
  Subcellular localization annotation: CTP_CleavageSite=84; ConfidenceScore=5.37e-01
MDKRGAKVDGKKSAPPKNETQNLSRSLPSPWSTSTQAYHNVEHAATSNVNPATSLFYPSWSGSQMPTAYDAMYQSWSFSNIYPMAAAEVGQCCLLDSGDEMQRISCDKSLQPSIPKTNGEGLPRSVTSESKETTVVGHDVKNAGAATTFKIKESDETKERRKRQKNMISDKRKKRKIMKLQDIPSTRQGQSSMMQGNGPASQNVSSNETCNVIASDHFEANPTELQNQKLGTEPDACGSKPQLKRKETAEEKEQRRKHQKKIASKRSRMKIKVHNA

SEQ ID NO: 141224 - protein, 190 aa, Glycine max
  Coding DNA Sequence Number=SeqID_24446
  Gene Ontology: Mol. function=transcription factor activity; Cellular component=intracellular; Biological process=regulation of transcription, DNA-dependent
  Homolog annotation: Hit_ID=Q7CIJ7; Match level="QueryCoverage=92%, HitCoverage=52%, E-value=6e-78, Identity=80%"; Hit description =Repressor of galETK operon
MPLAYEQLGRRLRRIGVVEPDATVGDRGQITIDQHQRGRMGGVAQQRLLPHARDVRHDGFTSLIDEKIEAAFFQLGLMPAAAQHQTHAGLPSDVFHAPRQTREKRIVKIAGQQPQHIAASFRQRQRGGVAVVVKLAHRFLDAFAGHRFNVGGIIDHPADGGRGNAGAPRHVFHGGHGMSCCAVRRPVRRA

SEQ ID NO: 141225 - protein, 412 aa, Glycine max
  Coding DNA Sequence Number=SeqID_24447
  Gene Ontology: Mol. function=nucleoside-triphosphatase activity; Cellular component=membrane; Biological process=cobalt ion transport
  Homolog annotation: Hit_ID=Q6D593; Match level="QueryCoverage=61%, HitCoverage=91%, E-value=1e-122, Identity=88%"; Hit description =Putative ABC transport ATP-binding subunit
  Pfam annotation: Domain name=ABC_tran; Domain location=202-393; Score= 180.1; E_value=5.6e-51; Accession=PF00005.17; Description=ABC transporter
  Pfam annotation: Domain name=BPD_transp_2; Domain location=1-180; Score=-57.6; E_value=0.02; Accession=PF02653.6; Description=Branched- chain amino acid transport system  permease component
  Pfam module annotation: Pfam domain module=ABC_tran::BPD_transp_2; Domain location=202-393::1-180
  Subcellular localization annotation: CTP_CleavageSite=74; ConfidenceScore=5.41e-01
ALTYAGMLLFFRNETGFGGNNGFTGFTTLLGFSVTATGTRIALFIATVLLLLFSLALGFALARSKFGRVLTAVRDAENRLMFIGYDPKGFKLFVWTLSAVLCGLAGALYVPQVGIINPSEMSPTNSIEAAIWVALGGRGTLIGPLLGAAIVNGVMTEQLFTQPHPADRHRQQTDPVLLLENINVSFDGFRALTDLSLQIGVGELRCVIGPNGAGKTTLMDVITGKTRPDSGQVIYDQDTDLRQLSPVEIARAGIGRKFQKPTVFEALTVFENLEIALKNDKSVWASLRARLSGEQRDRIDEVLKLLRLGGERQRQAGLLSHGQKQFLEIGMLLVQEPHLLLLDEPAAGMTDAETDYTAELFRSLAGKHSLMVVEHDMGFVETIADHVTVLHQGQVLAEGSLREVQADDRVID

SEQ ID NO: 141226 - protein, 412 aa, Glycine max
  Coding DNA Sequence Number=SeqID_24448
  Gene Ontology: Mol. function=dolichyl-diphosphooligosaccharide -protein glycotransferase activity; Cellular component=endoplasmic reticulum membrane; Biological process=protein amino acid N-linked glycosylation via asparagine
  Homolog annotation: Hit_ID=Q9LVR2; Match level="QueryCoverage=99%, HitCoverage=97%, E-value=1e-173, Identity=70%"; Hit description =Dolichyl-di-phosphooligosaccharide-protein glycotransferase (Oligosaccharyltransferase)-like
  Pfam annotation: Domain name=DDOST_48kD; Domain location=4-412; Score= 426.1; E_value=4.8e-125; Accession=PF03345.5; Description=Dolichyl -diphosphooligosaccharide-protein glycosyltransferase 48kD subunit
MSKLIFVFLSLIPLLCTSFSPERPSDRRVLVLLDDFAIKSSHSFFFNSLKSRGFDLQFPLADDPKIALQRYGQGAGFGGSIDAAAILDFVDSGHDLIVAADSNASDLIREIATECGVDFDEDPAAVVVDHSGYAVSATEGDHTLIASDDFIKSDAPVLFQGIGHSLNPTNSLVLKVLSASPSAFSANPKSKLTSPPSLTGTSISLVSVIQARNNARILISGSLSLFSNRFFTSGVQKAGSPTKHEKSGNEQFLNELSKWIFHERGHLKAVHVQHHKVGEANEPAIYRINDNLEYSVEVYEWSGTTWEPYVADDVQVQFYMMSPYVLKTLSTDGKGHYFTSFKVPDVYGVFQFKVEYEKLGYTSLSLSKQIPVRPFRHNEYERFIPAAYPYYGAAFSMMAGFFIFTAVHLYSK

SEQ ID NO: 141227 - protein, 196 aa, Glycine max
  Coding DNA Sequence Number=SeqID_24449
  Gene Ontology: Mol. function=RNA-directed DNA polymerase activity; Cellular component=chromatin; Biological process=chromatin assembly or disassembly
MEGTLAPQTFRLLDSIGPQKLVILVDGGSSHNFIQTRMARFLALPSSPTTPLHVMVGNGNTLDCDIISPQILGPVTTDYTSLTMNFPYFGHTVTLIADAPPTPTLASSHQLKRFAQNHNISALFHITPALAQPTPPWQISLIGILLQTNSANGAVLLRKTHAKCQQQWRNLLVQTRGSGLATAAGEKGKTPLLMAR

SEQ ID NO: 141228 - protein, 414 aa, Glycine max
  Coding DNA Sequence Number=SeqID_24450
  Gene Ontology: Mol. function=protein dimerization activity; Biological process=electron transport
  Homolog annotation: Hit_ID=Q6RZV0; Match level="QueryCoverage=93%, HitCoverage=74%, E-value=1e-47, Identity=27%"; Hit description =Transposase-like protein
  Pfam annotation: Domain name=DUF659; Domain location=15-165; Score =179.9; E_value=6.3e-51; Accession=PF04937.6; Description=Protein of unknown function (DUF 659)
MIDAIAKCGLGFTGPYAEILKTTWLERIKSEEGLQSKDVEKEWATTGCTIIADTWTDYKSKAIINFLVSSPSRTFFHKSVDASAYFKNTKWLADLFDSVIQEFGSENVVQIIMDGCVNYTGIANHIVQSYGTIFVSPCGSQCQELIRTGITKSVSTFLSLQSMLKLRTRLKNMFHSHEYASNTSNANKPQSLSCIAIAEDGDFWRTVEECVAISEPFLKVLREISEGKPTVGSIYELMSRAKESIRTHYIMDENKYFFNVLEKLLPVPDMRRDITNQIYTFTKAHGMFGCSLAKEARNTVAPYSLLIRCRALVGAWSTFWQILSEKRNKIDRETFNDLVYVNYNLKLARQMSAKSTEVDLLQFDDIDMTAEWVEENETASPTQWLDRFGPALDGNDLNTRQFGSSIFGANDPIF

SEQ ID NO: 141229 - protein, 371 aa, Glycine max
  Coding DNA Sequence Number=SeqID_24451
  Gene Ontology: Mol. function=galactosyltransferase activity; Cellular component=membrane; Biological process=protein amino acid glycosylation
  Homolog annotation: Hit_ID=Q8RW34; Match level="QueryCoverage=98%, HitCoverage=77%, E-value=5e-63, Identity=57%"; Hit description=Beta 1,3-glycosyltransferase-like protein I
  Pfam annotation: Domain name=Galactosyl_T; Domain location=155-356; Score=9.8; E_value=1.5e-07; Accession=PF01762.12; Description =Galactosyltransferase
MVIDCREQHKKLDAIETELAGARQEGFVSKPLIETNGTYSMRRPLVVIGILTKFGRQKNRDAIRKAWMGSGASLKKIEEGKGIIVQFVIGRSENRGDNQDKDIDRENRLTNDFIILDILGISFGIHFSMKILLSCLILNLEMEPPEYNFLDRFNNAPENSAHAKIESTKLIKVRIGGNFTTENSVASNLSPQPIVLVKLDQDNHVETNDAFPKKAKLFFAHAADKWDAEFYAKVNDDVYVNIDALGATLATHLDKPRVYMGCMKSGEVFSELEYLMILILVSVKYDRNHKWYEPEWWKFGDKKSYFRHASGEMYVISQALAKFISINRSILRTYAHDDVSAGSWFIGLDVKHVDEAKFCCSSWSTGLPLFS

SEQ ID NO: 141230 - protein, 69 aa, Glycine max
  Coding DNA Sequence Number=SeqID_24452
MVPFGVPPFDLGLGPWVGKKERVSYRKRQVLAMASKRILKELKDLQKDPPTSCSAGSCLCYALPCLCVS

SEQ ID NO: 141231 - protein, 48 aa, Glycine max
  Coding DNA Sequence Number=SeqID_24453
MKQLEEGNLNWGLCNDGVLVVIEDELYLLVRTAVPHAIEVRETHSVII

SEQ ID NO: 141232 - protein, 361 aa, Glycine max
  Coding DNA Sequence Number=SeqID_24454
  Gene Ontology: Mol. function=acyltransferase activity; Cellular component=integral to membrane; Biological process=metabolic process
  Homolog annotation: Hit_ID=Q8L4Y2; Match level="QueryCoverage=92%, HitCoverage=87%, E-value=1e-114, Identity=59%"; Hit description =Probable 1-acyl-sn-glycerol-3-phosphate acyltransferase 4
  Pfam annotation: Domain name=Acyltransferase; Domain location=84-244; Score=57.2; E_value=5.3e-14; Accession=PF01553.11; Description =Acyltransferase
  Subcellular localization annotation: CTP_CleavageSite=90; ConfidenceScore=5.15e-01
MAVLKPVSSCFGAKYQALAPWRILRGLVCLLVLLSTAFIMLVFFGFISAVIMRLFSVIYSRRATSFFFGAWLALWPFLFEKINKTKVVFSGDIVPSRERILLIANHRTEVDWMYLWDLALRKGCLGYIKYILKSSLMRLPVFGWAFHILEFIPVERKWEADESIMRYMLSTFKDPQDPLWLALFPEGTDFTEQKCLRSKKYAAEHGLPVLKNVLLPKTKGFCACLQELRSSLAAVYDVTIGYKYRCPSFLDNVFGVDPSEVHIHICRFPLDSIPVSEEEMSMWLINRFQTKDQLLSNFQTQGQFPDQAAERDLSAVKSILNCMTIVTVTARIDLIIDIIVLTSIHTPFKAQRARRIMLRST

SEQ ID NO: 141233 - protein, 374 aa, Glycine max
  Coding DNA Sequence Number=SeqID_24455
  Gene Ontology: Cellular component=plasma membrane
  Homolog annotation: Hit_ID=Q10QE9; Match level="QueryCoverage=98%, HitCoverage=97%, E-value=1e-113, Identity=57%"; Hit description =Expressed protein
  Pfam annotation: Domain name=DUF677; Domain location=40-368; Score =644.4; E_value=9.3e-191; Accession=PF05055.3; Description=Protein of unknown function (DUF677)
  Pfam annotation: Domain name=DUF793; Domain location=35-368; Score= -228.1; E_value=0.034; Accession=PF05633.2; Description=Protein of unknown function (DUF793)
  Pfam module annotation: Pfam domain module=DUF677::DUF793; Domain location=40-368::35-368
MGSHMSKKIPETSSIGLSTELHYKTELSSYEAACKLDSDLQSFDTTLQARTNQVINTLAVGVEVRALSFDSLKQITECLLEMNQEVVKVILDCKKDIWKSQELFELVEEYFENSLKTLDFCTALEKCLKRARDSQLLIHVALQQFEEESSGSGGDNRYPRTLQEFKNFKAAGDPFTEEFFQIFQSVYKHQIFMLEKLQLRKNKLDKKLKYIHSWRKVSSMIFVATFAAVLICSVVAAAIAAPPVAAAIAAATSIPIGSMGKWIDSLWRNYENALKGQKEVISSMQAGTYVAIKDLDNIRVLIDRLEIEIESLLHNVDFAIEEEAVKVAIEEIKKKLGVFMKNVEDLAVQADMCSRDIRRARTVVLQRIIKHPHN

SEQ ID NO: 141234 - protein, 252 aa, Glycine max
  Coding DNA Sequence Number=SeqID_24456
  Subcellular localization annotation: CTP_CleavageSite=47; ConfidenceScore=5.14e-01
MEMNIRVLISGQISTIAQRARKVRARLADVPSSSAPPAPPTSAMPTPAAHDSQRFEAMLQSIHQGQILLLQSLQVVVPLGSILSVEQFIEKVSWPGTVPSTVREGEGPSAQVPQQVHDASSKATIPGAFDFLGAGVKIRPDEAVFPEPIVAVIHETVEAGESQLRQEAATPERTPQTLEDPLSPGMGLSFARQVTDPPTPVHERQADPPTPIMEMLEDPTTPVLRLSSTPPATPVLHLIDEEDMQDQDTQGT

SEQ ID NO: 141235 - protein, 495 aa, Glycine max
  Coding DNA Sequence Number=SeqID_24457
  Gene Ontology: Mol. function=protein serine/threonine kinase activity; Cellular component=integral to membrane; Biological process=protein amino acid phosphorylation
  Homolog annotation: Hit_ID=Q1SAX0; Match level="QueryCoverage=95%, HitCoverage=83%, E-value=1e-176, Identity=68%"; Hit description =Protein kinase
  Pfam annotation: Domain name=Pkinase; Domain location=194-460; Score =132.4; E_value=1.2e-36; Accession=PF00069.15; Description=Protein kinase domain
  Pfam annotation: Domain name=Pkinase_Tyr; Domain location=191-460; Score=69.1; E_value=1.4e-17; Accession=PF07714.7; Description =Protein tyrosine kinase
  Pfam module annotation: Pfam domain module=Pkinase::Pkinase_Tyr; Domain location=194-460::191-460
MSLNSCGFQSLYLGSSKCSNLVFQDVRKLQQYQDALDKCSNFDHPFGESCADCTGAILSLRDSLYNQVTNNNNNHTEVAICAVAAIVAVAAGKPNDPAVDKVLRCLPPSASGSDKKLSQMKLTKKMSIFGSPGSLWKSLLSVPVVILAILLVVIMVKRLSKKKLRRQANLKEIAAWSGLYWFCKREIENAMNYGGEKICLGRGSAGQVYRGILPSGQLVAIKHLTKSNTSESFTREVEGLSRLRHPNLVCLFGCCIEGDERYLVYEFCANGNLAQHLLRRDSHLTWETRVRILRDCSYALKYLHHHIEGCVVHRDIKLTNILLNEKYQAKLSDFGLAKVMGIKESKVFTDVRGTIGYMDPEYMSNAKLTCASDVYSFGIVALQILSGQKVIELDLDARDQLTRKARDVSMGKRPLSDFEDPRLNGKVDKTDFEAILQIAVLCVAKSSKGRPTIELVFEELDKVCRDTETRMKQKKDESLSTTSTPSSKSSKSAPL

SEQ ID NO: 141236 - protein, 242 aa, Glycine max
  Coding DNA Sequence Number=SeqID_24458
MGLLSKSKSTMPGTRRESQFLKLVHPGGFVELHSNPIIASQVMNKNPRHCVTRPDFFQFPWIVVNPESILTPGNVFYIVPCHTIRHKIKSTNIVTANTNHTLHFLPNQSSIDPHRQGQISNSNKIRCFQKQSSFSASTSCVKLPREGHKHGKGGNYWAQSSVREKHVYYSSDYTSRDSGKEEARSRSGRFSHSEQIPTLKPCLKKDKSHSTRSRRNLKVRFECNDDNVVNSANFTTKIYRYT

SEQ ID NO: 141237 - protein, 112 aa, Glycine max
  Coding DNA Sequence Number=SeqID_24459
  Homolog annotation: Hit_ID=Q1SAX0; Match level="QueryCoverage=42%, HitCoverage=9%, E-value=7e-12, Identity=66%"; Hit description =Protein kinase
  Subcellular localization annotation: CTP_CleavageSite=24; ConfidenceScore=5.10e-01
MNTCPPEFRGCDANAFDKTVRAFRQHKVVGNPSSPHLSKTSFTSPHSPNATYWDVLNFSTHVPAPQHQIKLNANILEKSRHCMKEEGREMDLTLWRIIGCWRYEWGKLCRCC

SEQ ID NO: 141238 - protein, 749 aa, Glycine max
  Coding DNA Sequence Number=SeqID_24460
  Gene Ontology: Mol. function=protein serine/threonine kinase activity; Biological process=protein amino acid phosphorylation
  Homolog annotation: Hit_ID=Q1SAX1; Match level="QueryCoverage=55%, HitCoverage=71%, E-value=1e-180, Identity=76%"; Hit description =Protein kinase
  Pfam annotation: Domain name=Pkinase; Domain location=60-334; Score =148.0; E_value=2.5e-41; Accession=PF00069.15; Description=Protein kinase domain
  Pfam annotation: Domain name=Pkinase_Tyr; Domain location=60-334; Score=148.0; E_value=2.4e-41; Accession=PF07714.7; Description =Protein tyrosine kinase
  Pfam module annotation: Pfam domain module=Pkinase::Pkinase_Tyr; Domain location=60-334::60-334
TKRTNSKREQQGVIPQENVVTRTPPDVKKQKADDPNQVDTSNIQAQNFTFRELAIATKNFRQECLLGEGGFGRVYKGTIPATGQVVAVKQLDRNGVQGSKEFLVEVLMLSLLNHENLVKLTGYCADGDQRLLVYEFMPGGCLEDRLLERKTDEPALDWYNRMKIASNAAKGLWYLHDMANPSVIYRDLKSANILLDNDHNAKLSDYGLAKLAGKDKTNIVPTRVMGTYGYSAPEYVRTGNLTLKSDVYSFGVVLLELITGRRAIDTTRSHDEQNLVSWAQPIFRDPKRYPDMADPSLKKNFPEKDLNQVVAIAAMCLQEEAAARPLMSDVVTALSFLSTSPPEVVPEAQSAAPENEAGSGKDSDSSSSNEEEENVTAETQVSAKYQESEDASENEYDYYGNENQQKYSPQDIKQTKEFYSKSSRKSSTRSKNGTTSSSYRSSSTSDSENGSNKTSRKSSRKNGSKKSSLSQKSGKKSSLSQKSSSKKSSVRVLSHKKSKDGSHSPNSRRSSSSGGDLLDRSGSRPSEGNVSIGLISSENSDIGAVDDVVVIALKSNFKISSRSSTVALILLKARLQPSNFVGVRDLTLSVRINRRLIRKKVKGVVCVSSDNICGLDLMTDGVTRYDVENVAGCENGFWVDHNPRKLEEVGNWLSLLVPGIVLLDLDNNPIRKCFLVFGGWGGSCGETQDYEHGSVRSKTMTSRSCSSPMANADQKHQNLYGVEFLHPNHVSTNACLGISLQHVSMSSML

SEQ ID NO: 141239 - protein, 97 aa, Glycine max
  Coding DNA Sequence Number=SeqID_24461
MEVQLENSFDPVLLASPSCRTKHLVHSLPCKWIPSMWFNSLAQSETERTWKEAEWEQRMRVMKTGSKQSKVDLMLCFVAPLLLSSLFCSQQRLIRNR

SEQ ID NO: 141240 - protein, 55 aa, Glycine max
  Coding DNA Sequence Number=SeqID_24462
MPCNVEEANCRPVTATTADTLTLQLASNFLLNGLNISKSNTFCQGPLHNTSTKQK

SEQ ID NO: 141241 - protein, 89 aa, Glycine max
  Coding DNA Sequence Number=SeqID_24463
  Gene Ontology: Mol. function=catalytic activity; Cellular component =cytoplasm; Biological process=cellular metabolic process
  Homolog annotation: Hit_ID=Q9SMJ5; Match level="QueryCoverage=66%, HitCoverage=17%, E-value=3e-28, Identity=95%"; Hit description=DTDP -glucose 4-6-dehydratase
VIVADNYFTGSKDNLKRWIGHPRFELIRHDVTEQLLIEVDQIYHLACPASPIFYKYNPVKVGVLRFYFYISVIYHDPVSCLHDLFLAQE

SEQ ID NO: 141242 - protein, 404 aa, Glycine max
  Coding DNA Sequence Number=SeqID_24464
  Gene Ontology: Mol. function=chitin binding; Cellular component =extracellular region; Biological process=chitin metabolic process
  Homolog annotation: Hit_ID=UPI00006A17C9; Match level="QueryCoverage =49%, HitCoverage=100%, E-value=2e-30, Identity=33%"; Hit description= UPI00006A17C9 related cluster
  Subcellular localization annotation: CTP_CleavageSite=34; ConfidenceScore=5.04e-01
RTTRPHLQRATRPRLQRTTRPHLQRTTRRGLHVLAFRGLHVLTFRGLHVLLFRGLHSLTFVGLHALTFRGLHVLAFRGLHALAIRGLHVLAIRGLHVLAFRGLYILTFRGLQALTFRGLQALIFRELHVLLFRGLHALAFVGLHALTFKGLHVLAFRGLHALAFRGLHVLAFRGLHVLDFRGLHALAFIGLHTLAFIGLNICTFRELKGSRPQDTQWTRRSPTRPWGFQLWLWASVSPTWCPSPPARSRHHDIGKYAHRSTDFLCHLLFAGIAPARHLVDPEKSNRVLGFPALITRLGQFYRVPIAPNKVIRPPINRDFIKKYCAPQAGAGRDTTSTWGWPAAGNRRIAATSRAPQLIYKGWSIAYDPWLTNRRPSPKPKVSKSTRSMTDKSSGVQLKTLKKHY

SEQ ID NO: 141243 - protein, 72 aa, Glycine max
  Coding DNA Sequence Number=SeqID_24465
MTEARQKGGRSLPPSSPRRARLLPPEATAFWRKNLEGPTFEEVTKTHGLRKTPPFDFRHIGSTNSISNSSEI

SEQ ID NO: 141244 - protein, 116 aa, Glycine max
  Coding DNA Sequence Number=SeqID_24466
MIDIPLLVADNSADQVDHQILENDEQPTKEYDLLENVDAALRRSTRHPQAPPPPPLTTGGHHELSLPAAEEEHCYQSGILRILLKDSVEKNFPNPSFHSFPENLAFGLTSVNERDL

SEQ ID NO: 141245 - protein, 43 aa, Glycine max
  Coding DNA Sequence Number=SeqID_24467
VVGSREGVAGAEVLGISNEQYIIVVHQYCSTESDVCVKVDPFT

SEQ ID NO: 141246 - protein, 93 aa, Glycine max
  Coding DNA Sequence Number=SeqID_24468
MWEIKEGNRGDRDYSGCDLDGEFSKRVTVADRIGFEDYCQTWSCNGKRFEEEYNARCGLWKGIAENNMDASENSCIYHDFGIIQTRGGLLSHV

SEQ ID NO: 141247 - protein, 77 aa, Glycine max
  Coding DNA Sequence Number=SeqID_24469
MEIGKGKMKEDKEMPNLNVVSSSMSESCRWNELEARSMKAGLSVLECEKKRAENEVEVWNDWNLESFVNFKIYNSHK

SEQ ID NO: 141248 - protein, 126 aa, Glycine max
  Coding DNA Sequence Number=SeqID_24470
MYKDNWTQPWPMGSEIYPEVHENLRAFFSSSSPILLEPLAHGSSDWSLLMEDCIIECRAHREFVSLRKCFKALSNAKNPNYTYKWMIKSQACKNRDMQHALSRNSLMCAKRFKIALSARAQTRPPI

SEQ ID NO: 141249 - protein, 248 aa, Glycine max
  Coding DNA Sequence Number=SeqID_24471
  Gene Ontology: Mol. function=translation initiation factor activity; Cellular component=transcription factor TFIIE complex; Biological process=regulation of transcription, DNA-dependent
  Homolog annotation: Hit_ID=Q8RU47; Match level="QueryCoverage=96%, HitCoverage=84%, E-value=1e-93, Identity=70%"; Hit description =Putative Transcription initiation factor IIE, beta subunit
FKRQPEKSAPASQNGRTSAPIKFSNDTERLQHVNSIRKAPVGAQMKRVIDLLFETRKALTIEQINEACYVDMRANKDVFESMRKNPKVKYDGERFSYKSKHAVRDKNQLLFLVRKFPEGIAVVDLKDSYPNVMEDLQALKAAREIWLLSNFDSQEDIAYPNDPKVPIKVDDDLKQLFRGIELPRDMIDIERDLQKNGMKPATNTAKRRSAAQMEGISSKPKPKKKKNEITKRTKLTNAHLPELFQNLK

SEQ ID NO: 141250 - protein, 474 aa, Glycine max
  Coding DNA Sequence Number=SeqID_24472
  Gene Ontology: Mol. function=transcription factor activity; Cellular component=plastid; Biological process=regulation of transcription, DNA-dependent
  Homolog annotation: Hit_ID=Q9ZNX9; Match level="QueryCoverage=99%, HitCoverage=100%, E-value=1e-134, Identity=53%"; Hit description =Sigma-like factor precursor
  Pfam annotation: Domain name=Sigma70_r2; Domain location=240-313; Score=45.0; E_value=2.6e-10; Accession=PF04542.4; Description=Sigma -70 region 2
  Pfam annotation: Domain name=Sigma70_r3; Domain location=316-398; Score=51.0; E_value=3.8e-12; Accession=PF04539.6; Description=Sigma -70 region 3
  Pfam annotation: Domain name=Sigma70_r4; Domain location=409-462; Score=71.5; E_value=2.7e-18; Accession=PF04545.6; Description=Sigma -70, region 4
  Pfam annotation: Domain name=Sigma70_r4_2; Domain location=403-460; Score=14.6; E_value=0.022; Accession=PF08281.2; Description=Sigma-70, region 4
  Pfam module annotation: Pfam domain module=Sigma70_r2::Sigma70 _r3::Sigma70_r4::Sigma70_r4_2; Domain location=240-313::316-398::409 -462::403-460
  Subcellular localization annotation: CTP_CleavageSite=32; ConfidenceScore=5.09e-01
MGVVTVSGSASRTPLGFNTKFSTHRLKRPLIVAFKGDKHNDSALVATQEKIPVPVETAKKTQKKRIGKSNKLPKRESSPSSMDVDYNEAAAMLENIYKLSPASHTGNAECIDDKIKRVSRRGKKVVDESEEKELKGDRVVRRQNKNKKAKRLTLDQRISLKNNKRGDEVIPTRKKRNFRNRIEKIEELIREYSALLQVKEDLQKELAREPADGELADATNMSITQVKKAIDVGQAARNKLIKHNLRLVLFVINKYFTDFASGPRFQDLCQAGVKGLITAIDRFEPNRRFRLSTYSLFWIRHAIIRSMTLSSFIRVPFGLESVRAEIQKAKTELTFKLQRSPTEEEIIERVHISPERYHDIIKASKSILSLNSRHTTTQEEFINGIVDDDGVNGDNRKQPALLRLALDDVLDSLKPKESLVIRQRFGLDGKGDRTLGEIAGNLNISREMVRKHEVKALMKLNHSARLDYLRRYVV

SEQ ID NO: 141251 - protein, 342 aa, Glycine max
  Coding DNA Sequence Number=SeqID_24473
  Gene Ontology: Mol. function=transcription regulator activity; Cellular component=nucleus; Biological process=regulation of transcription
  Homolog annotation: Hit_ID=Q9FK20; Match level="QueryCoverage=93%, HitCoverage=92%, E-value=3e-64, Identity=49%"; Hit description =Similarity to helix-loop-helix DNA-binding protein
  Pfam annotation: Domain name=HLH; Domain location=105-156; Score =58.3; E_value=2.5e-14; Accession=PF00010.16; Description=Helix-loop -helix DNA-binding domain
MDDSLCDIFDDKEFGSEHFGGDDLFAILESLESDFTDFPPPINEEAVVAAVSKDNNEDVSRLVSQKSTSSSAPLDSETELETSSKTKRQKLTPTTPEEANPDGQQKMSHITVERNRRKQMNEHLTVLRSLMPCFYVKRGDQASIIGGVVDYISELQQVLQALEAKKQRKVYSEVLSPRLVSSPRPSPLSPRKPPLSPRLNLPISPRTPQPGSPYRPRLQAQQGYNNIISPTMSNVSLDPSPTSSANSSINDNINELVANSKSPTADVEVKFSGPHVLLKTVSQRIPGQAMKIITALEDLALEIVHVNINCAADDTMLNSFTIKVVSGSSESSEKKVRVWKEG

SEQ ID NO: 141252 - protein, 118 aa, Glycine max
  Coding DNA Sequence Number=SeqID_24474
MCANTHDVTEDKVEKYARHLRVYDDSFANLKHHSLSLLCGVTVDMQIMQSQYLRRVRRKFLQILIHAYEVAWKILLQKKLVIGTGLCHGLVLTYTCPVCIDFEIFRLLAEVSRYVPLF

SEQ ID NO: 141253 - protein, 217 aa, Glycine max
  Coding DNA Sequence Number=SeqID_24475
  Homolog annotation: Hit_ID=Q6R7N3; Match level="QueryCoverage=23%, HitCoverage=14%, E-value=6e-07, Identity=51%"; Hit description =Putative WRKY transcription factor 30
MSEVHGRNFTLARIKVEGQRRHTTCEKGFPDNNVGRYNGNDAEQVIIIISNGVEEGQSEGLKERPSFACATWPLTQTFLFGTNHFSSTSAFTQHFIYTFVLSFINMDNMGDPKSIIHELLQGLELARQLQVYLHLPTSSQETRDLLIQKIISTFEKALEMVNCKGPVPAGESSHYPLGAALIRVSDSPLSSSPRSEDSDRDFKDQDPNAFKKRYVWF

SEQ ID NO: 141254 - protein, 79 aa, Glycine max
  Coding DNA Sequence Number=SeqID_24476
VVQGRRTQSLCDYEARTLQSLVVCPRVHVRVVSDVRVDHAVTTWRVAPAHGDGASWCDTCRLEEVVQVPVPVCDAEKME

SEQ ID NO: 141255 - protein, 95 aa, Glycine max
  Coding DNA Sequence Number=SeqID_24477
MIDKKPTRKGLNPATRSGNTYRNIPSSRTVMLETEEDPNMTEFECVDEYLEGNKSLLRSLRSMVGIISKRSLKLWGMVKERKVIVEPGVRHRIRL

SEQ ID NO: 141256 - protein, 114 aa, Glycine max
  Coding DNA Sequence Number=SeqID_24478
  Gene Ontology: Mol. function=two-component response regulator activity; Cellular component=nucleus; Biological process=two -component signal transduction system (phosphorelay)
  Homolog annotation: Hit_ID=Q9M8Y4; Match level="QueryCoverage=72%, HitCoverage=59%, E-value=3e-15, Identity=51%"; Hit description=Two -component response regulator ARR22
  Pfam annotation: Domain name=Response_reg; Domain location=9-107; Score=22.3; E_value=6.6e-05; Accession=PF00072.14; Description =Response regulator receiver domain
MTLSFAKSTRSCSSAYLTEAKTVKDGKEAVDLCRSGENFDIIFMDKEMPIMDGHEATKHLSAMGVKSIIVGITTRADGKDKEEFLASGSNHCFEKPLDQAKVEQVLQEHENFGI

SEQ ID NO: 141257 - protein, 425 aa, Glycine max
  Coding DNA Sequence Number=SeqID_24479
  Gene Ontology: Mol. function=DNA binding; Cellular component=nucleus; Biological process=regulation of transcription, DNA-dependent
  Homolog annotation: Hit_ID=Q948S4; Match level="QueryCoverage=46%, HitCoverage=35%, E-value=5e-61, Identity=55%"; Hit description=Myb
  Pfam annotation: Domain name=Myb_DNA-binding; Domain location=146 -191; Score=45.0; E_value=2.6e-10; Accession=PF00249.21; Description =Myb-like DNA-binding domain
  Pfam annotation: Domain name=Myb_DNA-binding; Domain location=51-88; Score=8.5; E_value=0.76; Accession=PF00249.21; Description=Myb-like DNA-binding domain
  Pfam annotation: Domain name=Myb_DNA-binding; Domain location=94-140; Score=54.7; E_value=3.1e-13; Accession=PF00249.21; Description=Myb -like DNA-binding domain
  Pfam module annotation: Pfam domain module=Myb_DNA-binding::Myb_DNA -binding::Myb_DNA-binding; Domain location=146-191::51-88::94-140
MLEVKKELNDFNFDSRLPDGLNLCFSSSPNCNTDTFLQESTPIAGTTKARARRWTEEELTWLPNWSFAAAYLPGRTDVQCLHRWQKVLNPDLVKGSWTKKEDDRLIELVRKYGIKRWFFIAKYLPGRIGKQCRERWHNHLDPTVKKDAWTEEEELILAYYYQIYGSKWAEIARILPGRTDNAIKNHWNCSMKKKLDASPLGCDIKVASSGFCASGIRPEHVVAKVEGQSFNGMVSPKQSHWLNRSVDNILTKLILQNDSGEESCSASSRGTPTPRASRQFLDNSLDCLPLSSTVTDEAYESLKRQKVYFSDTELKVGDESDSPLLNLSYSKSANREKKGQAGNGGNYNSNNTMPHSVDEFSECLSPKTHMALACAYNNGCTPPTSILKNDTGDINPETLLRNLAMTYENVPSIIRKRTPKKGKLL

SEQ ID NO: 141258 - protein, 336 aa, Glycine max
  Coding DNA Sequence Number=SeqID_24480
  Pfam annotation: Domain name=MBD; Domain location=28-124; Score=10.3; E_value=0.0032; Accession=PF01429.10; Description=Methyl-CpG binding domain
MGKPRDEKSEATNTHISSSTIGNSKQAIEKSNEHPEWLPGGWNVWTSENSKKWCKYGSWCYIAPSGHKFYSKPEVLRYLETVNSYSHTSKKEKICKSNVFEDSVDNGHARISETDISPKNKLAENVTGISNDKNSRVNSKKSKNKKELTMPRRLSQRLAGHEPEVLLTEKAIKYATRKFCNDKPATTEILTNGVSGHLHIREESKLVLQASDRLKTLYGESSSKSDKSYDPQTVPNEQLQRLEAENVADDRSDPLFPTPFGDWSHPCLEFEIETLSGALLVDAPTATAAAGILPVMTPDVNAPANKELLDNPNQSQTKKEFSTVCKPSNKFWTSSS

SEQ ID NO: 141259 - protein, 389 aa, Glycine max
  Coding DNA Sequence Number=SeqID_24481
  Homolog annotation: Hit_ID=Q5S2C3; Match level="QueryCoverage=93%, HitCoverage=34%, E-value=1e-162, Identity=69%"; Hit description =Protein PIR
MAVPVEEAIAALSTFSLEDEQPEVQGPGVWVSTERGATESPIEYSDVSAYRLSLSEDTKALNQLNALTQEGKEMASVLYTYRSCVKALPQLAADMQRFSRPERRINGPTISHLWSMLKLLDVLVQLDHLKNAKASIPNDFSWYKRTFTQVSGQWQDTDSMREELDDLQIFLSTRWAILLNLHVEMFRVNKYPSLELDFALLFPERHILLRVLPVLVVLVTSSEKDSESLYKRNEAVIPAFPDLHLSPAAILKELSTYFPKFSSQTRLLTLPAPHELPPPIRAEHDDFVIRFASAMNQLLLLKSTDGSDVEWSKEVKGNMYDMIVEGFQLLSRWTARIWEQCAWKFSRPCKDASPSFSDYEKALIKGLASHGHKGPYTRKGIWELMKEKG

SEQ ID NO: 141260 - protein, 424 aa, Glycine max
  Coding DNA Sequence Number=SeqID_24482
  Gene Ontology: Mol. function=protein binding; Cellular component =microtubule organizing center; Biological process=microtubule cytoskeleton organization and biogenesis
  Homolog annotation: Hit_ID=Q1SAW3; Match level="QueryCoverage=94%, HitCoverage=42%, E-value=0.0, Identity=92%"; Hit description =Cytoplasmic fragile X mental retardation protein interacting protein
MVLAATVATLTDLGFLWFREFYLESSRVIQFPIECSLPWMLVDCVLESPNSGLLESVLMPFDIYNDSAQQALVLLKQRFLYDEIEAEVDHCFDIFVTKLCETIFTYYKSWAASELLDPSFLFASDNAEKYAVQPIRLNMLLKITRVKLLGRMINLRSLITEWMNKVFRENIEFLFGRFECQDLCAIVELEKLLDVLKHSHELLSRDLSVDSFSLMLNEMQENISLVSFSSRLASQIWSEMQSDFLPNFILCNTTQRFIRSSRTVPVQKPSVPSVKPSFYCGTQDLNSAHQSFARLHSGFFGIPHMFSVVRLLGSRSLPWLIRALLDHISNKITLLEPMITGLQDSLPKSIGLLPFDGGVTGCVRLVKEHLNWETKSELKAEVLHGIKEIGSVLYWMGLLDIVLVSNIVQYQFIYCNWHQHKFKT

SEQ ID NO: 141261 - protein, 430 aa, Glycine max
  Coding DNA Sequence Number=SeqID_24483
  Gene Ontology: Mol. function=ubiquitin-protein ligase activity; Cellular component=ubiquitin ligase complex; Biological process =protein ubiquitination
  Homolog annotation: Hit_ID=Q1SAW5; Match level="QueryCoverage=99%, HitCoverage=98%, E-value=1e-166, Identity=70%"; Hit description=U box
  Pfam annotation: Domain name=Arm; Domain location=169-215; Score=2.8; E_value=5.4; Accession=PF00514.13; Description=Armadillobeta-catenin -like repeat
  Pfam annotation: Domain name=Arm; Domain location=216-257; Score =14.1; E_value=0.21; Accession=PF00514.13; Description=Armadillobeta -catenin-like repeat
  Pfam annotation: Domain name=Arm; Domain location=258-298; Score =20.6; E_value=0.0056; Accession=PF00514.13; Description =Armadillobeta-catenin-like repeat
  Pfam annotation: Domain name=Arm; Domain location=338-379; Score =15.7; E_value=0.13; Accession=PF00514.13; Description=Armadillobeta -catenin-like repeat
  Pfam annotation: Domain name=U-box; Domain location=49-121; Score =75.6; E_value=1.6e-19; Accession=PF04564.6; Description=U-box domain
  Pfam module annotation: Pfam domain module=Arm::Arm::Arm::Arm::U-box; Domain location=169-215::216-257::258-298::338-379::49-121
MASELKEKLRELVKAIVDSDDYSLQAADEAIATLSSLKHLKSPDDFPLPPQFRCPISTQLMSDPVILSTGQTYDRPFIQRWLNEGHRTCPQTQQVLSHTILTPNYLVRDMILQWCRDRGIDLPGPVKDIDEAVTNADRNHLNSLLRKLQLSVPDQKEAAKELRLLTKRMPSIRTLVGESSDVIPQLLSPLSSPGAASTDPDLHEDLITTILNLSIHDDNKKVFATDPAVISLLIDALKCGTIQTRSNAAATIFTLSAIDSNKHIIGESGAIKHLLELLDEGQPFAMKDAASAIFNLCLVHENKGRTVRDGAVRVILNKMMDHILVDELLAILALLSSHPKAVEEMGDFDAVPLLLGIIRESTSERSKENCVAILYTICFSDRTKLKEIREEEKANGTLSKLAKCGTSRAKRKANGILERLNRSPSLTHTA

SEQ ID NO: 141262 - protein, 119 aa, Glycine max
  Coding DNA Sequence Number=SeqID_24484
  Gene Ontology: Mol. function=small conjugating protein ligase activity; Cellular component=endoplasmic reticulum; Biological process=protein modification process
  Homolog annotation: Hit_ID=O24560; Match level="QueryCoverage=54%, HitCoverage=38%, E-value=2e-24, Identity=76%"; Hit description =Ubiquitin carrier protein
  Pfam annotation: Domain name=UQ_con; Domain location=34-119; Score =16.0; E_value=2.3e-06; Accession=PF00179.16; Description=Ubiquitin -conjugating enzyme
MGVRKRWECWSTRCLSAHGGERVVGFGEVREKSGRRSERHWWWVIGEDHCEHRKGGFFNAIMSFPSNYPNSPPSVKFTSEIWHPNVYPDGRVCISILHPPGEDPNGYELASERWTPVHT

SEQ ID NO: 141263 - protein, 79 aa, Glycine max
  Coding DNA Sequence Number=SeqID_24485
MRSLPPEAKWLGRNPKCCVLVVVIKIHVAATFTSSPWIQILVHANTSTHRSVSDDTVKPRSRDFRNRRSGVRENEGPTV

SEQ ID NO: 141264 - protein, 87 aa, Glycine max
  Coding DNA Sequence Number=SeqID_24486
  Gene Ontology: Mol. function=hydrolase activity, acting on ester bonds; Biological process=lipid metabolic process
  Homolog annotation: Hit_ID=Q9M8Y5; Match level="QueryCoverage=90%, HitCoverage=21%, E-value=1e-34, Identity=82%"; Hit description =Putative GDSL-motif lipase/acylhydrolase
MVKLVVEHAGFVTSKVACCGQGPYNGLGLCTPASNLCPNRDSYAFWDPFHPTERANRIIVQQILSGTSEYMYPMNLSTIMALDSSKN

SEQ ID NO: 141265 - protein, 94 aa, Glycine max
  Coding DNA Sequence Number=SeqID_24487
  Subcellular localization annotation: CTP_CleavageSite=37; ConfidenceScore=5.14e-01
MTKEVIHDHNFTAPRLQYSSSPSSFAFSLWYLLAQVSCSSPRQVACLGLKLHLSPGELDASQGEFRVRNLHENIILPFLVALFLDLTNNHQNPE

SEQ ID NO: 141266 - protein, 44 aa, Glycine max
  Coding DNA Sequence Number=SeqID_24488
MVFLNHARVVLSLLGVQLEEGWYGELREVVAGGGGGEREEIERP

SEQ ID NO: 141267 - protein, 593 aa, Glycine max
  Coding DNA Sequence Number=SeqID_24489
MDRREKGEKRVEGLMVEKLKGGVVVGKRGGPSTPPPTWRLEFPSQQNENNKNKNRNQVQEFLNFPTSTTLSTRTLCAKLWQIQPHQLAPLPKMNKPSTLRRHRRDTLLKLPNLKQLSEPPHTHQPASAIGLRRHVQTSPFQHHRSAKRNGRLKQHVSPPCYSCSMQVAPHVTSKSSLDFKGWITESSRNPKTFRELLKVLNRIWCLEEQHASNILIVKALKMELDLSRAQVKELQQEKQLNKRDMENLMKQIAEEKLVRKNIEHDKIKAAIQSAMQEIEEERRLRKHSESQHRRLAREFSEVKSSFSGSLRDLEKERKTRVLLENLCDDFAKGIRDYEYEVGSLMDNNAEKDQVKGDSLDRLILHLSEAWLDERKQMKLALAGHDDLPEIDSSIVDRLGVGTETFLHAKRCVNLIKYGNSSTKEPKEIYPCLLHSLDENNNNTAEVHKEKKGRNNSVRKQARVNVMKSMLSCDENESWFVEMGGESTALFNTPGASTVGETTTQGPPESNTLLWTKRMNSSHVVRNSSLSSEGNDKVYPETIFREDSFVHSAVTGNASPLKDNNNTLMAKLLEARLERQISRSKHRNVNGITL

SEQ ID NO: 141268 - protein, 380 aa, Glycine max
  Coding DNA Sequence Number=SeqID_24490
  Gene Ontology: Mol. function=hydrolase activity, acting on ester bonds; Cellular component=cellulose and pectin-containing cell wall; Biological process=lipid metabolic process
  Homolog annotation: Hit_ID=Q4U0W1; Match level="QueryCoverage=97%, HitCoverage=97%, E-value=1e-144, Identity=65%"; Hit description =Lanatoside 15'-O-acetylesterase
  Pfam annotation: Domain name=Lipase_GDSL; Domain location=33-358; Score=341.3; E_value=1.6e-99; Accession=PF00657.12; Description=GDSL- like LipaseAcylhydrolase
MIPKVSADFFVIVTIVLLCLFSLSHSECNFKAIFNFGDSNSDTGGFYAAFPGESGPYGMTYFKKPAGRASDGRLIIDFLAQALGLPFLSPYLQSIGSDYKHGANYATMASTVLMPNTSLFVTGISPFSLAIQLNQMKQFKTKVEEKVEQGIKLPSSDIFGNSLYTFYIGQNDFTFNLAVIGVGGVQEYLPQVVSQIVATIKELYNLGGRTFMVLNLAPVGCYPAFLVEFPHDSSNIDDFGCLISYNNAVLNYNNMLKETLKQTRESLSDASVIYVDTHSVLLELFQHPTSHGLQYGTKACCGYGGGDYNFDPKVSCGNTKEINGSIMPATTCNDPYNYVSWDGIHSTEAANKLITFAILNGSFSDPPFIFQEHCDLQPIG

SEQ ID NO: 141269 - protein, 416 aa, Glycine max
  Coding DNA Sequence Number=SeqID_24491
  Gene Ontology: Mol. function=protein binding; Cellular component =nucleus; Biological process=regulation of transcription, DNA -dependent
  Homolog annotation: Hit_ID=Q5SMS6; Match level="QueryCoverage=89%, HitCoverage=90%, E-value=1e-125, Identity=56%"; Hit description =Fimbriata-like
  Pfam annotation: Domain name=F-box; Domain location=38-85; Score =49.5; E_value=1.1e-11; Accession=PF00646.23; Description=F-box domain
  Pfam annotation: Domain name=Kelch_2; Domain location=282-330; Score =24.6; E_value=0.00035; Accession=PF07646.5; Description=Kelch motif
  Pfam module annotation: Pfam domain module=F-box::Kelch_2; Domain location=38-85::282-330
MAGETSWISHYDDRQRETGAFDSFLELSEEGEKEATAVSLDVLPDDLLERILAYLPIASIFRAGCVSKRWHEIVNSERFVWNLSHVLPQKPWYFMFTSSDEPGGHAFDPLLRKWYSIELPCIGTSNWFIASSYGMVCFMDNDSRSELCICNPITKTYRKLEEPPGLKFSDYSALAISVNRESHRYTVAIVKSKQVPDNYVQWDISIHLYNSENAIWVTSLTEVLMGWRGGNESVICNEMLYFLVYSTGGGQSENRHALVAYNMSNHSSQGSLTRNFIPVPCSLTCGRLMNLKEKLVMVGGIGKPDRPDIIKGIGIWLLNDKKWEEIARMPHKFFQGFGELDDVFASSGADDLIYIQSYGAPALLIFDVNHKQWKCGVNTQVIAYSETIDIAVENCLHRFAKLLSLSNDPSPGYNIH

SEQ ID NO: 141270 - protein, 136 aa, Glycine max
  Coding DNA Sequence Number=SeqID_24492
  Homolog annotation: Hit_ID=Q10NA7; Match level="QueryCoverage=98%, HitCoverage=55%, E-value=2e-19, Identity=37%"; Hit description =Expressed protein
NTIIDERGSFAVSSPYPVPARIALSGDVLPLKEDKAKSLAEKLQEVILSEKKAIKEFTCTVSGVLSSSASSSTSQSDNLQDLLGDNERYTIYRFKTRSCTFVDGLGGTFDVDIEDLETSKADPLASFSAKIVDGIC

SEQ ID NO: 141271 - protein, 99 aa, Glycine max
  Coding DNA Sequence Number=SeqID_24493
MVPSRIFESSKKKEKAKSTNPYKNHGRRTLMATLQPPPENAYPYTTQQQKREMKAGRLTVSGGGGSPDNVGASVSPNSVIFRIGMICTYDVYRNENFTT

SEQ ID NO: 141272 - protein, 279 aa, Glycine max
  Coding DNA Sequence Number=SeqID_24494
  Gene Ontology: Mol. function=hydrolase activity, acting on ester bonds; Biological process=lipid metabolic process
  Homolog annotation: Hit_ID=Q6KAI2; Match level="QueryCoverage=67%, HitCoverage=72%, E-value=1e-42, Identity=75%"; Hit description =Putative anther-specific proline-rich protein
  Pfam annotation: Domain name=Lipase_GDSL; Domain location=39-248; Score=24.0; E_value=1.9e-05; Accession=PF00657.12; Description=GDSL -like LipaseAcylhydrolase
MVENNPARVFGSSMFLCLLVLITWNNIVVVVPQAEARAFFVFGDSLVDNGNNNYLFTTARADSYPYGIDYPTHRATGRFSNGLNIPDIISEKIGSEPTLPYLSRELDGERLLVGANFASAGIGILNDTGIQFWMQRLYELGARRVLVTGTGPLGCVPAELAQRSRNGECAAELQEASALFNPQLVQLVNQLNSEIGSVVFISANAFESNMDFISNPQAYEGQPPTSHSRYAIQYSPNGDMGLQIHAPNESQYRVAFGCNFKDLANYYLLPVRVVAYILH

SEQ ID NO: 141273 - protein, 166 aa, Glycine max
  Coding DNA Sequence Number=SeqID_24495
  Gene Ontology: Cellular component=integral to membrane; Biological process=defense response to bacterium
  Homolog annotation: Hit_ID=Q5JJY5; Match level="QueryCoverage=89%, HitCoverage=60%, E-value=4e-21, Identity=35%"; Hit description =Putative MtN3
  Pfam annotation: Domain name=MtN3_slv; Domain location=7-98; Score =70.1; E_value=7.2e-18; Accession=PF03083.6; Description=MtN3saliva family
MAETIRLGVAVLGNAASVALYAAPMVTFRRVIRKKSTEEFSCFPYIIGLLNCLLFTWYGLPIVSYKWENFPLVTVNGVGILLELSYVLIYFWYASAKGKVKVAMTAIPVLLVFSIIAAVSAFAFHDNHHRKLLVGSIGLGVSVAMYGSPLIVMLLLKGYNILGVKW

SEQ ID NO: 141274 - protein, 51 aa, Glycine max
  Coding DNA Sequence Number=SeqID_24496
MTRARFSSRFSAIDRVTRHKIRELDDAKMGVKMEAPSLIGHSAGLNMCLVI

SEQ ID NO: 141275 - protein, 89 aa, Glycine max
  Coding DNA Sequence Number=SeqID_24497
MAARGGQCLEKLRRFVRTVFFVAALVASLLVTSLPVLVAVVDVLVPCVLISSFSCVKCYGFKEHLRRYAFKSSLTDIPLVSVIRSFIII

SEQ ID NO: 141276 - protein, 498 aa, Glycine max
  Coding DNA Sequence Number=SeqID_24498
  Gene Ontology: Mol. function=catalytic activity
  Homolog annotation: Hit_ID=Q5VQE5; Match level="QueryCoverage=99%, HitCoverage=77%, E-value=1e-149, Identity=55%"; Hit description =Alpha/beta hydrolase-like
  Subcellular localization annotation: CTP_CleavageSite=44; ConfidenceScore=5.20e-01
VYSICDGPALSHGPYLGTVTLSSFVSIVLLSVKACVFTVNSQIEAEATVSPTRQRLHLKKSWGMPVLFLSSVAFALGHIVVAYRTSFRARRKLMFHRVDPEAVLSCKNVFTGYQKVPRSPVPSEGRTPKSDSEMKRRPFGAAHDEELPIRILADPESLFIPCQGLTLHYKLSLPGSPPLNISSAFCSTSSMAGGLSKLNRQLTFIPPKVHQQLYRSYSNQFHGSSLYAPLLDGPVTSPHLTEDIPVLHLDEIHEDEETYKSELEQNSEDIGQVGIVLIHGFGGGVFSWRHVMGPLARQSNCTVAAFDRPGWGLTSRLSQEDWEKKELPNPYKLESQVDLLLSFCSEIGFSSVVLIGHDDGGLLALMAAKRVQTSMNSFNVTVKGVVLLNVSLSREVVPSFARILLHTSLGKKHLVRPLLRTEITHVVNRRSWYDATKLTTEVLTLYKAPLYVEGWDEALHEIGKLSSETFLSAINADLLLQAVKDIPVLVIAGAEDSL

SEQ ID NO: 141277 - protein, 71 aa, Glycine max
  Coding DNA Sequence Number=SeqID_24499
  Subcellular localization annotation: CTP_CleavageSite=42; ConfidenceScore=5.31e-01
MGASSKKGKCTESPPTFIRGKRRKNRKRRGLRTLSAKGSGVVFMHGEGCFSCSYVFLNCDKEIRPTQFFGN

SEQ ID NO: 141278 - protein, 213 aa, Glycine max
  Coding DNA Sequence Number=SeqID_24500
  Gene Ontology: Mol. function=transferase activity, transferring glycosyl groups; Cellular component=periplasmic space; Biological process=carbohydrate biosynthetic process
  Homolog annotation: Hit_ID=Q3KJD9; Match level="QueryCoverage=28%, HitCoverage=10%, E-value=1e-24, Identity=90%"; Hit description =Periplasmic glucan biosynthesis protein, MdoG precursor
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDRQASGDLRPAGFAACHRRLSPDPAPWHRHRGRRQVPDVPARQGQQAGRCPVDLDVPVRREPASSLSIPSTSRGGPVPAFVPFSEG

SEQ ID NO: 141279 - protein, 973 aa, Glycine max
  Coding DNA Sequence Number=SeqID_24501
  Gene Ontology: Mol. function=binding; Cellular component=cytoplasm; Biological process=translation
  Homolog annotation: Hit_ID=Q53K35; Match level="QueryCoverage=99%, HitCoverage=36%, E-value=0.0, Identity=59%"; Hit description=HEAT repeat, putative
  Pfam annotation: Domain name=HEAT; Domain location=490-521; Score =5.6; E_value=8.8; Accession=PF02985.12; Description=HEAT repeat
  Pfam annotation: Domain name=HEAT; Domain location=655-691; Score =2.9; E_value=19; Accession=PF02985.12; Description=HEAT repeat
  Pfam annotation: Domain name=HEAT; Domain location=693-729; Score =0.2; E_value=40; Accession=PF02985.12; Description=HEAT repeat
  Pfam annotation: Domain name=HEAT; Domain location=776-811; Score =12.6; E_value=1.2; Accession=PF02985.12; Description=HEAT repeat
  Pfam annotation: Domain name=HEAT; Domain location=79-117; Score=1.5; E_value=29; Accession=PF02985.12; Description=HEAT repeat
  Pfam annotation: Domain name=HEAT; Domain location=842-879; Score =10.3; E_value=2.4; Accession=PF02985.12; Description=HEAT repeat
  Pfam annotation: Domain name=HEAT; Domain location=884-920; Score =21.4; E_value=0.0032; Accession=PF02985.12; Description=HEAT repeat
  Pfam annotation: Domain name=HEAT; Domain location=922-958; Score =3.3; E_value=17; Accession=PF02985.12; Description=HEAT repeat
  Pfam module annotation: Pfam domain module=HEAT::HEAT::HEAT::HEAT::HEA T::HEAT::HEAT::HEAT; Domain location=490-521::655-691::693-729::776 -811::79-117::842-879::884-920::922-958
DSDISLDPQVPFIPSVEVLVKALLIMSPAALKHAPESFFRIILCSHHPCVVGGAKIDAVWKRLSKCLQTQGFVVIDVISANVGNFLQVLLGPMGLKSANPLEQQAAILSLCNLMSIIPGDTYIEFEKNLLNLPERFAHDTLLENDIQIFLTPEGMLSTEQGVYVAESVTAKNTKQAKGRFRMYDDEDGEDHTRSNHSVRRDQPSREAAGAGKKDTGKAAKKAGNSPKLLFTYDVIVIHLDKGKTAKEEARELLLKEEASVRDRVREIQKNLSLMLRTLGDMAIANSVFAHSRLPSMVKFVEPLMRSPIVSDEAFETMVKLARCTAPPLCDWALDISTALRLIVTDEVHLLLDLVPSVTEEEFNERPHGLFERILDGLSISCKSGALPVLYHVLGVVPAYQASIGPALNELSLGLQPAEVASALYGVYAKDVHVRMACLNAVKCIPAVANRSLPENVEVATSIWIALHDPEKSVAQVAEDIWDHYGFDFGTDFSGLYKALSHINYNVRVAAAEALAAALDEHPDSIQESLSTLFSLYILDMGVGDDNVDAGWLGRQGIALALHAAADILRTKDLPVVMTFLISRALADLNADVRGRMINAGILIIDKNGKDNVSLLFPIFENYLNKTAPDEEKYDLVREGVVIFTGALAKHLAKDDPKVHAVVDKLLDVLNTPSEAVQRAVSACLSPLMQSKQDDAAALFNRLMDQMMKSEKYGERRGAAFGLAGLVKGFGISCLKKYRIVITLQESLAERNSAKSREGALLGFECLCETLGRIFEPYVIQMLPLLLVSFSDQVNAVREAAECAARAMMSQLSAQGVKLVLPSLLKENLCLLPTYRIIIYYASISMNYFIANLFAQGLEDKAWRTKQSSVQLLGAMAYCAPQQLSQCLPKIVPKLTEVLTDTHPKVQSAGQMALQQVGSVIKNPEISALVPTLLKGLSDPNEHTKYSLDILLQTTFVNSIDAPSLALLVPIVHR

SEQ ID NO: 141280 - protein, 214 aa, Glycine max
  Coding DNA Sequence Number=SeqID_24502
MTHEQVQSQSGKEFVFKPFGEDGTDAEYMRQQDLLLLGPPRFLFTIVEESKEDLESDDGKSKCDKSGKGSRGRSLGDLLVVETPYMTPTTSPPFFTPPFTTPISPYNQRGFNPLFETATDAEFNKLKSSPPPKFKFLQEAEEKLRRKLQEDENKGNGDEVDGSFITIVVDKKTEREVNHQPRPPQYHSSTSQLCAKGTGKPRTTLRKVVKKDVM

SEQ ID NO: 141281 - protein, 44 aa, Glycine max
  Coding DNA Sequence Number=SeqID_24503
MEVIFHKQSHMTQQWLDTSSIASGFHYEINSNNNNHIPLGSGEL

SEQ ID NO: 141282 - protein, 377 aa, Glycine max
  Coding DNA Sequence Number=SeqID_24504
  Gene Ontology: Mol. function=catalytic activity; Biological process =trehalose biosynthetic process
  Homolog annotation: Hit_ID=Q9FWQ2; Match level="QueryCoverage=78%, HitCoverage=78%, E-value=4e-87, Identity=53%"; Hit description =Putative trehalose-6-phosphate phosphatase
  Pfam annotation: Domain name=Trehalose_PPase; Domain location=107 -350; Score=260.3; E_value=3.9e-75; Accession=PF02358.7; Description =Trehalose-phosphatase
MKYLFLLLVTFKIMKRKFTQLRESMGFQTSHSTKRIPQPIFKAKEDLIDAHENSLIRRTTLNLTDHTQTNSMFTLSGYDSWVVRHPSALNSFDRLMKAASGKRIIVFLDYDGTLSPIVNDPDRAFMSDEMRAAVYEVATYFPTAIISGRSRDKVKGFVKLNNLYYAGSHGMDIMAPSMAVTSSDGKHFDIARNTNGTEVPFQPAKKFLPAIGEIIRVLKNEVKEIKGAMVEDNGFCLSVHFRQVQEKDYDVLEAKVKSVLENNPEFCLTEGKKVMEIRPSIKWNKGNAVEYFLDTLGLSSCNDILPVYIGDDRTDEDAFKVIQSREQGYPIIVSSIPRETNALYSLRDPSEIVKRVPRKNNFSSFDIKTFMITFQTQ

SEQ ID NO: 141283 - protein, 325 aa, Glycine max
  Coding DNA Sequence Number=SeqID_24505
  Homolog annotation: Hit_ID=Q10Q39; Match level="QueryCoverage=29%, HitCoverage=8%, E-value=9e-09, Identity=34%"; Hit description =Nucleotidyltransferase domain containing protein, expressed
MFGTSSDVFAAKTMNNNALANRGQSPTYSSNEAHDMHHFPGFYSTSEFSHLHSEAPTQNTTSSGYHYDFPVDEAMLMHQEEFGFPNSNEYQQAPVNVNSSDVSFLPPHVLASGYMHENSFGVLHGNWIGQSTIGADLSENTSTESITSRVQALQVGRELPMNVPNSSVPDYTPVHVAPPGSSQRGVDDKKFPPVEGGSSGPSFQVPTMSPFYNLPTETTFADTNYDILNGDFETHYANLQYGRFCKNPKSLPMHLREQLPWHGKPKGAINIVEHAHSPVRVMPSQRASRLHGNTNESAGFWLPRFSDGTGTFFPKPSSSYQQVKI

SEQ ID NO: 141284 - protein, 589 aa, Glycine max
  Coding DNA Sequence Number=SeqID_24506
  Gene Ontology: Cellular component=nucleus; Biological process =regulation of transcription, DNA-dependent
  Homolog annotation: Hit_ID=Q6H972; Match level="QueryCoverage=90%, HitCoverage=58%, E-value=1e-111, Identity=69%"; Hit description =SEU3A protein
MDDEDDGRQRMVHVQNRERWKKNKVGLEDSCGRCLKSAHFSVWVCERGSDSERMVPPGPPTPIGGAQPVPPSLLRSNSGMLGGQGGPVPSQTSFPSLVAQRNQFNNMNMLGNMSNVTSLLNQSFPNGIPNSGHGGPGNSQRSGGIDARAEADPLSGVGSGMNFGNQLQSNLMNPGSSGQGQGQQFSNASGSQMLPDQQHSQQLEPQNFQQHSQPSMQQFSAPLNAQQQQQQHFQSIRGGMGGVGQVKLESQVNNDQFGHQQQLPSRNLAQVKLEPQQLQTLRNMAPVKLEPQHNDQQFLHQQQQQQQQHQQQQQQQLLHMSRQSSQAAAAQMNHLLQQQRLLQYQQHQQQQQQLLKTMPQQRSPLSQQFQQQNMPMRSPVKPAYEPGMCARRLTHYMYQQQHRPEDNNIEFWRKFVAEYFAPNAKKKWCVSMYGSGRQTTGVFPQDVWHCEICNCKPGRGFEATAEVLPRLFKIKYESGTLEELLYVDMPREYHNSSGQIVLDYAKAIQESVFEQLRVVRDGQLRIVFSPDLKICSWEFCARRHEELIPRRLLIPQVSQLGVVAQKYQAFTQNATPNLSVPELQNNCNL

SEQ ID NO: 141285 - protein, 95 aa, Glycine max
  Coding DNA Sequence Number=SeqID_24507
MAKMLFSFAEESSSADARGTFLPRVSTKEELRKNHLPWNYAEELLPPESTEEEMTNKAKGKGKEVAEKGSADKRKGAFDDDKTGGGQKRNKQGPV

SEQ ID NO: 141286 - protein, 122 aa, Glycine max
  Coding DNA Sequence Number=SeqID_24508
  Homolog annotation: Hit_ID=Q1S3D9; Match level="QueryCoverage=52%, HitCoverage=39%, E-value=1e-15, Identity=66%"; Hit description=Early tobacco anther 1
  Subcellular localization annotation: CTP_CleavageSite=63; ConfidenceScore=5.45e-01
MVEPAILSSAESMRGSSCLALCLGLSVRPTSSAPNTTLKNRMATLALGASTRSYGFIATNDTVAAAARTMKRENPIDISLHNAAGWNPLQEALCLRASASCRSSSGSTTVPPRPSGAATCRA

SEQ ID NO: 141287 - protein, 691 aa, Glycine max
  Coding DNA Sequence Number=SeqID_24509
  Gene Ontology: Mol. function=heat shock protein binding; Cellular component=integral to membrane; Biological process=protein folding
  Homolog annotation: Hit_ID=Q94H83; Match level="QueryCoverage=99%, HitCoverage=99%, E-value=1e-174, Identity=44%"; Hit description =Putative heat shock protein
  Pfam annotation: Domain name=DnaJ; Domain location=66-127; Score =102.4; E_value=1.3e-27; Accession=PF00226.21; Description=DnaJ domain
MECNKDEAVRAKEIAERKFSEREYVGAKKFALKAQNLYPELEDITQLLTTIDIYTSAENKVSGEMDWYGILGVSPFADEETVRKQYRKLALTLHPDKNKSLGAEGAFKLVSEAWSLLSDKTKRLEYNQKRSLKGFQHNTPNHVGSQPEAPSSNGYYNLKKNVNSNVRTGNNSGRAPSAPVKKAETFWTICNRCRTHYEYLRVYLNHTLLCPNCNEAFVAVERGPPPNVFKPPNWSSHQRHQNSQHHAGSNNTNFQWGSHSRMAGFGSTDGSTSVAAQAASVVQQASEKVRREGSFHKPMKKRKTDDIRINGYQGYMANHMATRDGAAGLGTFSEPGKVNLETERNYGFSGLPGKHYSTRELSMFEIRNMLMDKSRIEIRKKLQEWKSMAEAKINKDKENKRQKSTFNGKTTGSEKLRETAVNGNRHLDIDSFPVRSDDTVKKNQAYVTITVPDPDFHNFDLDRDENSFAEDQVWAAYDDDDGMPRYYARIHKVISMKPFKMRISWLNSRSNSELGPIDWVGSGFYKTCGDFRTGKHEITESLNSFSHKVRWTKGTRGVVRIFPGKGEVWALYRNWSRDWNEHTPDEVIHKYDMVEVLEDFNEEQGILVTPLVKVAGFRTVFQRHMDRDRERMIPKEEMFQFSHQVPNYLLTGQEADNAPKDCRELDPAATPLDLLQIITEANETSKNALEA

SEQ ID NO: 141288 - protein, 405 aa, Glycine max
  Coding DNA Sequence Number=SeqID_24510
  Gene Ontology: Mol. function=DNA binding
  Homolog annotation: Hit_ID=Q9ZRR7; Match level="QueryCoverage=90%, HitCoverage=94%, E-value=2e-39, Identity=35%"; Hit description=SAP1 protein
  Pfam annotation: Domain name=AT_hook; Domain location=65-77; Score =16.6; E_value=0.031; Accession=PF02178.9; Description=AT hook motif
  Pfam annotation: Domain name=DUF296; Domain location=123-252; Score =107.2; E_value=4.8e-29; Accession=PF03479.5; Description=Domain of unknown function (DUF296)
  Pfam module annotation: Pfam domain module=AT_hook::DUF296; Domain location=65-77::123-252
MEPNDNQLTSFFHHHHQQHQHHQPPPPPQTTASPTNGLLPNADGSHILYPHSVASAVSSQLEPAKRKRGRPRKYGTPEQALAAKKAATTLSHSFSVDKKPHSPTFPSSKKSHSFALGNAGQGFTPHVISVAAGVSIVTPGISWLKFTKLHLLKGSYNGSRREMCILSASGSISNASLRQPATSGGSIAYEGRFEIISLTGSYVRNELGTRTGGLSVCLSNTDGQIIGGGVGGPLKAAGPVQEEGLMVVVDLFVHCPGCEVANRCSKVKGVGEKVVDGEQFSTYAPDSSVIVGTFFIDNKKDTGAGVKGDISASKLPSPVGEPVSSLGFRQSVDSPSGNPIRGNDEHQAMGGSHFMIQQLGLHGTPPRSTDWGHPDSRNTGFELTGRIGHGAHQSPENGGYEQIPD

SEQ ID NO: 141289 - protein, 515 aa, Glycine max
  Coding DNA Sequence Number=SeqID_24511
  Gene Ontology: Mol. function=binding; Cellular component =ribonucleoprotein complex; Biological process=translation
  Homolog annotation: Hit_ID=Q9XIR5; Match level="QueryCoverage=94%, HitCoverage=19%, E-value=1e-151, Identity=54%"; Hit description =Similar to translational activator
  Pfam annotation: Domain name=HEAT; Domain location=174-210; Score =25.0; E_value=0.00027; Accession=PF02985.12; Description=HEAT repeat
  Pfam annotation: Domain name=HEAT; Domain location=19-55; Score=7.9; E_value=4.6; Accession=PF02985.12; Description=HEAT repeat
  Pfam annotation: Domain name=HEAT; Domain location=241-277; Score =0.5; E_value=37; Accession=PF02985.12; Description=HEAT repeat
  Pfam annotation: Domain name=HEAT; Domain location=283-319; Score =18.6; E_value=0.022; Accession=PF02985.12; Description=HEAT repeat
  Pfam annotation: Domain name=HEAT; Domain location=364-400; Score =14.4; E_value=0.42; Accession=PF02985.12; Description=HEAT repeat
  Pfam annotation: Domain name=HEAT; Domain location=408-444; Score =23.0; E_value=0.0011; Accession=PF02985.12; Description=HEAT repeat
  Pfam annotation: Domain name=HEAT; Domain location=449-485; Score =1.1; E_value=31; Accession=PF02985.12; Description=HEAT repeat
  Pfam annotation: Domain name=HEAT; Domain location=58-93; Score=17.1; E_value=0.062; Accession=PF02985.12; Description=HEAT repeat
  Pfam annotation: Domain name=HEAT; Domain location=99-134; Score=9.1; E_value=3.3; Accession=PF02985.12; Description=HEAT repeat
  Pfam annotation: Domain name=HEAT_PBS; Domain location=195-221; Score= 1.0; E_value=74; Accession=PF03130.6; Description=PBS lyase HEAT-like repeat
  Pfam annotation: Domain name=HEAT_PBS; Domain location=226-254; Score= 10.8; E_value=3.1; Accession=PF03130.6; Description=PBS lyase HEAT -like repeat
  Pfam annotation: Domain name=HEAT_PBS; Domain location=429-465; Score= 7.6; E_value=8.9; Accession=PF03130.6; Description=PBS lyase HEAT -like repeat
  Pfam module annotation: Pfam domain module=HEAT::HEAT::HEAT::HEAT::HEA T::HEAT::HEAT::HEAT::HEAT::HEAT_PBS::HEAT_PBS::HEAT_PBS; Domain location=174-210::19-55::241-277::283-319::364-400::408-444::449 -485::58-93::99-134::...
  Pfam module annotation: Domain location=195-221::226-254::429-465
AFNAHALGALAEVAGPGLDFHLCTVLPPLLSAMGDDDKEVQTLAKEASETVVLVIDEEGIEPLMSELVKGVNDSQAAVRRSSSYLIGYFFKNSKLYLVDEAPNMISTLIILLSDSDSSTVTVAWEALSRVIISVPKEVLPSYIKLVRDAVSTSRDKERRKKKGGPILIPGFCLPKALQPILPIFLQGLISGSAELREQAALGLGELIEVTSEQSLKEFVIPITGTVRSSAALALGKLSGLSTRVDPLVSDLLSSLQGSDGGVSEAILTALKGVLKHAGKNVSSAVRTRFYSVLKELIHDDDEIVRTYASSILGILTQYLEDVQLTELIQELSSLANSPSWPPRHGSILTISSLFHYNPATICSSSLFSTIVDCLRDTLKDEKFPLRETSTKALGRLLLYRSQVDPSDTLLYKDVLSLLVSSTHDESSEVRRRALSAIKAVAKANPSAIMSHSTIVGPALAECMKDGNTPVRLAAERCALHAFQLTKVIGVFHDFVQVLEAHDLCLSRSKTEYMDC

SEQ ID NO: 141290 - protein, 394 aa, Glycine max
  Coding DNA Sequence Number=SeqID_24512
  Gene Ontology: Mol. function=two-component sensor activity; Cellular component=membrane; Biological process=signal transduction
  Homolog annotation: Hit_ID=Q8W229; Match level="QueryCoverage=94%, HitCoverage=63%, E-value=1e-148, Identity=71%"; Hit description =Putative ethylene receptor
  Pfam annotation: Domain name=GAF; Domain location=183-334; Score =54.7; E_value=3.1e-13; Accession=PF01590.16; Description=GAF domain
MERGLLLLLFLLLVMVLSVCGNDVEYSQCNCDEEGLWSIHNVLVCQKVSDFFIAIAYFSIPLELLYFVSCSNVPFKLVFLQFIAFIVLCGLTHLLNAYTYYGPHSFQLFLSLTVAKFLTALVSCATAISFPTLIPLLLKIKVRELFLRQNVLELGQEVGMMKKQKEASWHVRMLTCEIRKSLDKHTILYITLVELSKALDLHNCAVWMPDEDRREMHLTHELKPNSTRIFHNSIPISDPDVLDIKKSQGVWILRPDSALGAASSGGGGSGDSGAVAAIRMPILHVSNFKGGTPEFVETSYGVLVLVLPNSDSRAWTSHEMEIVKVVADQVAVALSHASVLEESQLMSQKLAEQNRALQQAQKNAMMARKARSSFEKVMSHGMRRPMHSILGLLS

SEQ ID NO: 141291 - protein, 415 aa, Glycine max
  Coding DNA Sequence Number=SeqID_24513
  Gene Ontology: Mol. function=ubiquitin thiolesterase activity; Cellular component=intracellular; Biological process=ubiquitin -dependent protein catabolic process
  Homolog annotation: Hit_ID=Q6Z1P7; Match level="QueryCoverage=86%, HitCoverage=88%, E-value=1e-120, Identity=55%"; Hit description =Carboxyl-terminal peptidase-like
  Pfam annotation: Domain name=DUF239; Domain location=196-375; Score =330.6; E_value=2.7e-96; Accession=PF03080.5; Description=Arabidopsis proteins of unknown function
MGIVVGCSCSAPPHPSHHLLLLGFFLTLLLQTFEVEPSTFNYTRYRKDSSLRLQRIQRHLDNINKPPVLTIESPDGDLIDCVHKRKQPALDHPLLKNHKIQKAPTKMPRGMKRVEEKEIEIRSAWQMWHKNGTRCPKGTVPIRRSTVHDVLRAKSLFDFGKKQRRFRLTGRSDAPDVVSGNGHEHAIAYTGSSQEVYGAKATINVWEPSIQVVNEFSLSQIWILSGSFDGTDLNSIEAGWQSDSYQATGCYNLLCAGFVQTNGRIAIGAAISPISSYESNQYDITILIWKDPKVGNWWMSFGDGTLVGYWPEGLFTHLATHATMVEWGGEVVNTRANGQHTSTQMGSGHFANDGFGKSSYFRNLEIVDTDNSLSSVHNILTLAENTNCYDIKSSYSNEWGTYFYYGGPGNNPLCP

SEQ ID NO: 141292 - protein, 334 aa, Glycine max
  Coding DNA Sequence Number=SeqID_24514
  Gene Ontology: Mol. function=protein binding; Cellular component =membrane; Biological process=protein transport
  Homolog annotation: Hit_ID=Q9FVV3; Match level="QueryCoverage=90%, HitCoverage=41%, E-value=1e-140, Identity=80%"; Hit description=ARE1- like protein; 78992-73047
  Pfam annotation: Domain name=Vps52; Domain location=1-201; Score= -79.3; E_value=6.5e-10; Accession=PF04129.3; Description=Vps52  Sac2 family
MSSQNWVFKQTLIICSLILSGPFGVIDEHFDSILPNCYDAIGLMLMIQIIHKHQLIMSRRRIPCLDSYLDKVNISLWPRFKLVFDMHLNSLRNANVKTLWEDDVHPHYVMRRYAEFTASLIHLNAECGDGQLDLNLERLRMAVDDLLIKLAKNFPKPKSQTVFLINNYDMTITVLKEAGPEGGKIQMHFEELLKSNTTIFVEELLQEHFNNLIKFVKSKASEDPTSNPDKPITVAEVEPLVKDFASRWKAAIELMHKDVITSFSNFLCGMEILRAALTQLLLYYTRLSDCIKRIVGGSALNKDLVSISSIIWKEERKREKLMTRQGDDDDIKAV

SEQ ID NO: 141293 - protein, 113 aa, Glycine max
  Coding DNA Sequence Number=SeqID_24515
MEWFFQISHPFVMPTEDTAEPRPAPPLPTHDDDFVDPPVAQVPVTSDPPAHFVVGCTTCVRMGRIAEHLERVINLRMVTAWTDLYDIMDLCLRIGRDDNPDDSLRPRQRSRID

SEQ ID NO: 141294 - protein, 192 aa, Glycine max
  Coding DNA Sequence Number=SeqID_24516
  Gene Ontology: Mol. function=DNA binding; Cellular component =mitochondrion
  Homolog annotation: Hit_ID=Q6ET43; Match level="QueryCoverage=86%, HitCoverage=79%, E-value=4e-31, Identity=41%"; Hit description =Putative Chain C, Structure Of The Plant Transcriptional Regulator Pbf-2
  Pfam annotation: Domain name=Whirly; Domain location=56-186; Score =209.0; E_value=1.1e-59; Accession=PF08536.2; Description=Whirly transcription factor
MFTLSRVFPLTSPSRHRLLEVLSSRKVEVGDRLRQEGRDFTYSAAISTATNNYAAKGIALYNIIFVNSTCQSGTVVVDRRGSIMMSFMHSIGERKYDWDKRQKFALSATEVGSLITMDAQDSCDFFHDPSMLSSNAGQVRKSLSIKPHANGYFVSLTVVNNLLNTKDYFSVPVTTAEFAVMKTACTVCLLSA

SEQ ID NO: 141295 - protein, 61 aa, Glycine max
  Coding DNA Sequence Number=SeqID_24517
MPSLIAYNDPQYAMKVNTEFHGKQSYCKLKFKKERTNIEQINSKKWTMYRKSAMQKVATEE

SEQ ID NO: 141296 - protein, 154 aa, Glycine max
  Coding DNA Sequence Number=SeqID_24518
  Gene Ontology: Mol. function=helicase activity
  Homolog annotation: Hit_ID=Q2R1R7; Match level="QueryCoverage=90%, HitCoverage=8%, E-value=3e-28, Identity=50%"; Hit description=AT hook motif-containing protein, putative
MSHHNEIEAHIVSRLGQMLDENNVHAKSFRMTRERLTDSQVHNVRLKLIAGREKDGRTYNVPTVSEVVALIAGDIDANSKRDIIVETQNGQLQRIHKFHCSYQGLQYPLLFPYGEDGYRPDILHRDTLSGKKRKRNCLTMRESITNESIIICIQ

SEQ ID NO: 141297 - protein, 65 aa, Glycine max
  Coding DNA Sequence Number=SeqID_24519
FGLEVDVDKSLPDLVIGDEARTFQINGISSQSDESVSTRNYTGRRHYNNEPKEGLSFSMCKTLVQ

SEQ ID NO: 141298 - protein, 217 aa, Glycine max
  Coding DNA Sequence Number=SeqID_24520
  Subcellular localization annotation: CTP_CleavageSite=50; ConfidenceScore=5.38e-01
MLHDSRIASYAASYTFSPTTTPLHHFFCKQRLFFKHPLLLHFGKANTQTGAAMSSNSSVASSKDTIEVPSFYHKQWVPEYLNFVQFRYDRATYQIRLRQHRQKVFFVEGLKHLRKDLEIFESVTINFFACDDKSTFDLHFTPSLDNQTCGRPRLSSREHVWMLEITQSMLGAPKPLKLLPVAITHLNAYGQHMTILRRFGPPLQWHVVVLDIGFGEC

SEQ ID NO: 141299 - protein, 387 aa, Glycine max
  Coding DNA Sequence Number=SeqID_24521
  Gene Ontology: Mol. function=catalytic activity; Cellular component =nucleus; Biological process=spermidine biosynthetic process
  Homolog annotation: Hit_ID=Q4ADY5; Match level="QueryCoverage=99%, HitCoverage=97%, E-value=1e-166, Identity=75%"; Hit description =Spermine synthase
  Pfam annotation: Domain name=Methyltransf_11; Domain location=172 -280; Score=3.6; E_value=0.024; Accession=PF08241.2; Description =Methyltransferase domain
  Pfam annotation: Domain name=Methyltransf_12; Domain location=172 -278; Score=8.8; E_value=0.07; Accession=PF08242.2; Description =Methyltransferase domain
  Pfam annotation: Domain name=Spermine_synth; Domain location=54-338; Score=386.5; E_value=4e-113; Accession=PF01564.7; Description =Sperminespermidine synthase
  Pfam module annotation: Pfam domain module=Methyltransf _11::Methyltransf_12::Spermine_synth; Domain location=172-280::172 -278::54-338
MEDGAGRGLECQKTMDGKVSNSNGPEKEIPSCCLKAKASIPESEAKFHSTVVSGWFSASQTCSGKSGKAVYFNNPMWPGEAHSIKVEKILYKEKSEYQEVLVFEVWPLHLIMYYNFNVKGIDANPFILQSSTYGKVLVLDGIVQLTEKDECAYQEMIAHLPLCSIQSPKTVLVVGGGDGGVLREVARHSSVEHIDICEIDKMVIDVSRKFFPQLAIGFEDSRVHLHVGDAVEFLKSACEGKYDAIIVDSSDPVGPAQELVEKPFFDTIARALRPGGVLCNMAESMWLHTHLIQDMISICRETFKGSVCYAWASVPTYPSGVIGFLLCATEGPPVDFVNPINPIEKLEGANEHKRELRFYNSEMHSAAFALPAFLKREVSVLRDLSLQ

SEQ ID NO: 141300 - protein, 683 aa, Glycine max
  Coding DNA Sequence Number=SeqID_24522
  Homolog annotation: Hit_ID=Q9SWS3; Match level="QueryCoverage=20%, HitCoverage=30%, E-value=2e-54, Identity=76%"; Hit description =Polygalacturonase PG1
  Pfam annotation: Domain name=Enolase_N; Domain location=514-653; Score=-1.3; E_value=0.066; Accession=PF03952.6; Description=Enolase, N-terminal domain
  Pfam annotation: Domain name=Glyco_hydro_28; Domain location=340-676; Score=-103.4; E_value=0.00051; Accession=PF00295.8; Description =Glycosyl hydrolases family 28
  Pfam module annotation: Pfam domain module=Enolase_N::Glyco_hydro_28; Domain location=514-653::340-676
MGKKRKHSETTHDEAQPQKEDVTSKRPSRTLLGWKDKNEVTDEVEDNSPMFRSKEKVLVTCSRQINYSDFPIKTLFWFYHFRCFCWSFSLGSICKGLLWPFRLLLCFYLCRGAPNRAKILKVILAKEELSPDVDLDAIASMTDGYSGSDLKNLCVTAADRPIKKILGKEKKSIFANFLYRSWLIDIGGFAKKVKITTLSLADQIKDCGAYRECPNCSYHIDNSDVSTEWPGFPLGVKFDPSDVELLEHLAAKCGIGNTQQHMFINEFILTLEGDQGICYTHPENLPGRLINDTKTIPRESHAPQSDIQDQDFPGNAAWLAGELRAEESTKYDGCDNILLCKEILDSSAILNDLGLDSTNLEDIASYATQRARNDNESCGISVLDSLELDTPDFDLFCSNITIRGKGAIDGQGFVWWNNDSPTYNPTKVMLESNGRLPSTKPTALMFYGSDGVAITNITIPNSQQTHLKFDSCTNVQVSGISVSSPGDNPNTDGIHLQNSQNMVIYSSTLACAVKGTWIDGESLNDVRGYIARALMYMAVCYGFQQPRGIPGLRLSDAPNVGRYKEHAAALAEGQPAPALCNSGDVKDLNMEDFKYAHQQGVAYDISVIQICHHEQVRATTGFEELRANAILAMSLAVCKAGAVVLKIPLYKPVEKLSTAEIQLEKRGAERSMGALCFGYYSWQ

SEQ ID NO: 141301 - protein, 68 aa, Glycine max
  Coding DNA Sequence Number=SeqID_24523
  Homolog annotation: Hit_ID=Q1STG1; Match level="QueryCoverage=42%, HitCoverage=32%, E-value=1e-07, Identity=86%"; Hit description =Hypoxia induced protein conserved region
MASSPAFSGCLWLSGISGLIAYNWSRLNMKTGVKIIHPSSCYGKVPVTRKGKRFVKPFKVTKDMDIDR

SEQ ID NO: 141302 - protein, 126 aa, Glycine max
  Coding DNA Sequence Number=SeqID_24524
MKCKTLESYLQIVRLQTLNQTFMSRGKHQPCEEKLKVEGVTSKSKRKTEEKKKIGSRPNPVGAFSARHALSGQGSTGAKRGVKHKGAGSVTRIKRGAHAKRAIQQKHTLSLQHALSARSEHAKRTI

SEQ ID NO: 141303 - protein, 380 aa, Glycine max
  Coding DNA Sequence Number=SeqID_24525
  Gene Ontology: Mol. function=mRNA (guanine-N7-)-methyltransferase activity; Cellular component=nucleus; Biological process=mRNA processing
  Homolog annotation: Hit_ID=Q5HZ60; Match level="QueryCoverage=99%, HitCoverage=97%, E-value=1e-127, Identity=61%"; Hit description=mRNA cap guanine-N7 methyltransferase 2 (EC 2.1.1.56) (mRNA (guanine- N(7)- )-methyltransferase 2)
  Pfam annotation: Domain name=Methyltransf_12; Domain location=29-134; Score=15.6; E_value=0.019; Accession=PF08242.2; Description =Methyltransferase domain
  Pfam annotation: Domain name=Pox_MCEL; Domain location=1-281; Score= -62.7; E_value=3.1e-10; Accession=PF03291.7; Description=mRNA capping enzyme
  Pfam module annotation: Pfam domain module=Methyltransf_12::Pox_MCEL; Domain location=29-134::1-281
MSQSTQQRLYDFAKMALINIFAHPYATVCDLYCGDADADKWVDAQIGHYIGIDAPSSGIEQMREAWEIHRKSYTAEFFELDPCTKNTETHLEEKTNVADVVCCLQHLQLCFETEEKARKLLHNVSSLLKPGGYFLGITPDSSTIWAKYQRNVEAYHNKSSSMKPNIVPNCIRTENYMITFEVEEEKFPLFGKKYQLKFANDVSAETHCLVHFPSFIRLAREAGLEYVEIQNLTEFYDDNRAQLAGLLTHYVPNLLDPRGRLLPRSYDALGLYTTFIFQKPDPEIAPPIATPLLPDVSYNLDEVLLFLFNSITTIPLTCWVNILLKDSVVHHADRRKVTIRPDDEIINGHAVEPAIGLGKISEQKGILGPGPADLRFPEAL

SEQ ID NO: 141304 - protein, 178 aa, Glycine max
  Coding DNA Sequence Number=SeqID_24526
  Gene Ontology: Mol. function=carboxypeptidase activity; Cellular component=membrane; Biological process=electron transport
  Homolog annotation: Hit_ID=Q9SUF1; Match level="QueryCoverage=56%, HitCoverage=26%, E-value=6e-28, Identity=54%"; Hit description =Nodulin-like protein
  Pfam annotation: Domain name=DUF6; Domain location=7-137; Score=13.3; E_value=0.012; Accession=PF00892.11; Description=Integral membrane protein DUF6
MKMKEVACQAKVIGTITITLRKYPTEKSLATRVCFVGALQSSIVAAIAERHHPHAWALGWDTRLFAPAYAGIVTSGVQYYIQGMVIKSMGPVIVTAFNPLRMIIITTLACIVLSEQLYLGSIIGAIVVVLGLYLVVWGKYKECHGRSMPPSPEKDNFLEDQRQLSVTVPKNDTNDNKG

SEQ ID NO: 141305 - protein, 63 aa, Glycine max
  Coding DNA Sequence Number=SeqID_24527
MGAKYLEVVKRGLHPNNGWSPDEIRDHEQLGECYYDLRNKGDQITSRDLKGTRLPPSSASLTS

SEQ ID NO: 141306 - protein, 91 aa, Glycine max
  Coding DNA Sequence Number=SeqID_24528
MGDVDNPPMPMVGHATWISPAIGSCETNVDLFSLFCLHVFTAAMLFPFTLYTATVKALFAFMLDIATSQVPSRLHTARALFAEMIRCSCCL

SEQ ID NO: 141307 - protein, 607 aa, Glycine max
  Coding DNA Sequence Number=SeqID_24529
  Gene Ontology: Mol. function=receptor activity; Cellular component =mitochondrion
  Homolog annotation: Hit_ID=Q2QXR0; Match level="QueryCoverage=93%, HitCoverage=94%, E-value=9e-76, Identity=35%"; Hit description =Expressed protein
  Pfam annotation: Domain name=DUF668; Domain location=438-532; Score =183.4; E_value=5.6e-52; Accession=PF05003.3; Description=Protein of unknown function (DUF668)
MVAESWFRSLWKAPRKHDANSEKVVIEVLAFEIASLMSKLVNLWQSLSDKQIVRFREEITNSVGIKKLVSDDDNFIERLICLEILENMAHVAESVARLAKKCSDPILKGFGNAFYEFITTGSDPYGWEFTGKKMEKKIKRMEKFISTNASLYQEMEVLADLEQTFTRVKANGESDGVTLMEYQKKVAWKRQEVKHLQDISLWNRTYDYTILLLARSLFTTFCKINHVFGLTEMVDVGRTTNSSVLNSDFVYRSQSVSTILQSSFHPSHNNVARFSSGPLNAITARSGPIGRTTNKTSISHSGPLGDSSTKSGPILGKQTTNANFYSGPLGRKFNQSVPVTGRNKKSKIWRFYGHSVAISGKETTTRPSRLTQVGPFKGCMAWDSSIFTDCQSSASGVHYGMQNPKDVNSNPLGPGKVVNHTESVFKPLRKLLNPPSETLGAAALALHYANVIIVIEKLAASSHLIGLDARDDLYNMLPRRVRASLKAKLKPYTKTMAALSSSIYDPSLAEEWNEAMSSILEWLAPLAHNMIRWQSERSYEQQSFVSRTNVLLVQTLYFANQEKTEEVITELLVGLNYVWKYGRELNAKALAECGSFRVDNEYPNLNG

SEQ ID NO: 141308 - protein, 2815 aa, Glycine max
  Coding DNA Sequence Number=SeqID_24530
  Gene Ontology: Mol. function=oxidoreductase activity, acting on the CH-NH2 group of donors, NAD or NADP as acceptor; Cellular component =membrane; Biological process=nitrogen compound metabolic process
  Homolog annotation: Hit_ID=Q93WZ8; Match level="QueryCoverage=75%, HitCoverage=92%, E-value=0.0, Identity=87%"; Hit description=NADH glutamate synthase precursor
  Pfam annotation: Domain name=ADH_zinc_N; Domain location=1730-1865; Score=-16.1; E_value=0.1; Accession=PF00107.16; Description=Zinc -binding dehydrogenase
  Pfam annotation: Domain name=Amino_oxidase; Domain location=1741 -2186; Score=-70.4; E_value=0.043; Accession=PF01593.14; Description =Flavin containing amine oxidoreductase
  Pfam annotation: Domain name=DAO; Domain location=1733-2101; Score= -46.3; E_value=0.0068; Accession=PF01266.14; Description=FAD dependent oxidoreductase
  Pfam annotation: Domain name=GATase_2; Domain location=1-382; Score =416.0; E_value=5.2e-122; Accession=PF00310.11; Description=Glutamine amidotransferases class-II
  Pfam annotation: Domain name=GHMP_kinases_C; Domain location=2699 -2782; Score=30.0; E_value=8.2e-06; Accession=PF08544.3; Description =GHMP kinases C terminal
  Pfam annotation: Domain name=GHMP_kinases_N; Domain location=2479 -2560; Score=32.8; E_value=1.2e-06; Accession=PF00288.16; Description= GHMP kinases N terminal domain
  Pfam annotation: Domain name=GXGXG; Domain location=1286-1482; Score =361.5; E_value=1.4e-105; Accession=PF01493.9; Description=GXGXG motif
  Pfam annotation: Domain name=Glu_syn_central; Domain location=478 -771; Score=645.3; E_value=5.1e-191; Accession=PF04898.4; Description= Glutamate synthase central domain
  Pfam annotation: Domain name=Glu_synthase; Domain location=835-1206; Score=854.1; E_value=6.9e-254; Accession=PF01645.7; Description =Conserved region in glutamate synthase
  Pfam annotation: Domain name=Pyr_redox; Domain location=1733-1828; Score=8.6; E_value=0.003; Accession=PF00070.17; Description=Pyridine nucleotide-disulphide oxidor
  Pfam annotation: Domain name=Pyr_redox_2; Domain location=1733-2064; Score=72.0; E_value=1.9e-18; Accession=PF07992.4; Description =Pyridine nucleotide-disulphide oxidor
  Pfam module annotation: Pfam domain module=ADH_zinc_N::Amino _oxidase::DAO::GATase_2::GHMP_kinases_C::GHMP_kinases_N::GXGXG::Glu _syn_central::Glu_synthase::Pyr_redox::Pyr_redox_2; Domain location =1730-1865::1741-2186::...
  Pfam module annotation: Domain location=1733-2101::1-382::2699 -2782::2479-2560::1286-1482::478-771::835-1206::1733-1828::1733-2064
LPPPGKYAVGMLFLPTSNSRREESKNVFQKVAESLGHSVLGWRSVPTDNTGLGKSAVLTEPVIEQVFLTPSTQSKVDLERQMYILRKLSMVAISSALNLDNDGIIDFYICSLSSRTVVYKGQLTPAQLKDYYFADLGNERFTSYMALVNILSINFSSFSTNSIYSNKQHGEQPVTEEMQGWGMTSEALRISGISTGTVALQYIFIDVLEKKIINALDFPQQFIVCNKNWDRAQPMRVLGHNGEINTLRGNVNWMKAREGLLKCKELGLSENELKKLLPIVDANSSDSGAFDGVLEFLIQSGKSLPEAVMLMIPEAWQNDNNMDPQRKAFYEYFSALMEPWDGPALIAFTDGHYLGATLDRNGLRPGRFYVTHSGRVVMASEVGVVDIPLEDVSQKGRLNPGMMLLVDFEKHIVVNDDALKEQYSLARPYGEWLKKQKLELKDIVDSVHESERVPPSITGVMPASGDDVDMENMGIHGLLAPLKAFGYTVESLEMLLLPMAKDGTEALGSMGNDTPLAIMSNREKLTFEYFKQMFAQVTNPPIDPIREKIVTSTECMVGPEGDLTEITEEQCHRLSLKGPLLSIEEMEAIKKMNYRGWRSKVIDITYSKGRGKKGLEEALDRICAEAHDAISDGYTTLVLSDRAFSRKRVAVSSLLAVGAVHQHLVKTLERTRVALVIESAEPREVHHFCTLVGFGADAICPYLAVEAIWRLQVDGKIPPKANGEFYSKDELVKKYFKASNYGMMKVLAKMGISTLASYKGAQIFEALGLSSEVIERCFAGTPSRVEGATFKMLARDALQLHGLAFPSRVFSPGSAEAKALPNPGDYHWRKGGEIHLNDPLAISKLQEAARTNSIDAYKQYSKLIHELNKACNLRGLLKFKEAAVKVPLDEVEPASEIVKRFCTGAMSYGSISLEAHTALATAMNKIGGKSNTGEGGEQPSRMEPLSDGSKNPKRSAIKQVASGRFGVTSYYLTNADELQIKMAQGAKPGEGGELPGHKVVGDIAVTRNSTPGVGLISPPPHHDIYSIEDLAQLIHDLKNANPAARVSVKLVSEAGVGVVASGVVKGHADHVLISGHDGGTGASRWTGIKNAGLPWELGLAETHQTLVANDLRGRTVLQTDGQIKTGRDVAIATLLGAEEFGFSTAPLITLGCIMMRKCHKNTCPVGIATQDPVLREKFAGEPEHVINFFFMIAEEMREIMSQLGFRTVNEMVGRSDMLEVDKEVIKSNEKLENIDLSLLLRPAAELRPEAAQYCVQKQDHGLDMALDNKLIGLSNAALVKGLPVYIESPIHNVNRAVGTMLSHEVTKKYHLNGLPTDTIHIRFNGSAGQSFGAFLCPGITLELEGDGNDYVGKGLSGGKIVVFPPKGSTFDPKQNIVIGNVALYGATSGEAYFNGMAAERFCVRNSGAKAVVEGVGDHGCEYMTGGIVVVLGNTGRNFAAGMSGGIAYVLDMDGKFLSRCNHELVDLDKVEEEEDITTLRMLIQQHQRHTNSVLAKEVLADFENLVPKFIKVFPKEYKRVLASIKSKEASKDAAESASKHGEEQDEIELVEKDAFEELKKLATASVNGKPIEAESFKRPSQVIDPVKHRGFVAYEREGVQYRDPNARINDWNEVMKETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPARRTGKRVAVVGSGPSGLAAADQLNKMGHTVTVYERADRIGGLMMYGVPNMKADKVDIVQRRVNLMAEEGINFVVNANIGHDPLHSLDRLREENNAIVLAVGATKPRDLPVPGRELSGVHFAMEFLHANTKSLLDSNLQDGNFISAKGKKVVVIGGGDTGTDCIGTSIRHGCSSIVNLELLPQPPQTRAPGNPWPQWPRIYRVDYGHQEGAAKFGKDPRSYEVLTKRFVGDENGVVKGLEVIRVRWEKDETGRFQFKEIEGSEEIIEADLVLLAMGFLGPESVSIHNSFISLCLQNVTIAEKLGIERDNRSNFKAEYGRFSTSLKGVFAAGDCRRGQSLVVWAISEGRQAAAQVDSFLTNEDLEHNVAGSPDELIKKKQQPRDTVAVANKQGKIIKKRSKGARLVHSRKLGMFIGFVMESIEVLEYPKLTLFILLNPHLIALASIETCLDSVCDTHEPVIRFPFRIEGEQENSCGHPGFSVSCSQNGQTLLNLFYCGELRIQRINYAAQQPPPIIHLLQLGVPQSVQSPFNDRVTSLELSGFKSNDTFELDCSRVPSKVAGGDRIWNCTTAMGEVVSSAPGKVLMTGGYLILERPNAGLVLSTNARFYAIVKPIHHEIKPDSWAWAWTDVRLTSPQLSREALYKLALKNLTIQTVSPRLVNNYSSISLDTRNPFVEYAVQYSVAAAYATFDHNKKELLHKLLLHGLDITILGGNDFYSYRNEIERRGLPLTPESLATLPPFSSITFNTDDADGGNCKPEVAKTGLGSSAAMTMAVVAALLHYLDVVKLSSSKDHRERKDVADLDMVHKIAQTAHCIAQGKVGSGFDVSSAVYGSQRYVRFSPEVISSTKVADIAVPLSDGITEIIKGNWDHDTTEFSLPPLMSLLLGEPGTGGSSTPSMVGAVKKWQKSDPQKSLDTWTRLSEANSALEMQLNLLSKLAKEQWNAYKSVIDSCSMLRPDKWIEQASEPNKEAVIKALLGAKEAMLGIRYHMRLMGEAAGVPIEPEPQTQLLDATMNLEGVLLAGVPGAGGFDAVFAVTLGDSSSNVTKVWSSLNVLALLVKEDPCGVCLEKADPRTNGITSAVSSIHIE

SEQ ID NO: 141309 - protein, 58 aa, Glycine max
  Coding DNA Sequence Number=SeqID_24531
MTLDQVRVLFLGYGSSYVIVLGGKHKNKSSLDLNSERTGSYPFPSCLAGLKRLWAGDW

SEQ ID NO: 141310 - protein, 395 aa, Glycine max
  Coding DNA Sequence Number=SeqID_24532
  Gene Ontology: Mol. function=protein serine/threonine kinase activity; Cellular component=mitochondrion; Biological process =protein amino acid phosphorylation
  Homolog annotation: Hit_ID=Q6Z7E0; Match level="QueryCoverage=93%, HitCoverage=68%, E-value=2e-81, Identity=34%"; Hit description =Putative pentatricopeptide (PPR) repeat-containing protein
  Pfam annotation: Domain name=PPR; Domain location=127-161; Score =46.2; E_value=1.1e-10; Accession=PF01535.11; Description=PPR repeat
  Pfam annotation: Domain name=PPR; Domain location=162-196; Score =39.6; E_value=1.1e-08; Accession=PF01535.11; Description=PPR repeat
  Pfam annotation: Domain name=PPR; Domain location=197-231; Score =37.2; E_value=5.5e-08; Accession=PF01535.11; Description=PPR repeat
  Pfam annotation: Domain name=PPR; Domain location=22-56; Score=32.7; E_value=1.3e-06; Accession=PF01535.11; Description=PPR repeat
  Pfam annotation: Domain name=PPR; Domain location=232-266; Score =25.7; E_value=0.00017; Accession=PF01535.11; Description=PPR repeat
  Pfam annotation: Domain name=PPR; Domain location=267-301; Score =36.5; E_value=9.5e-08; Accession=PF01535.11; Description=PPR repeat
  Pfam annotation: Domain name=PPR; Domain location=304-338; Score =38.6; E_value=2.2e-08; Accession=PF01535.11; Description=PPR repeat
  Pfam annotation: Domain name=PPR; Domain location=57-91; Score=38.5; E_value=2.3e-08; Accession=PF01535.11; Description=PPR repeat
  Pfam annotation: Domain name=PPR; Domain location=92-126; Score=37.2; E_value=5.8e-08; Accession=PF01535.11; Description=PPR repeat
  Pfam module annotation: Pfam domain module=PPR::PPR::PPR::PPR::PPR::PP R::PPR::PPR::PPR; Domain location=127-161::162-196::197-231::22 -56::232-266::267-301::304-338::57-91::92-126
MLDSALEFKNQLLKENCKPTVVTYTILIEATLLQGGIDEAMKLLDEMLEINLQPDMFTYNSIIRGMCREGYVDRAFQIISSISSKGYAPDVITYNILLRGLLNQGKWEAGYELMSDMVARGCEANVVTYSVLISSVCRDGKVEEGVGLLKDMKKKGLKPDGYCYDPLIAALCKEGRVDLAIEVLDVMISDGCVPDIVNYNTILACLCKQKRADEALSIFEKLGEVGCSPNASSYNSMFSALWSTGHKVRALGMILEMLDKGVDPDGITYNSLISCLCRDGMVDEAIELLVDMEMESSECKPSVVSYNIVLLGLCKVSRVSDAIEVLAAMVDKGCRPNETTYTFLIEGIGFGGCLNDARDLATTLVNMDAISEHSFERLYKTFCKLDVYRQLNLSD

SEQ ID NO: 141311 - protein, 200 aa, Glycine max
  Coding DNA Sequence Number=SeqID_24533
  Gene Ontology: Mol. function=calcium ion binding; Cellular component =mitochondrion
  Homolog annotation: Hit_ID=Q5QIT3; Match level="QueryCoverage=94%, HitCoverage=34%, E-value=2e-59, Identity=63%"; Hit description =Protein phosphatase 2A beta
MEVISDTASLEVDLLQLPEVSSLALKSNLTFVETLFEQWLSLPESNRLVTSLVNEAKSGAPLNVPGNCSSPNAASNSLPSMFPAGTAPPLSPRSTSGSPRIVKQRVGPSNLGSPLKVVSEPVKEVIPQFYFQFGRPPPNDLKEKCLIRIDHLFHDHMDGLQIHEFKSVTKEVCKLPSFFSTSLFRKIDNGTGVVTSCLDI

SEQ ID NO: 141312 - protein, 118 aa, Glycine max
  Coding DNA Sequence Number=SeqID_24534
MSGEKPLFFILSSTCEEPVDEFGAQNDVGFVALVDEVAEEVEGLVEVAGFAGSGEGFEEMGVFEIEGMGLGLGNGRESAVDVGGFIENWECTGIRMGIGAVGVGVEQGEEIGGNCCCH

SEQ ID NO: 141313 - protein, 72 aa, Glycine max
  Coding DNA Sequence Number=SeqID_24535
MDERLSCYALIARASIDVTIPLLIRVFSERVGHLNQIAKIEMWARGAGEPRIGGIFFLIKENVNLHQFTGGE

SEQ ID NO: 141314 - protein, 395 aa, Glycine max
  Coding DNA Sequence Number=SeqID_24536
  Gene Ontology: Mol. function=protein kinase activity; Cellular component=integral to membrane; Biological process=protein amino acid phosphorylation
  Homolog annotation: Hit_ID=Q7XHW7; Match level="QueryCoverage=93%, HitCoverage=56%, E-value=2e-63, Identity=40%"; Hit description =Putative receptor-like protein kinase
  Pfam annotation: Domain name=LRRNT_2; Domain location=28-66; Score =34.9; E_value=2.8e-07; Accession=PF08263.3; Description=Leucine rich repeat N-terminal domain
  Pfam annotation: Domain name=LRR_1; Domain location=120-142; Score =15.4; E_value=0.21; Accession=PF00560.23; Description=Leucine Rich Repeat
  Pfam annotation: Domain name=LRR_1; Domain location=144-166; Score =17.9; E_value=0.036; Accession=PF00560.23; Description=Leucine Rich Repeat
  Pfam annotation: Domain name=LRR_1; Domain location=168-188; Score =7.2; E_value=13; Accession=PF00560.23; Description=Leucine Rich Repeat
  Pfam annotation: Domain name=LRR_1; Domain location=189-211; Score =12.7; E_value=1.2; Accession=PF00560.23; Description=Leucine Rich Repeat
  Pfam annotation: Domain name=LRR_1; Domain location=71-94; Score=2.2; E_value=1.1e+02; Accession=PF00560.23; Description=Leucine Rich Repeat
  Pfam annotation: Domain name=LRR_1; Domain location=96-118; Score =15.7; E_value=0.17; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=28-66::120-142::144-166::168 -188::189-211::71-94::96-118
MAFHLEIIMLILIFIALAQPSERVNAEPTQDKQALLAFLSQTPHANRVQWNTSSSACDSWFGVQCDSNRSFVTSLHLPAAGLVGPIPPNTISRLTRLRVLSLRSNALVGPIPFDFANLTSLRNLYLQNNHLSGEFPTTLTRLTRLTRLELSSNNFTGPIPFSLNNLTRLTGLFLENNSFSGSLPSITLKLVNFNVSNNRLNGSIPKTLSNFPATSFSGNNDLCGKPLQPCTPFFPAPAPAPSPVEQQQHNSKRLSIAAIVGIAVGSALFILLLLLIMFLCCRRRRRRRRAAKPPQAVAAVARGGPTEGGTSSSKDDITGSVEAAERNKLVFMEGGVYGFGLEDLLRASAEVLGKGSMGTSYKAILEDGTTVVVKRLKDVAAAKREFEARMEVVGN

SEQ ID NO: 141315 - protein, 394 aa, Glycine max
  Coding DNA Sequence Number=SeqID_24537
  Homolog annotation: Hit_ID=Q337K5; Match level="QueryCoverage=90%, HitCoverage=30%, E-value=8e-85, Identity=46%"; Hit description =Expressed protein
AIVGIHGLDVQFAGIKFLDSLVSEFSPSTSSAMGLPREFHEQCRRSLEQDYLKTFYRWTQEAASSVTNRIIESDSAVPEVKVCTAALDHMLQILNWDFRSNTSETKINVNVFSAGVRQDGDSLKRSECHLVQPGSDWHDVLILSSHVGWLLSLYAALRLKFSCEGYWLDCPIAVSARKLVVQFCSLTGAVFLSDDGKMHEQHLLQLLSGIIEWVDPPDAVSKAIENGKSDSEMLDGCRALLAIANVTTPYVFEGLLKSMRPIGTLTFLSMLMSEVIKVLMTSNTEEETWSWEARDVLLDTWTAILTPINTINVNALLPSEGIKAAANLFGFIVECELRLASATAFNDEGDSDYLHASVSVEEVLENKPYIGIWWVRNKLEYKQRGHEFKVPRHF

SEQ ID NO: 141316 - protein, 1181 aa, Glycine max
  Coding DNA Sequence Number=SeqID_24538
  Gene Ontology: Mol. function=translation initiation factor activity
  Homolog annotation: Hit_ID=Q9LV05; Match level="QueryCoverage=98%, HitCoverage=98%, E-value=3e-95, Identity=32%"; Hit description =Arabidopsis thaliana genomic DNA, chromosome 5, P1 clone:MYN8
MPRSSKHKSSKHSSRDAREHSDSERDSGAKDRRSKEESGGGGAKKDSSSAEKRRPDSKDAHGNGEYSDEYASSSKRRKDGGGGGDRWNGGEEGSKKSKTVGDSKSRRRDGSVGVYGEGEEVKRSSGKGDGKHRDSASGRIREGAAEKEKERKFKEGGRSEESVDEQEQRVSKQVFEINGKKTFVDFDLCGSMWLCFFADSKKIDELQGPEPDNQLERRTRKKRDDYSDGDKHQDNAGDGYDRHLSSRDDIAKDGKKKDDRRKEEKHRDKYREEIDRDNKHRHDKQHDERPAKDHTTIRSDDKHAREEKNSLESRQKRTRLPESDRDHNRDRDGDRDLESVRDRERHGERDRDYDIDRDHDYDRDRDWDWDRDHDRDRDRDRDRRRDCDGSHVDDRSGRGKESGTKKRTLDDRDDYSDSKSRAVKSYYPDAEKRSLSTSRAESDVDRGRSQPRQAHADSSGTSNKHRSSPASNTHIGKDDYRNAKAEDSKYRDPSVEQRTKGSREGYSGTSDRGPKYKLMEKPIKIDECPAGDLSTERSSSAKASPGGLMERSPSSTSIERRYVNRSSVKRNLEIDESGRRNSTDVRDFSTSDDRLGWESTLEKPLLDEPSQADSSLYGRTNQSNASLIPPPPGFRATLDRPYMGSLEDDVRDNSNSRYRRSSEPGFGRGHGGNSWRAVPNWNSPVPNGFVPFPPGPAHGGFQTMVPQFTSQSLFGVRPPMEVNHAGIPYHIADADRFPGHLRPLGWQNLMDGTGTAHLHGWDNNNGVFRDDPHMYGGSDWDRNRHSTNSHGWESGSETWKEQNCDSKKELPSPACKDEPDPALVDNGLTDQTSQMSQDEHNREELVEKSPERKLSGLSSPAEVPLNSSSSTVLKKVPDTSMPIDNTSLFSRFYLSKLDISVDLVLPELYDQCMCALNIDKNATGDAVANTELLLKNGSRTRQKYAATFSRHSPFPEIDNSIFQRAIDLYKKHSMNLLNKGEVDDIAVSNQMQVDESFPIPSLENGHVFVSASNGIKDVPMPTLESGKVETTSPAKEQLEEINQTYGQMEEDHNKTGLSRPSSGCANQEAAVAGLQEKEPKITSDKVNSGDAKEDYTLAAKNEAQLAPTLHGEGDNIDSEAKTTGFARCADEKLGFGDTKVNPNPLIVEDGSPKACDALMPGSNESESLILSRIHHSPESTH

SEQ ID NO: 141317 - protein, 548 aa, Glycine max
  Coding DNA Sequence Number=SeqID_24539
  Gene Ontology: Mol. function=nucleic acid binding; Cellular component= intracellular; Biological process=ATP synthesis coupled proton transport
  Homolog annotation: Hit_ID=Q1SPF0; Match level="QueryCoverage=99%, HitCoverage=100%, E-value=0.0, Identity=77%"; Hit description=Zinc finger, U1-type
MSSTVLEVTRAAHEEVERLERLIVKELQNDPASNKERLYQSHRVRNMIDTITSTTEKLIGIYEDSDNARKDEIAALGGQTATGINVFSAFYDRLKEVYDCICVCKWKENLGFNIREYHRKHPVARVVDANDDYETLLNEELQIEFSGEPFLITDSVEFFQEALGRYLDLHELYYQYVNSKFGEPIEYSAYLDVFSDTDKIPRKMKMTRQYREYLANLLEYLLYFFQRTEPLQDLDRILSKVTTEFEESWAVGKVQGWENDNQENGHVLAEHATIDLDYYSTVEELMEVGPERLKEALAALGLKTGGTVQQRAERLFLTKHTPLEKLDKKHFAKGARGVEKNGVAAVSQEDGNSKEIALMEAKMTKLCDLLEETIARTKDNVVKKQALTYEEMEAEREEEETQEDTESEDEEEQIYNPLKLPMGWDGKPIPYWLYKLHGLGQEFKCEICGNYSYWGRRAFERHFKEWRHQHGMRCLGIPNTKNFNEITSIESVLTSVLRAQEAKELWKKIQQRQGVNKWRPDLEEEYEDKEGNIYNKKTYTDLQRQGLI

SEQ ID NO: 141318 - protein, 105 aa, Glycine max
  Coding DNA Sequence Number=SeqID_24540
MEGSGDNGKLCALTEMPSFVWPYVGGVPVRREFRVWFTVLLIRLRSSPIGNRHGVSWWCSRGALTQTLIFGSFIAIEQDHCKKDLFQLHCSLLRSGHLYHKVRPS

SEQ ID NO: 141319 - protein, 227 aa, Glycine max
  Coding DNA Sequence Number=SeqID_24541
  Homolog annotation: Hit_ID=Q47522; Match level="QueryCoverage=33%, HitCoverage=95%, E-value=5e-22, Identity=66%"; Hit description=LacZ protein
VPPVQLLTGWCVTAKAPPDISAGKCSGHAARRVPFAIQAAQLLGRAIGAGLFAITPAGERGMCCKAIKLGNARVFPVTTLNSIQRHNRMLTSIHCDVNRQGIVEETYLGPIRAAEHPEAMGLFKVSDMALLSQWHKQCLRRITVNDTSYYASSLSIPSTSRGGPVPAFVPFSEVGKPVVPAALMNRPTRGERRFAYWALAECILAYYVGTDEGVSEVLHVAGEKRLH

SEQ ID NO: 141320 - protein, 141 aa, Glycine max
  Coding DNA Sequence Number=SeqID_24542
  Gene Ontology: Mol. function=nucleotide binding; Cellular component =intracellular; Biological process=small GTPase mediated signal transduction
  Homolog annotation: Hit_ID=Q8J133; Match level="QueryCoverage=90%, HitCoverage=66%, E-value=9e-44, Identity=66%"; Hit description=Ras -like protein Ras1
  Pfam annotation: Domain name=Miro; Domain location=1-94; Score=3.4; E_ value=0.0026; Accession=PF08477.3; Description=Miro-like protein
  Pfam annotation: Domain name=Ras; Domain location=1-141; Score=144.9; E_value=2.1e-40; Accession=PF00071.12; Description=Ras family
  Pfam module annotation: Pfam domain module=Miro::Ras; Domain location= 1-94::1-141
MTYDPTIEDSYRKQVVIDDQPCILEILDTAGQEEYTALRDQWIRDGEGFLLCFSITSRSTFERLERFKDQIERVKDVDSTRQLVPMIVVGNKADRTHDREVSITEGNNLARHLRCEYIETSAKTTLNVEKYAFVCKLDFYY

SEQ ID NO: 141321 - protein, 69 aa, Glycine max
  Coding DNA Sequence Number=SeqID_24543
MFVMRILKDGGTEVAENGMIHVGEKKLKIDQGESEAEGLNDDEKRRGHCAPKTGQSLAVRIVMMLSIAE

SEQ ID NO: 141322 - protein, 36 aa, Glycine max
  Coding DNA Sequence Number=SeqID_24544
MSAVVPDFDNLDNTHHSDAGSPPSQQIQVINDRKEF

SEQ ID NO: 141323 - protein, 94 aa, Glycine max
  Coding DNA Sequence Number=SeqID_24545
  Subcellular localization annotation: CTP_CleavageSite=49; ConfidenceScore=5.03e-01
IPSLKNSVKADTTETDNGNINSSTNPDSPPLTGNTLHIPVRYASRTLTLDSTEFENSREQHQRVDIETVRRKHANRERGYGPVGGFKSFPSPPQ

SEQ ID NO: 141324 - protein, 210 aa, Glycine max
  Coding DNA Sequence Number=SeqID_24546
  Gene Ontology: Mol. function=zinc ion binding; Cellular component =nucleus; Biological process=chromatin modification
  Homolog annotation: Hit_ID=Q1SWG1; Match level="QueryCoverage=90%, HitCoverage=19%, E-value=3e-69, Identity=68%"; Hit description=PWWP; Nuclear protein SET; SET-related region; Zinc finger, FYVE/PHD- type
MQLHCLEKNGKQTTKMVSYCAYHRAPNPDTVLIMQTPLGVISTKSLLQTKKKTGSRLISSSRKKQDDSPVDNTEHEPFSAARCRIFQRTNHTKKRAADEAVSHRVRGPYHHPLDAIESLNTHRVVHEPQAFSSFRERLYHLQRTENERVCFGRSGIHEWGLFARRNIQEGDMRQIKGNPFKNHHYDICPAREYPFSKLYSSGLSTSINII

SEQ ID NO: 141325 - protein, 34 aa, Glycine max
  Coding DNA Sequence Number=SeqID_24547
VRNKFQHLESQNPRMEAAMGLHNGLVAVDVPGSR

SEQ ID NO: 141326 - protein, 462 aa, Glycine max
  Coding DNA Sequence Number=SeqID_24548
  Gene Ontology: Mol. function=zinc ion binding; Cellular component =nucleus; Biological process=chromatin modification
  Homolog annotation: Hit_ID=Q1SPG2; Match level="QueryCoverage=96%, HitCoverage=42%, E-value=0.0, Identity=79%"; Hit description=PWWP; Nuclear protein SET; Zinc finger, RING-type; Protein kinase C, phorbol ...
  Homolog annotation: Hit description=ester/diacylglycerol binding; SET- related region; Zinc finger, FYVE/PHD-type
  Pfam annotation: Domain name=PHD; Domain location=202-256; Score =30.0; E_value=8.5e-06; Accession=PF00628.19; Description=PHD-finger
  Pfam annotation: Domain name=PHD; Domain location=398-447; Score =38.3; E_value=2.6e-08; Accession=PF00628.19; Description=PHD-finger
  Pfam annotation: Domain name=PWWP; Domain location=7-91; Score=3.2; E_ value=0.008; Accession=PF00855.8; Description=PWWP domain
  Pfam module annotation: Pfam domain module=PHD::PHD::PWWP; Domain location=202-256::398-447::7-91
MRGEVFGGGRGDIVWAKAGRKEPFWPAIVIDPMTQAPELVLRSCIADAACVMFLGYAGNENQRDYAWVKHGMIFPFMDYVDRFQGQSELSYYNPSDFQMAIEEAFLAERGFTEKLIADINTAATNNGYDDSILKAFQEVSGTNQYAGYHFLNQDLFDKKETRPCEACGLSLPYKMLKKTKDSSPGGQFLCKTCARLTKSKHYCGICKKVWNHSDSGSWVRCDGCKVWVHAECDKICSNLFKNLEGTDYYCPTCKAKFDFELSDSEKPQPKVKWSKNNGQLVLPNRVTVLCNGVEGIYFPSLHLTEKQALSEWERHTGSKLRNWRTSIRVKDSMLPLEQWEPSIPMYSVPLMLQLAEFHATAQVPTKPKKPSLKERKHKLLTFLQEKYEPVHAKWTTERCAVCRWVEDWDYNKIIICNRCQIAVHQECYGARNVRDFTSWVCKACERPDIKRECCLCPVKGMM

SEQ ID NO: 141327 - protein, 76 aa, Glycine max
  Coding DNA Sequence Number=SeqID_24549
MNLLTNDDVIMCRVFPTTLKGVEVLVSLSPNLRLELKGRAYYNDYGSKVRMLLEQPIMYVEQQEIGVIVGYLRLNI

SEQ ID NO: 141328 - protein, 68 aa, Glycine max
  Coding DNA Sequence Number=SeqID_24550
MLVVGSPVGKVAGAPVKDGSCGRKRGSKQKGQLECGKRPLEEGRQVESSTEIRKKAVGKVTAARKVTG

SEQ ID NO: 141329 - protein, 151 aa, Glycine max
  Coding DNA Sequence Number=SeqID_24551
  Gene Ontology: Mol. function=heat shock protein binding; Cellular component=integral to membrane; Biological process=protein folding
  Homolog annotation: Hit_ID=Q337K3; Match level="QueryCoverage=76%, HitCoverage=38%, E-value=3e-26, Identity=50%"; Hit description=DnaJ domain containing protein, expressed
LTKSSQNDMRINLAISAVFTAWILVKRSAEYKPLQFLAFAFVYRLFEKLKASESPVTPKYNEEGEDTGEGLRMGKRLLRSLALVFGCVAISSLAYTFILNIIEFAGGFIPTLLYNSQFMWCEGVENQLKYILVYQSPVTNNTAENHPTTKN

SEQ ID NO: 141330 - protein, 358 aa, Glycine max
  Coding DNA Sequence Number=SeqID_24552
  Gene Ontology: Mol. function=pyridoxal phosphate binding; Cellular component=cytosol; Biological process=amino acid metabolic process
  Homolog annotation: Hit_ID=Q2XPX1; Match level="QueryCoverage=99%, HitCoverage=99%, E-value=1e-143, Identity=71%"; Hit description=L -allo-threonine aldolase-related protein
  Pfam annotation: Domain name=Aminotran_1_2; Domain location=3-345; Score=-40.2; E_value=2.3e-05; Accession=PF00155.11; Description =Aminotransferase class I and II
  Pfam annotation: Domain name=Aminotran_5; Domain location=12-341; Score=-190.4; E_value=0.012; Accession=PF00266.9; Description =Aminotransferase class-V
  Pfam annotation: Domain name=Beta_elim_lyase; Domain location=7-296; Score=484.5; E_value=1.3e-142; Accession=PF01212.11; Description =Beta-eliminating lyase
  Pfam annotation: Domain name=DegT_DnrJ_EryC1; Domain location=16-346; Score=-190.4; E_value=0.0073; Accession=PF01041.8; Description =DegTDnrJEryC1StrS aminotransferase family
  Pfam annotation: Domain name=Pyridoxal_deC; Domain location=16-280; Score=-178.0; E_value=0.012; Accession=PF00282.9; Description =Pyridoxal-dependent decarboxylase con
  Pfam module annotation: Pfam domain module=Aminotran_1_2::Aminotran _5::Beta_elim_lyase::DegT_DnrJ_EryC1::Pyridoxal_deC; Domain location =3-345::12-341::7-296::16-346::16-280
MVPRIVDLRSDTVTKPSEAMRAAMASAEVDDDVLGRDPSCFRLETEMAKILGKEGALFVPSGTMANLISVLVHCDIRGSEVILGDNSHIHIYENGGIATLGGVHPTTVRNNEDGTMDIHLIEAAIRDPKGELVYPTTRLICLENTHGNSGGRCLSVEYTDRVGEVAKKHGLKLHIDGARIFNASVALGVPVDRLVQAADSVSVCLSKGLGAPVGSVIVGSNNFITKARRLRKTLGGGMRQVGILCAAALVALQENVGKLQSDHNKAKLLADGLNEIKGLRVDISSVETNIIYVEVEEGSRATAAKLCKDLEDYGILLMPMGSSRLRIVFHHQISASDVQYALSCFQQAVNGVRNENGN

SEQ ID NO: 141331 - protein, 58 aa, Glycine max
  Coding DNA Sequence Number=SeqID_24553
MSLCRTSGRDVNLSRRGLHLRGTGYMDLGSSLMKGGILGKLNCRLAIKKVQKGSGIGR

SEQ ID NO: 141332 - protein, 114 aa, Glycine max
  Coding DNA Sequence Number=SeqID_24554
  Gene Ontology: Mol. function=protein binding; Cellular component =membrane; Biological process=protein transport
  Homolog annotation: Hit_ID=Q8GVS9; Match level="QueryCoverage=99%, HitCoverage=43%, E-value=4e-28, Identity=58%"; Hit description =Putative endosomal Vps protein complex subunit
MEKVMNILKPKPNPQQLLRDWQRRLRQECRNIERQIRDIQREEKNVQKAIREAAKRNDMGSAKAVICYLLRFKGSKDKALAKELVRSRQTVNRLYENKAQMNSISMHLGESVGS

SEQ ID NO: 141333 - protein, 342 aa, Glycine max
  Coding DNA Sequence Number=SeqID_24555
MQKPLKNKQGGSRCHIEETRGLKELLNQLILLEAVNSVREIRLENKVAVHNGIVCLNPKVLTVLGGVVQSLYEEWEMNQKYSGFSRSSLRKLENRDTGGPPQFVKLQVGSSSGIADYNSSRSRKPIAVVGEAEMRPTSTADYNSSRSRKPIAVVGEAGLRPPDFQQDPNQKADANLQSKPPQERAEDKASSSSGTRPKEVVESVPVQNQAAAQKLLQKLNHPSQNDRHHRGWKHRGKGKQEDPVVFTLEEYENRKAQTKPSIKDWDLDISRDEHLARQLQNQLDLEDSRVGRGTYEDKAQDIRMSMFAYERDSDSSHQMGQGGRGRGRGRGKGRGRGRGRHG

SEQ ID NO: 141334 - protein, 183 aa, Glycine max
  Coding DNA Sequence Number=SeqID_24556
  Gene Ontology: Mol. function=heat shock protein binding; Cellular component=integral to membrane; Biological process=protein folding
  Homolog annotation: Hit_ID=Q337K3; Match level="QueryCoverage=63%, HitCoverage=28%, E-value=1e-15, Identity=39%"; Hit description=DnaJ domain containing protein, expressed
  Subcellular localization annotation: CTP_CleavageSite=46; ConfidenceScore=5.32e-01
MALGISNILHCPKLSFSHNNFLPKVPTSISLRFPQTAAWSDRKIICAAASAAGSSNPDGEFNPYEVLGVSPIEKFDMVKAAYAKKKKEAEMNGDEATASRVVCDVIADMKTSFPSFKWVRLIVCNHVWKLKLEKAYDKLMMAQLSNRKKGVTFGSFKVSKEIKYADKLPVIPWGPRFNVAFYD

SEQ ID NO: 141335 - protein, 55 aa, Glycine max
  Coding DNA Sequence Number=SeqID_24557
MVQGKFVPNLGEALGMKSKCLRKEGKYGEGMNKKMKVIQWMNALLEPKLLNPRKP

SEQ ID NO: 141336 - protein, 78 aa, Glycine max
  Coding DNA Sequence Number=SeqID_24558
MAEYDVKSKEKEISAASSSLPRCFFSSSSPPLLPPLKLQIPLPFYPKLQGKAIFGVLEHTSTSWGFKFQKTGREDGES

SEQ ID NO: 141337 - protein, 68 aa, Glycine max
  Coding DNA Sequence Number=SeqID_24559
MEICSTGNRVIAEQEKQSGLSRGDKAIKYLYEEKWEVTTAIIMRKVSCTKPMAVKCEHNGDGGGDGGG

SEQ ID NO: 141338 - protein, 280 aa, Glycine max
  Coding DNA Sequence Number=SeqID_24560
  Gene Ontology: Mol. function=single-stranded DNA binding; Cellular component=nucleus; Biological process=response to DNA damage stimulus
  Homolog annotation: Hit_ID=Q84L33-2; Match level="QueryCoverage=91%, HitCoverage=61%, E-value=1e-64, Identity=54%"; Hit description =Isoform 2 of Q84L33
  Pfam annotation: Domain name=UBA; Domain location=122-164; Score =46.1; E_value=1.2e-10; Accession=PF00627.21; Description=UBATS-N domain
  Pfam annotation: Domain name=ubiquitin; Domain location=1-55; Score =4.5; E_value=0.091; Accession=PF00240.13; Description=Ubiquitin family
  Pfam module annotation: Pfam domain module=UBA::ubiquitin; Domain location=122-164::1-55
MAVKKNIEDVQGKDNYPCGQQLLIHNGKVLKDETTLVENKVSEDGFLVVMLSKSKTSGSAAASSVQPASNPATTVSMSNSTPPSDPPVQTQAANNSTSSTDAPTTKYDTYGLAASNLVAGSNLEQTIQQIMDMGGGNWDRDTVSRALRAAYNNPERAIDYLYSGIPEAAEVAVPVPQTAGMSSGAVPVGPNSSPLNMFPQVKTHDTEWIIKSNSILLFASFSVTFCALHQAETLSQETISSTGAGLGSLDFLRNNPQYVRSVCGSCITCKMHLIFMGIGV

SEQ ID NO: 141339 - protein, 457 aa, Glycine max
  Coding DNA Sequence Number=SeqID_24561
  Homolog annotation: Hit_ID=Q10S15; Match level="QueryCoverage=34%, HitCoverage=38%, E-value=7e-09, Identity=31%"; Hit description =Expressed protein
MRCCFLPCFPTSKRRNQLRSADATPSTDEPQTHGREGAFEPLARQKTDVEELIDCIAESKIKNVEQSIKSVETKEERSREEEAPQICKKEEEDDEISKRSHQEESSESLFSLSISSRNKVSDAEAEVNSPIQLVCTFGSSPSVKEGKPSENNEQQPATKELIKKEGEKGRANDPVTQYRYRDCPDDDGYDDNNLNVSLDATLEDDPSNEKKDWVEGADVNQTWVQEESSESFFSMSANSRIRISSAEAENEVNSQMSAHATSTNSITQGKIPDVSSVLNPSQRTVVKATLKNDKENINLVVKDVNIPISPEPSLKLSNRKARQRFDDKIGVDTSLSSWLVESSETTLNSVNNTSSVGEQTPKGRRGSPWSHEDRPILGALTLEEIRMLSLSASSRRSRSRSPDETPIIGTVGSYWSHTEQSMDLEFNKSGKDVKPKRSSTALQTRLERAFEASAAGV

SEQ ID NO: 141340 - protein, 620 aa, Glycine max
  Coding DNA Sequence Number=SeqID_24562
MEALNERSLARVISHRVLQMGISFPCQICVVGFLCEVCLASFILAALTSFGTLQLDRFSFSTMSMLNLSWNSDLNNNITWSCVLTKSESECLLKLGISKSSLPKSPHLENCKVKTQLYDCLDKRTGNHSFPPWTSWKGLLDTHPAAATTEQIKILRRQAVLESAYPPWIAGSDEENYPLTRKVQRDIWIHQHPLNCNNPNVKFLLADWERLPGFGIGAQIAGMCGLLAIAINERRVLVTNFYNRADHDGCKGMINYCDQYSGTVPFCGSSRSSWNCYFFLETSLECRQRALELMRSEDAWSKGIEAMQETKVALEKIVNVRLSAAAIRGVQFGIKTSLSHDLLATGLGSPRWWRSGGPPRIGVSGDAEDAEVVEGNWAEEEVPWNYLQPTTDINGSLVASHRKLDRRWWRAQAVRYLMRFPTEYTCNLLNEARHAAFGKIAAEMVLESPAEEWPEENRNKSGSGIEEYVWSNHKPWIPRPLLSIHVRMGDKACEMKVVEFEEYMQLADRIRRHFPNLNSIWLSTEMQEVIDKIKEYSGWNFHYTKVRRQGRTNVSMAKYEASLGRESSTNYPLVNFMMAADSDFFVGALGSTWCFLIDGMRNTGGKVMAGYLSVNKDRFW

SEQ ID NO: 141341 - protein, 772 aa, Glycine max
  Coding DNA Sequence Number=SeqID_24563
  Homolog annotation: Hit_ID=Q6KA74; Match level="QueryCoverage=91%, HitCoverage=93%, E-value=0.0, Identity=66%"; Hit description=Ankyrin repeat protein-like
  Pfam annotation: Domain name=Ank; Domain location=93-125; Score=20.5; E_value=0.0059; Accession=PF00023.20; Description=Ankyrin repeat
MEANGITHDSSLGAGRRDKREVGDKTMEDLSKYVHSPAHLAVARRDHAALRHIVSALPRLAKAGEVTTEVESIASELQADEVSTVIDCRDVPGRETPLHLAVRLRDPVSAEILMAAGADWSLQNEHGWSALQEAVCTREEAIAMIIARHYQPLAWAKWCRRLPRIVASASRIRDFYMEISFHFESSVIPFIGRIAPSDTYRIWKRGSNLRADMTLAGFDGLRIQRSDQTFLFLGEGYVAEEGNFTLPPGSLIALSHKEKEITNALEGAGTQPTESEVAHEVSLMSQTNMYRPGIDVTQAELVPHLNWRRQEKTEMVGNWKAKVYDMLHVMVSVKSRRVPGAMTDEELFAVEDGESMMNGENNDEYDDVLTAEERMQLDSALHMGNSDGTYEDEEHGAFDGQENGSAASRENSEANGVVKEKKSWFGWNKKSLKSSSDDPEDSKAVKKNSRFGSEGSNQRSADQPKLASDFLREDSVDSRKGKDKNIKKKKKKGANNNESKNESEYKKGLRPVLWLTPDFPLKTDELLPLLDILANKVKAIRRLRELLTTKLPHGTFPVKYSMLILPVAVFFRDCRWVKSADRQGRDTDGRSKHPRLRPETQVAEVRMEKAKHWGTLDFSSVSAQRAPPKHLLVLMLITSGTQVAIPIVPTIRVLVTFTKFEELQPVEEFSTPLSSPAHFYDAKSKESEGSGSWISWMKGSRGGQSSDSDSHRYKDEVDPFSIPADYKWVDANEKKRRMKAKKAKSKKHKKQTAAKGGDGVQHQRTEDVEEEQ

SEQ ID NO: 141342 - protein, 663 aa, Glycine max
  Coding DNA Sequence Number=SeqID_24564
  Gene Ontology: Mol. function=zinc ion binding; Cellular component =nucleus
  Homolog annotation: Hit_ID=Q9FFP4; Match level="QueryCoverage=96%, HitCoverage=88%, E-value=7e-45, Identity=37%"; Hit description =Arabidopsis thaliana genomic DNA, chromosome 5, P1 clone:MBK5
  Pfam annotation: Domain name=PHD; Domain location=23-76; Score=18.9; E_value=0.00072; Accession=PF00628.19; Description=PHD-finger
  Pfam annotation: Domain name=Plus-3; Domain location=540-639; Score =85.3; E_value=1.9e-22; Accession=PF03126.8; Description=Plus-3 domain
  Pfam annotation: Domain name=SWIB; Domain location=406-478; Score =26.8; E_value=6e-05; Accession=PF02201.9; Description=SWIBMDM2 domain
  Pfam module annotation: Pfam domain module=PHD::Plus-3::SWIB; Domain location=23-76::540-639::406-478
MAKNIEKSIVPKEEEEEESGEEWCFECKDGGQMVVCDHNDCGKVYHPVCVNKDDSFFDIAKYWVCGRHFCFDCNERSKFHCISCPNGVCRKCFAASDFTVVRGVKGLCIDCSELAVIIERNLDHDSEGNKITLDDTETYEYLFKEYWDIIKVKEGLTSGDILAALPNYKKGKQIPHHKQICKGEEEKQTDLMSQVIDEDYKPDEDYKPAKRKRYNSEVKDGLTCDDIFAALPNYKKGKKIVHHKRICKGEEEKKNDLMSWEWDVVEDYKPAKQKGYNSEVKEGLTGDDIFAAQPNYKKGKKILHHNFFCKGEEKKNDLMSWESNINEDYKPSKRKGYYSETKEGLTSDDIFAAQPNYKKGKDFLHNKKYCKGEEEKQNDSMLRHSDEDYKPAKQNLEEFEGWGSKLLISFLASIGKCESEPLTQCDVNSLIHEYIKEKNLHHPEDKGKFLADERLFPIFRKKVMPKSQIYPLLEFHIAKKLDDSSVEKKDEKIENSSTDKHVNDQKTSMGSRLSSLIGKPPLKKGSFFIKHSRFVSITANNINLIYLKRSLVLELSKQPESFVVKAVGTFVRAKVDSNDSRQRKSYHLLRVLGVFFDEISNGTLLQVSFMDKAVPISELSDEDFTEQECEDLQQKVKAGLLPKLSVVEVQEKAEILHEDITKH

SEQ ID NO: 141343 - protein, 59 aa, Glycine max
  Coding DNA Sequence Number=SeqID_24565
  Gene Ontology: Mol. function=zinc ion binding
  Homolog annotation: Hit_ID=Q1SRN3; Match level="QueryCoverage=96%, HitCoverage=23%, E-value=2e-13, Identity=49%"; Hit description=Zinc finger, RING-type; Pex2 / Pex12, N-terminal
MDTSSRISKMRNRERERLRGPQWLKMMEWWYQSAEERMSAPTVYPPPPPPPPPKVKKQI

SEQ ID NO: 141344 - protein, 247 aa, Glycine max
  Coding DNA Sequence Number=SeqID_24566
  Gene Ontology: Mol. function=zinc ion binding; Cellular component =integral to membrane; Biological process=protein transport
  Homolog annotation: Hit_ID=Q1SRN3; Match level="QueryCoverage=87%, HitCoverage=54%, E-value=2e-80, Identity=72%"; Hit description=Zinc finger, RING-type; Pex2 / Pex12, N-terminal
  Pfam annotation: Domain name=Pex2_Pex12; Domain location=1-242; Score= 200.2; E_value=4.9e-57; Accession=PF04757.5; Description=Pex2  Pex12 amino terminal region
MAAAQQLPASLRAALTYSIGVLALRRPFLHKLLDFEDESFALLMLVLESHTLRTTDASFSESLYGLRRRPANIALKNDDATTTTTSSSALRRRQRVLSVVFLVVLPYLKSKLHSIYNREREARLQATLWGDETQGFDDGRGDYSPVSTLTSDAAASISMRIANRVQRIVGFCYPWLHASTEGLQFAYQLLYLLDATGYYSLALHALGIHVCRATGQELCFFFYFFTRAISQLSSLPYIGGSLLVPKV

SEQ ID NO: 141345 - protein, 87 aa, Glycine max
  Coding DNA Sequence Number=SeqID_24567
MLNQSVANSGGSSVCIDHYVETVLRTARLLVDGDCEGCSRHNNIETREEDTEGKFQLWSLTKDWVTKMKKSHSVSVVTEGRSLMWLW

SEQ ID NO: 141346 - protein, 496 aa, Glycine max
  Coding DNA Sequence Number=SeqID_24568
  Gene Ontology: Mol. function=histone-lysine N-methyltransferase activity; Cellular component=nucleus; Biological process=chromatin modification
  Homolog annotation: Hit_ID=Q9FNC7; Match level="QueryCoverage=100%, HitCoverage=77%, E-value=4e-63, Identity=30%"; Hit description =Histone-lysine N-methyltransferase SUVR2 (EC 2.1.1.43) (Suppressor of variegation ...
  Homolog annotation: Hit description=3-9-related protein 2) (Su(var)3 -9-related protein 2)
  Pfam annotation: Domain name=Pre-SET; Domain location=337-485; Score =18.3; E_value=9.7e-06; Accession=PF05033.6; Description=Pre-SET motif
MAPNPRVNKAFSFMKALGISDKDVKPVLIKLFRVYEGNWELIEDDNYHTLVDAYFDFEKHKGVEGERKANDSCHGGEKPKRGPLLVDDDDDDKDLQTMDSSSQMLSAEDNKISPKTFEQKIIEPSQTFMKDIKPKTSSQASHTMLSEVEKISNLPRVAAKDRKSYPENASSAVEKVLVKPRTKKLKMQLASTNHIGLPDASDEKLCLKPLSTQDQDMESKDDVISACDRNTPAYNGNITIASSSRLGEVKISLNCDSALGQPNFSIPNLDIVMKFMDKKYIRSCNTVEPQFSMAKLLDDLCRIYLKLGYRKGSNSKRANLQQYVNQGERNPFRFISDITKGSEKVKISLIDETGSEDLPKFNYIPCNITYQSANVNISLARISDEGCCSDCSGNCLSSPLPCACAQETGGEFAYTPHGLLKEEFLTACVSMKNEPQDHHYVYCQECPLEKSKNEYMPERCKGHMVRKFIKECWRKCGCDMQCGNRIVQRGIACKLQ

SEQ ID NO: 141347 - protein, 181 aa, Glycine max
  Coding DNA Sequence Number=SeqID_24569
  Gene Ontology: Mol. function=protein kinase activity; Biological process=protein amino acid phosphorylation
  Homolog annotation: Hit_ID=Q1SGQ5; Match level="QueryCoverage=83%, HitCoverage=24%, E-value=2e-58, Identity=75%"; Hit description =Protein kinase
NSDDTDEKSKVPVVQQRGRFKVTSENVDPEKVAPPPVLQKSHSVQVFSQHNAASTHPTLPLLPASDATPSNLSGCSVFPVLHSVLQINILQRESILSLMKQITAGDSSADGTCNPAQIAITEKSLLEAAHEREKELLHEITELQWRCDCLVEWMLSSGWLGYSILSSSRTLEKLKCRKKLE

SEQ ID NO: 141348 - protein, 149 aa, Glycine max
  Coding DNA Sequence Number=SeqID_24570
MWCRALAYVSFRGVVHTGDVVACSCIHVSSWSDMYWGHCGMLLHSCHPWSGMYWRRSVVLLHMWHSMSGIVRSGNVITLRVFEMSLQLIMVSLSFLSSSSWHHSIFAMQFLSCWRVPMSGMAVEGGLKLSKGISCLRPDHMLNMGERDR

SEQ ID NO: 141349 - protein, 314 aa, Glycine max
  Coding DNA Sequence Number=SeqID_24571
  Gene Ontology: Mol. function=isomerase activity; Cellular component =cytoplasm; Biological process=carbohydrate metabolic process
  Homolog annotation: Hit_ID=Q1SGQ4; Match level="QueryCoverage=99%, HitCoverage=94%, E-value=1e-144, Identity=79%"; Hit description =Galactose mutarotase-like
  Pfam annotation: Domain name=Aldose_epim; Domain location=18-294; Score=256.6; E_value=5.2e-74; Accession=PF01263.10; Description =Aldose 1-epimerase
MSREMKYVQQCMGVNGLEKIILREVRGFSAEVYLYGAQVTSWKNDLGEELLFVSSKASFKPPKSIRGGIPICFPQFSNHGSLEHHGFARNKFWTLDPNPPPFPTNSTNKAFIDLILKHSEDDKKNWPHRYEFRLRIALGPAGDLMLTSRIRNTNTDGKSFTFTFAYNTYFYVTDISEVRIEGLETLDYLDNLKNKERFTEQGDAITFESEVDKVYLSTPTKIAIIDHERKRTFVLRKDGLPDAVVWNPWDKKAKSISDLGDNEYKHMLCVQAACVEKPITLKPGEEWKGRQEISPVPSSYCSGQLDPRKVLFSY

SEQ ID NO: 141350 - protein, 240 aa, Glycine max
  Coding DNA Sequence Number=SeqID_24572
MTEATRPKTRMEHIEEAIAKLASNQLHVITKLDELIHRIIVLEARRPHSPTHSSSSSVKTFLTHTLIPFLSLTPSLPSPLKPTLSPMLSSLPMPTPPPHPAVMPKHPTRLPTLFPMPVPHLATNSKHQVAHASSFIFNKLGHARVVASLDNLSCIVVHYGREAAPHDKLLEHSDMTLFKRGVVPYGSAMVARECQPAAFALGMAVDPKEPRRYRPWDPGGPRRTRNTLRTRCFRMGIEML

SEQ ID NO: 141351 - protein, 373 aa, Glycine max
  Coding DNA Sequence Number=SeqID_24573
  Homolog annotation: Hit_ID=Q1SSZ2; Match level="QueryCoverage=41%, HitCoverage=35%, E-value=3e-44, Identity=53%"; Hit description=C2 calcium/lipid-binding region, CaLB
  Pfam annotation: Domain name=C2; Domain location=11-95; Score=57.2; E_ value=5.5e-14; Accession=PF00168.20; Description=C2 domain
MSVVAPPYQLLEINVISAQDLAQVSKSVRGYAVAWLHPERKLATQVDQEGHTNPTWNEKFVFRVDDSFLNSDNSVIMIEIYSHAWLRHVLIGTVAVQLTNLLPPNRKPKLRFVALQIRRPSGRPQGILNIGVNLLDSTMRSMPLYSELSSSTVGYWDIMESSKKKKKSEEDDDNTHHHHSPLDSSLLTLQRCQSEKNDSTVNDYAYHGNAKHYGYDGQDSDVGMRKGAVFNEGSLISDVGPSPSVVAAAIAKGLYPMPPPAPRTVESSTMDGWSENSGTEGMKTKIERWRNELTPAYEDYVDERKVLRQTSKRVGRTPRRRGQGGGPCSCFGSVFGVEISITCGGGNRRKGRGGDKGRVTSASSELTYDDSYI

SEQ ID NO: 141352 - protein, 877 aa, Glycine max
  Coding DNA Sequence Number=SeqID_24574
  Gene Ontology: Mol. function=nucleic acid binding; Cellular component= intracellular; Biological process=DNA integration
  Pfam annotation: Domain name=rve; Domain location=93-284; Score=52.9; E_value=1.1e-12; Accession=PF00665.16; Description=Integrase core domain
  Pfam module annotation: Pfam domain module=RVT_2::rve; Domain location=441-668::93-284
MVVTAKGSIRVQINGISHVISDVYYAPELKTNLLSLGQLQEKGLAILIQNGTCKIFYPDRGLIIHTTMKGNRMFYLSASIGPKHPLCLQAEDVSEKETQLWHSRFEHLNYKGLSTLASKQMVLGLPSLKSPKTICTTCLVGKQHRDSIPKQSSWKASTKLQLIHADICGPISPPSHSNKRKDRGGEFTSKEFTELCTNQGISRQLTAAYTPQQKGVAERKNRTIMNVVRAVLHEKQVPKSFWPEAVRWCVHVSFWPEAVRWCVHVQNRSPTSGVDQQTPEEIWSGVKPRVDYFRIFGCVAHTHVPDQKRHKLDDKSLKCVLLGVSDESKAYKLFDPISKKVIGSRDVVFEEDKSWNWHGHAEENKANVLDWEDKETEEDAELVQHELIDGYDSNQDVLEPPSNLESNANQDSPVDALPVEGRVTRTRRQPAWMTDYETNLSTEEESLMAMMIANSDDPHSFEEARYAQRYGVDYMKVLAPVARLDTVRVLLALAAQGAWEVFQLDVKSAILLGELQEEVFVQQPAGFIKKGKEDQIYRLKKALYGLKQAPRAWYSKIETYFAKEQFERCHNEHTLFTKKDHDNILIVSLYVDDLIITGNSRNMCEEFKSSMKLEFDMTDLGKMRRFLGIEVIQSDAGIFICQRRYACEILARFNMTDINPVRNPIVPGTILSKDDEGAAVDAIKFKQAIGSLMYLTVTRPDLMFGVSLISRYMANPKESHWAATKRLLRYLKGTTEYGLFYKRGRKTGLIAYSDSNYAGDLDDRRNTSGSVFIIGIGAVSWASKKQPVHLGSEEKEETEILCDNSSTIQLSKNPVLHGRCKHIAIRFHFLRDLVHDQVVRLRYCSSDEQLADIMIKPLKLDQFERTRCMLGVVKATK

SEQ ID NO: 141353 - protein, 309 aa, Glycine max
  Coding DNA Sequence Number=SeqID_24575
  Gene Ontology: Mol. function=binding; Cellular component =intracellular; Biological process=RNA processing
  Homolog annotation: Hit_ID=Q9FND1; Match level="QueryCoverage=98%, HitCoverage=85%, E-value=4e-47, Identity=45%"; Hit description =Arabidopsis thaliana genomic DNA, chromosome 5, P1 clone:MRH10
  Pfam annotation: Domain name=DUF946; Domain location=4-309; Score =132.6; E_value=1.1e-36; Accession=PF06101.2; Description=Plant protein of unknown function (DUF946)
MSGAGVGFASGIISLGRLEVLKVRKFERVWSCPSSHGKSSGHVFYKPLEIPDDFSCLGHYCQSSDQPLRGHALVARETCSEPEAESPALKKPINYSLIWSADSPHDGCGYFWLPNPPLGHKAMGLVVTNKPDEPEVEEVWNTRACKRGTRGRGVSVGTFFCSTYSNNSGKIADIACLKNLDSTLHAMPNINQVHALINHYGPTAYFHPDEYTCHHQCNGFSRKEHLHIQQTVRRLWEEQSFPHPGSYLQGSSTLGIGAKNEAARSKLTVDSSTRYKVVAAEYLGEGAIAETCWLHESGVLQLCMTHVLK

SEQ ID NO: 141354 - protein, 129 aa, Glycine max
  Coding DNA Sequence Number=SeqID_24576
  Homolog annotation: Hit_ID=Q9LTX0; Match level="QueryCoverage=70%, HitCoverage=38%, E-value=2e-14, Identity=49%"; Hit description =Arabidopsis thaliana genomic DNA, chromosome 3, P1 clone: MBK21
MHRLQRAPQHERKRERKRERQQTLQRNLSDGFGFGEVGYPRAQSELEQAQRRHDAAQRVHVLHHGFQNHARLVREWGEVALHCWAFYLLVLEVWVLARKPDGWKELGGFEDWGFRVVGDEIGYRIRRGF

SEQ ID NO: 141355 - protein, 137 aa, Glycine max
  Coding DNA Sequence Number=SeqID_24577
MDWAFVHKTWDKWASTNIGYSEILDLSIELFDAGSAEQEGMRANPIELSHFVDFIKQNKLQTELFIIGSNQYLITSIHENWFSARCINTSKPAGEGAIVIQTAAYILVAMYEGSIGPASRAMAAADQLTWQLGRKNL

SEQ ID NO: 141356 - protein, 224 aa, Glycine max
  Coding DNA Sequence Number=SeqID_24578
  Gene Ontology: Mol. function=transferase activity, transferring hexosyl groups; Cellular component=soluble fraction; Biological process=carbohydrate biosynthetic process
  Homolog annotation: Hit_ID=Q6K1S5; Match level="QueryCoverage=69%, HitCoverage=27%, E-value=5e-67, Identity=75%"; Hit description =Putative glycogenin 1
  Pfam annotation: Domain name=Glyco_transf_8; Domain location=3-213; Score=9.2; E_value=5e-07; Accession=PF01501.10; Description=Glycosyl transferase family 8
MVFTCKGLVGSFLPRHCADSVLSPLSRRFPDPVNTFLEYDFVPYFPSIWLIGRSGSWASLQLLGCKNQYPQVVYLDADTIVVRNIDDLFKCGKFCANLKHSERLNSGVMVVEPSATLFNDMMSKIKTTASYTGGDQGFLNSYYSGFPNAHVFEPNLSSEVLSSRPIPEMERLSTLYNADVGLYMLANKWMVDENELRVIHYTLGPLKPWDWWTSWLLKPVDVWQ

SEQ ID NO: 141357 - protein, 82 aa, Glycine max
  Coding DNA Sequence Number=SeqID_24579
MTRSPRFSYNSRNLNPIGVFEEKRDETLKVENNISLVQDQVFVCGDVAAVIGAMAKYNTTRKEVARKKPEEMCTLGKSDAWL

SEQ ID NO: 141358 - protein, 324 aa, Glycine max
  Coding DNA Sequence Number=SeqID_24580
  Gene Ontology: Mol. function=nucleic acid binding
  Homolog annotation: Hit_ID=Q1SGN5; Match level="QueryCoverage=81%, HitCoverage=86%, E-value=4e-60, Identity=50%"; Hit description=RNA -binding region RNP-1
  Pfam annotation: Domain name=RRM_1; Domain location=203-270; Score =33.7; E_value=6.3e-07; Accession=PF00076.12; Description=RNA recognition motif. (a.k.a. RRM, R
MAGTGIHPYHQQWAPAAAAPPPPPAAAGGPPPHPGEEVRTIFITGLPEDVKERELQNLLRWLPGFEASQLNFKAEKANGFCSLLRTTPSTRRPKTFFRTCSSIQTPRIGAADAGGAFDQSKRLRTAGDYTHSGYTSPSPFHPPPPPVWGPHGYMAPPPPPPPYDPYAGYPVAPVPMPTPAPIPAPSTYVPVQNTKDNPPCNTLFIGNLGENINEEEVRGLFSVQPGFKQMKILRQERHTVCFIEFEDVNSATNVHHNLQGAVIPSSELFKGNPGSYMLSDLYRISKHDKASFHNGRSITAAAISLQVGTSVDYQVKQPFNYMMP

SEQ ID NO: 141359 - protein, 921 aa, Glycine max
  Coding DNA Sequence Number=SeqID_24581
  Gene Ontology: Mol. function=protein serine/threonine kinase activity; Cellular component=myosin complex; Biological process =protein amino acid phosphorylation
  Homolog annotation: Hit_ID=UPI000034F472; Match level="QueryCoverage =99%, HitCoverage=61%, E-value=0.0, Identity=72%"; Hit description =XIC; motor/ protein binding
  Pfam annotation: Domain name=DIL; Domain location=758-846; Score =130.1; E_value=6.1e-36; Accession=PF01843.9; Description=DIL domain
  Pfam annotation: Domain name=IQ; Domain location=150-170; Score=24.2; E_value=0.00047; Accession=PF00612.17; Description=IQ calmodulin -binding motif
  Pfam annotation: Domain name=IQ; Domain location=173-193; Score=17.1; E_value=0.064; Accession=PF00612.17; Description=IQ calmodulin -binding motif
  Pfam annotation: Domain name=IQ; Domain location=198-218; Score=24.7; E_value=0.00033; Accession=PF00612.17; Description=IQ calmodulin -binding motif
  Pfam annotation: Domain name=IQ; Domain location=221-241; Score=5.6; E_value=10; Accession=PF00612.17; Description=IQ calmodulin-binding motif
  Pfam annotation: Domain name=IQ; Domain location=246-266; Score=22.7; E_value=0.0013; Accession=PF00612.17; Description=IQ calmodulin -binding motif
  Pfam annotation: Domain name=IQ; Domain location=269-289; Score=17.4; E_value=0.051; Accession=PF00612.17; Description=IQ calmodulin -binding motif
  Pfam module annotation: Pfam domain module=DIL::IQ::IQ::IQ::IQ::IQ::IQ ; Domain location=758-846::150-170::173-193::198-218::221-241::246 -266::269-289
GLFPPLPEETSKSSKFSSIGSRFKLQLQQLMEILSSTEPHYIRCVKPNNLLKPAIFENANIIQQLRCGGVLEAIRISCAGYPTRRAFFEFVNRFSLLAPDVTEAHHDEKIVCQKILEKAGLKGYQIGKTKVFLRAGQMAELDAQRAKKLSNAAKTIQRRIRTHQARKHYLELRNKTIYMQSVCRGRLAFKLYQHKRREAAAVKIQKNIRRYEARNTYIKLQASVLTLQTALRAIASLKEFRFRKQTKASIIIQARWRCHKAASYYKKLKKGSIVTQCRWRGRMGRKELRKMKMAARETGALKDAKDKLEKRVEDITWRLQLEKSLRTNLEESKSQEIAKLKNALQEMQNKVDESNALLIKERENAKKAIEEAPPVVKEIQVIVEDTQKIESLTLEVESLKTSLESEKQKADEKYNEAQACSEERGKKLEDTEKKVRQLQESLARLEEKITNLESENQVLRQQALSMAPNKFLSGRSRSIIRRTDSGHLGVEAKTTLDMHSTSMNHRESSEVEDKPQKSLNEKQLENQDLLIKFIPKQIGFAGNRPIAACIIYKCLLHWRSFEVDRTSVFDRIIQTIGHSIETQDNNDVLAYWLSNTSTLVLLLQRTLKASGAAGMAPQRRRSSSGTVFGRMTHSFRGTPAGVNLSLINGSMSGGIDASRQVEAKYPALLFKQQLTAYVEKIYGMIRDNLKKEISPLLGLCIQAPRTSRASFVKGSSRSAATTEAQKALIGHWQEIVKSLGNFLNTLKANHVPPFLVRKVFTQIFSFINVQLFNSLLLRRECCSFSNGEYVKSGLAELENWCNNATDEVIHQKPRKTLNEITHELCPVLSIQQLYRISTMYWDDKYGTHSVSPDVISNMRVLMTEDSNNAVSNSFLLDDDSSIPFSVDDISKSKEPIDISDIEPPPVIRDNTGFSFLLPHPD

SEQ ID NO: 141360 - protein, 342 aa, Glycine max
  Coding DNA Sequence Number=SeqID_24582
  Subcellular localization annotation: CTP_CleavageSite=27; ConfidenceScore=5.26e-01
MAMMAATTLTLTPPRWSWRPTRRSFCRQMHPGLRGLGMYRNGGSNELNVSAWDDKPFEMLPSGNKAYLDEQDVVTFLDPPKDLIPFDPSSYNPAAYLWKKIEDIPQERRHRLLRLLKPRLVSIAWQIAGTRFDDPKLVKKSASTLLSSSTNDGIMLECYNCTSSGGPMSISWINSFRKAIFTGKDGQAYGRIISGSVLTAFADSFAPLYFTVRELKEVMSTEQPCDLAYEFGDGLHDIKELPLGFPRPGDNLNTYNFKHPYPFNDQIVVYVRYLGPGVSVGQAWQEGTKLEQVPRLSVESECISVIMGYLELEGEGHCFWQYGPSAVSALKKGPKIARLWQH

SEQ ID NO: 141361 - protein, 710 aa, Glycine max
  Coding DNA Sequence Number=SeqID_24583
  Gene Ontology: Mol. function=transferase activity; Cellular component= membrane; Biological process=protein metabolic process
  Homolog annotation: Hit_ID=Q9SJA2; Match level="QueryCoverage=96%, HitCoverage=99%, E-value=0.0, Identity=69%"; Hit description =Putative glucosyltransferase
  Pfam annotation: Domain name=Glycos_transf_2; Domain location=250 -425; Score=6.3; E_value=0.00043; Accession=PF00535.16; Description =Glycosyl transferase
MDFSTSSVMAMGCDFNQMGPIPSIDFSKWWVKESSSSRKGNPVVVTMENPNYSVLEIDAPDSAFQPVDKDRGKNAKQFTWLLLLKAHRVVGCLAWLGNSLCSLLHAVKKRLLFGHVEAEMSAKAKFLFRVILTFLVMALAFLSFELVAHFKGWRYFHNHNLHLPQTLEITGCFHTAYVRWLEFRADYIAPPIQSLSTFCILLFLIQSVDRMVLCLGCFWIKLKKIKPVIAGDSLNSHDLEGSNDGYPMVLVQIPMCNEKEVYDQSISAVSQLDWPKERLLIQVLDDSDDEGIQWLIKGEVSKWSQRGVNIIYRHRKFRTGYKAGNLKSAMSCDYVKDYEFVAIFDADFQPNPDFLKQTVPHFKGNPELALVQARWAFVNKAENLLTRLQNINLCFHFEVEQQVNGVFLNFFGFNGTAGVWRIKALEESGGWLERTTVEDMDIAVRAHLNGWKFIFLNDVKVLCELPESYEAYRKQQHRWHSGPMQLFRLCLPAIITSKVIAFWKKTNLIFLFFLLRKLILPFYSFTLFCIILPLTMFVPEAELPIWVICYIPVFMSFLNILPAPKSFPFIVPYLLFENTMSVTKFNAMVSGLFQLGSSYEWIVTKKAGRSSEPDLLAAEERDSKAMSLQLHRGTSDSGLSELNKIKECQETVPVKKMNQIYKKELALAFLLLTAAVRSLLSAQGMHFYYLLFQGVSFLLVGLDLIGEQMN

SEQ ID NO: 141362 - protein, 113 aa, Glycine max
  Coding DNA Sequence Number=SeqID_24584
MLTGTGTRGSRGTTNWGGGDKGGESEQLLNNVAEETVDFVEEGDLRGETHSELPSQLVKRAIQFRALSLELHNEGGSLDKGALRVEPVVEEGECKGIEVKGWRQHLETLHREN

SEQ ID NO: 141363 - protein, 326 aa, Glycine max
  Coding DNA Sequence Number=SeqID_24585
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P27066; Match level="QueryCoverage=99%, HitCoverage=75%, E-value=0.0, Identity=90%"; Hit description =Ribulose bisphosphate carboxylase large chain precursor
  Pfam annotation: Domain name=RuBisCO_large; Domain location=39-313; Score=679.8; E_value=2e-201; Accession=PF00016.10; Description =Ribulose bisphosphate carboxylase large chain, catalytic domain
MFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHVHAGTVVGLGSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 141364 - protein, 295 aa, Glycine max
  Coding DNA Sequence Number=SeqID_24586
  Gene Ontology: Mol. function=catalytic activity; Cellular component =cytosol; Biological process=cellular metabolic process
  Homolog annotation: Hit_ID=Q9SDZ2; Match level="QueryCoverage=98%, HitCoverage=98%, E-value=1e-161, Identity=90%"; Hit description=2' -hydroxy isoflavone/dihydroflavonol reductase homolog
  Pfam annotation: Domain name=3Beta_HSD; Domain location=9-276; Score=- 46.6; E_value=1.4e-09; Accession=PF01073.9; Description=3-beta hydroxysteroid dehydrogenaseisomerase family
  Pfam annotation: Domain name=Epimerase; Domain location=8-254; Score =71.7; E_value=2.3e-18; Accession=PF01370.11; Description=NAD dependent epimerasedehydratase family
  Pfam annotation: Domain name=KR; Domain location=6-149; Score=-88.6; E_value=0.032; Accession=PF08659.1; Description=KR domain
  Pfam annotation: Domain name=NAD_binding_4; Domain location=10-237; Score=1.0; E_value=1e-08; Accession=PF07993.2; Description=Male sterility protein
  Pfam annotation: Domain name=NmrA; Domain location=8-286; Score= -97.1; E_value=0.014; Accession=PF05368.3; Description=NmrA-like family
  Pfam annotation: Domain name=adh_short; Domain location=6-145; Score=- 61.1; E_value=0.059; Accession=PF00106.15; Description=short chain dehydrogenase
  Pfam module annotation: Pfam domain module=3Beta_HSD::Epimerase::KR::N AD_binding_4::NmrA::adh_short; Domain location=9-276::8-254::6 -149::10-237::8-286::6-145
MEESKGRVCVTGGTGFIGSWIIKRLLEDGYSVNTTVRPDPEHRKDVSFLTSLPRASQRLQILSADLSNPESFIASIEGCMGVFHVATPVDFELREPEEVVTKRSIEGALGILKACLNSKTVKRVVYTSSASAVDNNKEEIMDESSWNDVDYLRSSKPFGWSYSVSKTLTEKAVLEFGEQNGLDVVTLIPTLVFGPFICPKLPSSVRNSLDFILGEKGTFGVVLQTDMVHVDDVARAHIFLLEHPNPKGRSLNHIEGTKGSYLSSKKLIDAGFVYKYGLEEMVDDAIQCCKEKGYL

SEQ ID NO: 141365 - protein, 190 aa, Glycine max
  Coding DNA Sequence Number=SeqID_24587
  Gene Ontology: Mol. function=catalytic activity; Biological process =cellular metabolic process
  Homolog annotation: Hit_ID=Q9SDZ2; Match level="QueryCoverage=80%, HitCoverage=74%, E-value=9e-18, Identity=42%"; Hit description=2' -hydroxy isoflavone/dihydroflavonol reductase homolog
MHWTFPCSYPVDFQVKEPEELVTKRCIDGALSILKTWLNSKTVKRVVYTTSVGAVICNGKEDQVMDESFWSDEIYAGDKDPLAFNARIPMVHVEDVVRAHIFLLEHPDPKGSALKQNKGIRVPDLSAKKLIDDGFMFKYGLEEMLDDAVQCCKEKDYHNCDCAVVAETQKTLMLLPKLRPQTVFHNLEYG

SEQ ID NO: 141366 - protein, 357 aa, Glycine max
  Coding DNA Sequence Number=SeqID_24588
  Gene Ontology: Mol. function=nucleic acid binding; Cellular component= intracellular; Biological process=regulation of transcription
  Homolog annotation: Hit_ID=Q9SVY1; Match level="QueryCoverage=97%, HitCoverage=96%, E-value=1e-104, Identity=51%"; Hit description=Zinc finger-like protein
  Pfam annotation: Domain name=zf-C2H2; Domain location=196-218; Score =24.8; E_value=0.00031; Accession=PF00096.16; Description=Zinc finger, C2H2 type
  Pfam annotation: Domain name=zf-C2H2; Domain location=280-302; Score =24.1; E_value=0.0005; Accession=PF00096.16; Description=Zinc finger, C2H2 type
  Pfam annotation: Domain name=zf-C2H2; Domain location=306-331; Score =4.8; E_value=3.2; Accession=PF00096.16; Description=Zinc finger, C2H2 type
  Pfam module annotation: Pfam domain module=zf-C2H2::zf-C2H2::zf-C2H2; Domain location=196-218::280-302::306-331
  Subcellular localization annotation: CTP_CleavageSite=98; ConfidenceScore=5.35e-01
MTDPQSNLFHEWFNFMLLHPHYSSSSQSNYPLANNYSNNNRFGIQLQQGAPSSSSSSSSFYAAPPSSPPLRVALPLINKISLKSSEQHQQNETSSNVLEEKEEDEKKVDNNNKHHESGEDADEETVTVALHIGLPRMDTSSSSDLGPPKVVSTTCMEIGEKGEVNMISEHPLDHRLNKGQYWIPTPSQILIGPTQFPCPVCSKTFNRYNNLQMHMWGHGSQYRKGPDSLKGTQPTAMLRLPCFCCAPGCKHNIDHPRARPLKDFRTLQTHYKRKHGIKPYMCRKCGKAFAVKGDWRTHEKNCGKIWYCLCGSDFKHKRSLKDHIKAFGFGHGSFGIDCLQEEDEAASDIEHDGESSM

SEQ ID NO: 141367 - protein, 786 aa, Glycine max
  Coding DNA Sequence Number=SeqID_24589
  Gene Ontology: Mol. function=nucleoside-triphosphatase activity; Cellular component=membrane; Biological process=cell cycle
  Homolog annotation: Hit_ID=Q10NR0; Match level="QueryCoverage=83%, HitCoverage=45%, E-value=9e-61, Identity=28%"; Hit description=AT hook motif family protein, expressed
  Pfam annotation: Domain name=AAA; Domain location=404-627; Score= -33.6; E_value=0.073; Accession=PF00004.19; Description=ATPase family associated with various cellular activities (AAA)
MDATVTDLSPSCNAAAEPPRRSVRRRLVQSTLFPHKPPEPDQKNDKEDERDEDYSDSENHKKRKKPKAKTTPRKKASKNATPKKNVSANGTNKGSTSRQVLADSDRVIAPVHDLFLEAKLAAEEDSRIFTGRQIHPFFSLWKAGKKVQDVADSGSNLSTTKSEDERTTCGPIHVFENTQDDTSSLDWRNWTFLENTTSMNYGSESLNSSVLEASVESLNFDKLRSSLYPSGTSISQNSLSSDRLCIHPENLEELSPSNSASLAKQTCPPTCEDAKLDLEVDESATTTVQAGIFRKSDTEPPIRFLQESMRSYYCSCVDKAENSLWTYKYKPTKAVEVCGNDESVNFLRDWLHLWHERRYKSRKDISDMDKSDMRDVGDDDDDYKCSYSDYDSEDINEEDSLQNVLLITGPIGSGKSAAVYACAEEQGFEILELNASDCRNGTAVRNYFGDALGSLGFKRSSENTASPQKKTTKFPLALALFSGKAADEVNDGVDELITIPDDEAHIPSGSLQKLLGKNNVVASCDKVQTLILIEDVDILSPEDRGCIAAIQQIAETAKGPIILTSNSDNPGLPDNFDVLHVSFVLPSPKELLCHLYTVCLTEGVNIHPLLLEKFIHSCDGDIRKSIMHLQFWFQGKRFQKDGKAQTHYGSLPFDLELGHQILPKIMPWDFPSEISKLIENEITKSTNKMEETSRGLVTELLHTDEQKNDLNVQCMEADYIEAKKVEMIKRNSSLTDYSELEIQYNAISEFANSSDSPLTSCRQNGRRKLVVMSSDSEDEDSNNGYP

SEQ ID NO: 141368 - protein, 305 aa, Glycine max
  Coding DNA Sequence Number=SeqID_24590
  Gene Ontology: Mol. function=transcription factor activity; Cellular component=nucleus; Biological process=regulation of transcription, DNA-dependent
  Homolog annotation: Hit_ID=Q6Z2N2; Match level="QueryCoverage=95%, HitCoverage=93%, E-value=3e-71, Identity=57%"; Hit description =Putative TFIIH basal transcription factor complex p34 subunit
  Pfam annotation: Domain name=Tfb4; Domain location=12-263; Score =182.0; E_value=1.4e-51; Accession=PF03850.5; Description =Transcription factor Tfb4
MPSAPSKLYADDVSLLVVTLDTNPFFWSTFPFPFAEFLSQVLAFLNTILLLGQLNQVIVIATGCNSCGYVYDSTSDKNHGSTTGTMPALYSNLLHNLDEFLARDRQLDADASHAPGIVPSSLLSGSLSMALCCILLRQYIQRAFRSGPMPPQPRILCLQGAADGPEQYVAIMNAIFSAQHSTVPIDSCYIGSNNSAFLQQASYITGGIYYKPPQLDGLYQYLSTVFATDLHSRAFLRLPKSVGVDFRASNFETRTLINCMYCAGVSAINKQLTWAMCVLYAYPYSVSTMISVQPVENSFFNCMLL

SEQ ID NO: 141369 - protein, 152 aa, Glycine max
  Coding DNA Sequence Number=SeqID_24591
MACTKKTDQMTSEATKEIDDKIASQGSFVAHRRQDVLTAAIERLEHPGCVRAVGASGSQGLALPPESEVSPSAARVSTKESSVDPLGNDPDTGDLEKCGLYVEENPPRLVALGRLCEGLKTVHNIPFCNDQIKVGVEEVRDADAPIPVPTQE

SEQ ID NO: 141370 - protein, 116 aa, Glycine max
  Coding DNA Sequence Number=SeqID_24592
  Gene Ontology: Mol. function=motor activity; Cellular component =myosin complex; Biological process=auditory receptor cell differentiation
  Homolog annotation: Hit_ID=Q67VX5; Match level="QueryCoverage=99%, HitCoverage=9%, E-value=8e-50, Identity=69%"; Hit description =Putative myosin heavy chain PCR43
MGTPVNIIAGSHVWVQDPQVVAKLSNIYPKDTEAPPGGVDDMTKLSYLHEPGVLQNLKTRYELNEIYTYTGNILIAINPFQRLPHIYDLHMMQQYKGAPFGELSPHVFAVPDVAYR

SEQ ID NO: 141371 - protein, 346 aa, Glycine max
  Coding DNA Sequence Number=SeqID_24593
  Gene Ontology: Mol. function=enzyme inhibitor activity; Cellular component=cell wall; Biological process=cell wall modification
  Homolog annotation: Hit_ID=Q1SPH1; Match level="QueryCoverage=99%, HitCoverage=61%, E-value=3e-84, Identity=57%"; Hit description =Pectinesterase; Pectinesterase inhibitor
  Pfam annotation: Domain name=PMEI; Domain location=64-215; Score =150.8; E_value=3.7e-42; Accession=PF04043.6; Description=Plant invertasepectin methylesterase inhibitor
  Pfam annotation: Domain name=Pectinesterase; Domain location=266-346; Score=-240.8; E_value=0.0022; Accession=PF01095.10; Description =Pectinesterase
  Pfam module annotation: Pfam domain module=PMEI::Pectinesterase; Domain location=64-215::266-346
  Subcellular localization annotation: CTP_CleavageSite=94; ConfidenceScore=5.50e-01
MEYGRLGPSDPGGSSRLNPPRSSGRKNIVFLSLFAVLLIAASAVTAVAVRSRTKNTGGDGTSLGKFTQAISRTCSKTRFKMLCMKSLLDFPGSQGASEKDLVHISFNVTLQHFSKALYSSATISYTAMDPRVRAAYHDCLELLDDSVDALARSLNTVSVGAVGSANDDVLTWLSAALTNQDTCAEGFADAAGTVKDQMANNLKDLSELVSNCLAIFSGAGAGDDFAGVPIQNRRRLMAMREDNFPTWLNGRDRRLLSLPLSQIQADIVVSKDGNGTVKTIAEAIKKVPEYSSRRIIIYIRAGRGQFKVGEEENKCDVHRGREGQNRHHGRKKLLPEPDHISHRFLR

SEQ ID NO: 141372 - protein, 60 aa, Glycine max
  Coding DNA Sequence Number=SeqID_24594
MGAKDMLQNLTGKDSSSGANATTNRVEGKVQHQVPSHPQYATAIEDTINVLVLFQETNLF

SEQ ID NO: 141373 - protein, 88 aa, Glycine max
  Coding DNA Sequence Number=SeqID_24595
MELGMGRTEGAKRMVGAFFTLPSHMVKFRRLAGGPILIITLHSRHQENPHESIQKAYLAKEEERMRTYNAGAAWDCGKSKAKEGWKEK

SEQ ID NO: 141374 - protein, 208 aa, Glycine max
  Coding DNA Sequence Number=SeqID_24596
  Gene Ontology: Mol. function=oxidoreductase activity; Cellular component=intracellular; Biological process=auxin mediated signaling pathway
  Homolog annotation: Hit_ID=Q338B1; Match level="QueryCoverage=81%, HitCoverage=56%, E-value=3e-56, Identity=58%"; Hit description=Auxin- induced protein PCNT115, putative, expressed
  Pfam annotation: Domain name=Aldo_ket_red; Domain location=47-208; Score=-67.0; E_value=2.2e-05; Accession=PF00248.11; Description =Aldoketo reductase family
MKLFKSQGLLLIGSCKDNKIPASTQLNLLVMDAANKLSVHIPRVKLGTQGLEVSKLGFGSMSFSGVYNGPLPNEDGISLANANQALKHLPREKVQLATKFGLGGLNFPIIQVKVTPEYVRSCCEASLKRLDVEYIDLYYQHRVDQTVPIEETVGELKKLVEEGKVKYIGLSEASPDTIRRAHAVYPITALQIEWSLWTRDIEDQIIPL

SEQ ID NO: 141375 - protein, 152 aa, Glycine max
  Coding DNA Sequence Number=SeqID_24597
  Gene Ontology: Mol. function=oxidoreductase activity; Cellular component=intracellular; Biological process=auxin mediated signaling pathway
  Homolog annotation: Hit_ID=Q338B1; Match level="QueryCoverage=75%, HitCoverage=56%, E-value=2e-31, Identity=45%"; Hit description=Auxin- induced protein PCNT115, putative, expressed
MVQFPRQRQRIFSRKSPNHFLRRERERSILFSESYNNVEIPRAKLGTQGLEGVSLSDPIDQALKQLPRAKVQLATKFGISRMDFPNVQVKGTPEYVGELKKLVEEGKVRYIGLSEASPDTIRRAHAVHPITAVQMEWSLWSRDIEDEIIPLQ

SEQ ID NO: 141376 - protein, 641 aa, Glycine max
  Coding DNA Sequence Number=SeqID_24598
  Gene Ontology: Mol. function=pyridoxal phosphate binding; Cellular component=extracellular region; Biological process=biosynthetic process
  Homolog annotation: Hit_ID=Q1S2I5; Match level="QueryCoverage=99%, HitCoverage=37%, E-value=0.0, Identity=86%"; Hit description=MATH
VYGALSQLECGSEVWERILFQSFELLTDSNDEPLTATINFIFKAASQCQHLPEAVRSVRVRLKNLGLEVSPCVLDFLSKTINSWGDVAETILRDIDCDDDCGDSCSALPCGIFLFGEHGTAPSGLHVIDEQAYHASRHFSDIYILFEMLSIPCLVAEASQTFERAVARGAISAQSVTLVLQSRLSQRLNNNGSYASENFQHSDGATEGDACEQLGVQRDDYTSVLGLAENLALSKDPCVKEFVKLLYMIMFRWFANESHRGRMLKRLVDRATSNTDNGREVDFDLDILVTLVCEEQEFIRPVLSMMREVAELANVDRAALWHQLCASEDEIVRVREESKNEISNMAKEKVMISQKLSESEATNNRLKSEMRTEMDRFSREKKELAEQIQEVESQLEWIRSERDDEIAKLSAEKKALHDRLHDAETQLSQLKSRKRDELKKVVKEKNALAERLKNAEAARKRFDEELKRFATENVTREEIRQSLEDEVRRLTQTVGQTEGEKREKEEQVARCEAYIDGMESKLQACQQYIHTLEASLQEEMSRHAPLYGAGLEALSLKELETLSRIHEDGLRQIHALQQRKGSPAGSPLVSPHALPHTHGLYPTAAPPMAVGLPPSIIPNGVGIHSNGHVNGGAVGPWFNHS

SEQ ID NO: 141377 - protein, 101 aa, Glycine max
  Coding DNA Sequence Number=SeqID_24599
  Homolog annotation: Hit_ID=Q1S2I1; Match level="QueryCoverage=62%, HitCoverage=11%, E-value=2e-22, Identity=71%"; Hit description=C2
MKAFRLLNFLASLKDLEPGKVKDVWLKLVKDLEVHRDNEMLILEVYDHDTFGKEKIGRVILTLTKVILEGEYNETYPLDGAKSGNISLHLKWTPQHNFRDP

SEQ ID NO: 141378 - protein, 584 aa, Glycine max
  Coding DNA Sequence Number=SeqID_24600
  Gene Ontology: Mol. function=pyridoxal phosphate binding; Biological process=biosynthetic process
  Homolog annotation: Hit_ID=Q1S2I5; Match level="QueryCoverage=100%, HitCoverage=52%, E-value=0.0, Identity=56%"; Hit description=MATH
  Pfam annotation: Domain name=MATH; Domain location=61-192; Score =44.2; E_value=4.3e-10; Accession=PF00917.16; Description=MATH domain
MLDFIDADSGFLVDDTAVFSTSFHVIKEFSSFSKNGAVIAGRSGSGARKSDGHVGKFTWRIENFTRLKDLLKKRKITGLCIKSRRFQIGNRDCRLIVYPRGQSQPPCHLSVFLEVTDSRNTSSDWSCFVSHRLSVVNQRMEDKSVTKESQNRYSKAAKDWGWREFVTLTSLFDQDSGFLVQDTVIFSAEVLILKETSIMQDITENDSELSSSGSPVDKRSSFTWKVENFLSFKEIMETRKIFSKFFQAGGCELRIESDQAVGSDPDKNFWVRYRMAVVNQKNPAKTVWKESSICTKTWNNSVLQFMKVSDMLEADAGFLVRDTVVFVCEILDCCPWFEFSDLEVLASEDDQDALTTDPDELIDSEDSEGISGDEEDIFRNLLSRAGFHLTYGDNPSQPQVTLREKLLMDAGAIAGFLTGLRVYLDDPAKVKRLLLPTKLSGSCDGKKATKADESSPSLMNLLMGVKVLQQAIIDLLLDIMVECCQPSEVGPVADSVDACSKPSPNGSGAASPLECERENGAMESARVPVCERLDSVVQESSNASAVQSSDLKGNGIQEKALPGQPICPPETSATASENASLRSK

SEQ ID NO: 141379 - protein, 373 aa, Glycine max
  Coding DNA Sequence Number=SeqID_24601
  Gene Ontology: Mol. function=oxidoreductase activity; Cellular component=intracellular; Biological process=auxin mediated signaling pathway
  Homolog annotation: Hit_ID=Q338B1; Match level="QueryCoverage=89%, HitCoverage=90%, E-value=1e-110, Identity=58%"; Hit description =Auxin-induced protein PCNT115, putative, expressed
  Pfam annotation: Domain name=Aldo_ket_red; Domain location=16-341; Score=191.3; E_value=2.3e-54; Accession=PF00248.11; Description =Aldoketo reductase family
MDSSGTVVEECLRTHANDGGSSGPAAIGGEGEAYNEPLPEQDGISIIKYAFSKGITFFDTADVYGAGANEILLGKALKQLPREKIQLATKFGIARLDFSNMLIKGSPEYVRSCCETSLKRLDVEYIDLYYQHRVDTSVPIEETVKDFFLSMILIIVGELKKLVEEGKVRYIGLSEASSDTIRRAHAVHPITAVQIEWSIWTRDIEDQIVTICRELGIGIVSYSPLGRGFFGGKGILENVSASSSLNVWLFCDDYFTYQKVHPRFQAENMDKNKNIYERIESLAKMHRITPAQLALAWLLQQGEDVVPIPGTTKIKNLDQNIGALAVKLSEKDLREISEAVPIGDVAGGIHYYGLEHITWKYANTPPKDSSIST

SEQ ID NO: 141380 - protein, 50 aa, Glycine max
  Coding DNA Sequence Number=SeqID_24602
MREKGMNEELVDSDSVCDGGGLDGADVRNNRTIGVLKGGSYGNAGEEIQR

SEQ ID NO: 141381 - protein, 74 aa, Glycine max
  Coding DNA Sequence Number=SeqID_24603
MDRLKYEREKEKLRKCFSTGAKKNEEKSSLYIGSETLFKCLSRAIPLGRGFFGGKGVLENMPAYTTLNFLDVKN

SEQ ID NO: 141382 - protein, 758 aa, Glycine max
  Coding DNA Sequence Number=SeqID_24604
  Gene Ontology: Mol. function=nucleic acid binding; Cellular component= nucleus; Biological process=DNA repair
  Homolog annotation: Hit_ID=Q9SR14; Match level="QueryCoverage=99%, HitCoverage=100%, E-value=0.0, Identity=75%"; Hit description =Mutator-like transposase
  Pfam annotation: Domain name=SWIM; Domain location=621-653; Score =41.4; E_value=3.1e-09; Accession=PF04434.8; Description=SWIM zinc finger
  Pfam annotation: Domain name=zf-CCHC; Domain location=739-756; Score =15.9; E_value=0.0023; Accession=PF00098.13; Description=Zinc knuckle
  Pfam module annotation: Pfam domain module=MuDR::SWIM::zf-CCHC; Domain location=147-310::621-653::739-756
MANHDLILGQSHNLALGHDQQLMLSHNHSLGLGENHDLELGQTDDQHLGLGRTHDHELGLGIANDHELDLGLNHDDEGDGVHTYGHENELSMDQKPEHDDHVMPIPTQNHDLDLPENNDLAVSENQEFDENMALTVVHNPEMSIESAEEMGLHESHLMVSTTPVIQARTLAISPNYELAVGQEFPDVKSCRRALRDTAIALHFEMQTIKSDKTRFTAKCRSEGCPWRIHAAKLPGVPTFTIRTVHESHTCGGISHLGHQQASVQWVATSVEQRLKENPDCKPKEILEEIHRVHGITLSYKQAWRGKERIMAAMRGSFEEGYRLLPQYCEQVKRTNPGSIASVYANPTDNCFRRLFISFQASIYGFLNACRPLLELDRIYLKSKYLGTLLLATGFDGDGALFPLAFGVVDEENDDNWMWFLSELHNLLEINTENMPRLTILSDRQKGIVDGVEANFPTAFHGFCMRHLIDSFRKEFNNTMLVNLLWNAAQVLTILEFESKVLEIEEISQDAAYWIRRVPPHLWATAYFEGQSFFHLTANIVESLNTWILDASGLPIIQMMECIRRQLMIWFNERRETSMQWPSILVPSAERHVAEALDRARTHQVLRATDAEFEVISHEGTNTVDIRTRCCQCRGWQLYGLPCAHAVAALLSIRQNVHRFTESCFTVATYRKTYSQTIHPIPDKSLWKELSEAEGDVNASNANQLQLQIAINPPKSLRPPGRPRKKRVRAEDRGRVKRVVHCSRCNQTGHFRTTCAAPI

SEQ ID NO: 141383 - protein, 151 aa, Glycine max
  Coding DNA Sequence Number=SeqID_24605
VQEFVKGELRKEGREEELTKLMEEKERLKAEAKAKEIEAAEAAKRSARAAVASLLPSKLFGNKETDLESKREGEIQALNEENTNATASEAELVEETTETEGDRASEQLTAPSDLETKEVLGLTTDLPLYMLREEMIVTTKEADVGAWLRRS

SEQ ID NO: 141384 - protein, 751 aa, Glycine max
  Coding DNA Sequence Number=SeqID_24606
  Gene Ontology: Mol. function=nucleoside-triphosphatase activity; Biological process=protein transport
  Homolog annotation: Hit_ID=Q1SQS4; Match level="QueryCoverage=55%, HitCoverage=82%, E-value=1e-157, Identity=64%"; Hit description=ClpX, ATPase regulatory subunit
  Pfam annotation: Domain name=AAA_2; Domain location=451-603; Score =53.5; E_value=7.2e-13; Accession=PF07724.4; Description=ATPase family associated with various
TIGKSESSSKATIGDMDNPNPTNDEEVNKQILQHEKSAAGILCQLKIRHGAQASHLTLTKDVVGIVATLGKVEDDNLSRLFSEYLGVETMLAIVCKTYEGVKALEMPYAGNYVVNDAQRKLDFLIPRLPNGELPSGFLGFAVNMINLDSSNLFCVTPSGYGLRETLFYNLFSRLQVYKTRAEMIQALPCISEGALSLDGGMVRSCGVFSLGNREDVDVRFPRPERSMRLDNHHIEIERQLKDVKWKKEKIMEELKREQILLDTTRFNYNKKKADYLKFLAQSSSDATQPGSYKETATLALSHFRHLVFNFTRAGDSGCPPRAGFGVRRGYNVVSSLGDPPEVWSGGGIVVRPGNSNFDVAGGGAAPNSGDSKEGCWGGSNLGNSFPTPKEICKGLDKFVIGQERAKKVLSVAVYNHYKRIFNETSSSKWPAGDSDNNNVKTDAVDDDRVELEKSNILLMGPTGSDYNVAAAQQGIVYIDEVDKITKKAESLNISRDVSGEGVQQALLKMLEGTVVNVPEKGARKHPRGDNIQSVVFLYVTSNFWFPFSRHDSSIGFGAPIRANMRTGKVTEAAVASSLLQTVESSDLVAYGLIPEFVGRFPILVSLSALTENQLIQVLTEPKNALGKQYKKMFQMNGVKLHFTENALRSIARKAISKNTGARGLRSILENVLVDAMYEIPDIRTGDDVIDAVVVDEEAVGGEGRGRGAKILYGKDALDRYLSEQKNDSETMEASAADNEADTELPSIVASM

SEQ ID NO: 141385 - protein, 296 aa, Glycine max
  Coding DNA Sequence Number=SeqID_24607
  Gene Ontology: Mol. function=zinc ion binding; Cellular component =nucleus; Biological process=ubiquitin-dependent protein catabolic process
  Homolog annotation: Hit_ID=Q1EP48; Match level="QueryCoverage=72%, HitCoverage=81%, E-value=1e-116, Identity=93%"; Hit description =Ubiquitin ligase SINAT5-related
  Pfam annotation: Domain name=Sina; Domain location=2-196; Score =214.7; E_value=2.1e-61; Accession=PF03145.7; Description=Seven in absentia protein family
MATHCVPHVKLGCTTDVPLVDKSLEILGVWHWRRWLNHLSYLASTTPLDVQKSFHTTASLSMRQDDHKVDMHTGCTFNHRYVKSNPREVENATWMLTVFHCFGQYFCLHFEAFQLGMAPVYMAFLRFMGDENEARNYSYSLEVGANGRKLIWEGTPRSVRDSHRKVRDSHDGLIIQRNMALFFSGGDRKELKLRVTGRIWKEQNSDAGICAHHHCQKQDKEREAHGFCESLVVEDAELTHHVLFHHPRLQTLRCPLSRPPQPCPHISLLRRHYHFLPQHVERQIGCQPQHFFGLQI

SEQ ID NO: 141386 - protein, 463 aa, Glycine max
  Coding DNA Sequence Number=SeqID_24608
  Homolog annotation: Hit_ID=Q9M3A6; Match level="QueryCoverage=84%, HitCoverage=75%, E-value=1e-54, Identity=37%"; Hit description=SF16 -like protein
  Pfam annotation: Domain name=IQ; Domain location=116-136; Score=35.8; E_value=1.5e-07; Accession=PF00612.17; Description=IQ calmodulin -binding motif
  Pfam annotation: Domain name=IQ; Domain location=138-158; Score=16.2; E_value=0.12; Accession=PF00612.17; Description=IQ calmodulin-binding motif
  Pfam module annotation: Pfam domain module=IQ::IQ; Domain location =116-136::138-158
MGKKGGSWFSSVKKVFKSSSSKDSPLPEKKKENNKEEQWQHVAPEEVSVEHFPAESSPDLTNEGSVTSSTPVTEDTNPAVAFAAATAAAAEAAVAAAQAAARVVRLAGYGRQSKEERAAILIQSYYRGYLARRALRALKGLVRLQALVRGHNVRKQAQMTMRCMHALVRVQTRVRARRLELTEEKLQRRVYEEKVQREVDEPKQFLSPIKMLDMDGWDSRRQTSQQIKDNDLRKHEAVMKRERALAYAFNCQQQLKQHMHIDPNGDDIGSYSTERERAQLDWNWLERWMSSQSPNLRPRETLYRTLATATSTTDDMSEEKTVEMDMGATLDSTHANMGFINGESFDTSPISNRYHQRHHSAGVPSYMAPTQSAKAKVRSQGPFKQRGSPGPHWNSSTRRGSSVGLGCDSSSSGGPTAAHVFPRSPNPKINEIRLQSRRISGGSPDNVHIEDWALPLGATNGWA

SEQ ID NO: 141387 - protein, 138 aa, Glycine max
  Coding DNA Sequence Number=SeqID_24609
  Gene Ontology: Mol. function=nucleic acid binding
  Homolog annotation: Hit_ID=Q2QQM2; Match level="QueryCoverage=80%, HitCoverage=66%, E-value=4e-31, Identity=62%"; Hit description =Expressed protein
  Pfam annotation: Domain name=Alba; Domain location=23-92; Score=65.7; E_value=1.5e-16; Accession=PF01918.11; Description=Alba
  Subcellular localization annotation: CTP_CleavageSite=5; ConfidenceScore=5.18e-01
MPTTVAVSVPQNQNTNHGVESPKKNKIQVSNTKKPLFFYVNLAKRYIQQRNEVVLSALGMGITTVVTIAEILKNNGLAIEKKVSTSSVTMKDETKGRLVQKAKIEIVLEKTEKFDSLTAVANTESKVVAADDDNHEKK

SEQ ID NO: 141388 - protein, 648 aa, Glycine max
  Coding DNA Sequence Number=SeqID_24610
  Gene Ontology: Mol. function=transferase activity, transferring glycosyl groups; Cellular component=chloroplast; Biological process =glucan biosynthetic process
  Homolog annotation: Hit_ID=Q75T80; Match level="QueryCoverage=96%, HitCoverage=97%, E-value=0.0, Identity=85%"; Hit description=Starch synthase I precursor
  Pfam annotation: Domain name=Glyco_transf_5; Domain location=143-399; Score=394.3; E_value=1.8e-115; Accession=PF08323.2; Description =Starch synthase catalytic domain
  Pfam annotation: Domain name=Glycos_transf_1; Domain location=440 -619; Score=25.2; E_value=3.4e-05; Accession=PF00534.10; Description =Glycosyl transferases group 1
  Pfam module annotation: Pfam domain module=Glyco_transf_5::Glycos _transf_1; Domain location=143-399::440-619
  Subcellular localization annotation: CTP_CleavageSite=41; ConfidenceScore=5.41e-01
MESLELVPLLLLLHPPPSQSFNNSRSIRQLRFPSLLNSKTRNANLRSFSGNLQGGGGATSQDGPFAFEDQVSHHKDDRALVLARETDDFGYLVGFRLLPNSGLEEFMNVSHSITEEDSSSDEVEKPKVEDTEEEEAKTRVSHNIVVVTSEAAPYSKTGGLADVCGSLPIALASRGHRVMVVTPRYIHGTSEDLKFAGAVDLDQSTKVFCFGGAQEIGFYHEYREGVDWVFVDHPSFHRPGNPYGDKFGTFGDNQFRFTLLCHAACEAPLVLPLGGFSYGEKCLFLANDWHASLVPILLAAKYRPHGVYKDARSILVIHNIAHQGVEPAITYRNLGLPSEWYGALEWVFPTWARTHALDTGEAVNFLKGAVVTADRIVTGYSWEITTSEGGCGLHDLLSSRKSILSGITNGIDVTEWDPSCDKHIACNYSADDLSGKAECKISLQKELGLPMRPDCPMIGFIGRLDYQKGIDLIRLAMPELMEADVQFVMLGSGNPIYEDWMRATESIYKDKFRGWVGFNVPISHKITAGCDILLMPSAFEPCGLNQLYAMRYGTIPVVHETGGLRDTVHNFNPYAEESRAESTGWTFSPLTKESMLAALRYAIQTYNEYKSSWEGLMIRGMTRDYTWVNAATQYEQVIEWAFTDPPYC

SEQ ID NO: 141389 - protein, 525 aa, Glycine max
  Coding DNA Sequence Number=SeqID_24611
  Gene Ontology: Mol. function=protein serine/threonine kinase activity; Cellular component=membrane; Biological process=protein amino acid phosphorylation
  Homolog annotation: Hit_ID=Q8VZH5; Match level="QueryCoverage=99%, HitCoverage=83%, E-value=1e-147, Identity=53%"; Hit description =Receptor protein kinase-like protein
  Pfam annotation: Domain name=Pkinase; Domain location=182-454; Score =128.2; E_value=2.3e-35; Accession=PF00069.15; Description=Protein kinase domain
  Pfam annotation: Domain name=Pkinase_Tyr; Domain location=182-454; Score=116.4; E_value=8.2e-32; Accession=PF07714.7; Description =Protein tyrosine kinase
  Pfam module annotation: Pfam domain module=Pkinase::Pkinase_Tyr; Domain location=182-454::182-454
QADVIGWTGVKGVPTYKDYVIYVQDGEADDMLWLSLHPSPDSKPEFYDAILNGVEIFKLNDTDLSGPNPQLSEMLLKQQKEDEEAGFISHKAYHKHVVIGGAAGGAAGLAFMAALFLAVYNKKKRVPGSEGHTSWLPIYLNSHSKSSSSGKSVTSSANLSAMAQGLCRYFSLQEITQATKNFDEANVIGVGGFGKVYKGVIDNGMKVAIKRSNPQSEQGVNEFQTEIEMLSKLRHKHLVSLIGFCEENDEMCLVYDFMALGTMREHLYKGNKPMSTLSWKQRLEICIGAARGLHYLHTGAKYTIIHRDVKTTNILLDENWSAKVSDFGLSKTGPNMNTGHVSTVVKGSFGYLDPEYFRRQQLTEKSDVYSFGVVLFEALCARPVLNPSLPKEQVSLADWALLCKQKGTLEDLIDPCLRGKINPESLNKFVDTAEKCLSDHGTDRPSMNDLLWNLEFALNLQENVEGGSTHSARAQESDFEDVSLGDNDMARHYKNLSLGSDLDLSDDSNENPNAIFSELASPKGR

SEQ ID NO: 141390 - protein, 155 aa, Glycine max
  Coding DNA Sequence Number=SeqID_24612
  Gene Ontology: Mol. function=oxidoreductase activity; Biological process=electron transport
  Homolog annotation: Hit_ID=Q2QMN9; Match level="QueryCoverage=58%, HitCoverage=21%, E-value=3e-26, Identity=57%"; Hit description =Expressed protein
  Subcellular localization annotation: CTP_CleavageSite=27; ConfidenceScore=5.07e-01
MVTMETQIQELSPSKTRRKSSYGTSKRSILKKSFSQEQVTFTAPLSDDPLVALIGKGRNARGFDQVRGTEFFLVYARGAVFPTNTHGVPCIFDPFGRAGICGDWLLGSNIEAAVLSGIALANHIADYSQSPGTDPGEFAVGLNHEFQPLEGHDIG

SEQ ID NO: 141391 - protein, 485 aa, Glycine max
  Coding DNA Sequence Number=SeqID_24613
  Gene Ontology: Mol. function=RNA binding; Biological process =gynoecium development
  Homolog annotation: Hit_ID=Q58T16; Match level="QueryCoverage=92%, HitCoverage=68%, E-value=1e-137, Identity=58%"; Hit description=FLK
  Pfam annotation: Domain name=KH_1; Domain location=137-248; Score =43.5; E_value=7.4e-10; Accession=PF00013.19; Description=KH domain
  Pfam annotation: Domain name=KH_1; Domain location=364-426; Score =56.8; E_value=6.9e-14; Accession=PF00013.19; Description=KH domain
  Pfam annotation: Domain name=KH_1; Domain location=45-107; Score =51.0; E_value=4.1e-12; Accession=PF00013.19; Description=KH domain
  Pfam annotation: Domain name=KH_2; Domain location=137-182; Score =7.1; E_value=0.017; Accession=PF07650.7; Description=KH domain
  Pfam module annotation: Pfam domain module=KH_1::KH_1::KH_1::KH_2; Domain location=137-248::364-426::45-107::137-182
MAEMDQNTGGEHEAEETIEIEAEVHGGEEAVVAEKKWPGWPGESVFRMLVPAQKVGGIIGRKGEFIKKIVEETRARVKILDGPPGTVQRAVMISAKEEPGSSVPPAVDGLLRIHKRIIDGLESDFTHAPSGVAGKVSTKLLVPASQAGSLIGKQGGTVKSIQEASNCIVRVLGAGKDELYALSTTAVIEHHLGHAFKPFTSVITFLPLLTICVAFSSAEDLPIFALQDDRVVEVVGDPAGVHKALELIASHLRKFLVDRGVIPIFEMNMQTANPHHAEHMPPHQSWGPSQGLPPNVGGGPGFGPPSQYMPPPRQLDSYYPSAEMPPPVDRQPHQGISAYGRDASIGVHASSNTQSAPSIVTQITQQMQIPLSYADAVIGTAGASISYIRRASGATVTIQEARGVPGEMTVEISGTASQVQTAQQLIQNFMAEAAAAAAAPAQPQTTVPAADQGYNSYPAHGSVYASPPSNPGHAGGYGSVYGANY

SEQ ID NO: 141392 - protein, 216 aa, Glycine max
  Coding DNA Sequence Number=SeqID_24614
  Homolog annotation: Hit_ID=Q9LVV3; Match level="QueryCoverage=36%, HitCoverage=29%, E-value=2e-15, Identity=48%"; Hit description =Genomic DNA, chromosome 5, P1 clone:MNB8
MPHRIINQVTIVITMFSKQRRKESHALEAAADPQPDDKEDSADEQIEEEEDPHVFLPNVLGLVAVVVELGLERNGVVGDVERGGRVIGPFLFLQALSWRVERRRGLLLLLRSVVVVKRVLEDGVELGLEGERGKVEDLMRWRKGRVWDLRREWWEMEKKTKGGSMRKVYVRWLTVWENREWLGGVWATHWAAKASMLGSFSLWCCPRIVSDRAMQA

SEQ ID NO: 141393 - protein, 1240 aa, Glycine max
  Coding DNA Sequence Number=SeqID_24615
  Homolog annotation: Hit_ID=Q8LDQ4; Match level="QueryCoverage=34%, HitCoverage=98%, E-value=1e-146, Identity=61%"; Hit description=PP2A regulatory subunit TAP46
  Pfam annotation: Domain name=TAP42; Domain location=4-420; Score =449.9; E_value=3.4e-132; Accession=PF04177.3; Description=TAP42-like family
MDDMPLPALFEQARKIHAAATDSGADQEVVKKGCEALHRCEDMVNNLGLFSPNETKEDISTTNLKYILVPFYLAELTEKIAQDDRIQILKSSQAKLKEFISFCEAMELVPKEELESYIDGAPKTVADQRARKIARFKRQRAAESKLLEIKERKERRGRSTKAAALSTPVEAGEEEVLDDDGEEEREAWITTISLAICKALDMLDMLKKEEEMLSAVKDRQSKDGDKEFSKDVLDERAKKAEAWHRDSAVRAQYTRPSPPITCATFAQDVLEGRAKASQEHDHKHQPLIFGPASLVNGNITTERERMAAQVFQPSHRPCAQKEMKFYFLVVFSVILPRTPHWLPMIERVELMPTMSIEEAGLKEMEIMNKWQERNVKLMEEVNSSWHNDRKSKLGEDDDDEDDDAAQEKARAWDDWKDDNPRGAGNKKLTPCGGARESDLTGMGEKEVSVLDRDGCDNKSDTESMYPMYFGVSCAFFALQVLTEEPQVEVEKWSKIRDTMLQGSARLLGLVVWKLQKGMRNGGECKLKIAEGEIENLKKMRHEDAKANEKVVGIFAAQEQSWLSERRRLRQQIGALLSELRVFERNKDAAISELNQKLKDMESLVESRDKEIEQEEQKRKELEEKLNNVEKDAEETRESARREAQEHSSDLRKHKTAFIELVSNQRQLEAELGRAVKQVEATRQELASVEEKKEESDLMAQKLSLEITKFHKDLEQKDKILSAMLRKSKLDTAEKQMLLKEVKLSKARRKQAEQETQRWKAVSEGKHERQSLKSMLVNLSSRMDVFPGNRGVQHSSTGSSHIANEPDQLSPFPDHYLQQRNGDLSIPANAKRLEDWVRAEAERYATLIEQRHHLELDAFAEQMRLKDEKLEAFRWQLLRTELEMKQMQAHVEGLVKDVTQLRHDKMRLETLLLEREDELTSLKEQFVSKLRPLKNNSNLPPQSLEIAQEAVWSRVKVVKRKPGEKVLETMETLVEEDCEKEVQCQPHDQVNGANLLVQSPETEIEEEKSISREDSPTTPMQNQSPSKVEADASEKIASTSQTLSTTKKSLGKMDLHALGISYKIKRLKQQLVLVERLTGRQANDEHAEITDDSKVGMKAYLSLTTLLNKQVGRYQSLQEKTDDLCKRMHENDLYANRGDVSAARAKEKTSTLEHFLEETFQLQRYIVATGQKLMEIQSKILSGFVGVAEEMGKSSGIDMNRFADSIRNLFHEVQRGLEVRTARIIGDLEGTLAREGMTCLR

SEQ ID NO: 141394 - protein, 102 aa, Glycine max
  Coding DNA Sequence Number=SeqID_24616
MDVDEVVSTGVNKVELMGSEDTNASIDLEELGSGSKRRGQSSSSTSIQSQRRKIGEKDGISTSMKQVPESFDRLTQAYDEKVDENDILEVLDEVVMMLNLNK

SEQ ID NO: 141395 - protein, 239 aa, Glycine max
  Coding DNA Sequence Number=SeqID_24617
  Gene Ontology: Mol. function=nucleoside-triphosphatase activity; Cellular component=membrane; Biological process=cell cycle
  Homolog annotation: Hit_ID=Q10NR0; Match level="QueryCoverage=92%, HitCoverage=19%, E-value=7e-09, Identity=25%"; Hit description=AT hook motif family protein, expressed
MFLQSNPLTETEKIQKLWKDLRERRMDLKQHATSEQLGAFQVVKLASGLNNLISEADLFHKRDIMEPSTFLSGEATSSWYHEQIMTSTVAEHGFCFYAKLIADEASKLGCANCVDITSEMLASAIKLSGQDLTKSKVIYTGKEVEWKSPINSTQKSENKTSQFKAIQSIVPARISLALKGGAFNEYLSSLREITRSEASRISQEVEKNRRGRCTTLSPEDISLVSEGNLYRKDSSQHTT

SEQ ID NO: 141396 - protein, 172 aa, Glycine max
  Coding DNA Sequence Number=SeqID_24618
  Homolog annotation: Hit_ID=Q2QVG6; Match level="QueryCoverage=25%, HitCoverage=20%, E-value=2e-07, Identity=52%"; Hit description =Expressed protein
  Pfam annotation: Domain name=DUF1685; Domain location=26-124; Score =154.8; E_value=2.3e-43; Accession=PF07939.2; Description=Protein of unknown function (DUF1685)
MGEVERQVQFQQVETELQHLALKKRKRCLSKQQSMFEAPRDIAWERKRRQEGKTRTRTRTRRNSFHDNVTDDDLHELKGCIELGFGFNEENGQKLCNTLPALDLYFAVNRQLSSVSTPHSRPSSSFGSPVSSAPPPDSDSWKICSPGMNIYIHIHDSRLIDDFELEERFRYL

SEQ ID NO: 141397 - protein, 84 aa, Glycine max
  Coding DNA Sequence Number=SeqID_24619
  Subcellular localization annotation: CTP_CleavageSite=27; ConfidenceScore=5.57e-01
MAATHRCSALKALTCGPPSSIAVTASRSSVAVAPSFASSHNNKGNIGKVEIPFDDTRLAFTVSCILHSFAAAIKMVMESKNERW

SEQ ID NO: 141398 - protein, 65 aa, Glycine max
  Coding DNA Sequence Number=SeqID_24620
MSLRGIFMYTILNHRGEYKRRKEEEEEYSTAMQVYAERMSIAVRDGVRPIRRLIINVTLLPSHNE

SEQ ID NO: 141399 - protein, 394 aa, Glycine max
  Coding DNA Sequence Number=SeqID_24621
  Gene Ontology: Mol. function=binding; Cellular component=membrane; Biological process=translation
  Homolog annotation: Hit_ID=Q2LV56; Match level="QueryCoverage=80%, HitCoverage=78%, E-value=9e-20, Identity=24%"; Hit description =Tetratricopeptide repeat family protein
  Pfam annotation: Domain name=TPR_1; Domain location=100-133; Score =8.5; E_value=0.52; Accession=PF00515.18; Description=Tetratricopeptid e repeat
  Pfam annotation: Domain name=TPR_1; Domain location=142-175; Score =14.5; E_value=0.1; Accession=PF00515.18; Description=Tetratricopeptid e repeat
  Pfam annotation: Domain name=TPR_1; Domain location=16-49; Score=8.6; E_value=0.51; Accession=PF00515.18; Description=Tetratricopeptide repeat
  Pfam annotation: Domain name=TPR_1; Domain location=228-261; Score =5.7; E_value=1.1; Accession=PF00515.18; Description=Tetratricopeptide repeat
  Pfam annotation: Domain name=TPR_1; Domain location=270-303; Score =3.1; E_value=2.3; Accession=PF00515.18; Description=Tetratricopeptide repeat
  Pfam annotation: Domain name=TPR_1; Domain location=58-91; Score=9.5; E_value=0.39; Accession=PF00515.18; Description=Tetratricopeptide repeat
  Pfam annotation: Domain name=TPR_2; Domain location=100-133; Score =11.2; E_value=1.7; Accession=PF07719.7; Description=Tetratricopeptide repeat
  Pfam annotation: Domain name=TPR_2; Domain location=142-175; Score =17.2; E_value=0.058; Accession=PF07719.7; Description=Tetratricopepti de repeat
  Pfam annotation: Domain name=TPR_2; Domain location=16-49; Score=9.0; E_value=3; Accession=PF07719.7; Description=Tetratricopeptide repeat
  Pfam annotation: Domain name=TPR_2; Domain location=228-261; Score =9.3; E_value=2.7; Accession=PF07719.7; Description=Tetratricopeptide repeat
  Pfam annotation: Domain name=TPR_2; Domain location=270-303; Score =12.5; E_value=1.2; Accession=PF07719.7; Description=Tetratricopeptide repeat
  Pfam annotation: Domain name=TPR_2; Domain location=58-91; Score=4.8; E_value=9.2; Accession=PF07719.7; Description=Tetratricopeptide repeat
  Pfam annotation: Domain name=TPR_4; Domain location=100-125; Score =9.1; E_value=3; Accession=PF07721.5; Description=Tetratricopeptide repeat
  Pfam annotation: Domain name=TPR_4; Domain location=142-167; Score =7.0; E_value=5.4; Accession=PF07721.5; Description=Tetratricopeptide repeat
  Pfam annotation: Domain name=TPR_4; Domain location=189-211; Score =6.5; E_value=6.4; Accession=PF07721.5; Description=Tetratricopeptide repeat
  Pfam annotation: Domain name=TPR_4; Domain location=228-253; Score =5.0; E_value=9.4; Accession=PF07721.5; Description=Tetratricopeptide repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2::TPR _4::TPR_4::TPR_4::TPR_4; Domain location=100-133::142-175::16-49::228- 261::270-303::58-91:...
  Pfam module annotation: Domain location=:100-133::142-175::16-49::228- 261::270-303::58-91::100-125::142-167::189-211::228-253
MKEVVDNLKDDAPRLDSILMHMGSMYATLSKFEKSLDVYQRAVYIMERTYGMDSTFLVTPCLGMAKVLGSIGKATKAIETYQRVITLLESSRGTKSKDLVVPLLSLANLLLKEGRANDAETHFTRVLNIYTELYGQNDGKIGMAMSSLARVKCAQGKSDEAIQLFKRAIQVMKDSNYLSPDDNIMEKMRVDLAELLHTVGRGQEGRELLEECLWITERYKGKEHPSLVTHMINLATSYSRSKNYADAEHLLRRSLQIMIKQKGTDDQSISFPMLHLAVTLYHLKKDEEAEKLALEVLRIREKAFGKNSLPVGEALDCLVSIQTRLGRDESELLELLRRILNIQEREFGRESEEVLVTLKKIVYYLDKLGKKDEKLTLQRRLSVLSKKYKQMVNY

SEQ ID NO: 141400 - protein, 480 aa, Glycine max
  Coding DNA Sequence Number=SeqID_24622
  Homolog annotation: Hit_ID=Q9ZPY4; Match level="QueryCoverage=42%, HitCoverage=39%, E-value=2e-23, Identity=35%"; Hit description =Expressed protein
MASAEGKAPYTANCFTQDFRIPPSSPDHPSSVSKTIVSDWVPSNSINDQIHANAVCIPHNLNSDKLPEMKWWLHVKSDLGDEANYTCQQLNSYESELGTFYSEFLNGSVKSGGDQLVKDFDALSNIQSANLSIEQPWHVVSPTCMKNNNTRMPKFEASLNTDLHFTPKKKDQEEFYFQDSHFMDCDISNFLVSEQGKMASSDLESHLMGAEKTGAWWRTTGKDELASLVARKSLEHIENCDLPQPQTKHVSQRPSYPKGVDHDNTPPSSLNRKTETGSSYADSYTTGISTSDCSFQDSNKHSRCYCIHYSFLNPNGIAVFNSSQSKDFSSSTEGCQINSENGSVSELLKALCHSQTRAREAEKAAQRAYSEKEHILSLFFRQASQLFAYKQWLHMLQLENLCLQLRNKNQSFPNLFPASLPWDPCRGRLLKKSHSKARKRKNSNRRCVITKCAVAFAVGLGLAGAGLLLGWTMGWMFPPL

SEQ ID NO: 141401 - protein, 240 aa, Glycine max
  Coding DNA Sequence Number=SeqID_24623
  Gene Ontology: Cellular component=cytoskeleton
  Homolog annotation: Hit_ID=Q9M3A3; Match level="QueryCoverage=95%, HitCoverage=100%, E-value=4e-47, Identity=40%"; Hit description =Protein ABIL2
MGKVATSATLPVSQEASNYDEVFMQQSLLFDDSLKDLKNLRAQLYSAAEYFELSYSNDDQKQIVVETLKDYAIKALVNTVDHLGSVTYKVNDLLDEKVVEVSVAELRVSCIEQTMHGANRTKSKYVGYNLDDEGEWPHFRNAVRATIRETPPSTARPPTPKISRPTTPNPSRPTTPNPSNARQRYPSEPRKSSSMRLSAERDHGKDIEQYPSKSKRLLKALLSRRKSKKDDMLYTYLDEY

SEQ ID NO: 141402 - protein, 345 aa, Glycine max
  Coding DNA Sequence Number=SeqID_24624
  Gene Ontology: Mol. function=binding; Cellular component=thylakoid; Biological process=photosynthesis
  Homolog annotation: Hit_ID=Q9SR03; Match level="QueryCoverage=89%, HitCoverage=65%, E-value=1e-103, Identity=62%"; Hit description =Ankyrin-like protein
  Pfam annotation: Domain name=Ank; Domain location=121-153; Score =23.1; E_value=0.00097; Accession=PF00023.20; Description=Ankyrin repeat
  Pfam annotation: Domain name=Ank; Domain location=156-185; Score =18.6; E_value=0.023; Accession=PF00023.20; Description=Ankyrin repeat
  Pfam annotation: Domain name=Ank; Domain location=186-216; Score=9.6; E_value=1.3; Accession=PF00023.20; Description=Ankyrin repeat
  Pfam annotation: Domain name=Ank; Domain location=229-261; Score =38.9; E_value=1.7e-08; Accession=PF00023.20; Description=Ankyrin repeat
  Pfam annotation: Domain name=Ank; Domain location=54-87; Score=17.8; E_value=0.039; Accession=PF00023.20; Description=Ankyrin repeat
  Pfam annotation: Domain name=Ank; Domain location=88-120; Score=35.1; E_value=2.5e-07; Accession=PF00023.20; Description=Ankyrin repeat
  Pfam module annotation: Pfam domain module=Ank::Ank::Ank::Ank::Ank::An k; Domain location=121-153::156-185::186-216::229-261::54-87::88-120
MAPDASDALAARQKVQLFLNAARTGSIDLLKKLALQLDEGKDLAKSVEAIKDANKRGALHFAAREGQTAVCDYLLTDLKLSVDSQDDDGETALIHATRQGHTATAKYLIDHGADPTVASNLGATVLHHSAGIGDTELLKYLLSRGVNPDLESDSGTPLVWAAGHAQPASVSVLLEHGANPNAETDDGITPLLSAVAASSLACLELLIQVLVFTRCCFLPAGAKANISAGGATPLHIAADNGSLELLNCLLKAGADPNVSDEDGVKPIQVGAARGYLKAVEILFPLTSKVDTIPTWTVDGILEYMQSETRKQLGNMQDESINDKETNQPKEADFPKQNVPELYYSM

SEQ ID NO: 141403 - protein, 148 aa, Glycine max
  Coding DNA Sequence Number=SeqID_24625
MTIDGCRKKKPQVSFEVNAQKDITSPQKKNARYLHLLRFDPKMKTKTKTRFMCRMKGSCLLLTSSFTGIRTSKELRHMLSLCELKSITCFSVCNQKQKYNQKLYIIPVRTVCVRFCISRSSVGSVELSGTGTHSDAYSGFSAPNDYQR

SEQ ID NO: 141404 - protein, 1566 aa, Glycine max
  Coding DNA Sequence Number=SeqID_24626
  Gene Ontology: Mol. function=receptor activity
  Homolog annotation: Hit_ID=Q6ENK5; Match level="QueryCoverage=99%, HitCoverage=84%, E-value=0.0, Identity=48%"; Hit description=Thyroid hormone receptor-associated protein complex component TRAP170- like protein
  Pfam annotation: Domain name=MED14; Domain location=8-193; Score =207.6; E_value=2.9e-59; Accession=PF08638.1; Description=Mediator complex subunit MED14
MTAELGQQTVELSTLVTRAANDSYASLKELVDKCKSSELSDTDKKISILKFLSKTQQRMIRLNVPLIHHCQQLASTVSNHDMCFTQAADSLFFMHEGLQQARAPVYDVPSAIDILLTGSYQRLPKCIEDVGTQYALTEEQQKPALKKLDTLVRSKLLQVSIPKEFSNIMVSDGTAMLRLDGEFKVLITLGYRGHLSLWRILHLELLVGEKDKPVKLEATRRHLLGDDLERRMAAAENPFSVLYSVLHELCVALVMDTVIRQVQVLRQGRWKDAIRFELISEGHGASSSSALNPDGESDSSAMRTPGLKIVYWLDFDKNAGASESGTCPFLKIEPGSDLQIKCLHSSFVIDPLMGKEAEFVLDQSCIDVCRTADDVVLQSQMGELDIEYKQVKIDNFEVLVKIIVILFLRYLPKIWGLLLLRYHIDQRHDKSSPYKASTVLNPTKSKDDKCCSKDSEGHEVLCVRAYGSSFFTLGINIRNGRFLLQSSQNIVVSSALLECEEALNQGSMTAAEVFISLRSKSLLHLFASIGRVLGLEVYEHEFNTVKIPKNVSNGSAMLLMGFPDCGSSYFLLMQLDKDFKPLFKLLETQPNPSVKDNLSGELNQVLRIKEIDIGQMQVHEDEMNLSLVDWGKLRSVLPNAVCPNQTSGHEFFSDIRLENSIQIARGHPSGFSSLVDEVFGLEKGSSTPPFSVKNLSSSVNTSLPSQYGSVPMTLHSLKAGSPSPKWEVGMQMPLVSNVTKASSATNHYSGSLFSSGSVKGPVQSSSVGSIPTGQGRNSAGTKLSASKSEQDLASLKSLHSVDSSSSAAMDEEQLRVFSDNSNDALAGSRSSRLLSPPRPTGSRMSIPNSRPNGPQVESFKAAGSGSCATTPVSQTLESTVSYNTGEDVTSKNDRKSGKRTASDMLTLIPSLQGVESNSGICKKRKISDSAGCQLSLPQGVMSAEIIPRTEGYSYGSLIAEANKGNVPSSIYVAALLHVVRHCSLCIKHARLTSQMDALDISYVEEVGLRSGSSNIWFRLPLARGDSWQHICLRLGRPGCMYWDVKINDQHFRDLWELQKGINNTPWGSGVRIANTSDIDSHIHYDPDGVVLSYQSVEVDSIKKLVADIQRLANARTFALGMRKLLGVRAEEKSEELVTSSDTKTPSTKVALDTADKLTEQMRRAFRIEAVGLMSLWFSFGSGVLARFVVEWESGKEGCTMHVSPDQLWPHTKFLEDFINGGEVSPLLDCIRLTAGPLHALAAATRPARAGPVPGVAAALSSIPKQNGSYISSHGLLLSNSTTNVGLPTSGPGANTVMPTASGLTSQTLSMLAASGRGGPGIVPSSLLPIDVSVVLRGPYWIRIMYRKQFAVDMRCFAGDQVWLQPATPPKEGRLSGGSLPCPQFRPFIMEHVAQELNGLDPSFTGQQAGGMANSNNPNPGSGSQMMAANGNRINLPISAAMPRTGNQVASLNRVGNALAGSSNLALMTSAVSLRRPPGTVVPAHVRGELNTAIIGLGDDGGYGGGWVPLVALKKVLRGILKYLGVLWLFAQLPELLKEILGSILKENEGALLNLDPEQPALRFFVG

SEQ ID NO: 141405 - protein, 385 aa, Glycine max
  Coding DNA Sequence Number=SeqID_24627
  Gene Ontology: Mol. function=RNA binding
  Homolog annotation: Hit_ID=Q9LVU6; Match level="QueryCoverage=98%, HitCoverage=74%, E-value=1e-73, Identity=38%"; Hit description=RNA -binding protein-like
  Pfam annotation: Domain name=KH_1; Domain location=108-169; Score =10.6; E_value=0.063; Accession=PF00013.19; Description=KH domain
  Pfam annotation: Domain name=KH_1; Domain location=192-257; Score =11.6; E_value=0.049; Accession=PF00013.19; Description=KH domain
  Pfam module annotation: Pfam domain module=KH_1::KH_1; Domain location=108-169::192-257
MEVVGNVNAVKNALVIISSRLRESQHRDRSHFHGRVHSPERFFSPDDDYVPHVTSGSRRSSVDGASFGSRGSNTNSRNNNHPSLNYAMEPGAAPVVDDAQGFYGEELVFRILCPIEKVDRIIGESEGIVEFLQNEVGVDVKVTDPVGGSDEQIIIITSEEGPDDELFPAQEALLHVQTRIVDLVLDKDNTITTRLVVPSSEIECLDGKDVSLSEIRRLTGANIQILPRDELPLCVAKTDELVQIFPINGIERIQMRVSLDTMIRLLSRDLEVIDLNLANSSSLVGIVGEIKAARDAVVEVTSRLRSYLYRDFFQRDTVPLPAPLPGAAASSSNNIVPVTETPTTYQNLQTVAAALPSKETGGSSTETGKQKESDRRDDLLSGLNR

SEQ ID NO: 141406 - protein, 854 aa, Glycine max
  Coding DNA Sequence Number=SeqID_24628
  Gene Ontology: Mol. function=protein transporter activity; Cellular component=nuclear pore; Biological process=protein import into nucleus, docking
  Homolog annotation: Hit_ID=Q9FJD4; Match level="QueryCoverage=98%, HitCoverage=96%, E-value=0.0, Identity=77%"; Hit description =Importin beta
  Pfam annotation: Domain name=HEAT; Domain location=110-145; Score =0.4; E_value=38; Accession=PF02985.12; Description=HEAT repeat
  Pfam annotation: Domain name=HEAT; Domain location=153-190; Score =6.5; E_value=7; Accession=PF02985.12; Description=HEAT repeat
  Pfam annotation: Domain name=HEAT; Domain location=197-233; Score =5.6; E_value=8.9; Accession=PF02985.12; Description=HEAT repeat
  Pfam annotation: Domain name=HEAT; Domain location=345-381; Score =17.1; E_value=0.063; Accession=PF02985.12; Description=HEAT repeat
  Pfam annotation: Domain name=HEAT; Domain location=387-424; Score =22.5; E_value=0.0015; Accession=PF02985.12; Description=HEAT repeat
  Pfam annotation: Domain name=HEAT; Domain location=436-471; Score =4.3; E_value=13; Accession=PF02985.12; Description=HEAT repeat
  Pfam annotation: Domain name=HEAT; Domain location=481-520; Score =5.5; E_value=9; Accession=PF02985.12; Description=HEAT repeat
  Pfam annotation: Domain name=HEAT; Domain location=70-106; Score=1.9; E_value=25; Accession=PF02985.12; Description=HEAT repeat
  Pfam annotation: Domain name=IBN_N; Domain location=9-86; Score=56.1; E_value=1.1e-13; Accession=PF03810.9; Description=Importin-beta N -terminal domain
  Pfam module annotation: Pfam domain module=HEAT::HEAT::HEAT::HEAT::HEA T::HEAT::HEAT::HEAT::IBN_N; Domain location=110-145::153-190::197 -233::345-381::387-424::436-471::481-520::70-106::9-86
MYGSMLRTVSDNFRSKNLPGFLVSLSGELASEDKPVDSRKLAGLILKNALDAKDENRKQELVQRWLSLDPVAKTQVKSCLLQTLSSLVPDARSTATQVIAKVAGIELPQKQWPELIGSLLSNIHQVPTHVKQATLETLGYLCEEVSPQVVDQDQVNKILTAVVQGMNASEGNNDVRLAATRALYNALGFAQANFSNDMERDYIMRVVCETTVCPELKIRQAAFECLVSIAAMYYEKLAPYIQDIYNITAKAVRVDEEPVALQAIEFWSTICDEETDILEEYMGDSNGDSDIPCFYFIKQALPALIPLLLETLLKQEEDQDLDEGAWNIAMAGGTCLGLVARTVGDDIVPLVMPFIEENITKPDWRQREAASYAFGSILEGPSPDKLAPLVNHALPFMLSALVKDPNNHVKDTTAWTLGRMFEFLHSSIVGTPIINEGNCQQIITVLLQSMKDVPNVAEKACGALYFLAQGYEDVGPTSPLTPLFQEIVQSLLTVTHREDATESRLRTAAYETLNEVVRCSTDETATLVVQLVSVIMMELHKCLEAQNLSSDEREKRSELIGLLCGCMQVIIQKLGSLDSTKYVLVQYSDQIMRLFFRVFACRNATAHEEAMLAIGALAYSIGQEFSNYMPEFYKFLEMDLQNFEEYQVCAVTVGVIGDICRALELKILPYCDGIMTQLLKNLSSDNLHRSVKPPLFSCIGDIALAIGDNFNKYLMYAMNTLQLAAEMYAHTSGFDDEMTEYINSLRNGILEAYSAIFQGFKNSSKTQLLIPYAPHILQFLDSIYMEKDMDDVVMKTAIGVLGDLADTLGSNAGSLIQQSLSSRDFLNECLTSEDHLIKESAEWARLAINRAISV

SEQ ID NO: 141407 - protein, 54 aa, Glycine max
  Coding DNA Sequence Number=SeqID_24629
MAHHHKNEEYIMELNWKVMEELPRRTMVGPCFVPGHAPFPDGMYRWSVTTGVKD

SEQ ID NO: 141408 - protein, 132 aa, Glycine max
  Coding DNA Sequence Number=SeqID_24630
  Gene Ontology: Mol. function=acyl-CoA binding; Cellular component =cytoskeleton; Biological process=guanosine tetraphosphate metabolic process
  Homolog annotation: Hit_ID=Q9STP8; Match level="QueryCoverage=61%, HitCoverage=23%, E-value=4e-33, Identity=74%"; Hit description =Putative acyl-CoA binding protein
  Pfam annotation: Domain name=Ank; Domain location=39-71; Score=42.0; E_value=2e-09; Accession=PF00023.20; Description=Ankyrin repeat
  Pfam annotation: Domain name=Ank; Domain location=6-38; Score=49.8; E_ value=9.1e-12; Accession=PF00023.20; Description=Ankyrin repeat
  Pfam module annotation: Pfam domain module=Ank::Ank; Domain location =39-71::6-38
MNADSEGRTPLHWAVDRGHLNVTELLVGKNADVNAKDNDGQTPLHYAVTCEREAIAEYLLKHNADIYSKDNDGSSPRDICESNWPCMQHVGGESSVRCTPMHRLGEIVTGKGYLQRYPFLGKPSTLLLKVFK

SEQ ID NO: 141409 - protein, 253 aa, Glycine max
  Coding DNA Sequence Number=SeqID_24631
  Gene Ontology: Mol. function=protein phosphatase type 2C activity; Cellular component=protein serine/threonine phosphatase complex; Biological process=protein amino acid dephosphorylation
  Homolog annotation: Hit_ID=O82471; Match level="QueryCoverage=98%, HitCoverage=58%, E-value=2e-80, Identity=61%"; Hit description =Protein phosphatase-2C
  Pfam annotation: Domain name=PP2C; Domain location=1-205; Score=22.6; E_value=2.9e-07; Accession=PF00481.12; Description=Protein phosphatase 2C
MNGEEDESGATATTVFIGDDELLISHIGDSTVVLCRSGKAEVLTSPHRPIGSNKTSLDEIRRVREAGGWISNGRICGDIAVSRAFGDCFLKGIYLLHVERMLQKGVQEGRWSAKFISRVQLNNDLVVAYPDIYQVALGSDAEFVVLASDGLWDYMGRELPSHSSYYCSSEAVSIVRDQLRKHGNIQQACEALAEAALDRRTQDNVSIIIADLGRTDWKNAPLERQNTILELVQALATIGIVSIGIWFSSQLSL

SEQ ID NO: 141410 - protein, 175 aa, Glycine max
  Coding DNA Sequence Number=SeqID_24632
  Gene Ontology: Mol. function=sequence-specific DNA binding; Cellular component=nucleus; Biological process=regulation of transcription
MVLILIKELRRWRLWGMQYHARWRVLRWQNYYGNDDGFNRHVVAALLVWMENSYGSVCYILLLLIKKDEYMHPKMERIPFMEEQVRMVREQGKLLTMDIERLMLSEDNRFDFVNEIAAEANSYVENNRDEYGGEKKAILHVLSNRMNDTGIYRPEAYYESDPFKPGPHYLREEFT

SEQ ID NO: 141411 - protein, 72 aa, Glycine max
  Coding DNA Sequence Number=SeqID_24633
MGCYNCSCSGATTFGQIMSACDQLKRYCAMLVGATLYSNYLSTTYCTITTSAIHAYINSRSPSIQTHFLVLL

SEQ ID NO: 141412 - protein, 115 aa, Glycine max
  Coding DNA Sequence Number=SeqID_24634
MAGNIASAFCAHVHESLSMNSNRQLKGTYSNRDDRHTHPHHTLQVLTPGTRGPTMRWTGRLADKEIHLGPADSCVAKGNLDWVPRQAKPWPLANFQQGCIRTTIVPPLVINQLAI

SEQ ID NO: 141413 - protein, 324 aa, Glycine max
  Coding DNA Sequence Number=SeqID_24635
  Gene Ontology: Mol. function=nucleic acid binding; Biological process= DNA integration
MTPSSSTLDAMEPYSGNHKVLVGNGNVLPISHIGSHCLNSTLQLLDILVVPGLQKNLISISKLTRDFPVDSIFTNNSFLLQKRDTKEILAQGRREHNLYILEHGQAAFMTILNSNKLRGSFEYWHSRLGHVNYDAIFDLRKTSHLSLSSIFLNPSLYASCEQAKRCKNFYSKMEFFILCHAPIHLLKMAGPNASIAILLRQVYPYLHDYAPHKLSPRSIPCIFLGYSSMHKGFWCMDVSTSQIYFTCHAKFDEFYFPFSNTGLISSILHLGFSLFDEPSKLVIVSPPAPSKPSSQSSMPLLSRPCGLCPSKDTSPVVLVPPAEP

SEQ ID NO: 141414 - protein, 152 aa, Glycine max
  Coding DNA Sequence Number=SeqID_24636
  Gene Ontology: Mol. function=protein binding; Cellular component =chloroplast
  Homolog annotation: Hit_ID=P81760; Match level="QueryCoverage=92%, HitCoverage=55%, E-value=9e-44, Identity=66%"; Hit description =Thylakoid lumenal 17.4 kDa protein, chloroplast precursor
  Pfam annotation: Domain name=Pentapeptide; Domain location=104-143; Score=31.0; E_value=4.3e-06; Accession=PF00805.12; Description =Pentapeptide repeats (8 copies)
MAEWSGREERKNGQRVAELDGSHENKGGLFNFNGIKGVACGILAACTVTSAAFPVTAATQRLPPLSTEPHRCERAFIGNTIGQANGVYDKPLDLRQCDFTDEKTNLKGKSLSAALMSDAKFDGADMTEVVMSKAYAVGASFKGNNIYLCKIN

SEQ ID NO: 141415 - protein, 108 aa, Glycine max
  Coding DNA Sequence Number=SeqID_24637
  Gene Ontology: Mol. function=acyl-CoA binding
  Homolog annotation: Hit_ID=Q9ZRC2; Match level="QueryCoverage=75%, HitCoverage=15%, E-value=1e-08, Identity=59%"; Hit description=Acyl -CoA binding protein
MVQRLRDLWAQYSVLLFMKRNMAVTHIGDFPRRYTLIALKNLIGLKHTSNFISYRQMEAIHGFAREGDMANLLKCIENGVSMNLKGELFVATTLPYVYIILDCAVSCQ

SEQ ID NO: 141416 - protein, 428 aa, Glycine max
  Coding DNA Sequence Number=SeqID_24638
  Gene Ontology: Mol. function=sequence-specific DNA binding; Cellular component=nucleus; Biological process=regulation of transcription, DNA-dependent
  Homolog annotation: Hit_ID=O04136; Match level="QueryCoverage=94%, HitCoverage=100%, E-value=1e-142, Identity=65%"; Hit description =Homeobox protein knotted-1-like 3
  Pfam annotation: Domain name=ELK; Domain location=310-331; Score =33.7; E_value=6.2e-07; Accession=PF03789.4; Description=ELK domain
  Pfam annotation: Domain name=Homeobox; Domain location=332-389; Score= -11.0; E_value=0.07; Accession=PF00046.19; Description=Homeobox domain
  Pfam annotation: Domain name=KNOX1; Domain location=144-188; Score =70.7; E_value=4.6e-18; Accession=PF03790.4; Description=KNOX1 domain
  Pfam annotation: Domain name=KNOX2; Domain location=198-253; Score =108.5; E_value=2e-29; Accession=PF03791.4; Description=KNOX2 domain
  Pfam module annotation: Pfam domain module=ELK::Homeobox::KNOX1::KNOX2 ; Domain location=310-331::332-389::144-188::198-253
MAYHNHNLSQQDLPLHHFPNQSILPDQQQQLPSSPEPNSKPPSDLQTAPNWLNDALLRTHYTETTTNDATTNTATVAAAAANSNVNGSNFLNLNPGASDAQWPALHRHPGEVIDAGAGDSMVEHADLKGGGGDGGGDAVNWQIGRWKAEILQHPLYEQLLSAHVSCLRIATPVDQLPRIDAQLAQSQNVVAKYAAFGHNNIVADDKELDQFMSHYVLLLCSFKEQLQQHVRVHAMEAVMACWDIEQSLQSLTGVSPGEGTGATMSDDEDDQVDSDANLFDSSFDGADGMGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTVLKSKRKRVKAGQGANIGEPVYLCLKACK

SEQ ID NO: 141417 - protein, 137 aa, Glycine max
  Coding DNA Sequence Number=SeqID_24639
  Gene Ontology: Mol. function=RNA-directed DNA polymerase activity; Biological process=RNA-dependent DNA replication
  Pfam annotation: Domain name=AT_hook; Domain location=66-78; Score =14.9; E_value=0.061; Accession=PF02178.9; Description=AT hook motif
MRMLRWMCGKTRQDKIRNEAIRERVGVAPIVEKMVENRLRWFGHVERRPVDSVVRRVDQMERRQTIRGRGRPKKTIREVIKKDLELNDLDRSMFEYEVASYEFYEYSGKIEFGIRRECGNESKTNGILTSRRFSCFK

SEQ ID NO: 141418 - protein, 1171 aa, Glycine max
  Coding DNA Sequence Number=SeqID_24640
  Gene Ontology: Mol. function=RNA-directed DNA polymerase activity; Cellular component=chromatin; Biological process=RNA-dependent DNA replication
MLLPEVCLIAKSSNDDPSYLHNDSNIVSDQVSSVRASDIVASGFLDEAESPQLNPPQNVIDLDTKATTIQVISRQPFILPLPPLKKPNVSKKYLPIALLGYSLVHEEVGSYTSSFLTYESVIKFLKSIKFSNIDHSYVMFVECCRESEHVFMRAFPYKEDMVVLHKLPRSLHYKTFVDLPFSKTLNADLDFPPPPVIVDTTIREDHEPSGEGPSKRQRGKILILRLSFKHLCSVSLIAHAKGEFKGKNVECQKAQTNYAKALVEAAYANETLLRSLEESRESFVHAENKLKEIESREETLKTQLSIVEHLTKALHEEIERLKEKLKIDLDEVEAEILKTHEARCNKAFLQVMYFFKDANTFLFGVDKDVTHQGELVNEVDMLDIKAQGPTQGLKGPITKVRARKVEETLPQVVATILEASPMTESVRTYQELSITLVASSFGLSSITGSGAFHLSSNGANGDGLPHLDGAQRIEGITNQLNHDVRGPNANRRWHAKRGRGDEEGGPRRNRVEGVKLTIPPFKGRSDLDAYLKWELKIEHVFSCHDYTEEQKAKLATTEFSDYAFICVEEYYKEMEMALIRANIDEDNKAIMAHFLSGLNYDIRDVVELLKKEGRSSTSPTVTSTYRKSPMKPNTSSSRIGTRDIKCFKCLEIEEEALEGDLLMVKSCTNVASSRLLSKLNLETKPHPRPYKLQWLSEDGDMTEYKDVFPKGVPNGLPPLRGIEHHIDLILRASLPNQPAYRHNPQEIKEIQRQVEELMSKGWVQESMSLCIVPVHLVPKKDGTWRMCTDCKAINNITIKYRNRIPRLDELHGACIFSKIDLKSGYHQIRMREGDEWKTAFKTWCGLYEWLVMPFGLTNAPGTFMSAKEVHMDEEKVRAIKEWPTPKTVSEVRSFHGLAKKQEKAFAELKYKLIDALILALPNFAKSFEIECDASNVGIGAVLMQEGHPIAYFSEKLNGVALNYLTYDKELYALAKSKVKPHGLYHSLPILDFPWIDISMDFVLGFPRTKTGKDYVFVVIDRFSKMAHFIPYKKVDDACHVAYLFFKEVGYQVPKSFLENIVGDAQAKADYMRKKERFPEQRKLKLQPKGDGPFQVLEMVNDNAYKIDLPGNDENIEAQGSAQGLGGLMTRARARKAKETLQQVVATILEDAPMVKDIKPKLFQCMIITEDP

SEQ ID NO: 141419 - protein, 378 aa, Glycine max
  Coding DNA Sequence Number=SeqID_24641
  Gene Ontology: Mol. function=DNA binding; Cellular component =membrane; Biological process=DNA integration
MTNSQPYTPTRLGNLFLNHLTLTLLASNEYCTKYLFDGSIDRFKARLVAQGFTQTPDLDYDHTFSPLRFNSFLLHLGFIGSKADPSLSIYHHNTATLYLLVYVDDIILTGSNHFAIQTILAKIRAEFAIKDLGRLSYFLGLEVHYGANDIFLSQSKYAHDILDRAKVLDAKPIAMPLASGIQLTSTGDPFPDPTLYCSLVGALQYLTITRPDLSYVVNSARCVETRRSTYDYSIFLGGNLVSRSAKKQPTIARSNCESKYRAMANVATELMWFTHLLRDLHVYSAPPTLLCDNKSAIFLSQNPVAHKRAKHIDIDYHFVCELVLSKKLITQFVPSHLQLADIFTKSLSRPLFQLFHSKLCIGPNPTLCLRGDDRKENI

SEQ ID NO: 141420 - protein, 50 aa, Glycine max
  Coding DNA Sequence Number=SeqID_24642
MECVDLRHEFSAEAEQQGRRQWARRNPDREARRWDRPCGTGSRHHGHHND

SEQ ID NO: 141421 - protein, 335 aa, Glycine max
  Coding DNA Sequence Number=SeqID_24643
  Gene Ontology: Mol. function=oxidoreductase activity; Cellular component=integral to membrane; Biological process=electron transport
  Homolog annotation: Hit_ID=Q1H2I6; Match level="QueryCoverage=89%, HitCoverage=73%, E-value=8e-99, Identity=56%"; Hit description=L -sorbosone dehydrogenase, putative
MLALDTQGRLLVSLTDTGRILRLNQQGEAEVIAQGLNAPHGLALLGDDLLVAEQTGVVKLPKQGDGWGAPQPLIRNLPSGGHSLKTVKVSPDGYIFINVGSSCNVCLEDNPLRATLLRYTTEGRPAGAVLTVGRHAQSAIWSTGLRNTQGFTWHPETGDMFATNNGADNRSAIKNGKTDDDLPPEHLNKIEAGKHYGWPYCWGDPGQPGQLFQDPNFTGEPDICKQAQAPALTMPAHSTPIGMTFLQHSRLPTQIQQDAIIALHGSWNRKQPSGYALLRVQFRNQLPVAAVPFISGWLQGQKAWGRPVDVIVGADGWLYVSDDLTGWIYRIRSTQ

SEQ ID NO: 141422 - protein, 188 aa, Glycine max
  Coding DNA Sequence Number=SeqID_24644
  Gene Ontology: Mol. function=nucleotide binding; Cellular component =membrane; Biological process=translation
  Homolog annotation: Hit_ID=Q5R056; Match level="QueryCoverage=63%, HitCoverage=49%, E-value=6e-35, Identity=58%"; Hit description =Signalling protein containing EAL domain
  Pfam annotation: Domain name=EAL; Domain location=1-117; Score=-45.0; E_value=1.2e-07; Accession=PF00563.11; Description=EAL domain
MFEVTEAEKITDHAHLKNIFAEYKKHQFLTAIDDFGAGYSGLNLLAEWQPDIIKLDMNLIRDINQNKTKQLIVKSILDVCQGLGIQVISEGVETRDELHVLVDFGVNLFQGYYFAKPLFEGLPTRLPALLLVTPALALVFRPQVQPAMFDQMTDNRMFFNDARYFGPAGHNHYRQPERFMYPAITIME

SEQ ID NO: 141423 - protein, 132 aa, Glycine max
  Coding DNA Sequence Number=SeqID_24645
  Subcellular localization annotation: CTP_CleavageSite=63; ConfidenceScore=5.51e-01
MKDGRNTSSGDVSSPSRTSQTHLKLSGRLPLQSLVSADLHTTKSLKLYRTWTFLSVELSRHVEASRKGQTRFQNLISGLNCEWTEAVRLAGWPFAQQTCTTHPSSRFFLALSRGMLRSADGSLSQQIDLVRG

SEQ ID NO: 141424 - protein, 56 aa, Glycine max
  Coding DNA Sequence Number=SeqID_24646
MKFGGAVPFLIPMTRGGGHNPLFEDSPSESGSGAASVRYGLISNDTHEARCKCKVV

SEQ ID NO: 141425 - protein, 126 aa, Glycine max
  Coding DNA Sequence Number=SeqID_24647
MNWHVHVVYVHGGCINLVGRSIHGGLEWLKNLSISEGMLRRFNLSMVIALDGAHVRYIGCCVCSWGAKCTDLVGWPIRGGQAWLKNLSISEGMLRRFNWSMVFGTFLWPRSYVGTPLGPRLITYGG

SEQ ID NO: 141426 - protein, 256 aa, Glycine max
  Coding DNA Sequence Number=SeqID_24648
  Gene Ontology: Mol. function=protein dimerization activity; Biological process=electron transport
  Homolog annotation: Hit_ID=Q1S735; Match level="QueryCoverage=65%, HitCoverage=33%, E-value=2e-31, Identity=44%"; Hit description =Probable transposase [imported]-Arabidopsis thaliana-related
  Pfam annotation: Domain name=DUF659; Domain location=14-139; Score= -0.8; E_value=2.7e-07; Accession=PF04937.6; Description=Protein of unknown function (DUF 659)
MKHHFAGTNQNVVPFSKIPHDVKEIFVKLLKTKEKEGTSKVVILKTSNQTCEDRDVVIQDICKCVHGNALPFNSLLDSIVEGIGEKNVVQVVTDGASNLVAAGKKLLEKITSHCIDLILEDIGELPVLYNTIDNAKKSTTYKYRHTWALNLNRKYSKGRELARLALTRFATYYLTLNCIQQQQNAIRSMFASEEWATSPHASKSEAKQVTSLVLSDARFWKSITYCLKCVTPLVKVLRLVDGDSGKIAIDANTSRT

SEQ ID NO: 141427 - protein, 655 aa, Glycine max
  Coding DNA Sequence Number=SeqID_24649
  Gene Ontology: Mol. function=hydrolase activity
  Homolog annotation: Hit_ID=O82022; Match level="QueryCoverage=97%, HitCoverage=38%, E-value=2e-95, Identity=38%"; Hit description=ENBP1 protein
  Pfam annotation: Domain name=AT_hook; Domain location=126-138; Score =7.7; E_value=1.1; Accession=PF02178.9; Description=AT hook motif
  Pfam annotation: Domain name=AT_hook; Domain location=23-35; Score =4.9; E_value=3.3; Accession=PF02178.9; Description=AT hook motif
  Pfam annotation: Domain name=AT_hook; Domain location=248-260; Score =5.3; E_value=2.8; Accession=PF02178.9; Description=AT hook motif
  Pfam annotation: Domain name=AT_hook; Domain location=293-305; Score =8.6; E_value=0.75; Accession=PF02178.9; Description=AT hook motif
  Pfam annotation: Domain name=AT_hook; Domain location=94-106; Score =5.9; E_value=2.2; Accession=PF02178.9; Description=AT hook motif
  Pfam module annotation: Pfam domain module=AT_hook::AT_hook::AT _hook::AT_hook::AT_hook; Domain location=126-138::23-35::248-260::293- 305::94-106
PLLSVEEGSADDEGAGLGEIVRPKKRGRPKGPKKLGRPEGSEGRKKSVVLVGNKVVGEIAGPNKCGKTKGSKNKIKNVVEVGNEVAGAGEIAGPKKHGRPRGSTKIKKNALEVNNEVSGAGEITGFKKRGRPKGSTKKRYTVVYASSNEVACEVARQDLENKMLSNLCQKVSDELVSINNKYGPAMSTRSNSRSFVFEGQKFPGMSNDINLEGDGGSTSVWSSGLEKEKGRSPKPVKEIENSKITWPIVKRGRPKGSRNKKIKLIGQVRTKHGRPKGYKSKAEEAGNNFDKGGKKRGRPKGSHRKEKESAYHFDSLIERHGLVAEKEGGTSAESASKNDTGQEKKIYSCQRSSRITRQAIKQSQSRGLKEKTPAAVTIADENEPNGVTDRSMTNARGQSLQKHKSTRFSKVLSRIMPQNDLQEECITLLEDQVHEVKKSHFLLECSENPRNENTKRTGLTCATSNDQRRSSERLKALLIDGKNFQGVGREETVYHGLESSALMCDNGKKKEARTLRCHQCWQKSRSGIVICTECKRKRYCYECITKWYPDKTREEIEVSCPFCLGNCNCRLCLKEEDISVLTGTGEADTDVKLQKLFYLLDKVLPLLQSIQLEQISELKVEARMQGSQLLEEEVVHSLIDDDDRVYWYYIMNPYG

SEQ ID NO: 141428 - protein, 539 aa, Glycine max
  Coding DNA Sequence Number=SeqID_24650
  Gene Ontology: Mol. function=hydrolase activity
  Homolog annotation: Hit_ID=O82022; Match level="QueryCoverage=99%, HitCoverage=21%, E-value=1e-83, Identity=64%"; Hit description=ENBP1 protein
  Pfam annotation: Domain name=JmjC; Domain location=345-466; Score =71.9; E_value=2.1e-18; Accession=PF02373.13; Description=JmjC domain
MLCIDQVNILIHTAEVKTPPWQPRIIKKIQKKYEVEDMHELYGKDSKAIGSCRRKRQKCHVGITRNPKTPEKADTSGRDSTLPGSQLKEKLNEQQSRLLNMGESRSDKEACIQGLSESAKSKLSLNVGEQEVLNLNSRLQDFDLNNHDSSCIILEKDSEGISLPEHMQFKTCTNDDYEKGRISAMHLMKDKFCSIYDQSDTRSVFDDLNLPTPQARVNQEHQKNYIEQSRFKSRCIHFEELPYYSGKNVSDLLFPQEQFSQHYFSVCGNGVDNTVLQDVTDTGGDFPLDESYGQDPDNDIGGYPNTSESHLPCTSTEDTKFVNGLNSLDTPCSDINVEKIESVKNDTSSNNFCQNDDHLETQYGSAVWDIFRRQDVPKLTEYLKKHHREFRHINNLPVIHPIHDQILYLNEKHKKQLKQEFAINFCLPGVEPWTFEQHLGDAVFVPAGCPHQVRNRKSCIKVALDFVSPENVQECIRLTEEFRLLPKGHRSKEDKLECGCIISAPVTLLVSGVPYTRHSLFLDKEDGTICCGCCNNRSH

SEQ ID NO: 141429 - protein, 193 aa, Glycine max
  Coding DNA Sequence Number=SeqID_24651
  Gene Ontology: Mol. function=protein dimerization activity; Biological process=regulation of transcription, DNA-dependent
  Homolog annotation: Hit_ID=Q1T3H7; Match level="QueryCoverage=89%, HitCoverage=27%, E-value=2e-44, Identity=49%"; Hit description=Zinc finger, BED-type predicted; HAT dimerisation
  Subcellular localization annotation: CTP_CleavageSite=52; ConfidenceScore=5.34e-01
MSYMHTYLSSAIATQHKVSKKQKSDSSTKVISSPSLPKIDQEACRNALIKMFAAMGLSFRMVEHEAFQKFLSIIALFLVVISRTILARDVHKLWSSEKVKLKNFFSRHNHRICFTMDTWTSSQNLDYMSLTTYFIDNDWKLQKKVINFCQVSSHTWKNLAKTVEHCFSSWGLTRVLTLTIDKALSNDKTIEYL

SEQ ID NO: 141430 - protein, 76 aa, Glycine max
  Coding DNA Sequence Number=SeqID_24652
MSIGEEYSGMMGKIVEDMLSDRGTRCHRLMHGGSPLPTAKNHDRREDGKAYLIAKHGKISTPVKIATMKARNSALA

SEQ ID NO: 141431 - protein, 120 aa, Glycine max
  Coding DNA Sequence Number=SeqID_24653
MRYETWAPSSAMTMDKLKILIHPPQEMLRLFNRTISPTKDIRQGQSTPHEHTQYPTDIRQGQCTPMYMRNLHHHNVISTSSASRLGITLNMNVISFSVALLITTTSSHINMIINNIINSY

SEQ ID NO: 141432 - protein, 595 aa, Glycine max
  Coding DNA Sequence Number=SeqID_24654
  Gene Ontology: Mol. function=nucleoside-triphosphatase activity; Cellular component=integral to membrane; Biological process=cell division
  Homolog annotation: Hit_ID=Q8LBL6; Match level="QueryCoverage=90%, HitCoverage=87%, E-value=1e-165, Identity=57%"; Hit description=Cell division protein FtsH-like protein
  Pfam annotation: Domain name=AAA; Domain location=343-527; Score =279.3; E_value=7.4e-81; Accession=PF00004.19; Description=ATPase family associated with various cellular activities (AAA)
  Pfam annotation: Domain name=AAA_5; Domain location=343-473; Score =9.7; E_value=0.00033; Accession=PF07728.4; Description=ATPase family associated with various
  Pfam annotation: Domain name=FtsH_ext; Domain location=149-330; Score= 77.6; E_value=3.8e-20; Accession=PF06480.5; Description=FtsH Extracellular
  Pfam annotation: Domain name=TniB; Domain location=288-564; Score= -109.9; E_value=0.1; Accession=PF05621.2; Description=Bacterial TniB protein
  Pfam module annotation: Pfam domain module=AAA::AAA_5::FtsH _ext::TniB; Domain location=343-527::343-473::149-330::288-564
SYGSLIVEEAWLVFHYLAILGHLLPQLWLKEDILGRIPSLRVPHCCKTPHGVSSNNKIEPLVSRSKGEKKTHYGKDGTDRLKKRFSLRLRPRLRLLAMRMKRASIKSILNELGILIRKNIRAVAFSASISTVFCLCFLFLKLTALPPPKSVPYSDLIISLQNGHVEKVLVEEGSRRIYYNMKSQNIENDPVSGEESEVADASIDKDVDKIGSEGTSKAGQTPVGNVLKKFSKTRASIPEWQYSTRKIDHDGKFLVGLMREKGVTYSSAPQSVLMSMRSTLITVITLWIPLIPLMWLLYRQLSAANSPARKQRPNGQTVGFDDVEGVDSAKVELVELGAKLPRGVLLVGPPGTGKTLLARAVAGEAGVPFFTVSASEFVELFVGRGAARIRDLFNAARKFAPSIIFIDELDAVGGKRGRSFNDERDQTLNQAKMDGFESEMRVVVIAATNRPEALDPALCRPGRFSRKVYVGEPDEEGRRKILAVHLRGVPLEEDSSIICHLIASLTTGLVGADLANVVNEAALLAARRGSETVAREDIMEAMERAKFGISDKQLRSSKISKELSKLFPWMPSLMGKSERRQDDLQGPLGYQSLSS

SEQ ID NO: 141433 - protein, 604 aa, Glycine max
  Coding DNA Sequence Number=SeqID_24655
  Gene Ontology: Mol. function=DNA binding; Cellular component=beta -galactosidase complex; Biological process=DNA integration
  Homolog annotation: Hit_ID=Q1T2A5; Match level="QueryCoverage=99%, HitCoverage=74%, E-value=1e-118, Identity=45%"; Hit description =Integrase, catalytic region
MPTPFLDNKAPYEKLYGHPYDITILRVFGCLCFPSTLSANRKKLDPRATTSIFLGFKSYTKGYVTFDLKTRAINVSMNVIFYEDCFPFNVQDSHDPITVLPKPISSFHDDIEFPASTSSILPFVPSDSSPTAFIPTKIQQTLRRSERQIKRPCKYKDFHVSYLPLIVASHSIGSLYPLNSILSYSRLSPSYRSVIVFVTQQVEPKSYTEASKDPNWIQAMNVEIRALEANHTWTFTDLPPHKTAIGYLNEEVYMVIPQGMNPKKPGLVCKLQRSLYELKQASRQWYARLSSFLISHGYKQCAFDYSLFLKHQNNYITTLLVYVDDIVLSGNNFTEIQNITHLLNNAFKIKDLGDLRFFQGFEVARTSTGINLCQRKYALYILTDIGMFGFKPISTPSDYTTKLHQHSGSPISTEDASSYMRLIGKLIYLTNTRPDIIFVVQHLSQFVAHPTSAHQQAASQILRYIKGSPSAGIFFSADGSIQLKGFSDSDWDSCIDTRRSITGFTIYLGSSLISWKYKKQATVSRSSSEVEYKALASATFKLHWLTFPLEEFKVVFHQLVVLYCDNKSILHIAANPMFHERTKHIKIDCHIVREKILVGLVKLL

SEQ ID NO: 141434 - protein, 255 aa, Glycine max
  Coding DNA Sequence Number=SeqID_24656
  Homolog annotation: Hit_ID=P12628; Match level="QueryCoverage=34%, HitCoverage=17%, E-value=3e-24, Identity=75%"; Hit description=NADP -dependent malic enzyme
  Pfam annotation: Domain name=malic; Domain location=108-234; Score= -24.3; E_value=3.8e-06; Accession=PF00390.9; Description=Malic enzyme, N-terminal domain
MECKGDHISHLSLHSKMRPICKESMPRDVKGIHGRTGFNQDKINSFIEPKAYQEMERMSPNPTINTADMEDMQGTTGFNQDWINATEKVIEPNADQEMKWMSLNATVTEDMEDIQARIGFNQDGINVAIEPKADPEKERMFPNPTTNTADMEYIQGKIGLNQNKIIVCLPITIDVGTNNEMLLNDEFYIGVKQKRATGQEYAEFLKEYMHAVKQNYGEKVFIQVTDYALLWFNVGYIICGIRRISCIPKISWGGP

SEQ ID NO: 141435 - protein, 227 aa, Glycine max
  Coding DNA Sequence Number=SeqID_24657
  Subcellular localization annotation: CTP_CleavageSite=5; ConfidenceScore=5.44e-01
MFRISKMHARGSNFGNSYKQTPGSSSSFVPNHPLQRDFDLRHQNYIRNQASSTILRSRHLNEQGHASVLEKFMKNRLLFVEAATKEYINRQTIMQRMDTQLKKLHAPKCSQVNSSIACTSRMLPFSWLLQARSNGRVPEPAFQNVAGPITIATDYCAMAVDSKNGFPNGGLSYSSIVPQPVFSPDNHPSIATCTDLDVLPNSFVSGWRSNPKASSKEDVSGEVWRLF

SEQ ID NO: 141436 - protein, 150 aa, Glycine max
  Coding DNA Sequence Number=SeqID_24658
  Gene Ontology: Mol. function=oxidoreductase activity; Cellular component=mitochondrial nucleoid; Biological process=metabolic process
  Homolog annotation: Hit_ID=Q69XE0; Match level="QueryCoverage=82%, HitCoverage=20%, E-value=2e-36, Identity=59%"; Hit description =Putative cytosolic aldehyde dehydrogenase
  Pfam annotation: Domain name=Aldedh; Domain location=2-150; Score= -321.7; E_value=0.069; Accession=PF00171.12; Description=Aldehyde dehydrogenase family
MHNTFVGEVCAAGSRVLVQEGIYDEFEKRLAEKAKAWVVGDPFDPNVQQGPQDPPLVTYITTCYGRLTKSNLKKILSYIEHGKREEATLLTGGKRVGNKGYYIEPTIFSNVKEDMLIAQDEIFGPMIALMKFKLKVKDVLYLKLLMQSSL

SEQ ID NO: 141437 - protein, 99 aa, Glycine max
  Coding DNA Sequence Number=SeqID_24659
MVDAGVGLTRPNPNPIFACKRGEQHEQERHHANETQHPASAPAPRRRRRQTRHPARDVAPAHHAREHGRRRTRAWTAAAATALQSATEGNWMMEKLKEM

SEQ ID NO: 141438 - protein, 128 aa, Glycine max
  Coding DNA Sequence Number=SeqID_24660
MGKEEVNHHVQEEVNGGKRNKDILLTHVGALRRHDVSYATMETWGSRMVWLRCYGLPLHFWNVACFSKVVSTFGLKVDADNAILTRLAYARILVKAYKQIYILLERISINGHIIPIRTIKASLVPGLE

SEQ ID NO: 141439 - protein, 210 aa, Glycine max
  Coding DNA Sequence Number=SeqID_24661
  Gene Ontology: Mol. function=protein serine/threonine kinase activity; Cellular component=cytoplasm; Biological process=protein amino acid phosphorylation
  Homolog annotation: Hit_ID=Q53VM2; Match level="QueryCoverage=99%, HitCoverage=40%, E-value=2e-88, Identity=80%"; Hit description =Ser/Thr protein kinase
  Pfam annotation: Domain name=Pkinase; Domain location=2-206; Score =96.7; E_value=6.9e-26; Accession=PF00069.15; Description=Protein kinase domain
  Pfam annotation: Domain name=Pkinase_Tyr; Domain location=1-210; Score=-102.8; E_value=3.7e-06; Accession=PF07714.7; Description =Protein tyrosine kinase
  Pfam module annotation: Pfam domain module=Pkinase::Pkinase_Tyr; Domain location=2-206::1-210
MKVLDRSTIIKHKMVDQIKREISIMKLVRHPDVVRLHEACGNCFPFSCCHSQALLSVVKRFFLQVLASRTKLYIILEFITGGELFDKIIHHGRLSEADSRRYFQQLIDGVDYCHSKGVYHRDLKPENLLLDSLGNIKIFDFGLSAFPEQGVSILRTTCGTPNYVAPKVLSHKSYNGAVADVWSCGVILFLLLAGYLPFDELDLTTLYSKA

SEQ ID NO: 141440 - protein, 116 aa, Glycine max
  Coding DNA Sequence Number=SeqID_24662
MKNEVYTIVTCVEYHDDSYKQTMLGLYTHFSLKAGVAAHDVQRYVKEPDRAAQCTRQDKSQMKELKLQDPRCRIQCPGHPARKYWTHKSVISLTDCAGSTMSDTMSRTSCPKILDT

SEQ ID NO: 141441 - protein, 51 aa, Glycine max
  Coding DNA Sequence Number=SeqID_24663
IFGQDVLDIVSDIVDPAQSVKDITDLCVHPIWFLDITLDIMCSNSSFPSLS

SEQ ID NO: 141442 - protein, 241 aa, Glycine max
  Coding DNA Sequence Number=SeqID_24664
  Gene Ontology: Mol. function=histone acetyltransferase activity; Cellular component=nucleus; Biological process=regulation of transcription, DNA-dependent
  Homolog annotation: Hit_ID=Q9C5X9; Match level="QueryCoverage=93%, HitCoverage=14%, E-value=6e-49, Identity=40%"; Hit description =P300/CBP acetyltransferase-related protein 2
  Pfam annotation: Domain name=ZZ; Domain location=107-153; Score=6.5; E_value=0.036; Accession=PF00569.8; Description=Zinc finger, ZZ type
  Pfam annotation: Domain name=zf-TAZ; Domain location=166-234; Score =1.8; E_value=0.00022; Accession=PF02135.6; Description=TAZ zinc finger
  Pfam module annotation: Pfam domain module=ZZ::zf-TAZ; Domain location=107-153::166-234
MHCHEVIANGKRWFCTECKKFQECERCHTVHSHISAKGERHRLHQVLMDDVLGDTKENDIILDNGLFDSRHNFLSFCQRNRFQFDSLRRAKYSSMMILYLVKNPTLLTVGTTCRVCSKNNVSQRYWKCENCPEFTVCSECYNERGANCHAHTLNEAYSPAQSPSGNQELQQNSAMLQQLLDVIEHASLCHSIKTQPCTYPHCRQIKKLFAHASRCEIRFSGGCQFCKKGSEETSRMDSNAI

SEQ ID NO: 141443 - protein, 300 aa, Glycine max
  Coding DNA Sequence Number=SeqID_24665
  Gene Ontology: Mol. function=histone acetyltransferase activity; Cellular component=nucleus; Biological process=regulation of transcription, DNA-dependent
  Homolog annotation: Hit_ID=Q6YXY2; Match level="QueryCoverage=100%, HitCoverage=21%, E-value=1e-102, Identity=54%"; Hit description =Putative HAC5
  Pfam annotation: Domain name=DUF906; Domain location=36-254; Score =374.6; E_value=1.6e-109; Accession=PF06010.2; Description=Domain of Unknown Function (DUF906)
HQICALYNDKRDLDYRAEYTCPICRLKEIGNGMHVPLPKTAAMFSANDLPRTMLSDHIESRLFKRLWQENEDWAKAGYKNLDEVILLFQKIEGVDVCLFAMYVQEFGSECGYPNQRSVYISYLDSVKYFRPKRVTKSGEALRTIVYHEILIGYLDFCKKRGFATCYIWACPPMKGEDYLLYCHPDTQKTPKKDKLRHWYHSMLRKAAEENIVVGSTNLHDHFFVTTGSCDSKVTTARLPYFDGGFWSGAAMDKARDSEQECGGDYKMIFDKVVSKRCLKSMGHVNPPSEGTAKDILVMHK

SEQ ID NO: 141444 - protein, 209 aa, Glycine max
  Coding DNA Sequence Number=SeqID_24666
EVQEQMKADIEAMKEQMTIMMEAMMSIRKMMEVSTTTIIAASTLTEVDSTHPFSLNQANRLASDKVSQGGEALGSAGGSHFVQSADNSAPILIESQQPQSGQAQSFGGIPLPNTLGGPQYRPEPQPLHFTMGRVPLAMVERENFDHIEERLRAIEGGRDYAFADMVELCLVPGIVILPKFKVPDFDKYKGTTCPKNHLKMYCKKMGAYA

SEQ ID NO: 141445 - protein, 84 aa, Glycine max
  Coding DNA Sequence Number=SeqID_24667
MRERNVLIAKLATLREKELEKEYYDILMKDTSTISTLQLSYPIFIWGLSFVDLLILASRLMVLNTSYSAKQGTIQYFDQECQRY

SEQ ID NO: 141446 - protein, 351 aa, Glycine max
  Coding DNA Sequence Number=SeqID_24668
MFWINKMHAKGSNLENSCKQTPGSSSSFVPNHPLQRDFDLRHQNYIRNQARFFFDWRKDPGISRYRNLIKIDISTILHSRHPNKQGQAYVLANFLENRLFVEAASQDEYINRQTIMQRLDAQLKKLNAPKCSQVNSSIACTSQMVPSSGLLQARSNGSVLEPSFQNVAGPINNATDYCAVAVDNKNGFLNGGLSYSSFVPQPIFSPDNLPSIATCTDLDVLPNSFVSGGRSNPKACSKSVSSYFPQRQADDWKTLLLKYGDCFRTTMGKFVQSESPNLMTPQDALRGLSKVSDLPPVPRSLGDIRQHQHRKRDFQQNLKLCMQPYGLPGKTYMAQPNALSNQGVKCWGRKH

SEQ ID NO: 141447 - protein, 164 aa, Glycine max
  Coding DNA Sequence Number=SeqID_24669
PSASDFTPSPKQVKFAPTAAPMYPYLFDESDQLILTPLSDLMHFNSVEAEEASFIPSWEETKTIRDMGNDDCMRHLQVLWEELQPFGFDLTWLEPHVQSAMSAKAYFERVDYLKSIKVNIASLEIELKKLKTKLVVAQVDLEVARRDLPEVENDFRERDMDAEL

SEQ ID NO: 141448 - protein, 287 aa, Glycine max
  Coding DNA Sequence Number=SeqID_24670
  Gene Ontology: Mol. function=nucleic acid binding
  Homolog annotation: Hit_ID=Q651K8; Match level="QueryCoverage=66%, HitCoverage=23%, E-value=2e-34, Identity=42%"; Hit description =Proline-rich spliceosome-associated protein-like
  Pfam annotation: Domain name=zf-CCHC; Domain location=212-229; Score =21.1; E_value=0.00032; Accession=PF00098.13; Description=Zinc knuckle
MEGDEHMNEVPSENSNLGSDSLEKENILEDEKEDLQDGLKLKVVTEEVSGGLLAENGCISLEDGSLKRSLETPLAATGMAVTECFSFVADFMARKDASEVLESGEETFFPALHVGLEKTSAVSFWMENQTRNDKNKDFIPLADNTVPLYDRGYALGLTSADGSSNVDGKFSSDDILICKKSLLGQLMLPSAADCVVVGMLCMYGLGIIDAAARCFNCGSYNHSLRECPRPRDNIAVNNARDKLKSRRNQNSSSRHPTRYYQNSPAGKYDGLRPGSLDDATRKLLGLR

SEQ ID NO: 141449 - protein, 236 aa, Glycine max
  Coding DNA Sequence Number=SeqID_24671
  Gene Ontology: Mol. function=nucleic acid binding
  Homolog annotation: Hit_ID=Q651K8; Match level="QueryCoverage=79%, HitCoverage=25%, E-value=6e-27, Identity=41%"; Hit description =Proline-rich spliceosome-associated protein-like
  Pfam annotation: Domain name=PSP; Domain location=1-39; Score=29.7; E_ value=1e-05; Accession=PF04046.7; Description=PSP
MGCIVELDPPPWLNRMRELGYPPGYLDVDNEDQPSGITIFTDSEIADQEDGEIMEANASKPKRKKTVKFPGINAPIPEKADERLWGTRAGPSSSDISRNLSLPQHRSNYSTDYGSRGYHREHRLGDLRDEGPPGDPGHSSFMFSFHPRFGGHDSALRSPSMARSQSDRSRSPMHDEESSMPFSFHSLHYSSSERHFSPLDRDSGRLGSWTSESSTIVTTAVGGEDGTNRINHIGRF

SEQ ID NO: 141450 - protein, 78 aa, Glycine max
  Coding DNA Sequence Number=SeqID_24672
MEEPPDAILAKTKLKLQDWTLAQSATKISSLGIVLLKFGIPSYAVLDRVVYFDWQNLMDLIEVHPTTVNGGAHRGATS

SEQ ID NO: 141451 - protein, 45 aa, Glycine max
  Coding DNA Sequence Number=SeqID_24673
MEHDLAFIDAMAENTHLKDLQAEVRGQADDIKKLMELLDLHDQKQ

SEQ ID NO: 141452 - protein, 617 aa, Glycine max
  Coding DNA Sequence Number=SeqID_24674
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=85%, E-value=1e-121, Identity=52%"; Hit description =Chromo
  Pfam annotation: Domain name=Chromo; Domain location=525-579; Score =33.6; E_value=6.8e-07; Accession=PF00385.14; Description='chromo' (CHRromatin Organisation MOdifier
  Pfam module annotation: Pfam domain module=Chromo::RVT_1; Domain location=525-579::376-594
MAKLFKLQQTGIVSDYYLKFMSLANRSSGLSDDALLNFFLSGLHAEIRRDVVALLPTSLLKVVVLAKLYEERYLLVTKPGTCPNRQFLFFQLDETSMDDVNSPLDTGQQFIEEETVVDNHHLSLNALKGGKSVGTIRFLEFIGKLSVTVLIDGGSSDNFMQPRIAKFLKLLVEPALSFKVMVGNGNYVAAEGMVQNWIIQAQGNMFQLPVYLLSISGVDLILGASWLKTIGPHVADYASLNMIFLHENKFITLQGEVDHVPIQAHLHHIRRMVNTHSIAEVYTIKMVDPTAQAIPLPELSDDMEPELALLLCNYASVFATPTSLPPHCTQDHYIPLIEGSGPIKVKPYRYPHSQEEEIEKLVGDMLKEGIIQPSKSLFSSPIILVKKKDGSWHVCTNYRAINAITIKDSFPMPTVDELLDELFGASFFSKLDLRSGYHQVLLAPEDRHKTAFCMHHGHFEWLVMPFRLTNAPVTFQEIEYLGHTLSGQGVAMDTTKLDVIRKHRDLQFEQYIPLPLTTTEFGPSVQPFQVLSFRTVMHHSKSVPQVLIQWDSLGPSTATWEDVQEIQESFSEFNLENKVALDGGSIVTCTGRNVEFDKEGKLVNQKSHVEHDPQVGD

SEQ ID NO: 141453 - protein, 88 aa, Glycine max
  Coding DNA Sequence Number=SeqID_24675
MSIKVEEYISQVLTKNTDLFAWQTSNMLGIDLEFHCHRLAICPEARLDEAKTAFTTDTTNYWYSVMPFGLKNVGAMSKANGQDIHEPI

SEQ ID NO: 141454 - protein, 129 aa, Glycine max
  Coding DNA Sequence Number=SeqID_24676
MRVHITFYKVEDEVFPLILIRSTRFCGIEVDYLVGHRVRRFTQSGGSSNDDPSHHHGGFDAANGDVSSVLANDVATVDGVVFPNVGVTAPVGGSIIVEGGLRPNSSVHLNPREDEAESHLANRPPLFKS

SEQ ID NO: 141455 - protein, 66 aa, Glycine max
  Coding DNA Sequence Number=SeqID_24677
MSFSGKVLGDIEYWTNEFKKIDAKFNKARVELTKAYEALVESTKICFNCELRVVKALDLETISSDI

SEQ ID NO: 141456 - protein, 145 aa, Glycine max
  Coding DNA Sequence Number=SeqID_24678
MHTNNWKLTYDCQDTKNFYLTKRPLNTGIFFSIFLNKLMLLPEIAKKREGETRNQVGFRGDVFDISAQRFLPNEAMPEAVISGIAPMSGAVVVRDGVRSYWLRVNVLRREHAAAMIGEGGHRRRRIRNQRDCVVLDRKRINEIIA

SEQ ID NO: 141457 - protein, 160 aa, Glycine max
  Coding DNA Sequence Number=SeqID_24679
MSSQSSSICCIRPRKPRKLIGSVGPKEHDDALHVDRFFSYLCCCLALVDAPEFRSCIVDFPVWWTEAMPFYHHFFMFVIEIIILFESPSLPMDNEKSFVRYESSSDDSEATLSVLVSPQSVLPSPDGEEGFKEDISIKEDSSMDEEDPVMESKSMGEDSS

SEQ ID NO: 141458 - protein, 61 aa, Glycine max
  Coding DNA Sequence Number=SeqID_24680
MAEGISSPRQASCIGLKAFQGPVCVQDEDTYSQEFHEDRHTLQGKKGKEWMNMMARLCRLR

SEQ ID NO: 141459 - protein, 49 aa, Glycine max
  Coding DNA Sequence Number=SeqID_24681
MAVMTPIISAKREAANQSRKSAMWFLKIPPQLALSEHPLTAMWFKFTNG

SEQ ID NO: 141460 - protein, 97 aa, Glycine max
  Coding DNA Sequence Number=SeqID_24682
MEHSAKWPKAQTQELDWLPKPKVSGKEKVETPKESEEVQALKAELERAQAVKEKFKRMAIKVRKECEKLRDVNVATTEALERETKRARKEKWGQNKF

SEQ ID NO: 141461 - protein, 143 aa, Glycine max
  Coding DNA Sequence Number=SeqID_24683
  Gene Ontology: Mol. function=ATPase activity, coupled to transmembrane movement of substances; Cellular component=membrane; Biological process=transport
  Homolog annotation: Hit_ID=Q2P8N0; Match level="QueryCoverage=98%, HitCoverage=55%, E-value=3e-65, Identity=90%"; Hit description =Permease
MTIVRREVARIMRIWGQTLVPPAITMTLYFLIFGNLIGSRVVHRAGPGDDERDPEQLRQHQLLVLRRQVRSSRGRTAGQPDAELGDPVGLRGRRGAARPDGGRDRADHRDVLHPGAHPAPAGDADHGDPGRDDLLAGRLHQRG

SEQ ID NO: 141462 - protein, 44 aa, Glycine max
  Coding DNA Sequence Number=SeqID_24684
EHESYIDYRGKRLDVSGGPLNLDLQRGNEVSLEINLRWYVTPQL

SEQ ID NO: 141463 - protein, 86 aa, Glycine max
  Coding DNA Sequence Number=SeqID_24685
MISSSQLRIHRSKSPAFVDHPKRSLMVFDLLDNSEPSSRVFLFDNMLLVVPTVAICLSKGMIPLETIKKGMITLGIITKSLLVPPV

SEQ ID NO: 141464 - protein, 143 aa, Glycine max
  Coding DNA Sequence Number=SeqID_24686
GPQYHPQPHPSHSTAIKNPHAMAEMGKLDHLKERLRAIEGGEDYAFANLEELFLVPNIITPPKFKVLNFDKYKGTTCPKNHLKMYCRKMGAYAKDEELLIHSFQESLTGVAVTWYTNLEPSRVYSWKYLMVAFVRQCQYNGFG

SEQ ID NO: 141465 - protein, 32 aa, Glycine max
  Coding DNA Sequence Number=SeqID_24687
MTNANYLQESLHSVSNGNLRFGTAQTLVSRFL

SEQ ID NO: 141466 - protein, 249 aa, Glycine max
  Coding DNA Sequence Number=SeqID_24688
  Homolog annotation: Hit_ID=P76053; Match level="QueryCoverage=68%, HitCoverage=90%, E-value=4e-53, Identity=61%"; Hit description =Hypothetical protein ydaL
MQWPVVISPEGTAPRRIAQHMLDEQGCSLPGNCVETSSTSLARQLALRYDYVWFVPSGARPLALAQRGSADGHHPQISQLTAAFGVAFAIVEARAIGFAQPDIDCTAAAVLRLRAAEGLNIVKLPQPACHVAADNIGVRFIIPPFAMNNQQIAQALFARFQHKAEQRLPAGLHRLAQQIKTGVQRIFAQPQLIEHALLNAIGFIFQRRVARDNLKEAARQEVFRCVIMRLLARRFGRRRAQPLGVGAIF

SEQ ID NO: 141467 - protein, 107 aa, Glycine max
  Coding DNA Sequence Number=SeqID_24689
MASQKRESIASSSSQLKYDRYKFSSPKAWDRYTNNMFGRKIIPERKVQLSFNDFEEFQGELNRRNWHKKIANLEEGSIDVALVKKFYTNVYDHEDKSPKQVKKHQWS

SEQ ID NO: 141468 - protein, 86 aa, Glycine max
  Coding DNA Sequence Number=SeqID_24690
MKEVAESLKEFVEVTKKKMENKKKMEIKEAQEVVHEVVSELDNIPNFNGALRHRAIDWLTENPIKFTIIKALSLDDKEDYISSFMP

SEQ ID NO: 141469 - protein, 131 aa, Glycine max
  Coding DNA Sequence Number=SeqID_24691
SQDEATTSLSSSESEKAKGEESSEEIYPQEEGHPLVIKEKCKEALASIATPLGLEFIPQVKKLLDEGLVRKSLNPCALLVPKVGIIRHQVPKIGGMMNVLSGATLFCKITRTPNIFMGLREGAQSMKNLGI

SEQ ID NO: 141470 - protein, 123 aa, Glycine max
  Coding DNA Sequence Number=SeqID_24692
MEREMITMIVDTLPMFYYEKLVGYMPSSFVDLVFTSERIEVGITRGKFDYVAPASTSNRRSRSTGAKRKEGDAHAMTTTPTWPKPQSTPHNTHQYAEHHSSFSARAGNPSNSTPVRQGTFAPL

SEQ ID NO: 141471 - protein, 72 aa, Glycine max
  Coding DNA Sequence Number=SeqID_24693
MARSGMGERGISSRAQKKIKMENMNEEKRTTVRRWRCLQPCTLKLSPTIVGVSECPSLHCYKEYGDDKFKAS

SEQ ID NO: 141472 - protein, 102 aa, Glycine max
  Coding DNA Sequence Number=SeqID_24694
  Homolog annotation: Hit_ID=Q1T2T2; Match level="QueryCoverage=51%, HitCoverage=9%, E-value=1e-08, Identity=56%"; Hit description =Ribonuclease H
MDDQRSNYPLLPIPQKEHFGYHSEKQATKKSTLLLRKMPAQAERPKEPLEAPSVLHFVHRGRGGCQPTSLMIGCLGVFHQLKITSRCSVAHARRHATFRDNP

SEQ ID NO: 141473 - protein, 61 aa, Glycine max
  Coding DNA Sequence Number=SeqID_24695
MEEGIIPILDLTPKEEKRIEGLKRERRIHRDPPVEHWNDLKNSLRKRHILSYYERELMDKL

SEQ ID NO: 141474 - protein, 36 aa, Glycine max
  Coding DNA Sequence Number=SeqID_24696
MLGTSRPQFVLFGSSIVQYSYYEGWGATLSHLYARK

SEQ ID NO: 141475 - protein, 110 aa, Glycine max
  Coding DNA Sequence Number=SeqID_24697
MGSGMAQKNWLSYDANELILIDAFRQHSEIIEDPEHHDSRIFSHIVICLKVKVMFASLQGTACLLHFTPNCDLLPSEGSSAHLLEPYTGRQTHSSELCTQRVATKCGNNS

SEQ ID NO: 141476 - protein, 33 aa, Glycine max
  Coding DNA Sequence Number=SeqID_24698
MERKLLKFQCEEARGSPTTLVPIYGSMTLMTKD

SEQ ID NO: 141477 - protein, 229 aa, Glycine max
  Coding DNA Sequence Number=SeqID_24699
MAEQVTAGNNARELQRIRGRGKITLGGARFASSHCQEAAVRPSVRATPPVSALAVDVNFVIVSTVDAPVAEDVEHDFPSGSHDTSILTNYVHHVTERPKLKLSSHGRKVEKFGRSALETEDIVAATRLSFQIALGEVTITVNDVASLLHLPITVHKKQDMRHFNALRHMFGYPGCETYIAANVTQHSELWQLEHIHLLGCTLFDNKSTTRMHVVFLDAFCHLTQNGSYA

SEQ ID NO: 141478 - protein, 128 aa, Glycine max
  Coding DNA Sequence Number=SeqID_24700
MFSKKEGMMRIMKQAKYSLKAQVEKDEGPSGEGQSPRVEKDEGPSNPCGVYPDLSSFIGSGVYPDLSSLTGSGVYPDLSSFTGSGVYPDLSSFTGSGVIQKLYSLYQVIRPGLNRQNNSPHQASNSRD

SEQ ID NO: 141479 - protein, 156 aa, Glycine max
  Coding DNA Sequence Number=SeqID_24701
  Homolog annotation: Hit_ID=Q9FJE0; Match level="QueryCoverage=63%, HitCoverage=34%, E-value=7e-44, Identity=85%"; Hit description =Arabidopsis thaliana genomic DNA, chromosome 5, P1 clone:MMN10
DKIDSFLKQCPAFPTAFLIGGPADIFVTELTDQLQKLKVEPVLLHYLSEIKILQGMELRMTTSTRLKTCLYSFTSPGGPMYPTRAVRHAAWEALDLLFPVGRYPRHLISLFFRLLYPWYWPSSCWNFVISCIQAVFYSVLGFIFSTWDKIAKPKSQ

SEQ ID NO: 141480 - protein, 165 aa, Glycine max
  Coding DNA Sequence Number=SeqID_24702
MCLGRVAAVSKLKKKLDTTKFATCPLRVSVGNVLDTPTPTPPLTTVSELHRKHLWHLEPEQMNTGEALLDYQDELQITAKSYEVIVKHSRKLHGKCFTDKLYTTITIHGRYMQKGKNLGGCGTVDVRSEEPRATAEVFLNWNTMCNVLEPWAVNIESIIGSGTKR

SEQ ID NO: 141481 - protein, 156 aa, Glycine max
  Coding DNA Sequence Number=SeqID_24703
  Gene Ontology: Mol. function=catalytic activity; Cellular component =integral to membrane; Biological process=cellular metabolic process
  Homolog annotation: Hit_ID=Q9SMJ5; Match level="QueryCoverage=72%, HitCoverage=32%, E-value=1e-58, Identity=94%"; Hit description=DTDP -glucose 4-6-dehydratase
MTNRPELYPGREGSDNRKKAILLCLQNITSNQVIVADNYFTGSKDNLKKWIGHPRFELIRHDVTEPLTIEVDQIYHLACPASPIFYKYNPVKTIKTNVIGTLNMLGLAKRVGARILLTSTSEVYGDPLVHPQPEGYWGNVNPIGTCFSLCLSLYLS

SEQ ID NO: 141482 - protein, 40 aa, Glycine max
  Coding DNA Sequence Number=SeqID_24704
MAREVASATVHQKNSLPLQGPLKFNSCTNFEEVNQFALTT

SEQ ID NO: 141483 - protein, 164 aa, Glycine max
  Coding DNA Sequence Number=SeqID_24705
  Homolog annotation: Hit_ID=Q1RUD8; Match level="QueryCoverage=52%, HitCoverage=17%, E-value=3e-08, Identity=38%"; Hit description=IMP dehydrogenase/GMP reductase
MGSVLIPTVNKPTEGPCRLLKNVRWGISLPLDVVSKKGTNSPDPRIPRLHLCHMHSIMHSSIPPMRYRSFDLHQLLSHFSKHGNKSNRQEVLPSQGQKPRYHQHQGIRAVDGTPPNASLPQDLRKDLRVDHSRGVHKSHCITYPILRPAFEVLHIRRLPISTNH

SEQ ID NO: 141484 - protein, 42 aa, Glycine max
  Coding DNA Sequence Number=SeqID_24706
DQPSSSGGGGASTAQETVSEEPLAPAPSPAATEEETTPAQTP

SEQ ID NO: 141485 - protein, 142 aa, Glycine max
  Coding DNA Sequence Number=SeqID_24707
  Subcellular localization annotation: CTP_CleavageSite=72; ConfidenceScore=5.25e-01
MPSTICGDRAHKTPSGPGGAQQGPGVSGSGYGPLSVLQGARPPRKFVPSPHRDRAHKTPSGPGGAQQGPGVSSSGYVPLDRARKTPSGPEEVQQGLGVASSDYGPLSVLRSACRPQQGRRRAKHHSSLGMAGSGQQMHRHHL

SEQ ID NO: 141486 - protein, 261 aa, Glycine max
  Coding DNA Sequence Number=SeqID_24708
  Gene Ontology: Mol. function=ferric iron binding; Cellular component =chromatin; Biological process=aromatic compound metabolic process
MGIRKKLHPMMTNDGKCVMYAKACFSITSNEKTIFCGVLKKVKMPDGCASNISRCVQLKDKKVSSYKSHDAHFMLHYLLQVAARSTMSNQVSHLVIGLCSLFRCLCQKVVDLTDLNILQLDIRNTLSIRNHFLPSFFDVMVHLPIHLVNEVRSGGLVQFQWMYFLERYLGNLKSYFRNKSCVEGSIAEGYLVEECLTFCSRYLHNGVETRLNRMTRNSDRCVTNEAESPIFFSRIGHLIGGKKNGEAMFLDYKSSEHEKEN

SEQ ID NO: 141487 - protein, 87 aa, Glycine max
  Coding DNA Sequence Number=SeqID_24709
MSWTSYPTSWILQLCALYSNFQYFRAGCPGHCIRHLGSCSFVHCTATSSIFGQDVPDIVSDILDPAASILHLTFHLALCIVQPDLIL

SEQ ID NO: 141488 - protein, 98 aa, Glycine max
  Coding DNA Sequence Number=SeqID_24710
  Gene Ontology: Mol. function=nucleic acid binding
MTLQLVDRSITRPYGVIEDVLVRVKHFIFSADFVVMDISEDIDMPIILGRPFMLTASCIVDMGKRKLELGFEDQKIDFDLFVEDKSTPEHNVCLQELA

SEQ ID NO: 141489 - protein, 461 aa, Glycine max
  Coding DNA Sequence Number=SeqID_24711
  Gene Ontology: Cellular component=integral to membrane
  Homolog annotation: Hit_ID=Q57J05; Match level="QueryCoverage=70%, HitCoverage=46%, E-value=1e-130, Identity=67%"; Hit description =Putative inner membrane protein
  Subcellular localization annotation: CTP_CleavageSite=22; ConfidenceScore=5.10e-01
MADRQRRLPLLPALRSYLSLKSAALRTAARFAVMLMFGSALALFFNIPKPYWILMTIMFVSQNGYSATRVRIQHRALGTFAGLLIAAASLRFAVPESIALLTMLVITLASYLITRKYYGWSMIGFTVTAVYSLQLLSLNGAQFLLPRMMDTLMGCLIAFAGMIWLWPQWQSGLLRNNAHDALEAYQEALRLLLGPEQAPEKLAYQRVKVNQAHNALFNSLNQASTEPGFNFQYLKDMRLWVTHSQFIVEHINAMTILAREHTMLTPKLAERYLQSCEIALQRCQQRLAYDGPGNDSNILEAPENLNEGPVTIVEQHVKRILQHLNVMHTISSLAWSQRPHHGRWLSVLKPKARHAFCDIGWLNHQRRHKTNHIAAGGQYHQAFSGGSVEDIARFAGVLRVEYGTQQQAFAPNFTEDVELLIDLLQRRDKLLTTRVDTIQHLGRIDDIQRGFGNRTGQRVAA

SEQ ID NO: 141490 - protein, 47 aa, Glycine max
  Coding DNA Sequence Number=SeqID_24712
MEVEEPWQGLWLSLHYQVVFGHWACGEQAGRVADLGMDFMDDWVKGT

SEQ ID NO: 141491 - protein, 134 aa, Glycine max
  Coding DNA Sequence Number=SeqID_24713
MSPKSTLRLMRTLGPSLESLAQSSWSLLSNALGGYDCIMMPTSHTSDITLDRAKLIYGIVQKMDMNVGYLISHQISLIAQHDSSRLGFPALITALCKARGVTFDSRTLESLSPAINIAYVTKNCWNLDDPIVTF

SEQ ID NO: 141492 - protein, 129 aa, Glycine max
  Coding DNA Sequence Number=SeqID_24714
MSSLKGNLLDSQMRSTRIVGSMPKETSIPTPHEPPLTAEERRKLDLIEERLRAVEGFSDYPFVDMTDLCLVPDIIIPPKFKVLDFDRYKGTTCPKNHLKMYCHKMGAHSRDEKLLMHFFQDSLAGAAVV

SEQ ID NO: 141493 - protein, 74 aa, Glycine max
  Coding DNA Sequence Number=SeqID_24715
  Subcellular localization annotation: CTP_CleavageSite=60; ConfidenceScore=5.43e-01
MGVQIATRPTWAFQNIPPEGGCFWRKQPRSPGKSKPRRFRNFSVGDFAKIFNRYSTFFVRSSSFFGLQPISKKA

SEQ ID NO: 141494 - protein, 151 aa, Glycine max
  Coding DNA Sequence Number=SeqID_24716
  Gene Ontology: Mol. function=RNA-directed DNA polymerase activity; Biological process=RNA-dependent DNA replication
MLELCLVPDVVIPLKFKVSDFDKYKGTTCPKNHLKMYCRKMGAYTKDEKFLMHFFQESLTRAAVTWQYQYNSNMTPDRMKLQNMCKREHESFKEYDQMWRDLVAQVAPPMMEREMITMIVDTLPVFYYEKMVGYMPSSFVDLVFSSERIEV

SEQ ID NO: 141495 - protein, 195 aa, Glycine max
  Coding DNA Sequence Number=SeqID_24717
MTPGSKKITLFSDEEDRILEAHEDAPPSQPQFEHQQFNILQRSVETRGLVRRRQTADAAPYSLPPMPERQHGMYYTPPAFTQEPSQMALMYSYPHNFQPGYSMTCIFGSSPPLGGTPSFTQNNELSTPNAPLGGPWNVPGNIPDMDDLLGVDLRHDFSAEADKADERVNLEEEILIRQLGIGTGHVGLRRDITDI

SEQ ID NO: 141496 - protein, 220 aa, Glycine max
  Coding DNA Sequence Number=SeqID_24718
  Gene Ontology: Mol. function=transition metal ion binding; Cellular component=cytoplasm; Biological process=cytoskeleton organization and biogenesis
MGDRLEDMIRDLGQEWQAHSPMYDTLQTDSKKPLYSGCNNSLMLLSVVLSLVNVKAKYGWSDKSFSSLLQVVHNMLQEENTLPKSYYQAKKILCSMGMEYQKIHACPNDCILYKHEFEEMHKCPRCGISWYKVKDDDECSSDENSKEGPSPTKGVVDLSHHSKVLSVCLLMETTQKILHDMQMGETTMECSVIRLIPCSGRRLIICIQILAKRQEILVLD

SEQ ID NO: 141497 - protein, 99 aa, Glycine max
  Coding DNA Sequence Number=SeqID_24719
MLTLGKIKDATGVSGVEIHEFRQRMINDKDGSQSQSSQSNVVEKFLLNAQVVSIGEINNLRQDCYCLTVGTVDEIIIDAPWSYDSRPNCTTTFDPSKGG

SEQ ID NO: 141498 - protein, 310 aa, Glycine max
  Coding DNA Sequence Number=SeqID_24720
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=93%, HitCoverage=28%, E-value=1e-106, Identity=66%"; Hit description =Putative calcium-transporting ATPase 9, plasma membrane-type (EC 3.6.3.8) (Ca(2+)-ATPase isoform 9)
  Pfam annotation: Domain name=E1-E2_ATPase; Domain location=11-236; Score=57.6; E_value=4.1e-14; Accession=PF00122.10; Description=E1-E2 ATPase
MPTGCYLYLGAAVSDYRQSLQFQNLNAEKQNIKLEVIRGGRTIQISIFDIVVGDLVPLKIGDQVPADGVVITGHSLAIDESSMTGESKIIHKDQKAPFLMSGCKVADGVGAMLVTGVGINTEWGLLMASISEDTGEETPLQVRLNGVATFIGIVGLTVAVCVLAVLLGRYFSGHTKDLDGRVQFVAGETSISEAVDGVIKIFTIASHAGNNCGGCSARRSTFSSYLNVRRLSACETMGSATTICSDKTGTLTLNQMTVVEACVGRKKLNPPDDLTKLHPEVLSLINEGIAQNTTGNVFVPKVCLLLDNNV

SEQ ID NO: 141499 - protein, 542 aa, Glycine max
  Coding DNA Sequence Number=SeqID_24721
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=93%, HitCoverage=47%, E-value=0.0, Identity=76%"; Hit description =Putative calcium-transporting ATPase 9, plasma membrane-type (EC 3.6.3.8) (Ca(2+)-ATPase isoform 9)
  Pfam annotation: Domain name=Cation_ATPase_C; Domain location=379 -526; Score=41.4; E_value=3.1e-09; Accession=PF00689.11; Description =Cation transporting ATPase, C-terminus
  Pfam annotation: Domain name=Hydrolase; Domain location=32-283; Score= 42.2; E_value=1.8e-09; Accession=PF00702.16; Description=haloacid dehalogenase-like hydrolase
  Pfam module annotation: Pfam domain module=Cation_ATPase _C::Hydrolase; Domain location=379-526::32-283
MGVMTTTSGVDGGEVEVSGSPTEKAILSWAVKLGMNFDLIRSNSTILHVFPFNSEKKRGGLALKLPDSAVHIHWKGAAEIVLGTCTQYLDSDGHLKSIEEEKVFFKNSIEDMAAQSLRCVAIAYRSYDLDKIPSNEEELDQWSLPEHELVLLAIVGIKDPCRPGVKDAVKICTEAGVKVRMVTGDNLQTAKAIAFECGILMSNDDAVEPNIIEGKTFRELSEKEREQVAKKITVMGRSSPTDKLLLVQALRTGGEVVAVTGDGTNDAPALHEADIGLSMGIQGTEVAKESSDIIILDDNFASVVKVVRWGRSVYANIQKFIQFQLTVNVAALVINVVAAISSGDVPLNAVQLLWVNVIMDTLGALALATEPPTDNLMHRSPVGRREPLITNVMWRNLGVQALYQVTVLLVLNFGGESILRNDQDSVAHTIQVKNTLIFNAFVFCQIFNEFNARKPEEMNVFRGVTKNGLFMGIVGMTFVLQIIIIEFLGKFTTTVKLDWKLWLASLCIGLLSWPLAIIGKFIPVPKTPLSRYFRRFSKSKSQ

SEQ ID NO: 141500 - protein, 75 aa, Glycine max
  Coding DNA Sequence Number=SeqID_24722
MPLPLNFKKQRTPLMKKIQGLQAPHGASSWLVSTWMDQSLEFWLRAEEEQEWYGFHKWRCYSTISKNCKAHGRDD

SEQ ID NO: 141501 - protein, 150 aa, Glycine max
  Coding DNA Sequence Number=SeqID_24723
MGEVEEIQEKMKPDMEAIKEKMATMMEAVMSVKKIMEANAVAIAATSIVAKVNPTSPSGLKQMNHPTSNMVGKDLGKTHEIPHHNLADFEPWLGYATEGQAVGGIPLQNPLEGPQYHPQLHLLHSTAVKNPHDYGRNGKVGSSRGKAQGH

SEQ ID NO: 141502 - protein, 49 aa, Glycine max
  Coding DNA Sequence Number=SeqID_24724
MKQIPFLGVSDSEETVSEALESGKQGCFVDHSMALNRINSWNIKQVNLI

SEQ ID NO: 141503 - protein, 94 aa, Glycine max
  Coding DNA Sequence Number=SeqID_24725
MGAYSKDEELLIHCFQESLTGVAVTWANEEGENEGEAHVVTAIPIQPSFPPTQQCHYSANKQTFSLPTAQLSTKTIPKSTTKYVYRTSNDEHHL

SEQ ID NO: 141504 - protein, 130 aa, Glycine max
  Coding DNA Sequence Number=SeqID_24726
MAPEELEQLTQQIRDQLEESIIEKPEVGPLVARVSTKGSCVDPSPTDPDTGIYNSSQHPFVAWPWEVGVEEVKDTEAPVPVPTDEAVVSAAKPPDRLDHEVDDPLYLMILTIPQLFLKPLQVLWDATVFG

SEQ ID NO: 141505 - protein, 85 aa, Glycine max
  Coding DNA Sequence Number=SeqID_24727
METVGFHVLKLRNSCLASGNRLPRLCNRLPEMKSLEIVMAAQLIHDRVEMECLEGAWETLKGNARCRFRGTIRFTTTSLVHPEEP

SEQ ID NO: 141506 - protein, 73 aa, Glycine max
  Coding DNA Sequence Number=SeqID_24728
MAERGHGMYYTPHTFAQYPTQMYQYPFRGHHTDTSASEHSFSGVADTHPHFSWPTMTPSQQYHGPIPTPNAPL

SEQ ID NO: 141507 - protein, 105 aa, Glycine max
  Coding DNA Sequence Number=SeqID_24729
MSTPKCRNPEVEAQEKSPIKEHESREKDEEQAQQQWEKYSIVENQQENILQINNLPHQLIFKKGRQGEHEETLSAILSLITNTFLEMIWNVLPDYMKFMDFLAKR

SEQ ID NO: 141508 - protein, 88 aa, Glycine max
  Coding DNA Sequence Number=SeqID_24730
MGLRIKVENGELVNSARRSIRGAPDSKRQTINSQGSRLEGGGHMTSARQLIHGAPNKSGEWRIGEQREAINSPGSRLEGGGHMNSARQ

SEQ ID NO: 141509 - protein, 42 aa, Glycine max
  Coding DNA Sequence Number=SeqID_24731
MAFLGETSSQTIANSRLAFIFPNGPITHNQTGVYFQSLTPTP

SEQ ID NO: 141510 - protein, 88 aa, Glycine max
  Coding DNA Sequence Number=SeqID_24732
MPLTEFSDTLIEEWKMYEQCTQTLRYPTQPTYLNPLGFGDPIKGGNLVMHDMEAIAHDGDEGEREITNLMQEGKEVDEEGLDVESCGL

SEQ ID NO: 141511 - protein, 79 aa, Glycine max
  Coding DNA Sequence Number=SeqID_24733
  Subcellular localization annotation: CTP_CleavageSite=38; ConfidenceScore=5.02e-01
MSIVPGGLAQHPHVRTCATMPVQHLCLPMLTKSGCATAAAAVATHYTKLLAQQLNATSQLPVESRPCLWRNANKNIPPQ

SEQ ID NO: 141512 - protein, 193 aa, Glycine max
  Coding DNA Sequence Number=SeqID_24734
  Gene Ontology: Mol. function=ammonium transporter activity; Cellular component=membrane; Biological process=transport
  Homolog annotation: Hit_ID=Q0EEW6; Match level="QueryCoverage=63%, HitCoverage=33%, E-value=3e-19, Identity=56%"; Hit description =Putative ammonium transporter AMT2
MEEAYYLIRENMKQKQMVYLDRVHVIEYIEHLSNSLYIQYGNCPNFYDRFVRSRRRSKPRKVEQRRQRMAVNGSHSGGSGDSLWKPRVKKTWAINYRLRGRSSLQGGVGIQHVIRRENGVLLGKAFLGFFPTATMVFFQGLFAGITLILIAGALLGRMNFRACRCCLCRFGLLFPTLSLPFVIRIFMYKPEYK

SEQ ID NO: 141513 - protein, 234 aa, Glycine max
  Coding DNA Sequence Number=SeqID_24735
  Gene Ontology: Mol. function=calcium ion binding
MSDGTLQVLDGTHLRGVDLSLGDDGPFTGAKILDIAHSRASSSLFGLSLPDSLKVSALTRLRTPDTDAFRSAYYSADKASEILRDYISAIADELKGLLSSSSDHHAKHYNPLVVSILDGSTLRLLSEDEDDFAMLAENLFTDLDAEDKGKISKSEIRNALVQMGVEMGVPPFSEFPQLNDLLKKHGVDGEEKLGQAQFAQLLQSVLQDLEEELSKKNVVSIQNIRIINGSKLRR

SEQ ID NO: 141514 - protein, 238 aa, Glycine max
  Coding DNA Sequence Number=SeqID_24736
  Gene Ontology: Mol. function=protein serine/threonine kinase activity; Cellular component=nucleus; Biological process=protein amino acid phosphorylation
  Homolog annotation: Hit_ID=Q8SA64; Match level="QueryCoverage=93%, HitCoverage=42%, E-value=1e-101, Identity=72%"; Hit description=NIMA- related protein kinase
  Pfam annotation: Domain name=Pkinase; Domain location=4-230; Score =133.3; E_value=6.7e-37; Accession=PF00069.15; Description=Protein kinase domain
  Pfam annotation: Domain name=Pkinase_Tyr; Domain location=4-223; Score=-37.6; E_value=3.7e-10; Accession=PF07714.7; Description =Protein tyrosine kinase
  Pfam module annotation: Pfam domain module=Pkinase::Pkinase_Tyr; Domain location=4-230::4-223
MEQYEILEQIGKGAFGSALLVKHKHEKKKYVLKKIRLARQTERSRRSAHLEMELLSKLRNPFIVEYKDSWVEKGCYVCIIIGYCKGGDMAEAIKKASGVMFPEEKLCKWLVQLLMALDYLHVNHILHRDVKVVGTPSYMCPELLADIPYGSKSDIWSLGCCIYEMTSLKPAFKAFDIQALINKINKSIVAPLPTKYSGSFRGLVKSMLRKNPELRPSHLVPCIILEMGWVDDGFYIKH

SEQ ID NO: 141515 - protein, 374 aa, Glycine max
  Coding DNA Sequence Number=SeqID_24737
  Homolog annotation: Hit_ID=Q2QMH3; Match level="QueryCoverage=82%, HitCoverage=68%, E-value=1e-23, Identity=30%"; Hit description=IQ calmodulin-binding motif family protein, expressed
  Pfam annotation: Domain name=IQ; Domain location=120-140; Score=18.0; E_value=0.034; Accession=PF00612.17; Description=IQ calmodulin -binding motif
  Pfam annotation: Domain name=IQ; Domain location=98-118; Score=30.1; E_value=7.7e-06; Accession=PF00612.17; Description=IQ calmodulin -binding motif
  Pfam module annotation: Pfam domain module=IQ::IQ; Domain location =120-140::98-118
MGKASKWIRNFLLGKKEDKIKKIDAFCSEDKSGNTGSLIVSPKVKRRWSFGKLTGAGHKFSRSFDSADSAKLQIQALLETKTPRRLPKPLAKPSKDKNKAATKIQASFRSYLARRALHALRGLVKLQALVRGHLVRKQTTATLRGMHALMAIQVRARIHRVQMAEEANLLRQQSPPQHRQVPYSTDLITEENKDSNHMSVEEMLEVLKSRSGPLDGSYVKGRERDSMTYYSKHVPVVSKRENQYKKTLIIEPNSLENYRSMSEFNPTTIALSTSQRHSVPHGQSLSPNYMNKTESSRAKARSQSEPRQRPIRGTRHKGKSVESPLNGPRQNLFSNSLRFDHGSMDHWVINFHGSTNDSRRNSFGSSSVTTDSYY

SEQ ID NO: 141516 - protein, 308 aa, Glycine max
  Coding DNA Sequence Number=SeqID_24738
  Gene Ontology: Mol. function=DNA binding; Biological process =regulation of transcription, DNA-dependent
  Homolog annotation: Hit_ID=Q1SCZ2; Match level="QueryCoverage=92%, HitCoverage=60%, E-value=4e-14, Identity=23%"; Hit description =Transcriptional factor B3
  Pfam annotation: Domain name=B3; Domain location=15-109; Score=57.0; E_value=6.3e-14; Accession=PF02362.12; Description=B3 DNA binding domain
  Pfam annotation: Domain name=B3; Domain location=211-300; Score=28.4; E_value=2.6e-05; Accession=PF02362.12; Description=B3 DNA binding domain
  Pfam module annotation: Pfam domain module=B3::B3; Domain location=15- 109::211-300
MESALPSHGDKSLQEFFKVFLLRTGSTKLQIPTSFTKFFNGVLPLKVTLVDHDRKSWDVYLEKTEGCLVFKDGWQQFAKEKVLEDGDFLVFQYDGRSTFNVKIFSKTGCRKVAAPASSAKIEPTVILDEDSDQRCSKEIQCGRKRKQSPPSLKTNEESVLEGPCPSEGARFKSKRVYEEKDDHNEKKPDPTKCVPLQNSHHFQIYFNAPWRLKKVEIPRSVLRKTNIKLMSKISLRDENGKLWPASIISIKKEYRHFLGGGWNDFRRSYNIQEGDRCDFEFVVDKANAAQELLVRVRSKCSFGWVDCK

SEQ ID NO: 141517 - protein, 217 aa, Glycine max
  Coding DNA Sequence Number=SeqID_24739
  Gene Ontology: Biological process=nitrogen fixation
  Homolog annotation: Hit_ID=Q9M2C0; Match level="QueryCoverage=90%, HitCoverage=99%, E-value=4e-59, Identity=63%"; Hit description =Nodulin-like protein
  Pfam annotation: Domain name=DUF125; Domain location=44-208; Score =188.2; E_value=2e-53; Accession=PF01988.9; Description=Integral membrane protein DUF125
MANNNIQPCHDDLDPREANNPSKMLNLDVEGQREGFDYAKRAQWLRAAVLGANDGLLSTASLMMGVGAVRKDVKSMMLTGVAGLVAGACSMAIGEFVSVYSQYDIELAQMKREGNMDEKKDKLPNPYYAAFASALAFAIGAGVPLLGAAFVNSYKARLGVVAAVVTLALIVFGDLGAFLGKAPRVKSTLRVLIGGWLAMAITFGLTKLVDHLGLGVA

SEQ ID NO: 141518 - protein, 102 aa, Glycine max
  Coding DNA Sequence Number=SeqID_24740
MSAAVAQKVHICSIALTNSGGQEFCEAEYILHRKEKAKQSVPETGKEEVEEIEGTQKGEGRDESENGRFDIGRESEKRHRYWNSSNRRRSSCAIVVGLEERK

SEQ ID NO: 141519 - protein, 114 aa, Glycine max
  Coding DNA Sequence Number=SeqID_24741
MKQPSDTKRKSQIRFRFLAVRDIQSNSRLQIGSIDLYAKSIDFWDRLCSACTGDLPVSENFRNTNSVNCAKSVYKFKNLTTCTSKRNIRQKPLTRISLQMLAIISVTLLTRQTH

SEQ ID NO: 141520 - protein, 757 aa, Glycine max
  Coding DNA Sequence Number=SeqID_24742
  Gene Ontology: Mol. function=peptide-N4-(N-acetyl-beta-glucosaminyl)as paragine amidase activity
  Homolog annotation: Hit_ID=Q9FGY9; Match level="QueryCoverage=82%, HitCoverage=87%, E-value=0.0, Identity=53%"; Hit description=Peptide- N(4)-(N-acetyl-beta-glucosaminyl)asparagine amidase
  Pfam annotation: Domain name=Transglut_core; Domain location=236-301; Score=3.5; E_value=0.012; Accession=PF01841.9; Description =Transglutaminase-like superfamily
MVGVELSREKEDGGAQVFQFQLYSLTSVPPHQQKIFGAEQDTPVVNDSDLVAISDKLRLVSVNDSEPEPSAADLLKSDEELARLLQAEEEALMLQQYVASENPREFDSRVRPHVSQVRMYEDATRQEAARKSVPMEELEEKALVSLAKEGNFKPSKIEQDHAFLLQLLFWFKRSFRWVNSPSCHDCGNETVGQGMAPPLPSETLYGASRVELYRCTVCSQLTRFPRYNDPMKLVETREGRCGEWANCFTFYCRAFGYESRLGKRALSIDVLTVLPVNFQPRILDFTDHVWTECFSQFLGRWGKKLNYVIAIAKDGVYDVTKRYTRKWHEVLSRRTIITEPSLSSLLSNITKESRRGFASQLLSIIEVRDMEENKELERSLHAEDDESLSLPGRRSGNEEWRKSRLEMGSDKLSSSACPVRLCVDEHVTRIYNAFRPILYQFVGEELTKSEAVEVLRITKGILLDLSKSPYKTRRTSIDSVLDNPKFQKLLPSFDDLLGALSLEKKVNTDGRVEFCLVGDPVVTSLALPVALDALDDMIYILNKCENYGKDMFLLPFLKLNRIHSGSAIASSEELPFGIITSAFDGTRISKWEEPNGARGCWVVYRTFGNEMFELVAYELMSANDAPERDPMDWYGLWDFFVSTEIEAVGDVGFGLVPVGVEFEGEGFGVGGGGEVEILHLLEGLPLVLDWGIRVLGVKAGAGLGLECGVSLKGRRRRASWFRFFFHESRRRRNTKEITLTTATPTTTITTLTLFCRS

SEQ ID NO: 141521 - protein, 53 aa, Glycine max
  Coding DNA Sequence Number=SeqID_24743
  Gene Ontology: Cellular component=protein complex
  Homolog annotation: Hit_ID=Q1SS00; Match level="QueryCoverage=98%, HitCoverage=11%, E-value=5e-16, Identity=77%"; Hit description=IMP dehydrogenase/GMP reductase
MQSSLINSTLEDKNLSEIRNFKLLLKQLVTMEVIQCTTLWDSYKDEFENESVT

SEQ ID NO: 141522 - protein, 113 aa, Glycine max
  Coding DNA Sequence Number=SeqID_24744
  Gene Ontology: Cellular component=nucleus; Biological process=rRNA processing
  Homolog annotation: Hit_ID=Q1SAX7; Match level="QueryCoverage=99%, HitCoverage=60%, E-value=7e-25, Identity=54%"; Hit description =Nucleotide binding protein, PINc
MGKAKKGPKFAVMKKAVTSKAIKNYKEKVLNPEKKNLLKEKLPRNITCVPLINKQMNYYIWFYPLSFPWSSLFKLDLEKGMMDCLYAKCTPCITDCVMAELEKLGQKYRVALR

SEQ ID NO: 141523 - protein, 85 aa, Glycine max
  Coding DNA Sequence Number=SeqID_24745
IPGVPIMYITKRKYSIERLPEATIGGGSSLCEGMGEGCCTQPYPCICKEAVSGFEPMTNKSPRHNFTAAPGLALAPGLALDWTNH

SEQ ID NO: 141524 - protein, 100 aa, Glycine max
  Coding DNA Sequence Number=SeqID_24746
MKAVRDFLAYSRCIELVFLLDEVGNELDLVLLTGKPIEENAGWRPQRASPLAMVYDASPQDYSVKVETKFRRIVTYVGDGPARRTMALQFDFQVSDGEGL

SEQ ID NO: 141525 - protein, 230 aa, Glycine max
  Coding DNA Sequence Number=SeqID_24747
  Gene Ontology: Cellular component=cytoskeleton
  Homolog annotation: Hit_ID=Q8S8M5; Match level="QueryCoverage=99%, HitCoverage=78%, E-value=2e-46, Identity=44%"; Hit description =Protein ABIL1
MKDYVVRALVNAVDHLGTVAYKLSDILEKQTFDVSTMDLKVSTLNQRLLTWHMYTDKEGLRQQQLLAFIPRHHKHYILPSTPISKTLSWHLASETKSTLKKQTSRTSKNTKDSKFYKKISGVFHLLDSEGSTRMKTSAAQPHLTNGVPTSGAATQTMGATGRDHIDPVNLSISQIHNQDALKHSKPLTTYGSFDDRNGREAVQVHTRSKSVLSSFFVKQTAAKLKAGSVL

SEQ ID NO: 141526 - protein, 98 aa, Glycine max
  Coding DNA Sequence Number=SeqID_24748
MDAKHLTRTKERSHVIKQRSPDEIRGQDHLGLPSEVETKRERQKPIKVGYLRTDASRDGVTTDRSLPLLCARQAEDVAARQPRILCILQLSFTICKNK

SEQ ID NO: 141527 - protein, 109 aa, Glycine max
  Coding DNA Sequence Number=SeqID_24749
MNAVPSVTFVLAVILRACECKRGAEPSKGDWDVGNFFRCFVNDIYKGPQIKLFFSPDTTHHQDGSHSPDEALRDCLSPPRVVAIVATRHSGLVAWALGWDFRLHGPLYT

SEQ ID NO: 141528 - protein, 243 aa, Glycine max
  Coding DNA Sequence Number=SeqID_24750
MNNIRNGYREEKSFCYFHPKQVLVGVCPLCLNERLLILFAKQGRHHNRSSSSSISSHRLQSNSRHRKPPSSSIHKIFAFGSLFTRPESHHNYDYDDVSPTPEDANAKSIMTLQKLFCKIMVYGFVMELSYDRSVTMIFWNEFNFAESFISIKFEENGVASWEKSTVSKKVSSWNHQNKENKRVIEHGKSRDTFRWRKRIGHMLQLIRWKKSGGVCHVGTKVEGVKVRKGWMRTLTKRKTTTLE

SEQ ID NO: 141529 - protein, 128 aa, Glycine max
  Coding DNA Sequence Number=SeqID_24751
  Homolog annotation: Hit_ID=Q2J7U8; Match level="QueryCoverage=41%, HitCoverage=9%, E-value=7e-14, Identity=64%"; Hit description =Potassium-transporting ATPase, A subunit
  Subcellular localization annotation: CTP_CleavageSite=48; ConfidenceScore=5.86e-01
RARGPRPRTAGRCGRTRAKSAPTGGRPRSRGTARAPRASPWRTCRRGRCSRRGGGTAGRARPRRPRPAGPRTGSWRPSEFLRGDQGSDEVDDGGDGENGRDDLEHDHARSTALATRNTRANSAKVSAR

SEQ ID NO: 141530 - protein, 118 aa, Glycine max
  Coding DNA Sequence Number=SeqID_24752
MVIDQSLFHDLTKLPSDGVPFEGTLNDDWKFDFSAHDARQLVCTNNADMTGRLLAGSLAFESRILHYLIVRILLPRSSNLAQGVPPADDEGNQPVEDNSSLLRKLLEKFDGLQTFVGD

SEQ ID NO: 141531 - protein, 161 aa, Glycine max
  Coding DNA Sequence Number=SeqID_24753
MASRKCKSIGSRPTTEYDTRRFHSLDAWNQYTDNVLGRNILPERKVELYHTEFDDFKTELERRNLHKCLTNLVDGSIDVALVKEFYANLYNSKGHSPKQARVRGHLVKIDADSLNTFLETLWLPSDPREIEAALCIPGQGFILNAEGHPRRIMRKDLTNLA

SEQ ID NO: 141532 - protein, 109 aa, Glycine max
  Coding DNA Sequence Number=SeqID_24754
  Subcellular localization annotation: CTP_CleavageSite=26; ConfidenceScore=5.48e-01
VDTPGGSFGPADQPLFRSPMNCIFVHVSSTFEFGAMRSDCLVQLSSLNLFWSPMNCVFVHTSSTLEFGAMRSDCLVQFSILNLFSEPHELRFRSCVLHPTSLELCVVIA

SEQ ID NO: 141533 - protein, 123 aa, Glycine max
  Coding DNA Sequence Number=SeqID_24755
  Subcellular localization annotation: CTP_CleavageSite=43; ConfidenceScore=5.41e-01
MWLRMPPDSWVTHFVSKRPFRGNTGSNKNRRKSLKVYQSHTVRGEKLASALDFVGNQSERTTLGRGFLFLVYLVTILYCSYIVWSKNRSKRIFQVRELYLRMRKVLAPLTFVSKDNSLIFRIV

SEQ ID NO: 141534 - protein, 167 aa, Glycine max
  Coding DNA Sequence Number=SeqID_24756
  Homolog annotation: Hit_ID=Q8S8I2; Match level="QueryCoverage=43%, HitCoverage=34%, E-value=1e-10, Identity=41%"; Hit description =Protein ULTRAPETALA2
MRKRKKMRILPKWILLIIEVILKEVKNKIKGLLSLDLVIGDPPQEERSLTIEIEEEFKNITEGPSKRRKQFRVGDDGKILFDEEEHKMILDFKRGEDYIEVLCGTTNKKYGDYVGRLKINNEGQYFITCECCPECPLGMSSYVERDAGRSTGSISRADQTLRTTTKL

SEQ ID NO: 141535 - protein, 244 aa, Glycine max
  Coding DNA Sequence Number=SeqID_24757
  Gene Ontology: Mol. function=4 iron, 4 sulfur cluster binding; Cellular component=mitochondrion; Biological process=biotin biosynthetic process
  Homolog annotation: Hit_ID=Q5H5R1; Match level="QueryCoverage=98%, HitCoverage=65%, E-value=1e-109, Identity=80%"; Hit description =Biotin synthase
  Pfam annotation: Domain name=BATS; Domain location=178-243; Score =82.9; E_value=1e-21; Accession=PF06968.3; Description=Biotin and Thiamin Synthesis associated d
  Pfam annotation: Domain name=Radical_SAM; Domain location=5-167; Score=93.5; E_value=6.5e-25; Accession=PF04055.11; Description =Radical SAM superfamily
  Pfam module annotation: Pfam domain module=BATS::Radical_SAM; Domain location=178-243::5-167
VTLLSVKTGGCPEDCAYCPQAQRYSTGVNAQKLMETDAVLAKARQAKAAGASRFCMGAAWRSPKDRDIPKVAAMIAGVKALGLETCATLGMLSGEQARALKDAGLDYYNHNLDTAPDYYDSIIHTRQYQDRLDTLEHVRDAGLKTCCGGIVGMGETRAQRVGLLLALATLPAHPDSVPINKLVQVAGTPLHGSAELDPFEFVRMIAVARIAMPRSMVRLSAGREAMSDELQALCFLAGANSIFC

SEQ ID NO: 141536 - protein, 143 aa, Glycine max
  Coding DNA Sequence Number=SeqID_24758
  Gene Ontology: Mol. function=receptor activity
  Homolog annotation: Hit_ID=Q1RWN2; Match level="QueryCoverage=57%, HitCoverage=6%, E-value=2e-23, Identity=60%"; Hit description =Peptidase S8 and S53, subtilisin, kexin, sedolisin; Integrase, catalytic region; Zinc finger, CCHC-type
MRAGIGGGALKKQKLICLSGEEAEEGVQHEGEEVEEGAEQERVEESTEAGVINTQLSAQGRNRREPLWMKDYVTGEGLSEEENEHNLILFTSNSDPKTCEEAVKNPKWRAAMDLEIEAIERNKTWELTDLLKEAKKIGVKWVF

SEQ ID NO: 141537 - protein, 533 aa, Glycine max
  Coding DNA Sequence Number=SeqID_24759
  Gene Ontology: Mol. function=nucleic acid binding; Cellular component= chromatin; Biological process=DNA integration
  Pfam annotation: Domain name=rve; Domain location=372-533; Score =138.2; E_value=2.3e-38; Accession=PF00665.16; Description=Integrase core domain
MTSESTFVQPAIPKFDGHYDHWAMLMENFLRSKEYWSLVEDGIPVAVEGEEFTEAQRKSIAEQQLKDLKKYQGSTTRVKRAQLQALRKKFEVLHMKEGESVDEYFARTLAIANKMKLHGESMGQLLIVEKILRSMASKFNYVVCSIEESNDLDTLTIDELQSSLLVHEQRMKGHGGDEQAPKVTTDDRSTGGKGRGTGRGTSRETARGRGRANYAELEEEEEILLMSFMEPNQSDEEVEDVWFLDSGCSNHMCANKQWFSNLDEEFRQSVKLGNNSALDVLGKEIAMSTNRMFKLPARVLPKALTCFQATLEDNTHLWHRRYGHLSYKGLKTLQYKEMVRGLPHLNASFKVCTDCMVGKQHRDAISKKSLWRASQRLQLVHSDICGPIKPVSNSKKRYFISFTDDYSRKMWIYFLVEKSEAFITFKNYKNLVEKEMGAFIRCLHTDRGGEFMSLEFNNFCRVNGISRQLTAAFTPQQNGVAERRNRTIMNMVRSMLSEKQIPKRFWPEAANWTVHVLNRSPTLAVKDMTPEEA

SEQ ID NO: 141538 - protein, 172 aa, Glycine max
  Coding DNA Sequence Number=SeqID_24760
  Subcellular localization annotation: CTP_CleavageSite=59; ConfidenceScore=5.70e-01
MAEPSKKRKGSSSTATAAAHRRHGPSGAPTTPIPPSLSSPRSSTLFSSDDQRLRILLPRSSNLAQASEEDLILMWAFLTGHQIDWAHLVRYRMHKALRANAPLPYPHLITLFLRHFQIPLDDEPFVQVKRSFAIGAGAVTSFGYRKDRNGQWLKKDALPPQDERTPSAPPQR

SEQ ID NO: 141539 - protein, 68 aa, Glycine max
  Coding DNA Sequence Number=SeqID_24761
MCTSYQLDKAPLKYVCHQSKQWFLYQYPFGMSRWLPYPLVDLILEGLLELLENKECAHWKAKYVSGWI

SEQ ID NO: 141540 - protein, 64 aa, Glycine max
  Coding DNA Sequence Number=SeqID_24762
MEALALYASCWYKMLWVREYRSEPDHEMWRDSYLIRVHDIERRMRQLEGKRLCVLENLTTLGFL

SEQ ID NO: 141541 - protein, 42 aa, Glycine max
  Coding DNA Sequence Number=SeqID_24763
MNFLLQGMGDFLDEMLTMMSQTKSNGKSNEKRDLNWLCLCVS

SEQ ID NO: 141542 - protein, 81 aa, Glycine max
  Coding DNA Sequence Number=SeqID_24764
MKAVKHECECRISLDLMLRWVVMVLFCLIRGERMMKCNMVATLATKKLGFSAEETPRVLRKIWGEFNFINTGESAVINVEE

SEQ ID NO: 141543 - protein, 82 aa, Glycine max
  Coding DNA Sequence Number=SeqID_24765
MSPINITLMRMNNMNLLHKVVKRMFLSHLGQLEAKQNFMQFSFNKGQMHSMTMAVRRWWQRGHGGVTMVVQKWWQQDCNYKI

SEQ ID NO: 141544 - protein, 476 aa, Glycine max
  Coding DNA Sequence Number=SeqID_24766
  Gene Ontology: Mol. function=protein binding
  Homolog annotation: Hit_ID=Q75KA7; Match level="QueryCoverage=87%, HitCoverage=75%, E-value=9e-12, Identity=24%"; Hit description =Expressed protein
  Pfam annotation: Domain name=BTB; Domain location=49-170; Score=-7.4; E_value=0.019; Accession=PF00651.21; Description=BTBPOZ domain
MPGFISSRFQLLLLLNVWCWSLSSVSVISGYTLTFSSFIQGKEEKIACVIGDRSTSDVDVRLRTQEGRDDWLYCHSEILVKNCKYFADRLSENWPTCQILDSRNCVDVYCQELNFDYHVNLIRLLYIVVDSSVDDLWHGVRNSLGILQVAVELGCPQIVTACVNYLEAVTWEEAEEDEILKIVPRMGLQAEPILARLQPVNQSAIVNIFVSALRFATSSPPPQMNDLKSSAQEQLEYMLTEDDDAPLLTADDNIKLEVKECVNRLFSQFNDSLTALFCGSTESLSGAGNIQLFKSYLTDLSWACQILSKLEIMREFVVYWFDASDKIVKVLEQGSSTTEVIEIKLRAIEVTSKVLEAIGYGTVILPTAKRLQVLKVWLPFVRVTKPLIDSVTMNCENAMLLKLDGEMWQSLESTFVSIILALPSGDQAEVLTEWLDNEYMQYPDLTEAFEVWCYRSKVAKRRLSLLEDEHAMTNSF

SEQ ID NO: 141545 - protein, 291 aa, Glycine max
  Coding DNA Sequence Number=SeqID_24767
  Gene Ontology: Mol. function=2 iron, 2 sulfur cluster binding; Cellular component=chloroplast; Biological process=chlorophyll biosynthetic process
  Homolog annotation: Hit_ID=Q9MBA1-3; Match level="QueryCoverage=73%, HitCoverage=49%, E-value=7e-66, Identity=61%"; Hit description =Isoform 3 of Q9MBA1
MEERIEKRCSYSPIKPSWQGVRAQNCEKSNSACGRNMCHVCDQGVHARPRGAPRKASRDRAELQPLINKILKTNNIPPRFSFSLQTETGLKGRFRVFAVYGEEIDKKNAWSALFDVEDPRSKVPQYKGKFLDVYQALEVARYDIQYCDWRARQDLLTIMLLHEKVVEVLNPLARDYKSIGTMKKELAELQEELAQAHQQVHISEARVSSALDKLAYMEELVNDKLLQERSTTEVSQTSSSPSTSFKPVDIEKRRSPRKSLDISGPVQSYHPHLKNFWYPVAFSTDLKDDTM

SEQ ID NO: 141546 - protein, 78 aa, Glycine max
  Coding DNA Sequence Number=SeqID_24768
  Subcellular localization annotation: CTP_CleavageSite=22; ConfidenceScore=5.01e-01
MKGTYSPSMATSRLQVDERCYRRGMVQSVARITRGRRAITSRRRHVTGLRVLFIKSDLIISKVVVGGVGYRYPQKDTS

SEQ ID NO: 141547 - protein, 483 aa, Glycine max
  Coding DNA Sequence Number=SeqID_24769
  Gene Ontology: Mol. function=malate transporter activity; Biological process=response to aluminum ion
  Homolog annotation: Hit_ID=Q14UU8; Match level="QueryCoverage=91%, HitCoverage=90%, E-value=4e-90, Identity=40%"; Hit description =Putative aluminum activated malate transporter
  Pfam annotation: Domain name=UPF0005; Domain location=41-418; Score =516.0; E_value=4.2e-152; Accession=PF01027.11; Description =Uncharacterised protein family UPF0005
MDIESTTQVNKGGFFSRLGNCLVAMPRNFKTKVINFARSITKIGKDDPRRVIHSLKVAIALTFVSLVYYSRPLYDGFGVAGMWAVLTVVVVFEFSVGATLSKGLNRGFATLLAGALGVGGQHLATAFGERAEPIVLGILVFSLAAGATFFRFFPKIKQRYDYGIVVFILTFCLVAVSGYRVEELFELAHQRLSTILIGAAACMVISIFICPVWAGEDLHMLVASNIEKLANYLEVFETEYFHCSEDTKKCEKSVLEGYKSVLNSKASEESLANLARWEPGHGRFPLRHPWKQYLKIGALTRECAYKIETLNNYLNPEIQVSLEFKCKVQAPCTKMTSESNKALKAISSSIKKMTHPSAAKVHIENSKTAIENLKVALEIVSLKNTDLLTIIPVATVASILEEITKSVEKIYESVSEFSHLAHFKSVVEPNVSPEKPPLLHRGIIKPVVDIDNTVDHVEITIPDITTDSLEKEKAPITKPSEHL

SEQ ID NO: 141548 - protein, 168 aa, Glycine max
  Coding DNA Sequence Number=SeqID_24770
  Gene Ontology: Mol. function=transferase activity
  Homolog annotation: Hit_ID=Q1SI60; Match level="QueryCoverage=79%, HitCoverage=35%, E-value=9e-12, Identity=42%"; Hit description =Immunoglobulin-like
MAARIFKAKYYSNGKFMDGAIRHNPSFSWRSIDNSRVLLKEGRRQKNWAEETKGEYTVKSAYKLFMDNILDSTGLYVDGHLEFEGSSKFVEISFLLVPDFKGKVLNVLLLASCVMLVLRTSPTCVGRNWALPIVDEFRDMVLAQTDWQEKLWGSSRLSVSSRIWACPM

SEQ ID NO: 141549 - protein, 40 aa, Glycine max
  Coding DNA Sequence Number=SeqID_24771
MMTGRLSGVNHGCISSSDAENMTAEQLIWLYSTMIFASVW

SEQ ID NO: 141550 - protein, 786 aa, Glycine max
  Coding DNA Sequence Number=SeqID_24772
  Gene Ontology: Mol. function=transferase activity, transferring glycosyl groups; Cellular component=chloroplast; Biological process =biosynthetic process
  Homolog annotation: Hit_ID=Q6DW76; Match level="QueryCoverage=98%, HitCoverage=98%, E-value=0.0, Identity=97%"; Hit description =Digalactosyldiacylglycerol synthase 1, chloroplast precursor
  Pfam annotation: Domain name=Glycos_transf_1; Domain location=525 -687; Score=21.2; E_value=6.4e-05; Accession=PF00534.10; Description =Glycosyl transferases group 1
MATHPQTPTSSNAFSFISKGWREVRDSADADLRLMRDRANSFKDLATSFDRELENFFNSATPPFSVPAMRSPPPKEIEFVKSLRPKLSEIRRAYSSPDFSKKVLEKWRPRTQIRINLSAIKNAIVSAEEVGQEEEEGIVDFEKRRRRRLSFWEEWKNDGEGESRDWEPIRVLKTRFKEFEKRGSSFEAFKNSEFVEKFKSSLKSMCKEPQESKEVPPLDVSELLAYIVKQSGPFLDHLGVKRDICDKIVESLYSKCKNHHLLHTLSGEESSVLGNGNINDELDLRIASVLQSTGHRYEGGFWTDHAKHVPLDNERHVAIVTTASLPWMTGTAVNPLFRAAYLSQSAKQKVTLLVPWLCKSDQELVYPSNVTFTSPEEQEAYIRSWLEERIGFKADFKISFYPGKFSKARRSIIPAGDTSQFIPSRDADIAILEEPEHLNWYHHGKRWTDKFNHVVGIVHTNYLEYIKREKNGALQAFFVKHINNWVTRAYCHKVLRLSAATQDLPKSVICNVHGVNPKFLKIGEKIAAERELGQKAFTKGAYFLGKMVWAKGYKELIDLLAKHKADLDGFKLDVFGNGEDANEVQSAARRLDLNLNFQKGRDHADDSLHRYKVFINPSISDVLCTATAEALAMGKFVVCADHPSNEFFRSFPNCLTYRTSEDFVTKVKEALENEPYPLTPEQRYQLSWEAATQRFMEYSELDGILNKENNGEKSRVDKGKLIAKSASMPNLTELVDGGLAFAHYCLTGNEFLRLCTGAIPGTRDYDKQHCKDLHLLPPQLLVLGAC

SEQ ID NO: 141551 - protein, 344 aa, Glycine max
  Coding DNA Sequence Number=SeqID_24773
  Homolog annotation: Hit_ID=Q9SD55; Match level="QueryCoverage=18%, HitCoverage=30%, E-value=1e-13, Identity=56%"; Hit description=Zinc -finger-like protein
  Pfam annotation: Domain name=zf-C3HC4; Domain location=309-344; Score= 18.6; E_value=0.0019; Accession=PF00097.15; Description=Zinc finger, C3HC4 type (RING finger)
MGMFLFLLPCLGVFLLFLVSYATQAQEKEKKKKEPRKHHARVEIGRDLRYKIKRNHSHGDPSYTSIVTKHGNYIGTVHDIKVTRTSKFARKGITKRKRVLPRQRRQESGMLGIHDKGLPLLYIEVCSSPKEISKFIHSNTPIAFICSQSTNCIGTPFSPSMEGEEGKQSSQKNPYVELEEVDFDFILAMSMQEQEREFTMLSTIESESDEYLSDSSIDNDDDGDPDFIASQEFETDLRFLEGEGSDDDDEDMEMEEDEIDPDELSYEELMELEEFIGEETRGLSANEISLCLYPYTCQCAESKSGIDRCVICQVEYEEGEALVALQCEHPYHSDCIRKWLQIKK

SEQ ID NO: 141552 - protein, 182 aa, Glycine max
  Coding DNA Sequence Number=SeqID_24774
MEQVLFLEFGDGWRRGCGVVGCDRLKRVKNGVGCGRVEGHCFVHNIIVDTPNKIVKFHFHSSIKLIWIDKFVYQQLYFVCVVTAKVEMLKRIRPNHFVPSHFYIYIYGRLADQSVPLRPIIGSAGRANGLSHLIQSTIFGRKVPGTKTHIVTQKRRDKVEAGREGLKVERVKKKEMMEKEKD

SEQ ID NO: 141553 - protein, 367 aa, Glycine max
  Coding DNA Sequence Number=SeqID_24775
  Homolog annotation: Hit_ID=Q6F3B5; Match level="QueryCoverage=98%, HitCoverage=34%, E-value=2e-32, Identity=39%"; Hit description =Expressed protein
MKSEFPACLRKRTVAVPSDVYANSNIMSDTVFLFPEGTSVQGETPFLWPLWFRAAVPGDTSLYMSIYYEMGDASSVIKYRTLRLHYNVQVSKPCPAMKYSILHQFVDIEIVIREDNHIPMMPNAPSYGYLPTLPPDPRQPARGMLEEMGDLNTVDFVLISRPFKSNDDPGFPNPPHVMSHHACHFSTASTGPISWLVDGPQTLHHDFSASFCEISLKMHIYNSSGATAFVRIDTLDSAGNGGHMNSVNVVQSATTDNQAGWHDITPVNELKVTSNVLETQPGKAPSLESVSSYIWSGSISTNLHIDAMSSAEIPLQICVFSPGTYDLSNYVLNWKLPSNGKGDSDETRQHSGKCQGYKYYLTVLQST

SEQ ID NO: 141554 - protein, 580 aa, Glycine max
  Coding DNA Sequence Number=SeqID_24776
  Gene Ontology: Mol. function=protein binding; Cellular component=cis -Golgi network; Biological process=ER to Golgi vesicle-mediated transport
  Homolog annotation: Hit_ID=Q6F3B5; Match level="QueryCoverage=68%, HitCoverage=36%, E-value=1e-134, Identity=52%"; Hit description =Expressed protein
MRSTFGASDCSLLCINSSLDTPIKTQDNPWASYITDASPTPSQDLGCFLNIDDINEVSATRKGFKNQIKNLWWRKGKEDGADSLNGPTYDFNSIESQIRVLGDYAFMLRDYELALSNYRLISTDYKIDKAWKRYAGVQEMMGLTYFMLDQSRKEAEYCMENAFNTYLDILHSAVMLEQASYCYLLSKPSMLRKYGFHLVLSGEQYKKCDQIKHAIRTYRSALSVFRGTTWSYINDHVHFHIGQWYASLGMYDVAVKHMTEILACSHQSKTTQELFLGDFLQIVEKTGRMFEVTKLQLPVINISSLKVIFEDYRTFGTPSAANTREGLWRSLEEEMLPSFSAAKTNWLELQSKLIPKKHSQSNVCVVGEAVTVNIEFKNPLQISIPISGVTLVCKYSASTDDVRSDENESSVEKDNEVDHFGNMSSDSSSFMVSDVDFLLGGGETTMLEYNGSRLQSLKMKIIVCSSWDFWERLNCPGHFLFPLNFLFHQSSTFWHCILLIQIQLSVTPRAEGSLEILGVRWKLSAFPLLKSQSIPKLQGSIHPLPGKTYAGDLRQLVLELRNPSEFPVKVPCLESTCSKF

SEQ ID NO: 141555 - protein, 168 aa, Glycine max
  Coding DNA Sequence Number=SeqID_24777
  Gene Ontology: Mol. function=nucleic acid binding; Cellular component= mitochondrion; Biological process=DNA integration
  Homolog annotation: Hit_ID=Q1SRN1; Match level="QueryCoverage=73%, HitCoverage=8%, E-value=3e-44, Identity=68%"; Hit description =Integrase, catalytic region
MTYLHLQILPKPQMVLRKKSMPERGGRKQDLKFNPIQGPANKDSVPCLPPVRIPIGCKWVFRVKENPKSMVNRHKPRLVAKGFNQYFGSDYTETFSPVSKPVTVRLILILAIIHCWTLKQLDVNNAFLNGILEEKVYMTQPPGFESHGKSLICRQHKAIHGLKQAPCA

SEQ ID NO: 141556 - protein, 324 aa, Glycine max
  Coding DNA Sequence Number=SeqID_24778
  Homolog annotation: Hit_ID=Q6F3B5; Match level="QueryCoverage=57%, HitCoverage=14%, E-value=7e-54, Identity=54%"; Hit description =Expressed protein
MRLLLSPYLIFAWTPIDETTSWRAKRTFPFRLNCVLCCVGSRWPLTAAEIRSALHLPHTTVSPVMMDPAMTPLGQMLLEEITPVVMLLSTPSVEEASLKNGLSFLQTLTPFCSFNNIDVPVRTASDQPYRLHKFKLRLFYASDVRKPDMKVAKEQLKQVITEAGEKEFSESCSDVSEINHEFSSSSEYQNTPSWFRFLNKELVRVASFSDHEAFDHPVICLVAVSSKDEQPISRFVDLFNTNKLPSLLNDGAMDPKVSKRYLLVHDNQDGPADRNDMIFNNQQFSISKLVDIAIFRTWSWLRGWEKGFAVPFQQWSSSMSLAFT

SEQ ID NO: 141557 - protein, 74 aa, Glycine max
  Coding DNA Sequence Number=SeqID_24779
  Subcellular localization annotation: CTP_CleavageSite=54; ConfidenceScore=5.18e-01
MAFMDDSNPLYNFQGTGHHRILSPTPTSFDTYYYQSISSSSLRVMMSRILTVVVVSEVGDGGAEGGIEAEIFQI

SEQ ID NO: 141558 - protein, 330 aa, Glycine max
  Coding DNA Sequence Number=SeqID_24780
  Gene Ontology: Mol. function=transcription factor activity; Cellular component=nucleus; Biological process=regulation of transcription, DNA-dependent
  Homolog annotation: Hit_ID=Q8LFU0; Match level="QueryCoverage=79%, HitCoverage=84%, E-value=6e-41, Identity=44%"; Hit description =Nuclear transcription factor Y subunit A-10
  Pfam annotation: Domain name=CBFB_NFYA; Domain location=161-217; Score=125.0; E_value=2.1e-34; Accession=PF02045.6; Description=CCAAT- binding transcription factor (CBF-BNF-YA) subunit B
MAMQTVYLKKHEGNAHNFVGTLSSAASAPWWSAFGSQSVHQGESCGQMKPFALELPNCIDQLAATKLSARGAEQVLGEGHTTQFTIFPDGCKMSDDAQKLQTTISLQSSLTDPHSRFEIGFSQPMLCAKYPYTDQFYGLFSAYAPQISGRIMLPLNMSSDDGPIYVNAKQYHGIIRRRQSRAKAVLDHKLTKRCKPYMHESRHLHAMRRPRGSGGRFLNTRSSINGNGKLGNEVHKTVGEQLQSSDSQSSEFLQSEVGTLNSSKETNGSSPNISGSEVTSMYSRGGLDSFSLNHLGSAVHSFANMIDGGRGMIIPPKWVAAAGNCYNLKV

SEQ ID NO: 141559 - protein, 599 aa, Glycine max
  Coding DNA Sequence Number=SeqID_24781
  Homolog annotation: Hit_ID=Q6Z130; Match level="QueryCoverage=46%, HitCoverage=79%, E-value=1e-117, Identity=74%"; Hit description =Hydrolase, TatD family like protein
  Pfam annotation: Domain name=SNARE; Domain location=206-268; Score =74.1; E_value=4.4e-19; Accession=PF05739.9; Description=SNARE domain
  Pfam annotation: Domain name=Syntaxin; Domain location=30-137; Score =43.1; E_value=9.3e-10; Accession=PF00804.15; Description=Syntaxin
  Pfam annotation: Domain name=TatD_DNase; Domain location=301-581; Score=227.9; E_value=2.2e-65; Accession=PF01026.11; Description=TatD related DNase
  Pfam module annotation: Pfam domain module=SNARE::Syntaxin::TatD _DNase; Domain location=206-268::30-137::301-581
MTLKVGKQQQQQQQQRHQHVIEITQGGGMDLDKFFQEVESVKEDLKELERLHLSLRATNQHGKALHSPKGVRELRSRMDLDVALSLTKAKLVKGRLAALHRTNQATLSLPGCGPGSYSDRTRTALVGALTKNLRQSMESFNKLREQISYEYRDTVQRRYYAVTGENPDQETIDLLISTGESETFLQKAIQQQGRATIMDTIQEIQERHDTMKEIERNLHELHQVFMDMAVLIQHQGEHLDNIESHMELANSFVSIGVQHLQVVRSHQKNTRNCTCFAILLFIIVLVSLKEEEIEENEGKGLRLDDVVHVTGGSLEESREALAIAETDGRLFCTVGVHPTRCKEFEESGDPEKHFQALLSLAKEGIQKGKVVAIGECGLDYDRLHFCPAEIQKKYFEKQFELAYITKLPMFLHMRAAAADFCEIVEKNKDRNLEKDRYMGFNIHQNSATLRFTAGVTHSFTGSMDDCIKLLSFDKMYIGINGCSLKTTENLDVVKGIPVERMMIETDSPYCEIKNTHAGIGFVKSTWPSKKKEKYDQECIVKGRNEPCLVKQVLEVVAGCKGINDVSNLSRTLYHNTCRIFFPHDLDSAADALLAGGNST

SEQ ID NO: 141560 - protein, 354 aa, Glycine max
  Coding DNA Sequence Number=SeqID_24782
  Gene Ontology: Mol. function=heat shock protein binding; Cellular component=nucleus; Biological process=protein folding
  Homolog annotation: Hit_ID=O04087; Match level="QueryCoverage=56%, HitCoverage=45%, E-value=4e-65, Identity=58%"; Hit description=DnaJ isolog; 47062-48761
  Pfam annotation: Domain name=DnaJ_C; Domain location=226-349; Score =30.6; E_value=5.8e-09; Accession=PF01556.9; Description=DnaJ C terminal region
  Subcellular localization annotation: CTP_CleavageSite=29; ConfidenceScore=5.10e-01
MVGITCVFGKNSIRDLCKPYKSFIRRWFRRNKKSSSSSRHNPQRQKQTQQEHMKEDRTTNGIHGFRSNGNGMRSINDDDSPMSLRGCGLCRHRSLDNSSCFPSENSGSRNNASRKINHPASSKSCDFIPTPSSSWNSSGSFRMPPHDLKSRNASRKRDTPIMYSNSSGMLKPPPIEKRLECTLEDLCYGCKKKIMITRDVLTDTGGIVQEEELLTINVQPGWTKGTKITFEGKGNERPGAYREDIIFIISEKRHQLFRREGDDLELGVEIPLVKALTGCTILVPLLGREHMNLTLDNIIHPGFEKIIPGQGMPISREPGKRGDLKITFLVEFPTKLTGNQRSEVVRILQNSTPS

SEQ ID NO: 141561 - protein, 333 aa, Glycine max
  Coding DNA Sequence Number=SeqID_24783
  Homolog annotation: Hit_ID=Q47522; Match level="QueryCoverage=15%, HitCoverage=62%, E-value=2e-21, Identity=94%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIQAFTIKLKKDLPLEEIEQILASHNEWVKVIPNDKETTLRELTPAKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141562 - protein, 71 aa, Glycine max
  Coding DNA Sequence Number=SeqID_24784
  Gene Ontology: Mol. function=RNA-directed DNA polymerase activity; Biological process=RNA-dependent DNA replication
MASEDIEKMAFVTLWGTFCYKVISFRLKNAGATYQRAMVALFHDMMHKEIKVYVDDMIAKSKIEEEHLVNL

SEQ ID NO: 141563 - protein, 130 aa, Glycine max
  Coding DNA Sequence Number=SeqID_24785
  Gene Ontology: Mol. function=unspecific monooxygenase activity
  Homolog annotation: Hit_ID=O04892; Match level="QueryCoverage=70%, HitCoverage=27%, E-value=2e-15, Identity=54%"; Hit description =Cytochrome P450 like_TBP
GPAAGRAPHVAWCPVRPRRPWKIRRTECLPRPVVLITASGLQGEQPLVDGTIPEPVGCRWTARAASAARAGRRVPVGGRIGNGPFGASSPGVEQSTQNCALNVKVKKFNQARVNGGSNYDSLKVAKCLVI

SEQ ID NO: 141564 - protein, 100 aa, Glycine max
  Coding DNA Sequence Number=SeqID_24786
MISVNPNSRSQVAGGDTQVVIGTKRFLLILTREVRWQAEIPYETNVVTCTLCQPRASEPVDTQRLTSPSAPLSSRDGESDDMRRYPSGYLYKPTSINLNP

SEQ ID NO: 141565 - protein, 60 aa, Glycine max
  Coding DNA Sequence Number=SeqID_24787
MGGYIHYGSLACKGFYKVERNLKNRWLLGDWITSCYHAFALIIKMYVSLGSFNSGNWSDS

SEQ ID NO: 141566 - protein, 137 aa, Glycine max
  Coding DNA Sequence Number=SeqID_24788
  Homolog annotation: Hit_ID=Q1SUH7; Match level="QueryCoverage=36%, HitCoverage=4%, E-value=5e-08, Identity=48%"; Hit description =WW/Rsp5/WWP; Synaptojanin, N-terminal; Galactose-binding like
MVAWREASMEIEGRCTDTSFENKREGVVVWGPSLNFISSLSLANFQPNSCSFVQILGALRDTSVIVVTLDLDEVFIIARLYTRTDTHSEASDFITNGSRFACRSRTLVSRREREEEGIASDRQNWCWRVERESAEKK

SEQ ID NO: 141567 - protein, 854 aa, Glycine max
  Coding DNA Sequence Number=SeqID_24789
  Homolog annotation: Hit_ID=Q8RU34; Match level="QueryCoverage=91%, HitCoverage=95%, E-value=1e-63, Identity=37%"; Hit description=Bzip transcription factor-like
  Pfam annotation: Domain name=DUF630; Domain location=53-112; Score =129.8; E_value=7.4e-36; Accession=PF04783.3; Description=Protein of unknown function (DUF630)
  Pfam annotation: Domain name=DUF632; Domain location=421-726; Score =284.8; E_value=1.7e-82; Accession=PF04782.3; Description=Protein of unknown function (DUF632)
  Pfam module annotation: Pfam domain module=DUF630::DUF632; Domain location=53-112::421-726
MEALKNINGRPPHGRILTSKVHGPEDQSDDFTYLLLHYATLKHALLPSRLTHMGCGGSKVEDFPAVVLCRERKAFLKAASEQRYALAAAHVAYFRSLREIGDALHKFAEQDLTTTTTGSSSPVLTLPSETKSINNKLSSSSPSISHADSPNGSHLPLSSGSELSSPSHSSSPHIHDSPESDPPPYGYYQNYHYAHYMKRSVPRGKPMVYEEPERHVATNGQWPDPSYGHANTGFYGFPGGDYPYYPPPGPSYSPPRPPPAPPSPPRVSTWDFLNLFDNFDNGYPSYPPRFGSSASSPDSKEVREREGIPELEEETEHEIMKEKEKEVPLKKEKKKVGEQKGFGVVGVRDFGEGPSNTKTVPLQQVSSSEGSSKTVRFHDGSDNGSVEKEIKSSPDTVASEERGAKKGVSFEIDEATVTTVDGDSSVLSSVTTLSAHGTRDLLEVVEEIQGEFVTASNFGKEVALLLEVCKPPYRSRVAALRVIFSRILQMVAPSRLPSDPLSIQFSSREIKLAQAYCGEPGKEFKTNPENLSSTLEKLYAWEKKLYKEVKDEERLRAIYEKKFKRLKTLDNLGAESKPRDPRGQELMVARFIRMWKFMLKCHQKQFQAIMESKSQSLKINIGLQGDEGLKAIVELEKELLNWCSQFNNWVKTQKSYVKNLNEWLIRCLPNEPEETADGIAPFSPSRFDAPPVFIICNDWNHAMNRISETGVAEAMHEFALKLHELWERQDEVQRQRIKAEYLRKDFEKQLRTLRTEMGGSEHEHDKVSGKIALSKLASDSGVSPLDDLKVDLDSMKKKLQEERVRHKEAIKLVRDAANNSLQAGLIPIFKTLESFTSEVVKAHEQVRLQSAGDS

SEQ ID NO: 141568 - protein, 187 aa, Glycine max
  Coding DNA Sequence Number=SeqID_24790
  Gene Ontology: Mol. function=peroxidase activity; Cellular component =chloroplast thylakoid membrane; Biological process=response to oxidative stress
  Homolog annotation: Hit_ID=Q5QHW7; Match level="QueryCoverage=85%, HitCoverage=38%, E-value=3e-75, Identity=88%"; Hit description =Chloroplast thylakoid-bound ascorbate peroxidase
MSRGTAILLKHNKTAGNSHVFLTLTLQKDGPGAPGGQSWTVQWLKFDNSYFKDIKEKKDEDLLVLPTDAALFEDPSFKVYAEKYAEDQEAFFKDYAEAHAKLSNLGAKFDPPEGIVIDDSPNAGAEKFVAAKYSTGKRELSDGMKQKIRAEYEAIGGSPDKPLQSNYFLNIIIIIAVLAFLTSLLGN

SEQ ID NO: 141569 - protein, 72 aa, Glycine max
  Coding DNA Sequence Number=SeqID_24791
MVVGRITIYLPLGFTLFLFASVPSQISANESYVLTLDHSNFSDTISISSSLSSTHHVSSDLNGHFGKGETKE

SEQ ID NO: 141570 - protein, 199 aa, Glycine max
  Coding DNA Sequence Number=SeqID_24792
  Pfam annotation: Domain name=PHD; Domain location=18-72; Score=9.9; E_ value=0.0058; Accession=PF00628.19; Description=PHD-finger
  Subcellular localization annotation: CTP_CleavageSite=21; ConfidenceScore=5.32e-01
MNRLVCTSCVLRLHPSFFCPSCFDFFDHPLSNTSSAFAHRFVSCTKCSSLTHLSCLPSPPPSPFLCPPCSQHNFSFFPDSTAPLDKRRALILLCACKLAAASVAKSLALARTRVERTVREAALARKRARDALDHCSTVEKIKRLGLQGTFDASNSKYLGMGTMNHNHNNVTVLNGFVGPQGKVKADVNNIDAKLPNRVA

SEQ ID NO: 141571 - protein, 79 aa, Glycine max
  Coding DNA Sequence Number=SeqID_24793
  Gene Ontology: Mol. function=protein binding; Cellular component =mitochondrion; Biological process=ubiquitin cycle
  Homolog annotation: Hit_ID=Q1SJZ0; Match level="QueryCoverage=92%, HitCoverage=22%, E-value=4e-30, Identity=86%"; Hit description =Cyclin-like F-box
MASGSDFALAVSSELESVLRLETVNYFVTRRPWLDLYGVNVRPVAPVGSASRRPYVDPALIHRSLPDELLFEVFHFIKL

SEQ ID NO: 141572 - protein, 105 aa, Glycine max
  Coding DNA Sequence Number=SeqID_24794
  Homolog annotation: Hit_ID=Q1SJY2; Match level="QueryCoverage=50%, HitCoverage=7%, E-value=4e-12, Identity=60%"; Hit description =Galactose-binding like
MVKVWWCFSFAFILIRVFIGAVYGDNVTYDGRSLIIDGQHKILFSGSIHYPRSTPQVRNIKQYCSIIRNTTLAAAMVGSRCFCFTLFYLRYRMLNNLMGGKRKEE

SEQ ID NO: 141573 - protein, 236 aa, Glycine max
  Coding DNA Sequence Number=SeqID_24795
  Gene Ontology: Mol. function=protein binding; Cellular component=Cul3- RING ubiquitin ligase complex
  Homolog annotation: Hit_ID=Q1SJY8; Match level="QueryCoverage=99%, HitCoverage=60%, E-value=2e-66, Identity=59%"; Hit description =BTB/POZ; TRAF-like
MGDRVETLARLAQWKIDNFGPCSYKKSDPFKLGIWNWCVLSVCVCVFEMNDLHFEPDQVLKDNPPFSRFVLRVSAASYFPCGLVIGEDWLLHAIGEITFVHCCLLCDCYWGMHPKRDGRVTISVQEKLLRTHDDFVWPVDTTFVGRLIIDVEFLDLKICPPNGGETSSVWPSDGNSQSIAFQNSTLRCLSRMLDEAIHADLTIMTADGSTLRAHKAVLSASSPVFQSMYHLNLKEK

SEQ ID NO: 141574 - protein, 224 aa, Glycine max
  Coding DNA Sequence Number=SeqID_24796
  Gene Ontology: Mol. function=protein binding; Cellular component =mitochondrion; Biological process=ubiquitin cycle
  Homolog annotation: Hit_ID=Q1SJZ0; Match level="QueryCoverage=78%, HitCoverage=50%, E-value=1e-84, Identity=82%"; Hit description =Cyclin-like F-box
MTPYDLGRASCVCRKWKYTIRNPVFWRNACLKAWQLSGIVENYRILQSKYDGSWRKMWLSRPRLRTDGLFVLQCSHISGLYVSRNTYIRAGVAEWKITNPVHVVCYFRYLRFFPSGRFLYKNSSQKVKDVAKCMNFRSSKADCVFGGHYTLSDDKVEAAVLYPGMRPTVLRIRLRLGFDVPLYSYHFTNIQWIPQNNSLPSPMPNKKKEASNSRGISFSAWIME

SEQ ID NO: 141575 - protein, 621 aa, Glycine max
  Coding DNA Sequence Number=SeqID_24797
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=82%, E-value=1e-116, Identity=47%"; Hit description =Integrase, catalytic region
  Pfam annotation: Domain name=zf-CCHC; Domain location=207-224; Score =9.9; E_value=0.023; Accession=PF00098.13; Description=Zinc knuckle
  Pfam annotation: Domain name=zf-CCHC; Domain location=243-260; Score =11.7; E_value=0.012; Accession=PF00098.13; Description=Zinc knuckle
  Pfam module annotation: Pfam domain module=RVT_2::Retrotrans_gag::zf -CCHC::zf-CCHC; Domain location=312-567::38-153::207-224::243-260
RSMITALSAKNKLEFVDGSAPEPLKTDRTYGAWRRCNNMVLSWIVHSVATSIRQSILWMDKAEDIWRDLKSRYSQGDLLRISDLQQEASTLRQGTLSVTEYFTRLRVIWDEIENFRPDPACTCNIRCSCSAFAIIAQRKLEDRAMQFLRGLNDQYTNIRSHVLLMDPIPAITKIFSYVAQQERKLLGNSSPNLNFDPKDVSINVAKTICDYCGRIGHTENICYKKHGMPLNHETRNKSTGGRKSCTHCGKMGHTVDVCYRKHGYPPGYKPYNGRSTVNNVVTMDSQPVEDQNQHLEPSSYAEASQYDCWIKAMEAELQALQSNNTWKLTPLPPHKTTIGCRWVYKIKHRADGSIERYKARLVAKGYTQMEGLDYLDTFSPVAKLTTVRLLLAMAAFNQWHLRQLDVNNAFLHGELDEEVYMQVPPGLLVPNSQMVCRLQRSLYGLKQASRQWFTKLSGLLTSLGFEKSHSDHSLFLRFTGSITTVLLVYVDDIILTGNSESEIQDVIKLLDQAFKIKDLGNLKYFLGLEIARSSSGIHLCQRKYTLDILSDSGMLGCQPNVTPMDYSTKLQATAGIPLSTEASSSYRRLIGRLIYLTNTRPDITYAVQQLSQYMSNPTSVH

SEQ ID NO: 141576 - protein, 170 aa, Glycine max
  Coding DNA Sequence Number=SeqID_24798
  Gene Ontology: Mol. function=carbon-sulfur lyase activity; Cellular component=nucleus; Biological process=metabolic process
  Homolog annotation: Hit_ID=Q4LEX7; Match level="QueryCoverage=79%, HitCoverage=100%, E-value=3e-58, Identity=77%"; Hit description =Hypothetical protein MP
  Pfam annotation: Domain name=DUF636; Domain location=28-122; Score =102.4; E_value=1.4e-27; Accession=PF04828.4; Description=Protein of unknown function (DUF636)
MAEKRHAKCHCGAVAFTVELSDGLNTARRCSCSFCRMRGAVVVSAPLSGITVTKGQDKLTEYRFNTGTARHFFCSVCGIYTFHQRRSNPNEYGVNVACLENVSPFDFPEVTVMDGVNHPMDGESGVFGYLSFREKGTGEIMLCVEKDDPREAPESGDKKPQPAIRLAAIQ

SEQ ID NO: 141577 - protein, 128 aa, Glycine max
  Coding DNA Sequence Number=SeqID_24799
MLSVVRNLAGQILVTDPRKEEGVSINPTFNVSVIFGKRDEPMLVACARQMIEHMSLSGSSRPLVLSLGLKDHSVETLKGIVSAVMDNNMCKFNSVLLTFALQIIESEEDRECLNKELVGKWRETKNST

SEQ ID NO: 141578 - protein, 347 aa, Glycine max
  Coding DNA Sequence Number=SeqID_24800
  Gene Ontology: Mol. function=RNA-directed DNA polymerase activity; Cellular component=nucleus; Biological process=RNA-dependent DNA replication
MHQEIIKYLNELYEKEDSQSLTKEKISKRIELQESFWKDPSKVKLEIRNFFLERFGEKERNRLYIDRVNLSQISLEEKKKLEARFEEEEIKEVAWDCESSKSPGPNGFYFKFITAFRNTLKGDIIKFIHEFHMNGVLPKGCNSSFIALIPKIDDPQNLGDYRPISLVDCMYKILAKLLARRIKGALTKVIDKRQSVFLEGRNLFHSVLVENEPVDEARRRKKKCLVFKVNYEKAYDSISWDFLFYMLRRLGLGVKWIGWIKQCLTKTHISILVNGSPIDEFSPQRVLRQGDPLAPFLFTIVAEGLCDMMKEAFAKDLFQGFLVGRDGIEINLLQYVDDILFSLECYI

SEQ ID NO: 141579 - protein, 143 aa, Glycine max
  Coding DNA Sequence Number=SeqID_24801
  Homolog annotation: Hit_ID=Q10KU3; Match level="QueryCoverage=69%, HitCoverage=9%, E-value=3e-15, Identity=44%"; Hit description =Expressed protein
MGNNNLLAMVYGDLQDALDLLNTSKQHNTNVKKALENAIEQQMVVKWNVGVLQLFVGKNDKVWRCVSPIGGNPKKYSKETWNEIKKSLTTPFGRLAIMGTQCKYEAGILIKNMCLKNHALGDVLQILNIGHSMPNTTKGMQWK

SEQ ID NO: 141580 - protein, 93 aa, Glycine max
  Coding DNA Sequence Number=SeqID_24802
MNVSTPIASMKTASPPVHEKGKSCERERKKNIFFSVGSTIIISKKLDIEGSIVVSYGAEPIPLTHTSHGHINLSTLTSKDMTFKLFRFSYAGY

SEQ ID NO: 141581 - protein, 341 aa, Glycine max
  Coding DNA Sequence Number=SeqID_24803
  Gene Ontology: Mol. function=helicase activity; Biological process =metabolic process
  Homolog annotation: Hit_ID=Q10C42; Match level="QueryCoverage=84%, HitCoverage=37%, E-value=6e-38, Identity=36%"; Hit description =Expressed protein
  Pfam annotation: Domain name=PPR; Domain location=125-159; Score=4.9; E_value=1.9; Accession=PF01535.11; Description=PPR repeat
  Pfam annotation: Domain name=PPR; Domain location=197-231; Score=2.0; E_value=4.4; Accession=PF01535.11; Description=PPR repeat
  Pfam annotation: Domain name=PPR; Domain location=232-266; Score =21.0; E_value=0.0043; Accession=PF01535.11; Description=PPR repeat
  Pfam annotation: Domain name=PPR; Domain location=280-313; Score=6.9; E_value=1.1; Accession=PF01535.11; Description=PPR repeat
  Pfam annotation: Domain name=PPR; Domain location=90-124; Score=0.2; E_value=7.1; Accession=PF01535.11; Description=PPR repeat
  Pfam module annotation: Pfam domain module=PPR::PPR::PPR::PPR::PPR; Domain location=125-159::197-231::232-266::280-313::90-124
MAIKLPSSAHPTRFLRWVYLSSSCIADISETPGILKPKDSSEFDQNLNFLKNKLAPDNLIRVLDRTSDLNSAVRIFKWASRQKSFHHTSNTYFRIILKLGMAGKVLEMRDFCEYMVKDRCPGAEEALVALVHTFVGHRRIKEAIVVLVNMNLGGYRPPIEVFNVLLGALVGGESRDFQSALFVYKEMVKACVLPTVDILNYLLEVLFATNRNELALHQFRRMNNKGCDSNSKTFEILVKGLIESGRVDEAATVLEQMLKHKWKINEAIMFLEDTQVHETAPFNRLLEGCCNASEVLAANVLLETMSERNIADCQSWNILIRWLCEEMLILKMPLKCFTICL

SEQ ID NO: 141582 - protein, 53 aa, Glycine max
  Coding DNA Sequence Number=SeqID_24804
MSEGYRHDETNYHRLDCTTAKVLEKCEARAIWLMPSTQTWVHRHRGERHYTRL

SEQ ID NO: 141583 - protein, 175 aa, Glycine max
  Coding DNA Sequence Number=SeqID_24805
  Subcellular localization annotation: CTP_CleavageSite=72; ConfidenceScore=5.47e-01
MKHFTDTLISANILLAGFPPPFMPSAFTPATRPNWGFFSCAPMCTPAYVRRLRSCACCPDFPILPYGLAALRSGATNYPCAIGTTRFNMPTTSSTGMQQPMSVLADDLYIQLAPATRFEPTTAPSGRMRHWLLLLAAVVDRQTLFSSSVVKLVKVQWGQGSDSIYIYIGSSGCYA

SEQ ID NO: 141584 - protein, 137 aa, Glycine max
  Coding DNA Sequence Number=SeqID_24806
  Gene Ontology: Mol. function=small conjugating protein ligase activity; Cellular component=cellular_component; Biological process =protein modification process
  Homolog annotation: Hit_ID=Q9SDY5; Match level="QueryCoverage=56%, HitCoverage=41%, E-value=3e-31, Identity=82%"; Hit description=NEDD8- conjugating enzyme Ubc12
MPLEAPVRRVDCIFSSPMKRGKGKPIRTLDWKLTHYLRLWFLPYYSVIQVFGYIGVSLLADISELNLPKSCSMQFPNGKDDLMNFKVSIRPDKGYYKGGTFLFTFQVSPIYPHEAPKVKVQDKGLPSKYRLGRKCLP

SEQ ID NO: 141585 - protein, 232 aa, Glycine max
  Coding DNA Sequence Number=SeqID_24807
  Gene Ontology: Mol. function=helicase activity; Biological process =viral genome replication
  Homolog annotation: Hit_ID=Q1SN45; Match level="QueryCoverage=92%, HitCoverage=12%, E-value=3e-79, Identity=61%"; Hit description=AAA ATPase
MHYAQPVDEIKEYYDCRYVSACEGAWRIFEFDLHYKWLPVQRLIFHLPNQQAVYFNDYEEIESFVERHEQVQTMFLAWFEANKNFVVGRDLTYSEFPTKFVYCQKEKMWQPRKKGQSIGTLQYIPPGIGELYYMRILLTMQRGCTGYDCLKTVSGEKYNTFQEACYELGFLANDREFIDAINEGSELATGNQFRRLFVTLLAMNTMTKPSDVWNETCELYCVMEYYMTRGRN

SEQ ID NO: 141586 - protein, 130 aa, Glycine max
  Coding DNA Sequence Number=SeqID_24808
  Gene Ontology: Mol. function=helicase activity
  Homolog annotation: Hit_ID=Q1SN45; Match level="QueryCoverage=55%, HitCoverage=4%, E-value=2e-14, Identity=56%"; Hit description=AAA ATPase
MEVIKVTRYSDHDCTIARAAEMIIHYLASCFFKLQDLLRSIYGRTNNIASFDLALPWLILQVESSLITNGIEKVEWAVHPRGRSREAKPLKATLRTINPFDRMPADKVFHKNVLLVPHIHIRKKIYLIQT

SEQ ID NO: 141587 - protein, 63 aa, Glycine max
  Coding DNA Sequence Number=SeqID_24809
LSTPSGLVDNDRRREALRVRITADGEADASKVGGGGGGGGGGGVEAENKEGNEQQFEGCTFRN

SEQ ID NO: 141588 - protein, 60 aa, Glycine max
  Coding DNA Sequence Number=SeqID_24810
  Homolog annotation: Hit_ID=Q10QE9; Match level="QueryCoverage=93%, HitCoverage=14%, E-value=1e-11, Identity=54%"; Hit description =Expressed protein
NDDFAIKNEDVMKFAIDEIKKKIETFSETMESLSAHADKCSRQIRRARTVVVQNIIKKPD

SEQ ID NO: 141589 - protein, 85 aa, Glycine max
  Coding DNA Sequence Number=SeqID_24811
MMGRLGRGKSWGSLGNFNVFIPGGSELSNKDCRNGKDLLGYRALLKECSAYLFVWASACFSDLNVVRLYQHHHHIFVTLNKKFKQ

SEQ ID NO: 141590 - protein, 146 aa, Glycine max
  Coding DNA Sequence Number=SeqID_24812
ERSALEGRTRAISSGRSGSENVGLSNANVVENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 141591 - protein, 439 aa, Glycine max
  Coding DNA Sequence Number=SeqID_24813
  Gene Ontology: Mol. function=protein binding; Biological process =regulation of transcription
  Homolog annotation: Hit_ID=Q8GX15; Match level="QueryCoverage=87%, HitCoverage=91%, E-value=1e-61, Identity=46%"; Hit description=Ap2 SCARECROW-like protein
  Pfam annotation: Domain name=GRAS; Domain location=130-369; Score =68.7; E_value=1.9e-17; Accession=PF03514.5; Description=GRAS family transcription factor
  Subcellular localization annotation: CTP_CleavageSite=8; ConfidenceScore=5.02e-01
MRVPSSPQASNNHVLHTNNNPNTFTYEPTSVLDLCRSPSPEKKLTVPKPEPQHNNQLDLDDHVLPNSDWWESIMKDLTLPEDSPTPLLKTNPSCIPDFPPSSQDPSFDHPTPDFTSLSEIYNQNIPFNYPSNTLEPSFHDLNHSLHPHNNNWDFIEEFIRAADCYDSSHFQLAQAILERLNNRLLRSPMGKPLHRAAFHFKDALQSILSGSNRNGNEIAEKAGPGTAPLLRITAVVPEEYAVESRLVRQNLNQFAQDLGISAQVDFVPLRTFETVSFKAVRFIDGEKIAVLLSPTIFSRLGGNGGSVGAFLADVRRMAPGVVVFVDGEGWTEAAAAASFRRGVVSSLEFYSMMLESLDASVASGGGGEWVRRIEMLLLRPKIFAAVEGARRRTPPWREAFYGAGMRPVQLSQFADYQAECLLAKVQIRGFHVDKRHAEL

SEQ ID NO: 141592 - protein, 120 aa, Glycine max
  Coding DNA Sequence Number=SeqID_24814
MGTTTGEELATQLAQASSARPSEQGCFLQKQPPSGGRIWKAQVTNPYGSCIYSFFIFRRSYGNSRIEQQYFLLVAVALWNFTDRVTLLPFDFRRVSGLTYCATKGAEYLEAANQRLHVIK

SEQ ID NO: 141593 - protein, 102 aa, Glycine max
  Coding DNA Sequence Number=SeqID_24815
MTNSLETRIHDVGYNVQDILPENTGIAKSIEAAGSTMSDTMSRTSCPKILELLKALKLQDPRCRIRCPGHLARKYWTYKSVISLTDYCAVSKRLDDLSLGTN

SEQ ID NO: 141594 - protein, 76 aa, Glycine max
  Coding DNA Sequence Number=SeqID_24816
MEVMVTLEQNLQLHAINERIETNATLCLLHHVVLPRQQPQGNGGRAFESPHNAMNNERIYGNTKVGFMEEEVKGEE

SEQ ID NO: 141595 - protein, 288 aa, Glycine max
  Coding DNA Sequence Number=SeqID_24817
MTSKNNTGILRFIPTNCTKGGRTGVGEEDLKWWHSRPVSPRSARDERTSHVMVLERSDMRRSARCKVSDAKSLDKEFKLIWAKWVRFESGVRVGSGVGSTRSILGQLGSSSSATRRKAFRGVAMSSRVAPEMAEVATVSAVESAAEAVMEKDIQLGVEAVCSGIKFGQDGLEAVLASRRKVMVGWRLLWMVVVGAVMASMEGSHRSSVRQVTAMEGNHGSSVRRVAAMEAPYSEVSTSKNKEEEGEDKLVSRLPVPQEEEEKQRAEQHRIFHPAHNTPARSCSNEVTK

SEQ ID NO: 141596 - protein, 153 aa, Glycine max
  Coding DNA Sequence Number=SeqID_24818
  Homolog annotation: Hit_ID=Q9SUF1; Match level="QueryCoverage=42%, HitCoverage=17%, E-value=1e-09, Identity=50%"; Hit description =Nodulin-like protein
  Subcellular localization annotation: CTP_CleavageSite=48; ConfidenceScore=5.72e-01
MKLANYSPLCFSSSSRGIGNLKTNLSSPSSSLFLEVLTLEVSNQASARSSNLWNYVLCARVGIAKQRTGIFTAFNPLCMIITSALGSFIFAEQLHLGSIIGAIIIAVGLYSVVCGKGKGKGKDKGKDYSDPTPPSPTTKKTETQHLPITSSDI

SEQ ID NO: 141597 - protein, 126 aa, Glycine max
  Coding DNA Sequence Number=SeqID_24819
  Subcellular localization annotation: CTP_CleavageSite=29; ConfidenceScore=5.28e-01
PPSLGTDVWGANTFPVRKYNSRTFHLKVRRSRLFQFFWRFPQINVGGDSACIPFVEHASRESRVALPPKAPVFSLGLRVKCGALSEFTLAQRLCAAHPSSRFFCALSQRMVRLADGWPSEWPGSAG

SEQ ID NO: 141598 - protein, 94 aa, Glycine max
  Coding DNA Sequence Number=SeqID_24820
MAYKVIMKDMQVQDIPNKQIQRTSLKEIIGKIYHVRDSTQSWLLCILHNQTSTAKNADPYTRKVLGANNFTRGHPIDIHTQIFLHLLINARTMV

SEQ ID NO: 141599 - protein, 634 aa, Glycine max
  Coding DNA Sequence Number=SeqID_24821
  Gene Ontology: Mol. function=protein binding; Cellular component =nucleus; Biological process=regulation of progression through cell cycle
  Homolog annotation: Hit_ID=Q39879; Match level="QueryCoverage=72%, HitCoverage=95%, E-value=0.0, Identity=90%"; Hit description=Mitotic cyclin a2-type
  Pfam annotation: Domain name=Cyclin_C; Domain location=348-473; Score= 155.7; E_value=1.2e-43; Accession=PF02984.9; Description=Cyclin, C -terminal domain
  Pfam annotation: Domain name=Cyclin_N; Domain location=222-346; Score= 214.2; E_value=2.9e-61; Accession=PF00134.13; Description=Cyclin, N -terminal domain
  Pfam module annotation: Pfam domain module=Cyclin_C::Cyclin_N; Domain location=348-473::222-346
  Subcellular localization annotation: CTP_CleavageSite=62; ConfidenceScore=5.82e-01
MSTQNRRSSFSSSTTSSLAKRHASASTTSSLAAAPTNMAKKRPPLSNLTNTVAHRNSSSSVPCAAKFAKTKKDVVPACSGNKRPTLANVKPASAVIFPKANSFPVKNEAPPTPPPPVATVTVPAPVVDVSPSKSDTMSVSTDESMSSCDSFKSPDIEYVDNSDVAAVDSIERKTFSHLNISDSTEGNICSREILVELEKGDKFVNVDNNYADPQLCATFACDIYKHLRASEAKKRPSTDFMEKIQKEINSSMRAILIDWLVEVAEEYRLVPDTLYLTVNYIDRYLSGNVMNRQRLQLLGVASMMIASKYEEICAPQVEEFCYITDNTYFKEEMESAVLNFLKFEMTAPTVKCFLRRFVRAAQGVDEVPSLQLECLTNYIAELSLMEYSMLGYAPSLVAASAIFLAKFILFPSKKPWNSTLQHYTLYQPSDLCVCVKDLHRLCCNSPNSNLPAIREKYSQHKGVIRVGDWLSRNTRIVRSKRNVLPVGAETRVVRLLTRPVFNQFPQPGSVGVDQVELVVCSTRLEAKTIQSPSGDQLHMVSFHAPSVFLSPSTASITYKFFEPDRYVYQIFSVGGNTGLVFQERDLDSGWVLPKDDVVLKHPSSIVSGMLHLSSNVLFFSYIQELPVPLATFRE

SEQ ID NO: 141600 - protein, 125 aa, Glycine max
  Coding DNA Sequence Number=SeqID_24822
MADMPFLGNCKARYDGVSIKEIVTGTQVVISPMTNVVVSGCAMEDFEASWSGGFLDGAIIWSYSTKGATFINMRIAEKLPDYVERHITKKVKKEVIETPLSNADQTIGTQANPLDLESRASSQMK

SEQ ID NO: 141601 - protein, 104 aa, Glycine max
  Coding DNA Sequence Number=SeqID_24823
MMNEGESGVWKLNKVSLPLTDVHPGDASSSIFYALGIIIGLSTADWNLLFGGSLPCPDFFFRMIEAHTQLIFKLDVFCVKGFPKHSMILGKHYIEGSDQTKKLM

SEQ ID NO: 141602 - protein, 113 aa, Glycine max
  Coding DNA Sequence Number=SeqID_24824
MAMEIYNGPPPYQEYVKFLETTQLRTREALTEVLQDMAHVKREAKTCKILGEHLFRKYVDAFFGSSFDDESRDEFFRKLEEEEEVIKKRGRKSKKMKNATIAKDAQAKGEHII

SEQ ID NO: 141603 - protein, 237 aa, Glycine max
  Coding DNA Sequence Number=SeqID_24825
KSKEFFVCIFLENAMISLSASDALSEFINVAHAKRRPHGLSAIPCGMHKAKPALLAKPLVEIIVLWAKRMASRKRKSTASRPAAQYDTRRFQSLEAWNKYTDNIVGQNILPERNVKIYHTKFDEFKVELERRNLHERLTNLSDGSINVAVVKEFYANLYTIEDQAPKQARVRGHLIKIDADSLNEFLQTTVVLEEGNLYPPTLDFAGSDYTSPDIECLLLHNLAPTSHTSDLNMDKA

SEQ ID NO: 141604 - protein, 101 aa, Glycine max
  Coding DNA Sequence Number=SeqID_24826
MVETPTMPQPNEDRVHSNDSICDMVNDAFRPYPDNNDMEEDKDMSPKASQTMLDDITELLELMKDGEQSLYEWLLDPFNFLNMAIYRKEPRGAEKFAQANL

SEQ ID NO: 141605 - protein, 79 aa, Glycine max
  Coding DNA Sequence Number=SeqID_24827
  Gene Ontology: Mol. function=RNA-directed DNA polymerase activity; Biological process=RNA-dependent DNA replication
MASEDMEKTTFVTLSGTFCYKVMSFGLKNAGTTYQQAMVALFHDKMHKEIEVYVDDMIAKSKLRRITSSTYRSCSRGCC

SEQ ID NO: 141606 - protein, 105 aa, Glycine max
  Coding DNA Sequence Number=SeqID_24828
MVFASCLYSSPFSLNHIPYNQQLMPPFIFDLPTITHHQILHDHHHPNTSHLHATTIDTTTIETLSQPRATTEMMPDLFGKQNWKLILDSHKDIFDERTEVDLKDE

SEQ ID NO: 141607 - protein, 56 aa, Glycine max
  Coding DNA Sequence Number=SeqID_24829
PVLSLGLRVKGGALSEFTLAQRLCAAHPSSRFFCALSQRMVRLADGWPSEWPGSAG

SEQ ID NO: 141608 - protein, 68 aa, Glycine max
  Coding DNA Sequence Number=SeqID_24830
MGSKVENVGCFLIFLRVRDFNMNKKACAILKAVANFGANLCLVAASAWAVQVFFVDMLDIVNDNVAIP

SEQ ID NO: 141609 - protein, 475 aa, Glycine max
  Coding DNA Sequence Number=SeqID_24831
  Gene Ontology: Mol. function=heat shock protein binding; Cellular component=integral to membrane; Biological process=protein folding
  Homolog annotation: Hit_ID=Q2R031; Match level="QueryCoverage=40%, HitCoverage=21%, E-value=2e-35, Identity=45%"; Hit description =Expressed protein
  Subcellular localization annotation: CTP_CleavageSite=63; ConfidenceScore=5.28e-01
MDEFGVLTERFGLKPQGKSAPMARAKRPPNVADSQTRPNSKSPLNGSPSHQNSTFDFDYGFFSSSNNSNTDNKTQRFDDIFGVDAKSNGASFDYDSIFSGSNKPVSASSYVDDIFGGMHEKSVGVDDLLDKIGGLNTNAKSPNTKTPAFDYLIPGFGVSNNGVEMNKQSVTPNKPAAAASQDDPFLIFETASSSASSESFLNALEQISRSNNSKGTKGGSPSLKSPPKPMSKVNRPSVSTIDELEDFAMGGAQTNASSRKANVNAAETKQNLAARMNNGKRVPAARVNQANGVDDLESFFSMGSRSSSVPKSRTPTMDHMYDNQMKNKERPEVSPRVPSRSSASVNKSPVMTSLDDLSLMFGGSPSSEFQEVEGETEERRKARLGRHQRAQERALKAVNDMNQRDLQTKMEQEERRKIADTADVQIKRWAAGKEGNMRALLSTLQYVLLFYNYYYQLIILHFTLGLLNIPLLSCN

SEQ ID NO: 141610 - protein, 161 aa, Glycine max
  Coding DNA Sequence Number=SeqID_24832
  Gene Ontology: Mol. function=heat shock protein binding; Cellular component=integral to membrane; Biological process=protein folding
  Homolog annotation: Hit_ID=Q2QNZ9; Match level="QueryCoverage=43%, HitCoverage=7%, E-value=1e-29, Identity=84%"; Hit description =Expressed protein
MGHWKLGGNSLATRFTVGKDAGEVGLCLEAGARVPRRGCTDVRESSHLQQQGVTLWDSGEQGLPVTCCNGSTVLPAIAHNRLIWGKQRNSVLWPECGWQPVSLTDMITSSAVKKVYRKANLCIHPDKVQQKGATLEQKYTAEKVFDILKEAYTKFNAEELS

SEQ ID NO: 141611 - protein, 154 aa, Glycine max
  Coding DNA Sequence Number=SeqID_24833
MKPEDFWKTEKNPIFYHFVVCSYWLMFIYIDSLVTHLYDPSTLRKTKNLLFKLVLDGLSLLLIIFYSYNTSKNSIKAKSFKFIGNFQETIGARTGWGAVIVAEAVALIAASTVHRVCITTCFLFSAALLYEVNKISGSALSTSDSRTKKQSGRA

SEQ ID NO: 141612 - protein, 83 aa, Glycine max
  Coding DNA Sequence Number=SeqID_24834
MRGDIVGHNKIPSKMKTLLKESHLKKTNLIKPHEKEEEEESVEASAYVKTREKLFKLLGSLVEEVGEIEVVQVVTDNGNNCFR

SEQ ID NO: 141613 - protein, 364 aa, Glycine max
  Coding DNA Sequence Number=SeqID_24835
  Homolog annotation: Hit_ID=Q2QNA4; Match level="QueryCoverage=29%, HitCoverage=43%, E-value=3e-20, Identity=48%"; Hit description =Expressed protein
MLSTLINSILTTLNGYTGHVMTFEVGAVLEDANWQAPVNCFDENDKEKNIPILGSAVRGGSLGSYDIGSATWADLRKAPLQSAMEVTYICVHFVLKELVRKSISETEVSNVSAMSQQSSALESGSFHSPVDEKLILKFVVEEMMIGHTDHISESRSLKDQILGYSGSELSDDEEEDCLEQILYSTSFEELASNYVKYDTVIWLAISLLLVLAWRIGLLMLLYLPIRRYVLQKDLSSCILYVTCIEVVYKVSRPSFIPFWGTVTIERRVPLSLVIDIIIEQDFLNSLSKLPAVYIWGSFNVIPFNVILLSTNKGYVIILKATIGLQMIVTEASKITQDVSTSGKHADPSTDEENICQEQLRDQLF

SEQ ID NO: 141614 - protein, 246 aa, Glycine max
  Coding DNA Sequence Number=SeqID_24836
MDRARLVYGLVMKMDMDLGSLLSGQISEMAQSNSSRLGFPAIIIALCIARGVVSYSLTFESLSPAINLAYIRKNCWNLDDPTITFPGTRKTRARGPEASSSASPAPASSTPAPSPPVPAPSGTSAQSSNVVVLMLQSLHHGLCMHGGIYGPSDLARSPAFSFGGGEAPTAQEPQPKPEVTPEATLEVTPLMEVTEDEDGTTDTDYAADMAAAQSTWDPWPTTAQDTPQPAQDAPSSPYDDHTPAQD

SEQ ID NO: 141615 - protein, 74 aa, Glycine max
  Coding DNA Sequence Number=SeqID_24837
MKTLFTVQYGKLLFTKNRNSKKQGKNKRSEEIEKQRSIPQIGSSGFSSDLEQHAIVVLINARVKYRRAIWESNP

SEQ ID NO: 141616 - protein, 98 aa, Glycine max
  Coding DNA Sequence Number=SeqID_24838
  Gene Ontology: Mol. function=receptor activity
  Homolog annotation: Hit_ID=P93159; Match level="QueryCoverage=95%, HitCoverage=14%, E-value=3e-26, Identity=64%"; Hit description=Beta -glucan-elicitor receptor
MANIQNNTPYIFLKAHSTVLPDPNFSLNLQSKPTNSFFQNLVLKYGDQPEYMHPYLIGSFNSSLSISYPSHHATSSVIYQPYKYDITISSKQGSKGRQ

SEQ ID NO: 141617 - protein, 34 aa, Glycine max
  Coding DNA Sequence Number=SeqID_24839
MIRLNGGGTLMPRVQSRNMDQGIKATSANGYAKM

SEQ ID NO: 141618 - protein, 333 aa, Glycine max
  Coding DNA Sequence Number=SeqID_24840
  Gene Ontology: Mol. function=zinc ion binding; Biological process =protein amino acid phosphorylation
  Homolog annotation: Hit_ID=UPI00000482A1; Match level="QueryCoverage =80%, HitCoverage=18%, E-value=4e-21, Identity=28%"; Hit description =ATP binding / ubiquitin-protein ligase/ zinc ion binding
MVCERQRCNFLDQFGELGNGFVGVSEGGLELDKGGIFSFLMIGKGICEAVLAFHLEGLVAGCLGLSCFSFDELGGICVDLNEALMMGRKFVNAVSTKHEEEATCKDCLENEVFASPEVLYELLLKRGTSLDSGHSRYPIGYGSDVWSLACVLLRLLIGSALPRNTLKMKEENDGDISASYVCWVEKVSSVMEDKLGSEYLSLRKILCKCLDVNPGNLNLVDVRKCIQDMLVKLQFDFLGNLISRDSTCHCLVLGELCLLPKQSSNGPIEHELQEKESDSQPNFLQNGKDKSDEFAAGSPKGMTEHKDLRGKIKELPLKGSFPKKKMKQLYRVS

SEQ ID NO: 141619 - protein, 323 aa, Glycine max
  Coding DNA Sequence Number=SeqID_24841
  Gene Ontology: Mol. function=monooxygenase activity; Cellular component=integral to membrane; Biological process=electron transport
  Homolog annotation: Hit_ID=Q1S4F4; Match level="QueryCoverage=69%, HitCoverage=55%, E-value=1e-114, Identity=88%"; Hit description=E -class P450, group I
  Pfam annotation: Domain name=p450; Domain location=1-265; Score= -170.9; E_value=0.0034; Accession=PF00067.12; Description=Cytochrome P450
MAKHIMSMDPGDIETEHLKKEYVTFMKGVVSAPLNLPGTAYRKALKSRSIILKFIEGKMEERVRRIQEGNESLEEDDLLNWVLKNSNLSTEQILDLILSLLFAGHETSSVAIALAIYFLPGCPQAIQQLKEEHREIARAKKQAGEVELTWDDYKRMEFTHCVVNETLRLGNVVRFLHRKAVKDVNYKGYDIPCGWKVLPVIAAVHLDPSLFDQPQHFNPWRWQKNVGHARYRYASFLVMVRNHCPEWRIIKGCGLHAQWRIKWVHSHASQTVASENLHRLRVVTSFTNRKVIRGESVVVRVGVVPATKYVFEKQLNLTLMDFQ

SEQ ID NO: 141620 - protein, 108 aa, Glycine max
  Coding DNA Sequence Number=SeqID_24842
  Gene Ontology: Mol. function=transferase activity; Cellular component= chloroplast; Biological process=metabolic process
  Homolog annotation: Hit_ID=Q53NI2; Match level="QueryCoverage=92%, HitCoverage=10%, E-value=3e-52, Identity=95%"; Hit description =Probable NAD kinase 2, chloroplast precursor
MAKTKLQVHPNVPCMLFTPICPHSLSFRPVILPDSAQLELKIPEDARSNAWVSFDGKRRQQLSRGDSVRISMSQHPLPTVNKFDQTGDWFHSLIRCLNWNERLDQKAL

SEQ ID NO: 141621 - protein, 539 aa, Glycine max
  Coding DNA Sequence Number=SeqID_24843
  Gene Ontology: Mol. function=oxidoreductase activity, acting on the CH-CH group of donors; Cellular component=mitochondrion; Biological process=tricarboxylic acid cycle
  Homolog annotation: Hit_ID=O82663; Match level="QueryCoverage=99%, HitCoverage=82%, E-value=0.0, Identity=84%"; Hit description =Succinate dehydrogenase [ubiquinone] flavoprotein subunit 1, mitochondrial precursor
  Pfam annotation: Domain name=DAO; Domain location=47-396; Score= -15.0; E_value=4.9e-05; Accession=PF01266.14; Description=FAD dependent oxidoreductase
  Pfam annotation: Domain name=FAD_binding_2; Domain location=47-456; Score=569.5; E_value=3.2e-168; Accession=PF00890.14; Description=FAD binding domain
  Pfam annotation: Domain name=Pyr_redox_2; Domain location=47-447; Score=-13.3; E_value=0.0018; Accession=PF07992.4; Description =Pyridine nucleotide-disulphide oxidor
  Pfam module annotation: Pfam domain module=DAO::FAD_binding_2::Pyr _redox_2; Domain location=47-396::47-456::47-447
  Subcellular localization annotation: CTP_CleavageSite=50; ConfidenceScore=5.42e-01
MWRCIARGLRGPASTRSTSNHSLGSQLSRFFSSGANSSYTVVDHTYDAVVVGAGGAGLRAAIGLSEHGFNTACITKLFPTRSHTVAAQGGINAALGNMTEDDWRWHMYDTVKGSDWLALWPTGDQDAIQYMCREAPKAVIELENYGLPFSRTEDGKIYQRAFGGQSLNYGKGGQAYRCACAADRTGHALLHTLYGQAMRHNTQFFVEYFALDLVMNSDGTCQGVIALNMEDGTLHRFKAASTILATGVRSSILLQGYGRAYFSATSAHTCTGDGNAMVARAGIPLEDLEFVQFHPTGIYGAGCLITEGSRGEGGILRNSEGERFMERYAPTAKDLASRDVVSRAMTMEIREGRGVGPLKDHIYLHLNHLPPDVLKERLPGISETAAIFAGVDVTKEPIPVLPTVHYNMGGIPTNHYGEVVTIKGDNPDAVVPGLMAAGETACASVHGANRLGANSLLDIVVFGRACANRVAEIRRPGKILFQREAKASREGCWSENNCMAGQIEKFKWFIANFANSVEYATSNANQCCCVPYTRNIRRR

SEQ ID NO: 141622 - protein, 656 aa, Glycine max
  Coding DNA Sequence Number=SeqID_24844
  Gene Ontology: Mol. function=transferase activity; Cellular component= chloroplast; Biological process=metabolic process
  Homolog annotation: Hit_ID=Q9C5W3; Match level="QueryCoverage=97%, HitCoverage=63%, E-value=1e-162, Identity=48%"; Hit description=NAD kinase 2, chloroplast precursor
MTTLGSLNSIQSHAPSRLPWTGPVPGDIAEVEAYCRIFRSSERLHSALMDALCNPLTGECSVSYEVLSDEKPLLEDKIVSVLGCIVALVNGGRQDVLSGRSSIGTPFRSTEVGMMEDTLPPLALFRSEMKKCCESLHVALENYFIPGDDRSLDVWRKLQRLKNVCYDSGFPRGEDYPSPEIFANWSPVYLFTSKEDMDSKESEAAFCMGGQVTEEGLKWLLDKGYKTIIDLREEDVKDNFYQAAVCDAISSGSIKLVRIPVKVRTAPTMEQVERFASYVSDCSKRPMYLHSKEGVWRTSAMVSRWRQYMTRPASQFFSNQAVISNDMSSYYTIGSGKLQDSMIAEGSSLEKDTNLLQEGLGATHGSASRFDSCSSLKKNNEKTQSNGALSELSPDDIASSQATAATGEGSFPIFSRKTRPLEAQVPPFDIFSKKEMSKFLGSRQIPKPSHFSHQGKRLEGLPDSRNPEPKLVDPEKSSNGSAHVDYPSGSNWKLVNLNNSSSVRTTVNGFSEGEMYYRSDANFSTIVNNDIDNVNTNSQRIGVNKDKAGLALSDEDLGLIEGDMCASSTGVVRVQSRKKAEMFLVRTDGFSCARERVSESSLAFTHPSTQQQMLMWKTTPKTVLLLKKPGEHLMEEAREGQVLLWGGERHLDKGSG

SEQ ID NO: 141623 - protein, 124 aa, Glycine max
  Coding DNA Sequence Number=SeqID_24845
  Gene Ontology: Mol. function=oxidoreductase activity, acting on the CH-CH group of donors; Cellular component=mitochondrion; Biological process=tricarboxylic acid cycle
  Homolog annotation: Hit_ID=Q6ZDY8; Match level="QueryCoverage=92%, HitCoverage=15%, E-value=2e-30, Identity=58%"; Hit description =Succinate dehydrogenase [ubiquinone] flavoprotein subunit, mitochondrial precursor
  Pfam annotation: Domain name=Succ_DH_flav_C; Domain location=1-124; Score=134.4; E_value=3e-37; Accession=PF02910.10; Description =Fumarate reductasesuccinate dehydroge
MGEASMMSKVKDRSLIWNSDLIETIELENLLINACITMYSAEARKESRGAHAREDFKVRDDGSWMKHTVGHLSSRVEVELFISSRNLDPFRFWENEKVRLDYRPVHLNVLDDEVESFPPKARVY

SEQ ID NO: 141624 - protein, 75 aa, Glycine max
  Coding DNA Sequence Number=SeqID_24846
MEEKELESWAVTRCVFLRNWKRKANTLALPENTDTKRLRANMGPHQHKEKKDLVGNVDRLDLDLDLDAKEWRNPT

SEQ ID NO: 141625 - protein, 166 aa, Glycine max
  Coding DNA Sequence Number=SeqID_24847
  Gene Ontology: Mol. function=transferase activity; Cellular component= chloroplast; Biological process=metabolic process
  Homolog annotation: Hit_ID=Q9C5W3; Match level="QueryCoverage=99%, HitCoverage=20%, E-value=1e-66, Identity=66%"; Hit description=NAD kinase 2, chloroplast precursor
  Pfam annotation: Domain name=NAD_kinase; Domain location=3-164; Score= -11.7; E_value=6.8e-05; Accession=PF01513.11; Description=ATP-NAD kinase
MNVFVEPDAHDIFARIPGFGFVQTFYTQDTCDLHEKVDFVACLGGDGVILHASNLFRNAIPPVVSFNLGSLGFLTSHNFEDYKQDLQQVIHGNSTRDGVYITLRMRLRCEIFRKGKAVPGKVQGDGVIVATPTGSTAYSTAAGGSMEYGQYTPCKTWAILPSRANF

SEQ ID NO: 141626 - protein, 36 aa, Glycine max
  Coding DNA Sequence Number=SeqID_24848
MTRWLPGSNNSTLRGPYAQSRVALRYRLIVISKTNR

SEQ ID NO: 141627 - protein, 724 aa, Glycine max
  Coding DNA Sequence Number=SeqID_24849
  Homolog annotation: Hit_ID=Q60EP7; Match level="QueryCoverage=85%, HitCoverage=80%, E-value=1e-67, Identity=32%"; Hit description =Unknow protein
MAEEKRAPSSFVKKGDRQMFTVELWPGETTIVSWKKLLKDANKHNGSTSAPQHVAIAPGQPVEVEETDPSQPNRFSAVIEKIERLYTGKDSSDDEDLLDVPDDDQYDTEDSFIDDAELDEYFEVDNSAIKHDGFFVNRGKLERINEPPVLPNQQPKKRRRKDILKNAGENNDGHGSNKNVKVGRPASAKTASLQAKNMLNLSENLVAPGDHIEDLKLPNQSDVSGIISKKKTADTKPILNPSVSLKTSSDDAPAVTDAKDVDKQKIGAFQSKNISDKYIDGSGSFDASHHKYNEKSAYAHSKSQPGRPSSNIDDINWTKEKNGMRELPDLNLSEGKSATQATKSENMHKKEGSSVRPKTSMLEKALRELEKMVAESRPPAVDNQEADATSQAVKRRLPREIKLKLAKVARLAATHGKVSKELINRLMSILGHLIQLRTLKRNLKIMINMGLSAKQEEDNRFQQIKKEVVDLIKMQAPTLESKQQLKGEASGDFQEFGTDGKPITKRKFTMDAALEDKICDLYDLFVDGLDENAGPQIRKLYAEVLAQLWPSGYMDNHGIKRGICRAKERRRALYNKHKDQEKIKRKKLLAPKQQENVRFDTNTITSQQNLRERSAPESSSHAYTSGNKQVSNTSTPSPMNGLKQEKAKGSSSSSVDDVRVADGVLTKKVKRKPELELEGAHLGPEKVASLQGEERPRSLKQSTGPLPTKSNLQPTSLPDLEQSS

SEQ ID NO: 141628 - protein, 62 aa, Glycine max
  Coding DNA Sequence Number=SeqID_24850
  Homolog annotation: Hit_ID=Q01GB5; Match level="QueryCoverage=73%, HitCoverage=39%, E-value=4e-08, Identity=50%"; Hit description=[S] KOG3381 Uncharacterized conserved protein
MRREVVLQFNSETKTNNRGHATVLYGRRKKNTELFQGIRMFGIPNIPHEICQSQVKDLNKFK

SEQ ID NO: 141629 - protein, 124 aa, Glycine max
  Coding DNA Sequence Number=SeqID_24851
MKLFAPLGELPSSQMPCFAINRREGRLRMRSQGPEVLREEERREKEAKMSSNRDCNQFLHHSLVVLQLFFVLHPISACFKDLNLIYGPLGVLSIVLCIFISFFDYRYLLFLNKVVVPCDGRVGC

SEQ ID NO: 141630 - protein, 212 aa, Glycine max
  Coding DNA Sequence Number=SeqID_24852
  Gene Ontology: Mol. function=sequence-specific DNA binding; Cellular component=nucleus; Biological process=regulation of transcription, DNA-dependent
  Homolog annotation: Hit_ID=O23208; Match level="QueryCoverage=74%, HitCoverage=74%, E-value=3e-31, Identity=45%"; Hit description =Homeobox-leucine zipper protein ATHB-40
  Pfam annotation: Domain name=Homeobox; Domain location=54-108; Score =66.9; E_value=6.6e-17; Accession=PF00046.19; Description=Homeobox domain
MNHQLIEDHMMLFPWLCPGGAFTEVTPQQGENNKPRHKRNRKNRGGENGTIITKKRKLTVEQISLLERNFSNEHKLESERKDQLALELSLDPRQVAVWFQNRRSRWKTQKLEEEYSNLKNVHETTMLDKCHLENEVLKLKEQLLETKKEIEQLLERGEKAPSNNSSSSQSMEEAVNPPFLGEFRVEEYDDGDVFYIPETHHINGMEWINLYN

SEQ ID NO: 141631 - protein, 105 aa, Glycine max
  Coding DNA Sequence Number=SeqID_24853
  Homolog annotation: Hit_ID=Q9SNC3; Match level="QueryCoverage=74%, HitCoverage=19%, E-value=4e-08, Identity=45%"; Hit description =Fasciclin-like arabinogalactan protein 4 precursor
MALEGRGGGGVEVGPREDLKEDVIAKDVSEGSGEEVIVDNEVSIGDNKNGKGRVVREIHDEVGDRGEEGDELGELRHGGEEGGEIVNVWRGRFRERSPYGKRKKV

SEQ ID NO: 141632 - protein, 67 aa, Glycine max
  Coding DNA Sequence Number=SeqID_24854
MSAEKYKLGATSRPMSARNARSESSDDASYSDLDRSSFLADVDCHFLRSISVNNIFLPRWANVFLVE

SEQ ID NO: 141633 - protein, 199 aa, Glycine max
  Coding DNA Sequence Number=SeqID_24855
MLGKPKRGLRILKIRVWELFTHREEKRHLGKGQLAQASWLFKDKGISQPRYERSLDLVFQLMSINKSIPQTKLGSDRSHIRPHSQRRKNDRRSQKVSISLPYLHGKDNVEGYLDWEIKREKFHWLPLASKGLPSIGGLPLLGKEVFTGILMQSYPPMALDRRLQEDWAKDEREGHRVLMSLTVNLDPWAKYEPNYLCIY

SEQ ID NO: 141634 - protein, 178 aa, Glycine max
  Coding DNA Sequence Number=SeqID_24856
  Homolog annotation: Hit_ID=Q9LV46; Match level="QueryCoverage=17%, HitCoverage=13%, E-value=2e-07, Identity=70%"; Hit description =Arabidopsis thaliana genomic DNA, chromosome 3, P1 clone: MOB24
MSSLEMQTILASIEASNWESKTCEHFNNIAISNAPENGRTDGLGLYWMNRKAILVPVPHLHHLFVPPTLLLCGSSSSLLPHLRGSWFMLVLLLRWFIFSQIIVRARGFRQTLGRAIGKALGKREASDDDNDVSSSEGLPHLPIEQQQPPVEEGVTDVEDFPGGPHDTSVLRDFENQLL

SEQ ID NO: 141635 - protein, 165 aa, Glycine max
  Coding DNA Sequence Number=SeqID_24857
  Gene Ontology: Cellular component=cytosol
  Homolog annotation: Hit_ID=Q9LTT4; Match level="QueryCoverage=86%, HitCoverage=32%, E-value=1e-45, Identity=66%"; Hit description=WD domain protein-like
  Pfam annotation: Domain name=WD40; Domain location=101-139; Score =8.4; E_value=3.8; Accession=PF00400.22; Description=WD domain, G -beta repeat
  Pfam annotation: Domain name=WD40; Domain location=59-96; Score=14.0; E_value=0.56; Accession=PF00400.22; Description=WD domain, G-beta repeat
  Pfam module annotation: Pfam domain module=WD40::WD40; Domain location=101-139::59-96
SFLRATDVEIAGFVDGAGVSTVFHTSFSLDGKLDVIVGDYPEGFMAVYFSKDSLEWDEDYHTFSWTLGFLSFAFAWHLDGNIFATGNQDKTCRVWDVRNLSKSVAVLKGNLGAIRSIRFTSDGQFMAMVEPTDFVHVYDAKHGFEKEQEIDFFGKISGVSFSPDT

SEQ ID NO: 141636 - protein, 88 aa, Glycine max
  Coding DNA Sequence Number=SeqID_24858
  Gene Ontology: Cellular component=integral to membrane
  Homolog annotation: Hit_ID=Q9LV46; Match level="QueryCoverage=85%, HitCoverage=45%, E-value=5e-18, Identity=64%"; Hit description =Arabidopsis thaliana genomic DNA, chromosome 3, P1 clone: MOB24
MDGIIFGPLHLFVFFTYMGLCAGKNVAQVKDDLKRNYVPALILEGVFFCHGWSNRRTHLGRNGLHHFIPRMKKEVDVDEEIGGKRKIV

SEQ ID NO: 141637 - protein, 406 aa, Glycine max
  Coding DNA Sequence Number=SeqID_24859
  Gene Ontology: Mol. function=protein kinase activity; Cellular component=cytoplasm; Biological process=protein amino acid phosphorylation
  Homolog annotation: Hit_ID=Q10R62; Match level="QueryCoverage=83%, HitCoverage=82%, E-value=1e-120, Identity=62%"; Hit description =Serine/threonine-protein kinase NAK, putative, expressed
  Pfam annotation: Domain name=Pkinase; Domain location=96-377; Score =172.6; E_value=9.9e-49; Accession=PF00069.15; Description=Protein kinase domain
  Pfam annotation: Domain name=Pkinase_Tyr; Domain location=96-377; Score=152.2; E_value=1.4e-42; Accession=PF07714.7; Description =Protein tyrosine kinase
  Pfam module annotation: Pfam domain module=Pkinase::Pkinase_Tyr; Domain location=96-377::96-377
MKILRLPCIEVAKYGVQFYSLGDTLFGIMVLNCSQQPQLQLQCKGSKKPASKPKQYSNSSEQRSAPTTSELNVPKSISSNLKSFSLNDLKEATKNFRRENLIGEGGFGRVFKGWIDENTYGPTKPGTGIVVAIKNLKPESFQGHKEWLQEVNYLGMLQHENLVKLIGYCLEGKNRLLVYEFMQKGSLENHLFRKGVQPMAWVTRVNIAIGVARGLTFLHSLDQNVIFRDLKASNILLDSDFNAKLSDFGLARDGPTGDNTHVSTRVIGTQGYAAPEYVATGHLTPRSDVYSFGVVLLELLTGRRAVEDDGPGFSEETLVDWAKPFLNDNRRVLRIMDTRLGGQYSKKGAQAAAALALQCLNTDPKFRPPMVEVLAALEALNSSNSFTRTPKHESHSTKISGGPSQK

SEQ ID NO: 141638 - protein, 202 aa, Glycine max
  Coding DNA Sequence Number=SeqID_24860
  Homolog annotation: Hit_ID=Q1SN43; Match level="QueryCoverage=43%, HitCoverage=16%, E-value=6e-13, Identity=38%"; Hit description =Nucleic acid-binding, OB-fold, subgroup
  Pfam annotation: Domain name=Rep_fac-A_C; Domain location=40-167; Score=-65.3; E_value=0.041; Accession=PF08646.1; Description =Replication factor-A C terminal domain
MVNGKIDASHSETVIQNVMNTSRVIWNPQDEHAMSFKERIFIVNATILFILNTDQWYCKSCNCKPAVTTDSGVYYCSSCRKNVLDTTPRYKLKLEVFDGFDTNAFVLFDTDCEKIMNQSCVDLLSELKVKKICDNEDIIQQFHSSGSVNTPEKSKFPIDFQTNIDRDIELSKSSTNEGKMNMIDGDNIKKNTEVSSCINDEN

SEQ ID NO: 141639 - protein, 67 aa, Glycine max
  Coding DNA Sequence Number=SeqID_24861
MESLHFHVEAWVGGTAEKFDMKDIVYGAIGCQSREFYLFSLQDGDVDLNASPQTLDRLLGCVLAFIF

SEQ ID NO: 141640 - protein, 107 aa, Glycine max
  Coding DNA Sequence Number=SeqID_24862
MGRGQVEWMTQPYYQLLSGTDVKGYRDDLMPVEIEEYGECSTRKPTKVVLPYEEACALNKIFLHKIKDLRKDNLYDVDTWLTMWHRKHSTTVYRIREAEFLVNGSHR

SEQ ID NO: 141641 - protein, 146 aa, Glycine max
  Coding DNA Sequence Number=SeqID_24863
MVNHKDENTKFLLWDHECANLIGQSADEVNRLKIADGDVDLNASPQALDRLLGCVLAFKVKVQPKFKNVVVLKYSNELDLINVVLDMLPDTEQFVSVTADHDPLLRIPLTPTKQLSSDELDDEPRSSEISPAQHSANKLARHHQIE

SEQ ID NO: 141642 - protein, 43 aa, Glycine max
  Coding DNA Sequence Number=SeqID_24864
MENSFLVFLTFFSNKCWWRLHTFSPLETNALAYLFCFHHPIVG

SEQ ID NO: 141643 - protein, 92 aa, Glycine max
  Coding DNA Sequence Number=SeqID_24865
  Homolog annotation: Hit_ID=P16181; Match level="QueryCoverage=45%, HitCoverage=26%, E-value=2e-08, Identity=66%"; Hit description=40S ribosomal protein S11-1
MVVGQILVMAKIKFGTPNGGGIFENYFSSLSSALFISTWYGSNKHILILRHTFDGFPGSLKANHNGLPKSIPTLSGTLSFPSFLQAAKVRKC

SEQ ID NO: 141644 - protein, 94 aa, Glycine max
  Coding DNA Sequence Number=SeqID_24866
MEDRDKNRNSVEVSLVTVKNRRSFVKKRALDSEKSKIETPSSAILREDRVKNCNSERWKLRRSVACCNLEPLKFHVVSKVLSEEVQLGNYLAFS

SEQ ID NO: 141645 - protein, 80 aa, Glycine max
  Coding DNA Sequence Number=SeqID_24867
MCKEYKGTGVNRYYYMCLNDLLALGGGGYYSVRVDQVHTMSRCILSHVLAFALVSALSVFSCLVNVAQAQSANTTTDPSE

SEQ ID NO: 141646 - protein, 133 aa, Glycine max
  Coding DNA Sequence Number=SeqID_24868
MEPPPSHPLPRLPSTADLTPQHAAFLDQHFRTKRDLSRESSNLPLSSSLWQQCSELESRLLQYLTKRTISWISRSFSVRSSLQQLSLALQSLSLCTSPQGIGSKRFRWVLSEEIPRLANEMNRIESLRCYLGG

SEQ ID NO: 141647 - protein, 640 aa, Glycine max
  Coding DNA Sequence Number=SeqID_24869
  Gene Ontology: Mol. function=transcription factor activity; Cellular component=endoplasmic reticulum; Biological process=regulation of transcription, DNA-dependent
  Homolog annotation: Hit_ID=Q6YUW7; Match level="QueryCoverage=90%, HitCoverage=71%, E-value=1e-103, Identity=36%"; Hit description =Chromosome structural maintenance protein-like
  Pfam annotation: Domain name=RINT1_TIP1; Domain location=122-633; Score=117.0; E_value=5.5e-32; Accession=PF04437.4; Description=RINT -1  TIP-1 family
MSDIEEVLVGVVKFHPQWHCLLKSVDTRVDKILSALRPQALADHRALLISLGWPPKLISLKNGSDHITSLPNPLILMQEDKRRNYSQSFIALCALQHLQNRREERQLNSNLIKRDTQNIQLWAIDELVSPIASRMECHFTKWSEQPEYMFALAYKVTRDFISGIDDVLQPLIDKARLISCSAKDAWVSAMVQMLSGFLEKKVFRFLTERYKVKHLKPDVSSSWLHLVDLIIAFDKKMQSLLNLDTCFLAVPGSFEGLSRGVSVLSIFCNRPDWLKVWAKIEFKNAWKKLKPELIEEKAWITSKKCISGIDTEQEFLLLTVEDLKAPPIAEFFLKIIWEMIERCQTMPSSLSHAQFIRFTAGRFLWYFFKQLLFRFKATELCIDSSDDVAIVRVCGLINAARYIWIKLQEWSDVADFLEMKIVENDSSKPTQDDTMDNDCFFDEEIRSLSEMETNWLMEIIAVVLRQFEMLSWKYVQNNDSFEDDQDYTNPVEDVDLVVSNDFVEALDALDSWLHTVKISLNKKDFLDLWRSIAEGLDHYISCSIVRSENWFSKMGVYQFEADMQALIFIFQPYCARPQAFFPCINEILKLLKLKKEELNKALEKAVFVLTLQHSLNMGWIQQKFRKLLNKNFLTDQGNGV

SEQ ID NO: 141648 - protein, 565 aa, Glycine max
  Coding DNA Sequence Number=SeqID_24870
  Gene Ontology: Mol. function=nucleotide binding
  Homolog annotation: Hit_ID=Q5VNG4; Match level="QueryCoverage=64%, HitCoverage=81%, E-value=1e-158, Identity=67%"; Hit description =Putative auxin-independent growth promoter
  Pfam annotation: Domain name=DUF246; Domain location=209-512; Score =531.9; E_value=7e-157; Accession=PF03138.5; Description=Plant protein family
  Pfam annotation: Domain name=DUF803; Domain location=1-159; Score= -94.3; E_value=1.7e-05; Accession=PF05653.4; Description=Protein of unknown function (DUF803)
  Pfam module annotation: Pfam domain module=DUF246::DUF803; Domain location=209-512::1-159
MGMLGCLLCIVGSTVIVLHAPEEKSLSSVQEIWELAIQPAFLSYTASTIAVTLFLVLYCAPRYGQTNILVYTGICSIVGSLTVCGPSGRWYLADSGSVPGDLLLIIGKALTHATVGLCPAASYRASPDYFLSPNGGGRYFLELCDCRTSLAYRLMPQGNAILDCSLIAAAGHVIPQSYVRISVSQFMDDLVVEELIGNRWVYKNNGYLMVSCNGGLNQMRVAICDMVAIARYFNVTLIVPELDKTSFWADPSYILPLIQKYKVVHLNRTDARLANNGQPIEIQKLRCRVNFSGLRFTSQIEELGRKVIRLLRQKGQFLVLHLRYEMDMLAFSGCTQGCNSDEVDELTRMRYAYPWWKEKIINSDLKRKDGLCPLTPEETALTLKALDIDQNIQIYIAAGEIYGGERRMAGLAKEYPKLVNINTQGSMVRKETLLEPSDLRFFQNHSSQMAALDYLVSLESDIFVPTYDGNMAKVVEGHRRYLGFKRTILLNRKLLVELIDQYNNGVLNWDEFSSAVKEAHADRMGSQTKRFVIPERPKEEDYFYANPQECLEQSADEPLALSSST

SEQ ID NO: 141649 - protein, 147 aa, Glycine max
  Coding DNA Sequence Number=SeqID_24871
  Gene Ontology: Mol. function=carboxypeptidase activity
  Homolog annotation: Hit_ID=Q8RUC0; Match level="QueryCoverage=52%, HitCoverage=20%, E-value=2e-24, Identity=63%"; Hit description=Leaf senescence protein-like
  Pfam annotation: Domain name=DUF231; Domain location=3-96; Score= -16.2; E_value=2.3e-06; Accession=PF03005.6; Description=Arabidopsis proteins of unknown function
MPFTKQEMRLEDGAVEYILEMYVTQVEEFREAQRVATKRGLEFLMMNTTEIMLLRPDGHPNNYGHAKDKNVTLNDCVHWCLPGPVDTWNEFLLYMLDIMGTVTHYEILSGAMFTAMKLSCTSIIIESFKGSGTSPDSDFSTNINVVR

SEQ ID NO: 141650 - protein, 164 aa, Glycine max
  Coding DNA Sequence Number=SeqID_24872
MENAVHELEKKWAQVQENALKQPSPGQREKTLDKHLHGLIEQLAVKQAQAEGLLGEIHLKEMELERLNGLWRRTESSNSEANTAARNRFSKGSSDKLHSLSDYEGHQRLPYHSAGRTESQQRLMLLRSAFVLYILALHILIRSIDSRNPVGAPIASPPLCASTG

SEQ ID NO: 141651 - protein, 91 aa, Glycine max
  Coding DNA Sequence Number=SeqID_24873
MAEMVIKDEVYDIDTAHKMSMGKGIMTLLSNTNLTTWGPLFVKRNPLQLRLGKESDSLSNRCIQMLIKVSHGAGPMPLSHSKRRCIPKAKQ

SEQ ID NO: 141652 - protein, 267 aa, Glycine max
  Coding DNA Sequence Number=SeqID_24874
  Gene Ontology: Mol. function=DNA binding; Biological process=DNA integration
  Homolog annotation: Hit_ID=Q1RSZ9; Match level="QueryCoverage=99%, HitCoverage=19%, E-value=1e-51, Identity=43%"; Hit description =Polynucleotidyl transferase, Ribonuclease H fold
  Pfam annotation: Domain name=GRP; Domain location=108-192; Score= -27.2; E_value=0.046; Accession=PF07172.2; Description=Glycine rich protein family
MEAWNRLRDIFQDNKHSRAITLEYDFTHTTMVAFSSVSAYCQHLKSLSNQLKNVGFSIDNSRLVLQLVSGLTKPYKGVAMLIRQSDPLPRFYQARSMLVLEESGLKKAARTSSSTMVARDSDESQEMFDHSLARRTNNGGKRYSNPGNSRKNRNNIGGRDNSGSGKGGFGGGGKGGGGSNCGGGQQQPQNNPWPAGQQWPWPWMQWVVPPCPYPAAPWVRPNYQQPPRQQPGILGSRPQQAYTATAPTRTDIEAAMHTLGITSPNPN

SEQ ID NO: 141653 - protein, 189 aa, Glycine max
  Coding DNA Sequence Number=SeqID_24875
  Gene Ontology: Mol. function=sequence-specific DNA binding; Cellular component=nucleus; Biological process=regulation of transcription, DNA-dependent
  Homolog annotation: Hit_ID=Q533S4; Match level="QueryCoverage=99%, HitCoverage=98%, E-value=4e-78, Identity=81%"; Hit description=MADS box protein PIb
  Pfam annotation: Domain name=K-box; Domain location=71-183; Score =76.3; E_value=9.5e-20; Accession=PF01486.8; Description=K-box region
  Pfam annotation: Domain name=SRF-TF; Domain location=9-59; Score =114.9; E_value=2.4e-31; Accession=PF00319.9; Description=SRF-type transcription factor (DNA-binding and dimerisation domain)
  Pfam module annotation: Pfam domain module=K-box::SRF-TF; Domain location=71-183::9-59
MGRGKIEIKRIENSSNRQVTYSKRKNGILKKAKEISVLCDAQVSLIIFGVSGKMHEYISPSTTLIDVLDRYQRASGKTLWDAKHENLSNEIDRIKKENDSMQIELRHLKGEDITSLNYKELMALEDALENGLSGQNLNKSLTSDLNFLFVPQMEVHRMFKRNDKILEEQNKELNFLLVLLIEIAGNEYG

SEQ ID NO: 141654 - protein, 77 aa, Glycine max
  Coding DNA Sequence Number=SeqID_24876
MAPLEGINDSVFWPLNKISMEYDEIKDGNDLLEVGHDDLDNNLVVTLHKLMDQYYFRISRLSILGMSTSEIIEGSIG

SEQ ID NO: 141655 - protein, 126 aa, Glycine max
  Coding DNA Sequence Number=SeqID_24877
MASKNENIPAVVYYDAYVANCEEGVEFKGGNNVLVPTRIGMTFNVVTISDDEDIDDTFGVDNQLNLVNKSCFMVKAIFRICPLDLMMKSVHFQREGESGRALASRPRAKHKISALSAAVSSARLSA

SEQ ID NO: 141656 - protein, 59 aa, Glycine max
  Coding DNA Sequence Number=SeqID_24878
MRIPKYLDLEWFSQQGGMLLDPARNLRNRLGVGGLTVEDKMLVYLITYILTPRSSNHAQ

SEQ ID NO: 141657 - protein, 1589 aa, Glycine max
  Coding DNA Sequence Number=SeqID_24879
  Gene Ontology: Mol. function=histone-lysine N-methyltransferase activity; Cellular component=nucleus; Biological process=chromatin modification
  Homolog annotation: Hit_ID=Q2LAE1; Match level="QueryCoverage=89%, HitCoverage=76%, E-value=1e-136, Identity=31%"; Hit description =Histone-lysine N-methyltransferase ASHH2
  Pfam annotation: Domain name=SET; Domain location=1181-1311; Score =172.2; E_value=1.3e-48; Accession=PF00856.18; Description=SET domain
  Pfam annotation: Domain name=zf-CW; Domain location=1062-1111; Score =43.9; E_value=5.4e-10; Accession=PF07496.5; Description=CW-type Zinc Finger
  Pfam module annotation: Pfam domain module=SET::zf-CW; Domain location=1181-1311::1062-1111
MGSCGRSAAIDDPSEKFVIEQQHLCSEVQEQVVSVQESCLEEEAYNVVDSNVELSTVTDGCLRGDRVSSEGRVDVTEGSGEGLGLASECKNADLLPLEKSTQDDCQNCLGVSCGSIEVLCVNSGSEGNFQDEGIFDQLSGSLTADDSQRRCAQQDEQKDDESGSLITEDSQRHCAQQDEQKDNKSDVLPAAGDDLDVVEGKNDETGVLADAFSHALDFRDCEVSLESESMADLLVDCNQQSEQEKIMRNPDPLLNVVEKCDALIGEETDACRKISPTPAMEVPSGALCTDTEVESINDHPCDQKDGEETDACRQISPTPTMEVPSDALFTDTEVESISDQPCDQKDGEETDACRKISPTLAMEVPSGPPSGALCTDAKVESTNDQPCDQKDIEDQNSTCEEKFKAFVDEEVININSCIKISSSLDCQETVASSPVVGFPCEPALLDPGCEMKNDMLQIDDFCKLKDCSSEETTNSTFRKPFSPESGLPSVALITNCSAKDVLDLHSKGDDVSINNNNAVNNPGQMDNDGTKAVEVDCITESIPLPSLRDSRRTKFGRKTQTKKASRNCKNKTKVTHSNGGMKLNLEAARKKRSCFSKPARSSVWGLIGNIEQFFEQDNELGVGEAVCQELGKARSKRQSGKAVKNGASTTSLSSVQKCSVSTTRVRLKIKFGKEVDLSCSNVLIPESVDGLASASYLVSDSGSQKVAGNADDKISDAVALGNSESFSNDLGKDGLVLNEQVANNPLETTEITEKSYGDAEEPCLAVPPEKVVEALIEPMSNKGMDPGTSPDSEVINSIPEVQIGERHQEDVHHAVLGSSKELNSKLNVTISKRGKKKEKLICSGNCITEDGSQGPRGNSRAKHSKNHRRKKNCRDAFSSLELPTEISKSVTSKELSPELLPHSGETELGGSVEALKVKNHMDAKTSNKPSVDHGFSDSLVSEKMLSSARPLGRKLPKSLRPSKVSKTKSKASDSSGRKKTTAGTCKEKQKNPINKSKVKGKGASLKVTCEVEDCPHPANAGNHKLDAIGKIIADDNRVSVNVSNLDMLSGVGFGEQILSPRNAWVRCDDCHKWRRIPAVLADRIDETNCTWTCKDSSDKAFADCAIPQEKSNAEINAELGLSDASGEEDAYEGSKNFKELEYWPPIGGKLGCGDECLNRILNIECVQGTCPCGDRCSNQQFQKHKYASLKWFKCGKKGYGLKAIEDVAQGQFLIEYVGEVLDMQTYEARQREYALKGHRHFYFMTLNGSEVIDASAKGNLGRFINHSCDPNCRTEKWMVNGEICIGLFALRNVKKDEELTFDYNYVRVFGAAAKKCYCGSSNCRGYIGGGDPLNAELIVQSDSEEEFPEPVMLTKDGEIEDAVPTPKYFNNVDTESAKHMLKDRDILENPTTAIDSDGSPEKESSMNPASAVSLLHSSAEMEDSKGKLPSSVRDEEISQQMEDVTSKPMPSVHQGYEKESEFADKTSSIQRLETTSPPTTVSKMLPNSAGSNRESKSEIIGGKKTPKLNGSVKKGKVHANPPNGLKTEVTANRLQVSSIKHKKVEGSSNGRFEAVQEKLNELLDGDGGISKRKDATKGYLKLLFLTVAS

SEQ ID NO: 141658 - protein, 54 aa, Glycine max
  Coding DNA Sequence Number=SeqID_24880
MVIGNSLKFGEERSIYEDLPNDLPPLEPMVRRGDSLGQARRRVPYVVMKGGKAV

SEQ ID NO: 141659 - protein, 71 aa, Glycine max
  Coding DNA Sequence Number=SeqID_24881
MRVPNDCSFETLKSRIHNTLQLTNDQLVDEIYYRRPFIDAGCSMDKLKDLIKQVAPMGIPPYGIHESQVVK

SEQ ID NO: 141660 - protein, 428 aa, Glycine max
  Coding DNA Sequence Number=SeqID_24882
  Homolog annotation: Hit_ID=Q9CA27; Match level="QueryCoverage=30%, HitCoverage=38%, E-value=4e-26, Identity=50%"; Hit description =Putative AP2 domain transcription factor; 68130-67156
  Pfam annotation: Domain name=AP2; Domain location=176-231; Score =68.1; E_value=2.8e-17; Accession=PF00847.10; Description=AP2 domain
NPLKEEEWEIYVVLVLFGSSDWSFVEARVRLRLYLLHATLAGVEFCCFDEFEVKKDMLWSCGVLTQFFTMVEPLNQSTPKMKKIKHKPNSIHNSKITRKLRIICNDPNATDSSSDEDEHFRNVRKMKRTVVEIALPPVSVNPVVADETSTESTNNDELNKMKRVLGKTPTVKRQSCGKYKGVRMRKWGKWAAEIRDPFKGARIWLGTFSTAEEASQAYNARRLEFEAMAKALSDEKSNNGSNSSSNNNVVASAETVAATENNSSNYCVSSAAGSVSDSKSASMDESESVLSLTSPSSVLELDTSAFNLIGSGKVSSNEVVETKGLEAEVAETKNLAAEFAELEMLEMPDLSMLNVPSPSAVAATAAAPSEFELDLLAFVDSEYGFHDEHDFDDDLAALEDFHICGFDDNEPSELPDYDFDDFGADEFA

SEQ ID NO: 141661 - protein, 750 aa, Glycine max
  Coding DNA Sequence Number=SeqID_24883
  Gene Ontology: Mol. function=protein serine/threonine kinase activity; Biological process=protein amino acid phosphorylation
  Homolog annotation: Hit_ID=UPI000034F553; Match level="QueryCoverage =96%, HitCoverage=93%, E-value=0.0, Identity=56%"; Hit description =ATP binding / kinase/ protein kinase/ protein serine/threonine kinase/ protein-tyrosine kinase
  Pfam annotation: Domain name=APH; Domain location=406-590; Score= -8.3; E_value=0.022; Accession=PF01636.13; Description=Phosphotransfer ase enzyme family
  Pfam annotation: Domain name=Pkinase; Domain location=404-675; Score =126.0; E_value=1e-34; Accession=PF00069.15; Description=Protein kinase domain
  Pfam annotation: Domain name=Pkinase_Tyr; Domain location=404-675; Score=67.1; E_value=5.5e-17; Accession=PF07714.7; Description =Protein tyrosine kinase
  Pfam annotation: Domain name=Usp; Domain location=18-155; Score=31.3; E_value=3.3e-06; Accession=PF00582.16; Description=Universal stress protein family
  Pfam module annotation: Pfam domain module=APH::Pkinase::Pkinase _Tyr::Usp; Domain location=406-590::404-675::404-675::18-155
MLQTDPAGEPARGGGSGGRTVVVGVKMDSPCKELLTWALVKVAHPRDTVVALHVLGSHETVNGVGKSSLLSLVKAFDSVLAVYKGFCNLKQVDLKLKICRGSSVKKSLVREANGYSATHIVVGTTHGLHKIRSSTVVAKYCAKKLSKDCCVLAVNNGKVVFKRDSSPPSVTELQGIDRHNRNGLIGSIQWTLGKSTKVLSDDNSGMEADEKKTGQVSDHSLAKLFLESKETVRNPSCSICGTTLALPDSSCYQSADGVSGDDGRENSLAIVPVQPSVAAITEMKPGWPLLHRGILLDRQSADRLLMHPQISVVQWAMRLPSRNLSYAVDCNEKPNICDQGQDQHAALDSESGALVPVDAELGTASLPEHNSGNIPKELEGLHEKYSSTCRLFEYQELVLATSNFLPGNLIGKGGSSQVYRGCLPDGKELAVKILKPSDNVLSEFLLEIEIITTLHHKNIISLLGFCFENGKLLLVYDFLSRGSLEENLHGNKKISLVFGWSERYKVAVGIAEALDYLHSKDDQPVIHRDVKSSNVLLSEDFEPQLCDFGLAKWASTLSSHITCTDVAGTFGYLAPEYFMYGKVNDKIDVYAFGVVLLELLSGRKPISPDYPKGQESLVMWATPILNSGKVLQLLDPSLGENYDHGEMEKMVLAATLCIKRAPRARPQMSLISKLLQGDAEAIKRARLQVNALDAPEMLDDEACPPSNLQSHINLALLDVEDDSLSMCSVEQGLTLEDYLRGRWSRASSFD

SEQ ID NO: 141662 - protein, 91 aa, Glycine max
  Coding DNA Sequence Number=SeqID_24884
  Homolog annotation: Hit_ID=Q8LN57; Match level="QueryCoverage=55%, HitCoverage=6%, E-value=1e-07, Identity=56%"; Hit description =Putative oxysterol binding protein
MAQYRILTIIIGSILCIIVNVIIHPIWAGFEFFVLVTGNLEKLTNSLQLLMETTLGKGKVMNLCQMFVYSESEAGLPSFPLDITSPALSSH

SEQ ID NO: 141663 - protein, 148 aa, Glycine max
  Coding DNA Sequence Number=SeqID_24885
  Gene Ontology: Mol. function=protein dimerization activity
  Homolog annotation: Hit_ID=Q9LIE1; Match level="QueryCoverage=51%, HitCoverage=10%, E-value=2e-15, Identity=45%"; Hit description =Transposase-like protein
  Pfam annotation: Domain name=zf-C2HC_plant; Domain location=28-84; Score=94.7; E_value=2.8e-25; Accession=PF07567.3; Description =Protein of unknown function, DUF1544
MIDGILENTNIPRSIYPNSRPNIRGKIDMAWAHCKLIQEGDKIAMMCIYCDKIVRGGGINRLKDHLAGKMGQVSLCKKVSPDVRYQMKQNIEENKSKNKKRRIDEEHDFIHLVKKVLYKTLFHDLTVRIFEKKSGVCATFPFPRVWRP

SEQ ID NO: 141664 - protein, 215 aa, Glycine max
  Coding DNA Sequence Number=SeqID_24886
  Gene Ontology: Mol. function=protein histidine kinase activity; Cellular component=integral to membrane; Biological process=two -component signal transduction system (phosphorelay)
  Homolog annotation: Hit_ID=Q8ZN78; Match level="QueryCoverage=81%, HitCoverage=31%, E-value=7e-52, Identity=60%"; Hit description =Sensory histidine kinase in two-component regulatory system with NarP
AVVPAHSADAAPARRRRSGGANDYRRFRSHAGRCLSPAERIAGHLPPQHSGGGSECRAGATVAAIKGANPRADSVTLSAALAGAQRPAAGARAADRARGGAQCRQARRRERDRGMLRGQRRRRQRIQHYRRRLRHRQSGRTGRALRLDHHERTRGATGRNAAHPAQKRRRHGGLPDILALTLRLFTLRYGCRRPEGRPERFAVQNAAIFEETVPL

SEQ ID NO: 141665 - protein, 254 aa, Glycine max
  Coding DNA Sequence Number=SeqID_24887
  Gene Ontology: Mol. function=nucleotidyltransferase activity; Cellular component=extracellular space; Biological process=metabolic process
  Homolog annotation: Hit_ID=Q09WE7; Match level="QueryCoverage=93%, HitCoverage=39%, E-value=1e-128, Identity=98%"; Hit description=UDP -sugar pyrophosphorylase
MASSLGDNFNLLSPQQQELVKMLLDNGQEHLFRDWPAPGVDDDHKNAFFDQLTRLDSSYPGGLEAYITNAKRLLADSKAGRNPFDGFTPSVPTGETLAFGDENYIKFEEAGVLEARKAAFVLVAGGLGERLGYSGIKIYTQLALPAETTTRTCFVQNYIESILALQEASSQGESQTQIPLVIMTSDDTHGRTLELLESNSYFGMQPTQVTLLKQEKVACLEDNDARLALEPQNKYKIQVLMASCSVLQGNSMIV

SEQ ID NO: 141666 - protein, 271 aa, Glycine max
  Coding DNA Sequence Number=SeqID_24888
  Gene Ontology: Mol. function=nucleotidyltransferase activity; Biological process=metabolic process
  Homolog annotation: Hit_ID=Q09WE7; Match level="QueryCoverage=80%, HitCoverage=36%, E-value=1e-122, Identity=100%"; Hit description=UDP- sugar pyrophosphorylase
MLSCALYFNSVTTVKKVDGEGHVSLSGYSRTILESGCLAFSVHFFSSCGGLGVKYKDASKTSFKSSTRLECMMQDYPKTLPPSARVGFTVMETWLAYAPVKNNAEDAAKVPKGNPYHSATSGEMAIYRANSIILRKAGVQVADPVVQVFNGQEVEVWPRITWKPKWGLTFNRIKSKVSGNCSISLRSTLAIKGPNIFIENLSVDGALIIDAVDDAEVNVSGSVQNNGWVLETVDYKDASEPEVLRIRGFKFNKIEQLETKYSEPGKFHLKA

SEQ ID NO: 141667 - protein, 79 aa, Glycine max
  Coding DNA Sequence Number=SeqID_24889
MALVMGPSLGGFHHPLPLEEDLSSNLQTPHNLNQLHLDEDALMPHNVAPCRACRPWIFFINEVLCFLKINGNKMEKEER

SEQ ID NO: 141668 - protein, 61 aa, Glycine max
  Coding DNA Sequence Number=SeqID_24890
MANEELKLQDPRCRIQCPDILPENTGVAVQCKIKVKCRNFSEEDRSPPASSRCSPETQIAI

SEQ ID NO: 141669 - protein, 51 aa, Glycine max
  Coding DNA Sequence Number=SeqID_24891
QKHLSGWRGREVNVQRDGLRLSISWILYLDDAKAQAVHSTEAMEPDRGAHQ

SEQ ID NO: 141670 - protein, 366 aa, Glycine max
  Coding DNA Sequence Number=SeqID_24892
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=1e-48, Identity=31%"; Hit description= UPI00006A17C9 related cluster
MPSPLEDYTSPPSEGYTLHALACKGLDALTFRGLHVLAFRGLRALAFMGIHALPFRGLHVLAFRGLHNLAIIGVHVVAFRGLHVLTFRGLHMLTFRGLHILAFRGLHTVTFRGLHRLHALSLRGLHVLTFRGLTVLAFRGQHALTLKGLQVLAFRGLHVLTFRVLHVLTFRGLHVLTLKGLHALAVRGLHTLTFRGLLVPSFKGLHVLTFRGLHVLTLRVLHALTFRGLHVPAFRGLHVLTFRRLHVLAITGINGLTFRVLHVLAFRGLHALAFVGLHALPFRVLHVLTFRGLHVLTLIGLHALAIRGLHTLTFRGLHVPSFRGLHVLTFRGLHVLTLRVLHVLTFIGLHVLPFIGLHVLSLQRAT

SEQ ID NO: 141671 - protein, 76 aa, Glycine max
  Coding DNA Sequence Number=SeqID_24893
MEGKPQETAYSSQKMNPALDVICRTFVYVQISSQTWLIVVVGRVLEEEQGCAINVGISSPGIRTETPLAYTLICKS

SEQ ID NO: 141672 - protein, 114 aa, Glycine max
  Coding DNA Sequence Number=SeqID_24894
MIKGSVSEFAGKADLGLDVGGAASAGGGGGGEWRRGGAEVALKDGHDKEHGDENGGGDEAEGDGVDGAVKVGPMLVSVDVQRSTDWWPPIGNGERERREKKRGEEVNFGIWIGV

SEQ ID NO: 141673 - protein, 1382 aa, Glycine max
  Coding DNA Sequence Number=SeqID_24895
  Gene Ontology: Mol. function=nucleic acid binding; Cellular component= nucleus; Biological process=RNA processing
  Homolog annotation: Hit_ID=Q5ZCG4; Match level="QueryCoverage=60%, HitCoverage=66%, E-value=0.0, Identity=55%"; Hit description =Putative ATPase
  Pfam annotation: Domain name=DEAD; Domain location=637-901; Score= -32.1; E_value=0.0029; Accession=PF00270.19; Description=DEADDEAH box helicase
  Pfam annotation: Domain name=Helicase_C; Domain location=1246-1324; Score=81.1; E_value=3.4e-21; Accession=PF00271.21; Description =Helicase conserved C-terminal domain
  Pfam annotation: Domain name=SNF2_N; Domain location=630-1027; Score =168.3; E_value=2e-47; Accession=PF00176.13; Description=SNF2 family N-terminal domain
  Pfam annotation: Domain name=zf-C3HC4; Domain location=1065-1105; Score=20.4; E_value=0.0012; Accession=PF00097.15; Description=Zinc finger, C3HC4 type (RING finger)
  Pfam module annotation: Pfam domain module=DEAD::Helicase_C::SNF2 _N::zf-C3HC4; Domain location=637-901::1246-1324::630-1027::1065-1105
MADADVDLSGLFTGNADEDDDMFYIDMQTVQKVLDEDDDCYFQEVGFLLCQKQSEIPNAVIVFNILDIRQSSPEDSSSKDVSPSESGIHDTFQIQNGSQVQEEPHFSRLGLADSVTSCSPFFSDVSDSGVRCSVGVSDSAANSMLDCERESERENRGPQSQACSSPKAFPGNFSDSFSPGESHEVFCTERTGVFKHEIPAYSVEASFPKAQSNKISICGDNLNLSMWIGENESQFKHVGEDVESEHASLSSIVDNDDVNAEDIITGVSGQQENDSCTSFEASFMDADRSLHVTTSTDSTIGQGSHVSSDFIDYHVSSNCYQGTYHGPFVADSSLGFVPNGIYSQLWPDEEMMNNIKAENVELNADIACMSNGLPSSTTGWMPFQDSQIMLADNGYPSFHSGKVNVDDMSSLSLSACASYMSYGDHYQNNFHCDDAEFNVGQEVKETPGIFSSVGCQAYQCFENENNFAVISGISNQYQDSIGGTASFQGNLDNLNLKAADISWTHPQALITNEQQFGSVKSEGGIQHNFINSHLSKGRTENFYVEEDPDVCIIEDISHPAPTSRSADIGNSLNISQSSRYVDSQSYTVGSTRMKACDERNILRVALQDLSQPKSEVSPPEGLLAVPLLRHQRIALSWMVQKETSSLYCSGGILADDQGLGKTVSTIALILKERPPLLNGCTNARKSELETLNLDVDDDVLPKTGRVKEESNMCEDNPSRYPTKSMSLLKQDKGRPSAGTLIVCPTSVLRQWAEELRSKVNGQASLSVLVYHGSNRTKDPYEVARHDVVLTTYSIVSMEVPKQPPADKDDEEKEIFEDPATASRKRKSPSNSSKSGKKKLDGTILEGVARPLAKVAWFRVVLDEAQSIKNHKTQVARACWGLRAKRRWCLSGTPIQNAIDDLYSYFRFLRYDPYSDYASFCTRIKSQITKNPENGYRKLQAVLKTIMLRRTKGTLLDGEPIISLPPKYIELKKVDFSMEERDFYSKLEADSRAQFQEYADAGTVKQNYVNILLMLLRLRQACDHPLLVKRYNSNSLWRSSVEMAKKLPQEKQISLLKCLEASLALCSICNDPPEDAVVSVCGHVFCNQCICEHLTGDDNQCPAANCKSRLSTSMVFSKTTLNSCLSDQSCDNSPSRSGSEVEESEPWSESKPYDSSKIKAALEVLKSLCKPQCCTPKSTSEHGTFREDNDCPRNPSIANNGKSLKDSLESQNLSDESRSSNGSVTVVGEKAIVFSQWTRMLDLLEACLKNSSINYRRLDGTMSVVARDKAVKDFNTCPEVTVIIMSLKAASLGLNLVVACHVLMLDLWWNPTTEDQAIDRAHRIGQTRPVTVLRLTVRDTVEDRILDLQQKKRTMVASAFGEDGTGDRQTRLTVDDLKYLFMM

SEQ ID NO: 141674 - protein, 83 aa, Glycine max
  Coding DNA Sequence Number=SeqID_24896
MGCTFNGNAMNIIGVVWWVIVVVRWVMVAVRRCDGSFMRWRLVSGERKRDREEEGGKSMLANAARILFAEVDHPDLDTWTHLA

SEQ ID NO: 141675 - protein, 48 aa, Glycine max
  Coding DNA Sequence Number=SeqID_24897
MALKPRKLPKTKIKLALKLKKVVLKQFGNKELFEELLGLNLPSPSIFL

SEQ ID NO: 141676 - protein, 95 aa, Glycine max
  Coding DNA Sequence Number=SeqID_24898
  Gene Ontology: Mol. function=transferase activity, transferring glycosyl groups
  Homolog annotation: Hit_ID=Q9LXU2; Match level="QueryCoverage=60%, HitCoverage=13%, E-value=1e-10, Identity=39%"; Hit description =Anthranilate phosphoribosyltransferase-like protein
MHKPEKALDFALKETSPNIDAENLGKYKGLAKHFEKKSNPHWNQVFAFSKERIQASFLEVVIKDKDVVVEDFRCKYVGRAKLTPTYIAVSHAGSN

SEQ ID NO: 141677 - protein, 119 aa, Glycine max
  Coding DNA Sequence Number=SeqID_24899
  Gene Ontology: Mol. function=protein binding; Biological process =primary shoot apical meristem specification
  Homolog annotation: Hit_ID=Q8H6S5; Match level="QueryCoverage=84%, HitCoverage=12%, E-value=4e-19, Identity=42%"; Hit description=CTV.2
MGAVPKAGGFPPLGAHGVTILKQPRTPPTNNPAMDADSDHVLKRTRPFGLSDEISNLPVNLLPVAYSGQSHGQSSYSSDDLPKTVVMTLNQGSIVKSMDFHPLQQILLLGKPLLDYRTG

SEQ ID NO: 141678 - protein, 190 aa, Glycine max
  Coding DNA Sequence Number=SeqID_24900
  Gene Ontology: Mol. function=RNA-directed DNA polymerase activity; Cellular component=chromatin; Biological process=RNA-dependent DNA replication
MAEATHSRVSADRIEDAIAKLSASQLAMNTKIDDLLQRMNQLEVGQQPPQSLSSSSVGQTPQMHNAVHRMKLDVPRFDGSDPTGWTFKITQFFEYHATPDQERLTIASFYMEGPALAWFQWMHHNAQLSSWPAFLHALHSRFASSTYEDPTRLLCKLQQRSSVSEYLSEFESLANRVVGLPATFVLSCFI

SEQ ID NO: 141679 - protein, 240 aa, Glycine max
  Coding DNA Sequence Number=SeqID_24901
  Homolog annotation: Hit_ID=Q5WN07; Match level="QueryCoverage=48%, HitCoverage=10%, E-value=3e-22, Identity=48%"; Hit description =Putative ATPase
MIVNDDEEFEEEEEDASASHQILDNEEELEAVARSASSDDDDNSPDEAAEDDDEDKQDESNVDHEVSKREKAKLRETQQLKKNEKFRRYWMHKMRPLMLIWYNNRRKGRLSYLLQQTELFAHFAKGDQSSQKKAKGRGHHASKVTEEEEDEEYLKGEKDGLANTRLVTQPSLSDGQNSIYKEGKTYSNIYKEEWIQPLPMGSNIYPKVHENPKTFFSSSSPILLESSIQYPWGVGLHQES

SEQ ID NO: 141680 - protein, 262 aa, Glycine max
  Coding DNA Sequence Number=SeqID_24902
  Gene Ontology: Mol. function=carboxypeptidase activity
  Homolog annotation: Hit_ID=Q8RV74; Match level="QueryCoverage=93%, HitCoverage=62%, E-value=1e-73, Identity=48%"; Hit description=Leaf senescence protein-like
  Pfam annotation: Domain name=DUF231; Domain location=77-247; Score =121.4; E_value=2.5e-33; Accession=PF03005.6; Description=Arabidopsis proteins of unknown function
VEWPIDVSYTDDFSFKRWKYSSYNFTMTTFWSPYLVRAKQVDSNGGLYNVYLDEFDEKWTTQIKEFDYVIINVGQWFLRPMVFYEKQKIVGCQYCSLENVTHLSWHYGYKKAFGTTFKAIINLENFKGVTFLRTFAPSHFENGVWDKGGNCVRTKPFKSNETRLEGNNLELHTIQLEQFKIAEKEARKKGLKFMLLDTTQAMLLRPDGHPNKYGHWPHENVTLFNDCVHWCLPGPIDTWSDFLLEMLKMEDVRSTSKERFHL

SEQ ID NO: 141681 - protein, 277 aa, Glycine max
  Coding DNA Sequence Number=SeqID_24903
  Gene Ontology: Mol. function=protein binding
  Homolog annotation: Hit_ID=Q7F241; Match level="QueryCoverage=88%, HitCoverage=95%, E-value=2e-53, Identity=46%"; Hit description =Speckle-type POZ protein-like protein
  Pfam annotation: Domain name=BTB; Domain location=82-207; Score=42.8; E_value=1.2e-09; Accession=PF00651.21; Description=BTBPOZ domain
MPPRRCTAAYSAVAQMGSNTSESDAEELVMRCLSCEEEYDVDDSGTCRECYQEANEAEEELRHEIEELKSKVSFLTLPSPNLNASTADVVLVPVDDSDDAPIPAHKHLLIRFKNLVVLTTLNWTQFGYVSRSPVFRAMLKNDMTERRSGTIKISDVSYDTLHAFVNYLYTAEASLDNELACNLLVLGEKYQVKHLKTYCEKYLIAKMNWDKAISNYAFAYQYNCKQLQSVSLAVILDHMDSLTQNECYAELVDTNPRLVVEIYETYIGRLLNTAGAF

SEQ ID NO: 141682 - protein, 139 aa, Glycine max
  Coding DNA Sequence Number=SeqID_24904
MGKDMVEVNFHKSCLTGIGVNDRTTQRYASLLNFRTMGIPFVYLGILGGIPRIKWEKENGGGEPFFSEGSLSCRILESKYAHVSKMFGENQSTKHSIGGGMWSKFVGRGVKGDGRWVREFIWRDWFEWEQPMQEEFMER

SEQ ID NO: 141683 - protein, 114 aa, Glycine max
  Coding DNA Sequence Number=SeqID_24905
MGKPSNKSKETQKLTNVEYAPPDTIARNQRGKDRWVYLPDSAGGSKRLVLVAMQSLQDEGQMREEGDRNVFSPAEARRVLNIGKRLGVTLCGYDAEVIAKIRIDGTKWKLRLRK

SEQ ID NO: 141684 - protein, 69 aa, Glycine max
  Coding DNA Sequence Number=SeqID_24906
MDAEKKGKDAEETEPWHKPKNGSVFPKERVSVKQMVYKKVKQVVVDFVESTAKKGSISPAPEASNSNHE

SEQ ID NO: 141685 - protein, 79 aa, Glycine max
  Coding DNA Sequence Number=SeqID_24907
  Homolog annotation: Hit_ID=Q9ZU94; Match level="QueryCoverage=78%, HitCoverage=23%, E-value=4e-07, Identity=44%"; Hit description =Expressed protein
MSETTAIWVNWVGGETKVVKLDDRMRHTMRALVVDEVTTTLEETINGVRGGGDDEVIVVGEGDRVDEGSEKRVDGVFID

SEQ ID NO: 141686 - protein, 391 aa, Glycine max
  Coding DNA Sequence Number=SeqID_24908
  Gene Ontology: Mol. function=RNA-directed DNA polymerase activity; Cellular component=chromatin; Biological process=chromatin assembly or disassembly
MSVGLIQLSCSPFSSPVLLVKKKDSSWRFCVDYRTLNSLTVKDYFPMPTIDELLDELGAASWFSKLDLRQGFHQILMAEQDTAKTAFRTYLEHYEYKVIPFGLCNTPSMFQATMNELLKPFLRHFITVFFDDILVYSPSLKDHIHYLTQVFECLTQGHLFLKESKFYRGNASIASALTTLLQKDNFHWSEGAQSAFDNLKQAMTQAPVLALPDFSVPFTLETDAFGIAMGIVLMQHGHPLAFFNKIFYPQLQRASTYVRELHATTTVVCNWRQYLLGHPFIILINHKSLRELMNQVIQTLEQQVYLSKLLGYDYLIQYKADKTNVVVDALSRLPHYTHGQCLILSMPYPMFLEAIHDYIRANTSLQDHIRQVTSATNPQLDYRFHDVLLYF

SEQ ID NO: 141687 - protein, 191 aa, Glycine max
  Coding DNA Sequence Number=SeqID_24909
MVLWAQTEQHKNKVSVTVIPAPRKSVKRMMAETLVRFIAALFSCKGNLSEEDSQVPVSGLRCYFSKCNKKEKSKRLPPDLDLDVLRWRCLDLPLSCKNARTPSQARLRFRWRRTRPPSVPTPFRAKATTTFSIEIFDDEDFINVLSCCLGLSLKRVAQFLPPNYRPSLQPSNTSTSPQKLNGVSGNFSLRA

SEQ ID NO: 141688 - protein, 54 aa, Glycine max
  Coding DNA Sequence Number=SeqID_24910
MGMDQGAGMSTKKYETKVKNKKNAFASVIPAPRKSVKRMVDKVFALTPTYPRMQ

SEQ ID NO: 141689 - protein, 325 aa, Glycine max
  Coding DNA Sequence Number=SeqID_24911
MGCCVSKCRPEYKPSPEQEHHFKFNHVQDKLPISQAPPLPPTLYSSTKISPSPPSPTSSTSSISSFTCTTSNTISSASSLSTASSSLSSKDRSFSNEFLWSCYKDNPHIITRINSLRDSTSLSFMPPTKPNRKVVNINPSPPKPNLATLKQSPPQNTVGSFSMPQKRVRSNSPTNLTRQKSFRKDTERSVTINYASNMQSRTLIRSPSPSRRFNGDKCGSANLGITINSSKVSSVSGVHSNSHHHSVLPSTRKESVKAVSPNNNNCSRRVLHSGLRNTHETRTLGVGPKVDETVVKDVVSDHDKDLTLMEDIDNPLISLDCFIFL

SEQ ID NO: 141690 - protein, 485 aa, Glycine max
  Coding DNA Sequence Number=SeqID_24912
  Gene Ontology: Mol. function=magnesium ion binding; Cellular component=chloroplast; Biological process=metabolic process
  Homolog annotation: Hit_ID=Q9ZPN5; Match level="QueryCoverage=84%, HitCoverage=50%, E-value=2e-92, Identity=43%"; Hit description =Linalool synthase
  Pfam annotation: Domain name=Terpene_synth_C; Domain location=94-361; Score=169.4; E_value=8.8e-48; Accession=PF03936.6; Description =Terpene synthase family, metal binding domain
MQYAVLFRWFLDDEEIRTRVEKEPEHFSTTMLSMYRASNLIFCGENELEDVKSFTRDLLKRSLLTKNGETQRKLSQFQQMVQRELNIPWLAHMDHLDHRIWIEENEEVNFLWKGKTSHVRWAQNCGLTNMGFGREKTTYCYYAIAAATTYPNDTYVRMLVAKSAVMITVADDFFDAEGSFKELNDFMNAVRRWDSKGLSSQLGKVIFEALDNLVSEASGKYVEQGGIHDIQSSLQDLWYETFLSWLTEAKWNKKGEAPSIDDYLKNGMISIAIHTMILPASCFLNPSLSYENLRPAQYEPITKLLMVICRLLNDIQTYKRETEEGKWNFLGLNLMKNPNFGMEDSIALGREIIDERTKEFIQHVLVNGQSDLPKPCKLLHLTCLKVFHLFYNSRNAFDSNTQLLEDINKAIYLPLRRNTKTTKIDLSQLRSMPKMKDKSIQRPRFNWSFKHNRSFCVHQVISPPALRNGYGIISFNPKALIPGFI

SEQ ID NO: 141691 - protein, 480 aa, Glycine max
  Coding DNA Sequence Number=SeqID_24913
  Gene Ontology: Mol. function=serine carboxypeptidase activity; Cellular component=cellulose and pectin-containing cell wall; Biological process=proteolysis
  Homolog annotation: Hit_ID=UPI000034F551; Match level="QueryCoverage =90%, HitCoverage=90%, E-value=0.0, Identity=69%"; Hit description =SCPL31; catalytic/ serine carboxypeptidase
  Pfam annotation: Domain name=Peptidase_S10; Domain location=52-473; Score=730.6; E_value=1e-216; Accession=PF00450.12; Description =Serine carboxypeptidase
MTSLYTLVLLLFLFLSYRPALSFSSRHRQYWGGGGRILSSGEHNGDLVTNLPGQPRVNFQHYAGYVTVNETNGRALFYWFYEAITQPKEKPLVLWLNGGPGCSSVGYGATQEIGPFLVDTDGQGLKFNNFSWNKEANMLFLESPVGVGFSYSNTSSDYDQLGDELTANDAYSFLHNWFQKFPSYRGRTFYIAGESYAGKYVPELAELIHDRNKDPSLYIDLKGILLGNPETSDAEDWMGLVDYAWSHAVISDETHQTIKTSCDFNSTDPWHNEDCSQAVDEVLKQYNEIDIYSLYTSVCFASTASSNDQSMQTSTKRSSKMMPRMLGGYDPCLDGYAKAFYNKPDVQKALHASDGHNLKKWSICNDKIFNDWADSKPSVIPIYKKLISAGLRIWVYSGDTDGRVPVLSTRYSLSSLALPITKSWRPWYHDNEVSGWFEEYKGLTFATFRGAGHAVPCFKPSNSLAFFSSFLNGESPPSTK

SEQ ID NO: 141692 - protein, 284 aa, Glycine max
  Coding DNA Sequence Number=SeqID_24914
  Gene Ontology: Mol. function=magnesium ion binding; Cellular component=chloroplast; Biological process=metabolic process
  Homolog annotation: Hit_ID=Q84UU3; Match level="QueryCoverage=97%, HitCoverage=34%, E-value=2e-60, Identity=43%"; Hit description =Terpene synthase
MESPSSSLVEKIKGKIFSSNVDPYTSICPSAYDTAWLAMIPDSHNSFKPMFKNCLDWLLNNQNQQGFWGECDAFGKPTLETLPATLASIVALKKWNTGALMIDTGLVFIETNIEKLLKDIDNNCPRWFRIVFPAMVQLSESVGLEIVFPDAVTGSVSRIFHRQQYLLNKEELVGKHCFPPLLSYLEALPPTYTISEEDIRSNLSDDGSVFQSPSATAKAFMATGKIECLAYLQSLIQRCPDGVPQTYPMDEELIKLCMVNKLQRLGLAEHFVEEIDEILAKVYR

SEQ ID NO: 141693 - protein, 83 aa, Glycine max
  Coding DNA Sequence Number=SeqID_24915
MEMKRLMVMVSWFTAGVDQKKGREKIVKLALTSDCGRTGVAELIQHGGVKEEGEVSVAKGGEEGRGDVVVNDVEGALVMSSMW

SEQ ID NO: 141694 - protein, 62 aa, Glycine max
  Coding DNA Sequence Number=SeqID_24916
  Homolog annotation: Hit_ID=P33079; Match level="QueryCoverage=65%, HitCoverage=44%, E-value=5e-07, Identity=65%"; Hit description=Auxin- induced protein 10A5
  Pfam annotation: Domain name=Auxin_inducible; Domain location=1-59; Score=-31.8; E_value=0.1; Accession=PF02519.5; Description=Auxin responsive protein
MGFRIHGIFRWDTVSTNKAASKKLEVPKGYLAVYVGGKMRRLYWGLSEVVQLEVSIKLDSGS

SEQ ID NO: 141695 - protein, 143 aa, Glycine max
  Coding DNA Sequence Number=SeqID_24917
  Gene Ontology: Mol. function=oxidoreductase activity; Biological process=gibberellin biosynthetic process
  Homolog annotation: Hit_ID=Q4JH25; Match level="QueryCoverage=93%, HitCoverage=35%, E-value=1e-53, Identity=75%"; Hit description=GA 20- oxidase
MDSGGLLRCELEVLPHVPTNFIWPKEYLVDAQHELQAPVVDLYGFLRGENEATKHAAKLISEACLKHGFFQVINHGVDPHLIRQAHDQMDTFFKLPIHRKLSVHKTPGSMWGYSGAHAHRFSSQLPWKETLSFPYHDNTLEPV

SEQ ID NO: 141696 - protein, 91 aa, Glycine max
  Coding DNA Sequence Number=SeqID_24918
  Gene Ontology: Mol. function=oxidoreductase activity; Biological process=gibberellin biosynthetic process
  Homolog annotation: Hit_ID=Q4JH25; Match level="QueryCoverage=93%, HitCoverage=23%, E-value=7e-36, Identity=81%"; Hit description=GA 20- oxidase
ALSNGRYKSCLHRAVVNKYKERKSLAFFLCPKEDKLVRAPNDIVSMDGTKHYPDFTWSHLLHFTQNHYRADQATLPNFTKWLLSSKTTHTS

SEQ ID NO: 141697 - protein, 330 aa, Glycine max
  Coding DNA Sequence Number=SeqID_24919
  Gene Ontology: Mol. function=transcription regulator activity; Cellular component=nucleus; Biological process=regulation of transcription
  Homolog annotation: Hit_ID=Q9LSL1; Match level="QueryCoverage=59%, HitCoverage=58%, E-value=1e-65, Identity=66%"; Hit description =Arabidopsis thaliana genomic DNA, chromosome 5, TAC clone:K21L13
  Pfam annotation: Domain name=HLH; Domain location=163-212; Score =40.3; E_value=6.6e-09; Accession=PF00010.16; Description=Helix-loop -helix DNA-binding domain
MEFYDQDFLEELMTLRRETWDTNPRTEENQFFDGGSFDCFDQNSLPYLPNSSCGQEVPQTYNNDYPFSEIYGCLLDESSPQIMDSFYSTLDTPLNTPPFLGQEDYPILSMMEEEEQGLLGEELKNLELQTTCKMEPTQSSEMPVFNMGTGLERKNRSKKLQGQPSKNLMAERRRRKRLNDRLSMLRAIVPKISKMDRTSILGDTIDYMKELLEKINNLQQEVEVDSNMAGIFKDVKPNEILVRNSPKFEVERSVDTRVEICCAGKPGLILSTVNTLEALGLEIQQCVISCFNDFTMQASCSEESEQRTMLSSEDIKQALFRSAGYGGRCL

SEQ ID NO: 141698 - protein, 46 aa, Glycine max
  Coding DNA Sequence Number=SeqID_24920
MPSFRDLEQKWAPKVEALFEASMESEGERKATSSRFSASVGASFRK

SEQ ID NO: 141699 - protein, 244 aa, Glycine max
  Coding DNA Sequence Number=SeqID_24921
  Gene Ontology: Mol. function=carboxypeptidase activity; Cellular component=membrane; Biological process=auxin mediated signaling pathway
  Homolog annotation: Hit_ID=Q9SUF1; Match level="QueryCoverage=74%, HitCoverage=47%, E-value=4e-49, Identity=51%"; Hit description =Nodulin-like protein
  Pfam annotation: Domain name=DUF6; Domain location=72-202; Score =22.5; E_value=0.0015; Accession=PF00892.11; Description=Integral membrane protein DUF6
  Pfam annotation: Domain name=TPT; Domain location=63-202; Score= -26.0; E_value=0.019; Accession=PF03151.7; Description=Triose -phosphate Transporter family
  Pfam module annotation: Pfam domain module=DUF6::TPT; Domain location= 72-202::63-202
MEHMKIKEVACQAKVIGTVITFGGTLLMALYKGPVLSFMRSSTSHPSQPENVATETGNHWVIGTLFLLIGCAGFSAFYILQAITLRKYPAEMSLATWVCFVGALQSSIVAIFAERHHPHAWSLGWDARLFAPAYAGIVTSGVQYYIQGMVSKIMGPVIVTAFNPLRMIIVTALACIILSEQLFLGSIIGAIVVVLGLYLVVWGKAKERRGLMTPSPAENNFPEDQRQLPVTAPRNDSINNNNKA

SEQ ID NO: 141700 - protein, 381 aa, Glycine max
  Coding DNA Sequence Number=SeqID_24922
  Gene Ontology: Cellular component=intracellular; Biological process =intracellular protein transport
  Homolog annotation: Hit_ID=Q8W2G2; Match level="QueryCoverage=61%, HitCoverage=100%, E-value=3e-37, Identity=37%"; Hit description=Seed protein B32E
  Pfam annotation: Domain name=GAT; Domain location=1-116; Score=72.5; E_value=1.4e-18; Accession=PF03127.5; Description=GAT domain
LLEIQNAQGLADVLMEMLSALSPKDRELSAKLSWQVVIFHLFLNILGKICQGVKEEVIVDLVDQCRSYQKRVMLLVNNTTDEQLLGQGLALNDSLQRVLCRHDDIVKGTADSGAREAETSVLPLVNVNHEDDESEDDFAQLAHRSSRDTQAQNQKPAYDKAEPGRINPLIPPPPASKKPVYSGTGMVDYLSGDTYKTEGSPENSEPTSFTAPLHSSPNPTSSTIPSLSSSHPHAVSTTSSPIFSSEPVYDEQPSSEDKSSECLPAAPWDAQSPGIIPPPPSKYNQRQQFFEQQGVSHSSSGSSSSYDSLVGQTQNLSLNSSTPTKQQKPEDALFKDLVDFAKSKTSSSSKPNRFFKDQSLFKFAGRKKGIGDYSMGNFKLL

SEQ ID NO: 141701 - protein, 761 aa, Glycine max
  Coding DNA Sequence Number=SeqID_24923
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=88%, HitCoverage=91%, E-value=0.0, Identity=50%"; Hit description=Protein kinase; Type I EGF
  Pfam annotation: Domain name=EGF_CA; Domain location=303-347; Score =30.9; E_value=4.6e-06; Accession=PF07645.6; Description=Calcium binding EGF domain
  Pfam annotation: Domain name=Pkinase; Domain location=430-703; Score =164.4; E_value=3e-46; Accession=PF00069.15; Description=Protein kinase domain
  Pfam annotation: Domain name=Pkinase_Tyr; Domain location=430-697; Score=123.8; E_value=5e-34; Accession=PF07714.7; Description=Protein tyrosine kinase
  Pfam module annotation: Pfam domain module=EGF_CA::Pkinase::Pkinase _Tyr; Domain location=303-347::430-703::430-697
LLNLKILDDELQAAMILSRDDTKVVLVAWFLLMISAMSQTIRPSCQNKCGSVNIPYPFGTTENCCLNRNFYVACNTSHNPPKPFLWNVTKNIEILEVSLNGHLRIKSPVAYVCYDEKGVLVDSGNSFMTLQAFHFSYSQNKFIGIGCDTLSTINATIGKNYSAGGCFSLCSSVESSANGSWFGIGFCQTSIPKNILAYQARVLRSNLMHSDMNIPCAYSLLVEEDSFKFSTDDFIKLQKTKTATTVLDWAVGNQTCQEAKKNLTSYACQANSVCIDSDNGPGYLCRCLEGYVGNAYLHGGCQDIDECANPSLNDCSDICLNLPGSYNCSCPKSKSYEGDGRKGGSGCVSNLPHVVNQIVIGTGIGLMLLLIGSGWLFHVFRKRKMVRLTARYFKRNGGLMLQQQIANMEGSSERAKIFTATELKKASENFHESRIIGRGGYGTVYRGILPNDKVVAIKKSKLVDHSQIEQFINEVVVLSQINHRNVVKLLGCCLETEMPLLVYEFVNNGTLFDHIHNKNTTLPWVTRLRIAAETAGVLAYLHSAASIPVIHRDFKSTNILLDDKYTAKVSDFGTSRLVPRDKCQLTTLVQGTLGYLDPEYFQTSQLTEKSDVYSFGVVLAELLTGRRALSFDMPEEERNLALYFLSAVKDDCLFQIVEDCVSEGNSEQVKEVANIAQWCLRLRGEERPTMKEVAMELDSLRMMTTTTTWINAASNSTEYVIGERSGRTETTDYANCHYTTCAGHEDDTICNDVMSPLWDGR

SEQ ID NO: 141702 - protein, 543 aa, Glycine max
  Coding DNA Sequence Number=SeqID_24924
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=99%, HitCoverage=72%, E-value=1e-141, Identity=49%"; Hit description =Protein kinase; Type I EGF
  Pfam annotation: Domain name=EGF_CA; Domain location=298-341; Score =36.8; E_value=7.6e-08; Accession=PF07645.6; Description=Calcium binding EGF domain
  Pfam annotation: Domain name=Pkinase_Tyr; Domain location=425-543; Score=-105.2; E_value=5.1e-06; Accession=PF07714.7; Description =Protein tyrosine kinase
  Pfam module annotation: Pfam domain module=EGF_CA::Pkinase_Tyr; Domain location=298-341::425-543
MGVQYSKLLLQLLLVAFFIAATKTEPPLSKPNCQQKCGNVIIPFPFGMTEACSLNTSFLITCHRNLSPPTPFLQNDYHQISVLDISLEYGQLSISLPVARNCLINNLTGESFIAMNLGPFHLSSNQNKLIVFGADAAGMVYNLENASGILYPTIACMSVYAPAASAPDKSCSGTLCCETPIQQRLSEFFYESSTNIFRRNNTKRLESYPCGYTFLVKDGAYKFHITDIFNLSTNNKFPVVADWAVGTHTCQDAMKNASSYLCKSNYSECRDAEVGPGYHCKCYSGYRGNPYVSNGCQDVDECNEKTHNCTEGSICSNSPGIYSCSCPKGYEGDGKNNGTGCRPKVSSSRIIIIALTVSVSILTLLGGTFYMYWTSKKRNLIRLREQYFQQNGGLLLQQQVVRYSGSTEMTKIFTVEELSQATNNFDESMVLGQGGQGTVYKGILSDNRIVAIKMSRIGNPNQVEHFINEMILLSQINHRNVVKLLGCCLETEVPLLVYEFVPNGTVYEHLHNQGQSLRLTWKTRLQIATETARALAYLHSATT

SEQ ID NO: 141703 - protein, 231 aa, Glycine max
  Coding DNA Sequence Number=SeqID_24925
  Homolog annotation: Hit_ID=Q5EMP6; Match level="QueryCoverage=68%, HitCoverage=62%, E-value=8e-45, Identity=54%"; Hit description =Senescence-inducible chloroplast stay-green protein 2
MNGVCKPELNSQDPALCFANLNDKAGNLNLDQMQQKAVRLLVPSARFEASKLKVVLLEDQINKHASIIPRTYILSHCDFTANLTLAVSNVINLEQLRGWYEKDDVVAEWKKVQNDMCLHVHCFVSGPNSFLDLAAELRYHIFSKEMPLVLKAIHCGDSALFREHPELLDSIVRVYFHSCSEKYNRMECWGPLKDAMEGKQADQFQGSIRRDSPEKLRSPKSIFQALFAFLL

SEQ ID NO: 141704 - protein, 335 aa, Glycine max
  Coding DNA Sequence Number=SeqID_24926
MLDPRTHHPTNSFELYDATRHKPHTWDVTNSGLWPSKPALEEAEVDDSGICSPPMRTTSPPRRKNNHRSLSPTSRTQAIVRGQRELMEMVKNMPESNYELSLKDLVEHHMVVDATRHEKNAVEERNLSSVYNKREKNGGSRKVDNNNNNKNMAQVKRNGNIDRGGFYLKMGLPFPFGSKDKKKKIKKKNEPLGNSCSSRVTPKPSDGSAKGGVVDKEWWKKSPLACKESDSGESSINSDSGKSSGSSSSNSSSSRSNSRRENSGRRCWPFIRRPKNRTQKNSQMNIWKLFMMAWIPQLKQLLLQVIDFRVIYEHELTCYLMETNVQVKNQVDLLM

SEQ ID NO: 141705 - protein, 100 aa, Glycine max
  Coding DNA Sequence Number=SeqID_24927
  Gene Ontology: Mol. function=tetracycline:hydrogen antiporter activity; Cellular component=integral to membrane; Biological process=tetracycline transport
  Homolog annotation: Hit_ID=O21999; Match level="QueryCoverage=50%, HitCoverage=33%, E-value=3e-22, Identity=100%"; Hit description=LacZ- alpha
MTLPTIRGSKGILAIVRGRNKEEERRGSGAKEGRNTIVMMNPAEERECMQAWHWPSFYNVVTGKTLALPNLIALQHIPLSPAGVIAKRPAPIALPNSCAA

SEQ ID NO: 141706 - protein, 189 aa, Glycine max
  Coding DNA Sequence Number=SeqID_24928
  Gene Ontology: Mol. function=kinase activity; Cellular component =intracellular; Biological process=intracellular protein transport
  Homolog annotation: Hit_ID=Q2V732; Match level="QueryCoverage=74%, HitCoverage=21%, E-value=5e-43, Identity=60%"; Hit description=VHS and GAT domain protein
  Pfam annotation: Domain name=VHS; Domain location=8-136; Score=38.0; E_value=3.3e-08; Accession=PF00790.9; Description=VHS domain
  Subcellular localization annotation: CTP_CleavageSite=48; ConfidenceScore=5.30e-01
MAILTAASPFLSHKATSNCSVSLKFLKRGKVGPLIMQAKDALKILKKRLASKNPKIQLLALFVLETLSKNCGESVFQQIIERDILHEMVKIVKKKPDLNVREKILILIDTWQEAFGGPTGVYPQYYAAYNELKSAGVEFPPRDENSVPFFTPAQTQPIIHSAAEYDDATIQASLQSDASDLRKLAGYLS

SEQ ID NO: 141707 - protein, 147 aa, Glycine max
  Coding DNA Sequence Number=SeqID_24929
  Homolog annotation: Hit_ID=Q2QQS4; Match level="QueryCoverage=30%, HitCoverage=33%, E-value=5e-15, Identity=86%"; Hit description =HesB/YadR/YfhF family protein, putative, expressed
MSNTEITVALTDEKGKFDELVEDKGVKILIDPKALMHVIGTKMDFVDDKLRIVALYLYGEKGGGDKNGKGSEVDRQKIKYGSEAVVDLLSHEIVKIAIQLAVDPHIDIQVQLMDFYYSACENKGNESFGAQNKRILRTDMVSIYRVL

SEQ ID NO: 141708 - protein, 379 aa, Glycine max
  Coding DNA Sequence Number=SeqID_24930
  Gene Ontology: Mol. function=hydrolase activity; Cellular component =cellulose and pectin-containing cell wall; Biological process =electron transport
  Homolog annotation: Hit_ID=Q6ESF3; Match level="QueryCoverage=96%, HitCoverage=88%, E-value=1e-111, Identity=51%"; Hit description =Hydrolase, alpha/beta fold protein-like
  Pfam annotation: Domain name=Abhydrolase_1; Domain location=95-373; Score=48.4; E_value=2.4e-11; Accession=PF00561.10; Description =alphabeta hydrolase fold
IFGTVLAVLFIGFVAWSYQTIQPPPPKICGSLNGPTITAPRIKLRDGRNLAYKEHGVPKDVAKHKIIFVHGFDACRHDAYVAKTLSPDVAEVLGVYIVSFDRPGYGESDPHPNQTVKSLALDIEELTDKLGLGSKFYIIGFSLGGQVVWRCLKYIPHRFMDLLLTYMVFNFFTSTRCGTTPHTCNPTHLLLKCESLPHVLIAPVLNYWWAGLPANLTNEVFYQQKLQDQWTVRVAHYIPWLTYWWNTQKWFPSSSLIADSIDLLSLQDRELLPKRSDRKNHVAQVRQQGEHETVHRDLILAFGSWEFSPLDLENPFPNNEGSVHIWQGDEDLIVPVKVQRYIAQKLPWIQYHELQGAGHLFPHVDGMSDTIIKSLLSGK

SEQ ID NO: 141709 - protein, 176 aa, Glycine max
  Coding DNA Sequence Number=SeqID_24931
  Gene Ontology: Mol. function=binding
  Homolog annotation: Hit_ID=Q9LRV2; Match level="QueryCoverage=76%, HitCoverage=19%, E-value=1e-37, Identity=58%"; Hit description =Selenium-binding protein-like
MNLLGKKKLRRSSTRGENASKSNLSREKTRPSHAQEQGKCLVGETQLGISGNEGVPGAAIWLGHFVEQFAGVAEAVAFGVGFDGAVEEEGGGVGGEGEQVGLDLAGLHDGAVGGAEAEEEGVEREREGLGEGEENGSGFSDATRFEVREDRVDHCIGGGLGLRVWMWFQVLLAEEL

SEQ ID NO: 141710 - protein, 653 aa, Glycine max
  Coding DNA Sequence Number=SeqID_24932
  Gene Ontology: Mol. function=catalytic activity; Cellular component =intracellular; Biological process=metabolic process
  Homolog annotation: Hit_ID=Q60DD6; Match level="QueryCoverage=81%, HitCoverage=85%, E-value=1e-100, Identity=39%"; Hit description=PPR repeat containing protein
  Pfam annotation: Domain name=PPR; Domain location=136-170; Score =47.1; E_value=6e-11; Accession=PF01535.11; Description=PPR repeat
  Pfam annotation: Domain name=PPR; Domain location=235-269; Score =20.6; E_value=0.0058; Accession=PF01535.11; Description=PPR repeat
  Pfam annotation: Domain name=PPR; Domain location=270-304; Score =14.1; E_value=0.16; Accession=PF01535.11; Description=PPR repeat
  Pfam annotation: Domain name=PPR; Domain location=336-370; Score =18.1; E_value=0.032; Accession=PF01535.11; Description=PPR repeat
  Pfam annotation: Domain name=PPR; Domain location=406-440; Score =20.2; E_value=0.0072; Accession=PF01535.11; Description=PPR repeat
  Pfam annotation: Domain name=PPR; Domain location=509-542; Score=5.9; E_value=1.5; Accession=PF01535.11; Description=PPR repeat
  Pfam module annotation: Pfam domain module=PPR::PPR::PPR::PPR::PPR::PP R; Domain location=136-170::235-269::270-304::336-370::406-440::509 -542
MNGYKLLLNVPVPCSCERGISICMYPLLKQAQGPYSSLSYCSLLLNHCLSKKSLNFVKIVHAHFLKLGLNTYTYLGNRCLDLYSEFGHLNDAPKVFDDISHKNSTSWNICLKWLLKSGQFGKACHLFDAMPVRDVVTWNSMISGYASCGYFSHALELFVEMQGTGVRPSGFTFSILMSLVSSPSHAKQIHSRMIRSGVDLDNVVLGNSLITMYGRLGLVEYSFGVIMTMKQFDVISWNSLIWACHRAGHHELALEQFYWMRGAEFLPDQFTCSVLMSVCSNLRDLDKGKQVFAFCFKMGFVYNSIVSSAAIDLFSKCNRLEDSVRLFKEQDQWDSALCNSMISSYARHYLGEDTLQLFVLTLRKNIRPTEYMVSSLLSSVSIFLPVEVGNQIHSLVPKLGFESDAVVANSLVHMYAKFGFINDALNIFNEMKIKDLVSWNTIMMGLTYYGRVSLTMDLFRELLTREGMLPDRITLTAVLLACNYGLLVDEGIEIFSSMEMEFRVKPGEEHYACVVEMLCKAGKLKEAIDIIETMPYRTTSDIWRSIFSACAIYGDLQIIEGVAKKIMDMESLISLPYLVLAQAYQMRGRWDSMVRMRKAAENRGSKEFIGHSWIGIKNNVYTFASNQLQHYGGKDLYLVLNLLVWEMETEGYV

SEQ ID NO: 141711 - protein, 265 aa, Glycine max
  Coding DNA Sequence Number=SeqID_24933
  Gene Ontology: Mol. function=protein binding
  Homolog annotation: Hit_ID=Q1S6L6; Match level="QueryCoverage=83%, HitCoverage=53%, E-value=1e-89, Identity=72%"; Hit description =Cyclin-like F-box
MSGAGREKPDPDRGRGWGVNIHPRRFRGWGWGGKWRVGGGGGLSNVSLKVLDLELFSSDKFILEADLLEKLHLKYCSFEVFELIEKGTLKVLKIDDVSVIHLDIGDSTENLEIIDVSNFTIMWPKFSHMISKASKLYKLWMWGVVFDDEDEVVDIETISVCFPQLTHLSLSYDLRDGVLHYGLQGLSCLMNVVVLELGWTVISDLFSVWVAALLEGCPNLKKLIIYGFVSEVKTHEECQILARFSEFILQLGRKYGHVKFEFEYE

SEQ ID NO: 141712 - protein, 279 aa, Glycine max
  Coding DNA Sequence Number=SeqID_24934
  Gene Ontology: Mol. function=DNA binding; Cellular component=nucleus; Biological process=regulation of transcription, DNA-dependent
  Homolog annotation: Hit_ID=Q8W475; Match level="QueryCoverage=82%, HitCoverage=39%, E-value=2e-36, Identity=39%"; Hit description =Putative SWI/SNF family transcription activator
  Pfam annotation: Domain name=Myb_DNA-binding; Domain location=37-82; Score=36.5; E_value=9.4e-08; Accession=PF00249.21; Description=Myb -like DNA-binding domain
DNFIICANCFKSGNYGEKRSAEDFVFSESSENSVKHDTVWTEAETLLLLESVLKHGDDWELVAQSVQTKTKLDCISKLIELPFGELMLGPTHKNVNINGANGIMNNAKQVQSSSSDNQEISKTKDQTPELTNENEQNGDAVKESPSKRQRVAALSDSSSLLMNQAHACAHCADASLAVTSLVGLISNVVDPHITAAAADAAVSALCDEDLCPREIFDVEEDYSARALEGEEGLEMERSSLSGNHLMDGNDYSVVSSCSLLDECLTQYLVMVHFRDFLWD

SEQ ID NO: 141713 - protein, 52 aa, Glycine max
  Coding DNA Sequence Number=SeqID_24935
MSGPRNGQVHEPTNQPPMQRRNKDWITISQEGNSEDENIGNLAYQNYSLMQC

SEQ ID NO: 141714 - protein, 157 aa, Glycine max
  Coding DNA Sequence Number=SeqID_24936
  Gene Ontology: Mol. function=nucleic acid binding; Biological process= DNA integration
  Homolog annotation: Hit_ID=Q1S7S0; Match level="QueryCoverage=96%, HitCoverage=15%, E-value=7e-13, Identity=26%"; Hit description =Integrase, catalytic region; Peptidase aspartic, catalytic
MKIALLDQNKFGFIDGSIVKPALGHANHIVWHRNDNIVASSWLLKSLSKEMQVVGFMSVYVWESLLKLKSAHTCTCTRIKPWCEYAQLEYVMYFSLGLNEAYSWIRGQILYMDPFPYITEIFSMVVQEEKHKEIGTTFATPHAFVVKQGSDSKNKPN

SEQ ID NO: 141715 - protein, 529 aa, Glycine max
  Coding DNA Sequence Number=SeqID_24937
  Gene Ontology: Mol. function=ubiquitin-protein ligase activity; Cellular component=ubiquitin ligase complex; Biological process =protein ubiquitination
  Homolog annotation: Hit_ID=Q84TU4; Match level="QueryCoverage=96%, HitCoverage=65%, E-value=1e-59, Identity=32%"; Hit description=Arm repeat-containing protein
  Pfam annotation: Domain name=U-box; Domain location=212-285; Score =111.3; E_value=2.7e-30; Accession=PF04564.6; Description=U-box domain
MKPMPFQNICNNMVGVLKRLKPVLDDIMDYQIPSNVNLCKECEELDMQVNEARDFIEKWSPKMSKIHSVLQGGTLLIKLQSTSLDICHMIVKSLQSPPSASVLANLQHYIQELQCFKKEMAMVFIEEALRNQRDNVELCTEHLKEIIELLKLTSNQELLRESIAVEKERLNAEVNKMKGDLEELDDIVILVCNLRDYVMKTECPVVKSGLLIPLYFRCPLSLELMLDPVIVASGQTYERQSIQKWLDHGLTVCPKTRQRLTPTNLIPNYTVKAMIATWCEENNVKLSGNSEQNNSACITSPSDHLLPQDLTHDCCVESLPSSNSISRSALQTENAFEKQKGDNSFRLCEEYNGCQSGAIEKCEQQSPYTHSRSESFSSSISSTDCAHAVSKEVSGISNKLQNVKVLSGEITKVCPPSPGNKQSGISPWLSGTQFQSPGSNVGVLENGNNNNSHSRFDSHPVFNSGSDELTTSSHVIRLIEDLHSQSIETQTAAAEELRLLTKHNKENRIIVGQYGAVAPLLSLLYSDLQ

SEQ ID NO: 141716 - protein, 115 aa, Glycine max
  Coding DNA Sequence Number=SeqID_24938
  Gene Ontology: Mol. function=ubiquitin-protein ligase activity; Cellular component=ubiquitin ligase complex; Biological process =protein ubiquitination
  Homolog annotation: Hit_ID=Q84TU4; Match level="QueryCoverage=97%, HitCoverage=14%, E-value=3e-40, Identity=76%"; Hit description=Arm repeat-containing protein
  Pfam annotation: Domain name=Arm; Domain location=21-61; Score=16.2; E_value=0.11; Accession=PF00514.13; Description=Armadillobeta -catenin-like repeat
  Pfam annotation: Domain name=Arm; Domain location=63-103; Score=7.5; E_value=1.4; Accession=PF00514.13; Description=Armadillobeta-catenin- like repeat
  Pfam module annotation: Pfam domain module=Arm::Arm; Domain location =21-61::63-103
MDHAEGMVDKAVALLSNLSTIPEGRLEIARERGIPLLVEIVEYGSQRGKENAASILLQLCLHSSKFCTLVLQEGAVPPLVALSISGTPRAKEKAQQLLSHFRNQREAATTGKGKS

SEQ ID NO: 141717 - protein, 94 aa, Glycine max
  Coding DNA Sequence Number=SeqID_24939
MDSPPASASYVVVACDATRERTEHEIKLVVDHVQERHVFLPSVGYQTLTCPESFAGTNFRAREDEVKKKVDAYATKLLPSYEDFESEGGTLFKF

SEQ ID NO: 141718 - protein, 125 aa, Glycine max
  Coding DNA Sequence Number=SeqID_24940
  Homolog annotation: Hit_ID=Q9SJM8; Match level="QueryCoverage=85%, HitCoverage=42%, E-value=2e-37, Identity=73%"; Hit description =Expressed protein
  Pfam annotation: Domain name=Yip1; Domain location=9-108; Score= -23.2; E_value=0.0048; Accession=PF04893.7; Description=Yip1 domain
MTKWAATSPGWGVQMEKLGLLDYYLIFLYVVFNMLAGRTGNLDLHTCTSVVGYCLLPVVIFSALSLFLPVDGVIRLSVAAVFVLWATRASAGLVVSFADGGDEHRGLIAYASFLIYTLFSLLVIF

SEQ ID NO: 141719 - protein, 291 aa, Glycine max
  Coding DNA Sequence Number=SeqID_24941
  Gene Ontology: Mol. function=protein binding; Cellular component =nucleus; Biological process=regulation of transcription from RNA polymerase II promoter
  Homolog annotation: Hit_ID=Q1S6L0; Match level="QueryCoverage=93%, HitCoverage=70%, E-value=1e-114, Identity=75%"; Hit description=WD40- like
  Pfam annotation: Domain name=WD40; Domain location=100-138; Score =52.7; E_value=1.3e-12; Accession=PF00400.22; Description=WD domain, G-beta repeat
  Pfam annotation: Domain name=WD40; Domain location=145-183; Score =43.1; E_value=9.4e-10; Accession=PF00400.22; Description=WD domain, G-beta repeat
  Pfam annotation: Domain name=WD40; Domain location=211-258; Score =7.6; E_value=4.8; Accession=PF00400.22; Description=WD domain, G -beta repeat
  Pfam annotation: Domain name=WD40; Domain location=3-47; Score=45.1; E_value=2.3e-10; Accession=PF00400.22; Description=WD domain, G-beta repeat
  Pfam annotation: Domain name=WD40; Domain location=55-94; Score=44.7; E_value=3.2e-10; Accession=PF00400.22; Description=WD domain, G-beta repeat
  Pfam module annotation: Pfam domain module=WD40::WD40::WD40::WD40::WD4 0; Domain location=100-138::145-183::211-258::3-47::55-94
MELKEIQRLEGHTDKVWSLAWNPTTGHAGIPLVFASCSGDKTVRIWEQNLSSGLWACTAVLDETHTRTVRSCAWSPSGKLLATASFDATTAIWENVGGDFECVSTLEGHENEVKCVSWNAAGTLLATCSRDKSVWIWEVLPGNEFECVSVLQGHSQDVKMVKWHPTEDILFSCSYDNSVKVWADEGDSDDWQCVQTLGEPNKYYFSTSPITSNFEASCGHTSTVWALSFNVSGDKMVTCSILMPIPYGSDDLTLKVWETESVGTQSGGGFAPCIFRVSRYGMLLRFDNYDL

SEQ ID NO: 141720 - protein, 249 aa, Glycine max
  Coding DNA Sequence Number=SeqID_24942
  Homolog annotation: Hit_ID=Q5N7J0; Match level="QueryCoverage=46%, HitCoverage=30%, E-value=5e-16, Identity=72%"; Hit description =Putative dual-specific kinase DSK1
MPCKIALVKYDLSLDIWRSHYVHETKITETKCVYSLPKFVSLADCHSVEDIEDSIISCKSYPHSIFSSDSSSTIRSYTKQSSYGNRSRENSSLSDFGSSSKQDRSGISIKGECRLITSQIDQKQNQSGFLPKHSDAPLLCTGCGTRLSIKESMRFSYSDIQSATNDFSKDKLLGEGGYGHVYNGVLKDGQQIAAKKIMKLFLSGTKGMPSPLGLQRNCVFYMRNVVVVLLFIGTCDQAIDFSPMILFPW

SEQ ID NO: 141721 - protein, 293 aa, Glycine max
  Coding DNA Sequence Number=SeqID_24943
  Gene Ontology: Mol. function=cation transporter activity; Cellular component=integral to membrane; Biological process=potassium ion transport
  Homolog annotation: Hit_ID=Q83S20; Match level="QueryCoverage=80%, HitCoverage=42%, E-value=8e-99, Identity=77%"; Hit description =Putative transport protein ybjL
MVNQIQPAVVLPRKTPGERIKPALADGDVEAFVARPPQKRQRQNCQQNKVDSVEAQKRPDDDDQRPRQRQQDVGNGVGAGIAERRNAAARGIADDLHGRCAGARAHDGTKQQRAVHAQHVSAEQIANHHRQQTHQQAAQQHQRARTAETVLQPAAGAQTNPGHKHHQAKLFHHGQCALRDVAERRVVGAQEAEHDAGKQQPGGVAQAKAEVTELEGDHADHQADDKEGAERQQIGHLAVNSNEADAIGQAFHPARFAAHLQHITFVEHNAVVDRHLNLAANHPVQEAAVIGQF

SEQ ID NO: 141722 - protein, 59 aa, Glycine max
  Coding DNA Sequence Number=SeqID_24944
  Homolog annotation: Hit_ID=Q5N7J0; Match level="QueryCoverage=85%, HitCoverage=8%, E-value=1e-12, Identity=64%"; Hit description =Putative dual-specific kinase DSK1
AEPMIEKLALHELIDTRLGESYDTYELYLMAKDAYFCVQRKPEMRPSMGEMHMINTRVT

SEQ ID NO: 141723 - protein, 100 aa, Glycine max
  Coding DNA Sequence Number=SeqID_24945
MAKHTQSFPLLHLEAALSLFISLVVRAQNFQGPQGTKEKGTEWDVPLCFVRAANATEVFCYHLKSDGMSNYGQFCTVNPIYASCQKRYEDIPVLGQRPSE

SEQ ID NO: 141724 - protein, 59 aa, Glycine max
  Coding DNA Sequence Number=SeqID_24946
  Gene Ontology: Mol. function=ubiquinol-cytochrome-c reductase activity; Cellular component=mitochondrial envelope; Biological process=mitochondrial electron transport, ubiquinol to cytochrome c
  Homolog annotation: Hit_ID=Q1S6K7; Match level="QueryCoverage=66%, HitCoverage=55%, E-value=9e-12, Identity=82%"; Hit description =Ubiquinol-cytochrome C reductase, UQCRXQCR9 like
MRKKGIGKRMDPFSKEGASDDKGNIDRVATHNDLVEAFENASTSSSRNTFHRFEFDSPL

SEQ ID NO: 141725 - protein, 181 aa, Glycine max
  Coding DNA Sequence Number=SeqID_24947
MENAEEEINGHNLIDEDSDKDDASGDDGCGEENDVATMGMEEISGLISAFEEEINQHIIINCEMNMLKIESMKNEARCVCRAYFRVHIQQTIELWYVSVWKDDHSQELLEERYCAMMPSHRKLTDIETLQIDNFRRVGIRPPHILDLFASTLGDMARYITGRMIFIIKMIGKDGNKFLMQV

SEQ ID NO: 141726 - protein, 62 aa, Glycine max
  Coding DNA Sequence Number=SeqID_24948
MLLLLDAGNPCLGRVQWFGEMVEDGLDAGVPEFLTDEKALHRYTNRRYYSTHTNNLHREPGE

SEQ ID NO: 141727 - protein, 225 aa, Glycine max
  Coding DNA Sequence Number=SeqID_24949
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=4e-33, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLTFRGLHVLAIRGLHTLAFRGLHALAFRGLHALTFRGLHVLTFRGLHVLAFRGLHVLAFRGLHPLAFRGIHVRTFRGLHALAFSGLDALAFRGLHALPFRGLHVLTFKGLHILAFRGLHILVFRGLHALAIRGLHALAIRGLHTLTIRGPHVLAFIRLHALTFRGLHVLAFRGLHVLTFRGLYALPFRELHVLPLEGYTSSLSEGCTSVPLDNSRSPALNA

SEQ ID NO: 141728 - protein, 453 aa, Glycine max
  Coding DNA Sequence Number=SeqID_24950
  Gene Ontology: Mol. function=[protein-PII] uridylyltransferase activity; Biological process=nitrogen compound metabolic process
  Homolog annotation: Hit_ID=Q6ZI91; Match level="QueryCoverage=97%, HitCoverage=98%, E-value=1e-140, Identity=57%"; Hit description =Putative ACT domain-containing protein
  Pfam annotation: Domain name=ACT; Domain location=129-200; Score =35.6; E_value=1.7e-07; Accession=PF01842.15; Description=ACT domain
  Pfam annotation: Domain name=ACT; Domain location=263-334; Score =16.9; E_value=0.026; Accession=PF01842.15; Description=ACT domain
  Pfam annotation: Domain name=ACT; Domain location=349-415; Score =31.3; E_value=3.5e-06; Accession=PF01842.15; Description=ACT domain
  Pfam annotation: Domain name=ACT; Domain location=36-99; Score=22.8; E_value=0.0012; Accession=PF01842.15; Description=ACT domain
  Pfam module annotation: Pfam domain module=ACT::ACT::ACT::ACT; Domain location=129-200::263-334::349-415::36-99
MAKVCWPYFDPEYENFSNRMNPPRVSMDNASCHDCTLIKVDSVNKPGILLEVVQILTDLDFIITKAYISSDGGWFMDVFHVTDQQGKKITDSKTIDFIEKALGPKSQSTEGVKNWPSKRVGVHSVGDHTAIELIGRDRPGLLSEISAVLANLHFNVFAAEVWTHNRRIACVLYVNDATNQAVDEANRLSLMEEQLNNILRGCDGEKVARTSFSMGSTHMDRRLHQMLFADRDYESYAVAREVDSPPSLRPKITIERCEEKGYSVVSVKCKDRAKLMFDIVCTLTDMQYVVFHATVSSDGPYALQEYFIRHMDGCTLDTQGEKERVIQCIEAAIRRRVSELSTCIAAMGVSLELCAKDRVGLLSEVTRILRENGLTVCRAGVSTRGEQALNVFYVRDASGNPVDMKTMEALRKEIGKTMMVDVKRVPSNAKAPETRGWAKTSFFFGNLLERFLT

SEQ ID NO: 141729 - protein, 128 aa, Glycine max
  Coding DNA Sequence Number=SeqID_24951
MPHQSPKDNVALHPIPYDCSRYFTRDVAIKTITLKPGIEFDLNDVMLFYFKEMYENSRHAPTSDYEMEDNSNHICMVKKRLSHEMSKVTVRLSSLRYAQIHLCALSAMVALSATSRIQSLFKACLVQN

SEQ ID NO: 141730 - protein, 74 aa, Glycine max
  Coding DNA Sequence Number=SeqID_24952
MSLLTVVTKEEGRSKDVFVDVELVEVELPDSGALCATSREVPVVILVHSFTDQYELLLEVIVPNFPDLNRIAFR

SEQ ID NO: 141731 - protein, 61 aa, Glycine max
  Coding DNA Sequence Number=SeqID_24953
MTDSEVNKSKEYVSKVRAESLKVISTRLNFDRLVVRKAIIGWVGHFVTLNLMDILVANSYP

SEQ ID NO: 141732 - protein, 472 aa, Glycine max
  Coding DNA Sequence Number=SeqID_24954
  Gene Ontology: Mol. function=transporter activity; Cellular component= integral to membrane; Biological process=transport
  Homolog annotation: Hit_ID=Q652I7; Match level="QueryCoverage=76%, HitCoverage=70%, E-value=2e-90, Identity=47%"; Hit description=SEC14 cytosolic factor-like
  Pfam annotation: Domain name=CRAL_TRIO; Domain location=192-372; Score=36.6; E_value=1e-08; Accession=PF00650.10; Description =CRALTRIO domain
  Pfam annotation: Domain name=CRAL_TRIO_N; Domain location=106-178; Score=29.3; E_value=1.3e-05; Accession=PF03765.5; Description =CRALTRIO, N-terminus
  Pfam annotation: Domain name=EMP24_GP25L; Domain location=383-461; Score=13.2; E_value=0.045; Accession=PF01105.14; Description =emp24gp25Lp24 family
  Pfam module annotation: Pfam domain module=CRAL_TRIO::CRAL_TRIO _N::EMP24_GP25L; Domain location=192-372::106-178::383-461
MNNTNECCCNDENGKIVVGVPLVFNFFDKNTNNIEKSLKVQLEKKNQLEDHDCDQEDDDDDLEATSLGDAAPSPAEIKLKAEKSLLEFRCKVEDAILGNYLLGEQDHEKLAPQEIVVAREQIREITLWGVPLLPSKAHKGTDVVLRKFLKAKDFKVSEAFDMLQKTLVWRRENNVDRIIDEDLGAEFGNNNAGFLCSKDREGRPVCYHVCGIFKDRRIYKKTFGSDNKCDKYLRWRIQLIEKAVKKLCFREGGVNSVLQVFDLRNTPMQGTKELNSLSKRALILFQNYYPEIIHKNIIVYAPFWFYTSQVLFSRFMNQRNKKKFILARPQKVTQTLLKFIAPEHLPTEYGGVRRNNDEDFSPSDKVSEHKIKGSTVSKVEFPVKELGVTIMWDVTVVGWNVSYKEEFIPDDEGSYSVLLQNQSVDGSSTRNSFYISEPGKIVITVENGTYKKKKMFYRFTARTTVPMFFLLQ

SEQ ID NO: 141733 - protein, 183 aa, Glycine max
  Coding DNA Sequence Number=SeqID_24955
  Gene Ontology: Mol. function=nutrient reservoir activity; Cellular component=vacuole
  Homolog annotation: Hit_ID=P02858; Match level="QueryCoverage=67%, HitCoverage=28%, E-value=2e-25, Identity=44%"; Hit description =Glycinin G4 precursor [Contains: Glycinin A5 subunit; Glycinin A4 subunit; Glycinin B3 subunit]
MYIVLGVCDACVYECVLARYNNGGLKGAIGLAIPGCPETFEEPEDNLDGGEEAQGDILLIPPGVPFWIYNTGDEALVAVSDQNRRCRVGHRTHQATRMSLLHRQQHHQKQQEGEDEDGSVLSGFSKHFLAQSFGINEDIAEKLQSPDDGKNNNNKRKTKTKKMSQDPENIARPSRAHFYNPNA

SEQ ID NO: 141734 - protein, 745 aa, Glycine max
  Coding DNA Sequence Number=SeqID_24956
  Gene Ontology: Mol. function=ATPase activity; Cellular component =chromosome; Biological process=chromosome organization and biogenesis
  Homolog annotation: Hit_ID=Q6Q1P4; Match level="QueryCoverage=99%, HitCoverage=66%, E-value=0.0, Identity=47%"; Hit description =Structural maintenance of chromosomes 1 protein
  Pfam annotation: Domain name=SMC_hinge; Domain location=289-366; Score=57.3; E_value=5e-14; Accession=PF06470.4; Description=SMC proteins Flexible Hinge Domain
MKGEHFLWKLFNIHNDYAETIKDLEDEEKSREGVVKELEYFESEASKKKKEQAKYLKEIALREKRIAEKGNKLDKSQPELLKLKEEMTRITSKIKKGKKELDKKKVERKKHDADIALLQNDIQDLTAKMADLQEKGRDVDDELDLQGNDLEEYFRIKEEAGMKTAKLREEKELLDRKLNADSEAQKNLEENLQQLRNRESELNSQEEQMRARLEKILDNSAKNKVGLENLKKELRVMQDKHRDSKKKYENLKLKIGELENQLRELKADRYENERDVRLSQAVETLKRLFQGVHGRMTDLCRPTQKKYNLAVTVAMGKFMDAVVVDNEKTGKECIKCKFDPSLEKAILFAVGNTLVCDDLEEAKILSWSGERFKVVTVDGILLTKSGTMTGGTSGGMEARSKQWDDKKIEGLNKKKEQYESELEELGSIRDMHLKESEASGKISGLEKKIQYAEIEKLNDAVNKSNADVRKLEKRINEITDRIYRDFSKSVGVANIREYEENRLKAAQSIAEERLNLSSQLSKLKYQLEYEQNRDMNSRIQDLESSLGALEKDLKRVHDREAAAKLAAENATEEINQLKEEAKEWKSKSEDCEKEIQEWKKKASAATTNISKLNRLIHSKEAQIDQLNVQKQEILEKCELEQISLPIILDPMDTDSSVPGPSFDFDQLNRALKDRRHSDRDKIEVEFKQKIDALISEIERTAPNLKALDQYEALLEKERAVTEEFEAVRKEEREKTQRFNEVKQRR

SEQ ID NO: 141735 - protein, 37 aa, Glycine max
  Coding DNA Sequence Number=SeqID_24957
MTYTANMIGEVGRDFFVQLYESDIQLNIYKQMDRAVQ

SEQ ID NO: 141736 - protein, 115 aa, Glycine max
  Coding DNA Sequence Number=SeqID_24958
MCTGAESRGIVDGNNPVTNSKVGGVYHEINGMRSTEGGDGEGKRNSGCSGRFIQGLHQHLHQLLKALFPTLSLSEVRNYISSFLCVVFVLKVLFGSKSENKSNRLILSMLYGKKL

SEQ ID NO: 141737 - protein, 411 aa, Glycine max
  Coding DNA Sequence Number=SeqID_24959
  Gene Ontology: Mol. function=drug transporter activity; Cellular component=membrane; Biological process=multidrug transport
  Homolog annotation: Hit_ID=Q1SB90; Match level="QueryCoverage=93%, HitCoverage=71%, E-value=1e-114, Identity=51%"; Hit description =Multi antimicrobial extrusion protein MatE
  Pfam annotation: Domain name=MatE; Domain location=1-159; Score =114.6; E_value=2.8e-31; Accession=PF01554.9; Description=MatE
  Pfam annotation: Domain name=MatE; Domain location=221-384; Score =128.2; E_value=2.2e-35; Accession=PF01554.9; Description=MatE
  Pfam module annotation: Pfam domain module=MatE::MatE; Domain location=1-159::221-384
MMTNVLLYSRSAISMLYLGRQGKVELAGGSLAIGFANITANSFLKGLTMGMDPICCQAYGAKRWSVLSQTFCKTLCLLLLVAIPISLLWLNMAPLLHWLGQDPEVTKVAQVYMVFSIPELLAQVHLNPLRSFLRTQGLTTPLTIAASFAAILHLPINYFLATYLELGVKGIALATGLNSINMILGLVLYLVVSEKPLKPWEGVTILSSFHDWRPLLTLALPSCISVCLEWWCYEIMLFLCGLLSNPQTTIATMGVLIQTTGFLYVFPFSLSAALTTQIGHSLGAGQPSRAQNTAKIGLFIAFALGVSAFVFLLFVRNVWGKLFTNETQIVDMVTAILPILGLCEIGNWPQTAACGILSGTARPYVGARINLCAFYLIGLPVAIFAAFMHRRIGGTKVEELSNWLKQQMRKM

SEQ ID NO: 141738 - protein, 326 aa, Glycine max
  Coding DNA Sequence Number=SeqID_24960
MQFLGFLGIYKESYKLIFSWRKIFTQITFTLILPLSFIFLIHIQVSDLLFGKITHDAKDLTETLPGTPQHQKLLDTFSSDWATFFLFKLLYFISLLIFSLLSTSAIVYTVASFYTGKEVTFKKVLSVVPKVWKRLMVTFLCTVVAFFVYNVMAVLVLGIWALTIGVRNGGGAILSVLAILYLVGSVYLTVVWLLASVVTVLEDSYGYEAMMKSKELIKGKMGLSVMIVLKLNFLFFLTQFLFSMVVVNGWKVFGLGSVDRTVFGIVCFLLLSHLFLLMLVIQTVMYFVCKSYHREIVDKSALSYHLEVYECYEPLKAKDVQLDYHV

SEQ ID NO: 141739 - protein, 106 aa, Glycine max
  Coding DNA Sequence Number=SeqID_24961
MVVFRGVCVLNRDLGSGSVVTVLEEDTYGVRAMMKTNVEAHDFFRVDTVSVQENGGARVEFGCSISFASPTTIRILKNLPCWITLKCIMVSEPLKAKDVQMEECHV

SEQ ID NO: 141740 - protein, 458 aa, Glycine max
  Coding DNA Sequence Number=SeqID_24962
  Homolog annotation: Hit_ID=Q1SL66; Match level="QueryCoverage=94%, HitCoverage=68%, E-value=1e-101, Identity=45%"; Hit description =Aldehyde oxidase and xanthine dehydrogenase, a/b hammerhead; Membrane attack complex ...
  Homolog annotation: Hit description=component/perforin/complement C9
  Pfam annotation: Domain name=MACPF; Domain location=135-344; Score =51.1; E_value=3.7e-12; Accession=PF01823.10; Description=MACPerforin domain
MGEHVAAFHTATNAVQALNRGFDVNCDTRLLYCKRVAGSRVIHVDEEHVRDLWLFPMFQLTLFRTLRSMWGVAVLESVVIRRLTSMIVEKEKRLLRNLMVEYFNQKANISQSFPLGTFNSAFSFTGSKHIDATETKSLSSDGFYFPLAKVQLINSHLMLQENVERDIPVNWDPPSLASFIENFGTHVITSITIGGKDVIFSKQHHSSPLSTLEIKNYIQEIGSQRFSDISNHTSSLQTKSKDKASFTLIPTLYTDLILVVDSFSFNNQVIHPQPASGTYLSGKDVRVIFRRRGGDDLEQDHSMWLRTVCSSPDVIQMTFCPITDLIDEVPGKEHLAHIIGLYLEYKPPIEELRYFLEFQIAHVWAPLHDRTPGHRRKEPLCPSLQFSIMGQKLYITVGRLQVTGLRLFLEGSKHNRLIVHLQNLSSLPKILWPYWDTYVAIGAPENCYSRILNALKMD

SEQ ID NO: 141741 - protein, 119 aa, Glycine max
  Coding DNA Sequence Number=SeqID_24963
  Homolog annotation: Hit_ID=Q1SZM6; Match level="QueryCoverage=48%, HitCoverage=19%, E-value=5e-07, Identity=50%"; Hit description =Ribonuclease H
MTTNLKAKELWQVAGLWHHLERKLDNSKFYLELGCSYVMNMGNLLKQRHPIHQVILIKCKGVESSHTHAPLIQAIKALVAQAWIVSIQHTLREGNFYVDWLANKGSFEFIPLSVLETCP

SEQ ID NO: 141742 - protein, 65 aa, Glycine max
  Coding DNA Sequence Number=SeqID_24964
  Homolog annotation: Hit_ID=Q1T2K5; Match level="QueryCoverage=68%, HitCoverage=8%, E-value=8e-08, Identity=55%"; Hit description =Alpha/beta hydrolase fold
MANHLLVKDSSLVVMCMLSIFSCECENENEEHNRPSVDRIVILREKVVEKPQPLRNLGTKVHRSS

SEQ ID NO: 141743 - protein, 114 aa, Glycine max
  Coding DNA Sequence Number=SeqID_24965
MECCMAVRNLRDIVRRSMHTQYLACLCLQDVVKQHHHTINTTAYENLPYSCGVALPYHFTHDMDCNIISMMPDLHVAINGGASLEGQVDSTLGRKTCKASKIESRDALSNGFHY

SEQ ID NO: 141744 - protein, 498 aa, Glycine max
  Coding DNA Sequence Number=SeqID_24966
  Gene Ontology: Mol. function=RNA-directed DNA polymerase activity; Cellular component=intracellular; Biological process=RNA-dependent DNA replication
DVQGLIDNRELIIMRKDKEVCVITPEFQRLEISYNSGESTTTPLVISLPGPMPYASLKAVPYKYSATMLEGGQEVPLPSLTPAISVDNIASDSKVLRNGRVIPTLFAKKMNDPAVKQVTVNGPGTRKEVGQSNGTSKNSDHDEILKLIQKSEYKVVDQLLQTPSKISILSLLLNSEAHREALMKVLDQAFVERDVTVNQLDSIVGNITACNNLSFSDEELPEEGRNHNLALHISVNCKSDALSNVLVDTGSSLNVMAKSTLDQLSYQGPPMRRSGVVVKAFDGSRKSVIGEVDLPITIGPFVFQITFQVMDIQAAYSCLLGRPWIHEAGAVTSTLHQKLKFVRNGRLITVSGEEALLVSHLSAFSFIGADETEGTSFQGLTVEGKKPEKNEVSFATWKSAQKVVQEGTGVGWGKVVQLLESKNREGLGFASSAGSATNSVGSSSITSTFCSAGFINNSPEANAVLEDVPEEIVLAFVTPGKIVRNWDAVDIPSVVHAS

SEQ ID NO: 141745 - protein, 110 aa, Glycine max
  Coding DNA Sequence Number=SeqID_24967
MAGFVGGRQFQSRLPSSRIGVRPYYSKKVLRQLGHVQRIPRQPPPRPMYQLCDQAWVNWFSTLMSFHQRRDNHHVVLYIYSPSQYIDILCTRWRLLLLDGVRSYAKVVGP

SEQ ID NO: 141746 - protein, 95 aa, Glycine max
  Coding DNA Sequence Number=SeqID_24968
MAHLCILREITVLVAGIAVLDSRLRHLPPVLDNLNACLQYTRGVAILAYLYDNLSYVSQYAKKKCGGYIGYSWQSWTFEHLPSVGYLEIMMLMTY

SEQ ID NO: 141747 - protein, 88 aa, Glycine max
  Coding DNA Sequence Number=SeqID_24969
MPRKAMPNGREKLENFQTKVNGGNNFNCNGGGNDNGSGIGGGDSDTNDGGDNDDSNVGDDGSSDSNIDDDGDVNGRGDSSVGDCSGDN

SEQ ID NO: 141748 - protein, 65 aa, Glycine max
  Coding DNA Sequence Number=SeqID_24970
MTHRELKIVKLNSNRIWELIKELRRNEKARTFHLGAEAASSLISVKQRTVAVAAAAAAAASCRAF

SEQ ID NO: 141749 - protein, 460 aa, Glycine max
  Coding DNA Sequence Number=SeqID_24971
  Gene Ontology: Cellular component=nucleus; Biological process =regulation of transcription, DNA-dependent
  Homolog annotation: Hit_ID=Q6H972; Match level="QueryCoverage=96%, HitCoverage=41%, E-value=1e-49, Identity=51%"; Hit description=SEU3A protein
MDEFGIGDALSKMFVASARQLAKALEVPLVNDLGYTKRYVRCLQISEVVNSMKDLIDYSRETGTGPMVIVGMTIMIKKRDVKGNQEQIIRVHNVSPKDLFFGAYLLGYYNLRVDADIWEERLLLLVVLLSTQILFLEPESLAKFPRRTSGSSGPRGQAQQHEEQLQQQQQQQMVAHNSNGDQNSVQAAAMQIASSNGMVSVNNTVNPASTLTSTSTIVGLLHQNSMNSRQPNSMNNASSPYGGSSVQIPSPGSSSTVPQAQPNSSPFQSPTPSSSNNPPQTSHPALTSANHMSTTNSPANISMQQQQPSISGEPDPSDAQSSVQKIIHEMMMSSQINGNGGMVGVGSLGNDVKNVNGILPVSANTGLNGGNGLVGNGTMNSNSGVGVGNYGTMGLGQSAMPNGIRSAMVNNSIMNGRGGMASLARDQAMNHQQDMSNQLLSGLGAVGGFSNLQFDWKPSP

SEQ ID NO: 141750 - protein, 189 aa, Glycine max
  Coding DNA Sequence Number=SeqID_24972
MGLSRRPARFKKPDFMPTEPNGEEKLEVLRVVGAGVFINEQNPEGESSEVNTIVGYENNNVRDEAGNNDNGINLLATVATRLIRKKVEKKLRKLPLPLDLRWRNQKRREEKPTESETSNPEIACPNDSKARKRKAKQSISRQDEKMEMLTVAAASVSINEQNPEGESSEADDDNGMQLLAAVATGDKTP

SEQ ID NO: 141751 - protein, 74 aa, Glycine max
  Coding DNA Sequence Number=SeqID_24973
MEFSLEVKAKSKFGRGQSKYHTWIEKVYPREMRGVVVAVVLGRWWYWVEARLQRDGYLCPFRNEKARCINKKPK

SEQ ID NO: 141752 - protein, 196 aa, Glycine max
  Coding DNA Sequence Number=SeqID_24974
MSLFLNFLELGLASLLAKPVLSSLVVALSAPCRSKSRFVSQDAWDRYANDVIGQKILPERNVKLYITEFDEFRREIERRNWHKELTNFSLGSIDVAIVKEFYANLYGPKDKSHKQVRVRGHLIKFFIDTLNTFLKTPVVIKEGESLLTYSRFANLRSVPQELTTCLCIPRRGFELNADGLPLKILRKNLTTLPRPG

SEQ ID NO: 141753 - protein, 192 aa, Glycine max
  Coding DNA Sequence Number=SeqID_24975
  Gene Ontology: Mol. function=nucleic acid binding
  Homolog annotation: Hit_ID=Q1S853; Match level="QueryCoverage=66%, HitCoverage=38%, E-value=8e-09, Identity=29%"; Hit description=RNA -binding region RNP-1
  Pfam annotation: Domain name=RRM_1; Domain location=70-135; Score =17.2; E_value=0.0037; Accession=PF00076.12; Description=RNA recognition motif. (a.k.a. RRM, R
MGGGEKMSRERNIGCGRDRLRGKTIERARVTFGEAFRWEYAGNKERVKQNYIVSNWRDHEDITSFYFTCFADDITEKELWHHFKKWGDIREIFIPNRRNYTGRRYRFVRFKGVRDIPYTAKQLDRIVIGGMKLYVNLPKYGRELPRKVDAGIKTQFTGTTSDPQQSCIFNILGSHQHWPEDVGRAPIKPSHV

SEQ ID NO: 141754 - protein, 754 aa, Glycine max
  Coding DNA Sequence Number=SeqID_24976
MAVLTRNIRPPGQRLAYNNHSQRHDTSISSVHLDIGPEDNNWLKDAWVGHLKNPAMFDRLDDELLWEIGMNISPKYIGEDLVLLLGLTNAGVEQVMNGRQHGGASMFYSMEKWSPSLCIGFRLTWVQCWGIPLQAWDMKYIQKILVPMGEMVDMDDDVEDKRRLDQERVLVKTPWRPTIKHTIDVHIGDECFKVFSGSSEKIDSDESYLGNLILRLTNTLEKEGDMHDLLASATQAEPCRTTNSPSAGSNDHGTNPLSSGHRERNYPLGNALSPRTLCSIRQVTLDEQTRTLGATYAERENPSHENGKQEKGESSGAAEARMALGIATSIETGMVSLHTQHLEDMAQYGTAFNTNNDSTTESVERKCIRYPVERFGICQRDSRNNNIKEFNGWIDDLEVVEAPWLGRKFTWFRPNRASRSKLDRFLLSPEWLGKWPASTKITLPRNFSDHCQILLRSISVDWGPKPFRILDCWNNSLKGVMIGGICIVEPYKVKEEAIWDCGSEKSPGPDGMNFKFIKQFWKLIKPNVLRFLDEFHVNGALPRGCNASFIALIPKVDDSQFLNDYRPISLIGCMYKIVSKLLAKRMKKVMAYIVDETQYAFIEGRHLLHCALIANEVIEEAKKSSKSFLVFKVDYEKALGLLFSPKGGLRQGDLLSPFLFNVVAEALNGLMRIADASSIGACRPRIFFINGFLCFLEDEWQRNGERERERRRHFKEKMSLEEAHHHRRPWIRDWRKKEMNEGRGREEHEILCSK

SEQ ID NO: 141755 - protein, 121 aa, Glycine max
  Coding DNA Sequence Number=SeqID_24977
MDSSIGVKSIMKFDSRYSVEIVFDGSKLGIEPYVVLAFFKLRVQQCLAFHLELLNEAEVAAVAEEKETHSFEIDPSHALYMMNPNKFRALKHRAYGLADIQINELNARESLRIGWLGQGGV

SEQ ID NO: 141756 - protein, 91 aa, Glycine max
  Coding DNA Sequence Number=SeqID_24978
MSFCACDGLTPLEGDHSDGVARTSEFPFGAVNGYYALARTSLEPPVLENLEFLLQRNFQKLCARVKEGVSARRKRERPVIEVEATKYAAQQ

SEQ ID NO: 141757 - protein, 242 aa, Glycine max
  Coding DNA Sequence Number=SeqID_24979
  Gene Ontology: Mol. function=RNA-directed DNA polymerase activity; Biological process=RNA-dependent DNA replication
MANVRAIKVMLRSFKLVSGLKINFSKSSFWAIGMTEQWMNNAAPKIVVDRLVRLQRWFLWGGHSDQKKITWVNWGFSLSTKGKRWLRHQGFDEIQLCTAWKMVLEFVSSPRRIMATSFGIQIWRVEEFGCDKKDIQRVPLVLFWEDGWKDDGVLLIEKYPRLYHISQQQHQYIHQLRATSGAGLIIQLQRQDTWNWEGDSSRGYTVGNAYMLLDRDSTNENQVGVFTALWKLKIPSKASFFA

SEQ ID NO: 141758 - protein, 637 aa, Glycine max
  Coding DNA Sequence Number=SeqID_24980
  Gene Ontology: Mol. function=nucleic acid binding; Cellular component= nucleus; Biological process=DNA replication
  Homolog annotation: Hit_ID=Q6WG36; Match level="QueryCoverage=99%, HitCoverage=100%, E-value=0.0, Identity=75%"; Hit description=RPA 70kDa subunit
  Pfam annotation: Domain name=Rep-A_N; Domain location=4-105; Score =126.9; E_value=5.6e-35; Accession=PF04057.3; Description=Replication factor-A protein 1, N-terminal domain
  Pfam annotation: Domain name=Rep_fac-A_C; Domain location=476-627; Score=288.2; E_value=1.5e-83; Accession=PF08646.1; Description =Replication factor-A C terminal domain
  Pfam annotation: Domain name=tRNA_anti; Domain location=204-287; Score=36.5; E_value=9.3e-08; Accession=PF01336.15; Description=OB -fold nucleic acid binding domain
  Pfam module annotation: Pfam domain module=Rep-A_N::Rep_fac-A_C::tRNA_ anti; Domain location=4-105::476-627::204-287
MSLNLTANAIPAIIGGDVNAKPLVQVLDVALVSNSNNSQQQQQRYRLLLSDAVFSHHAMLATQLNDRVRTGRVQKGSVVQLLDYICTPLKNRKIIVILNMETIMDEFEIIGNPKPYMDSDIPTVRASDSASADSTVENLPRSYNSNNSSAGQNASHNNTQNFRPTIQPPYQPPPLYKGRGPVVKNEAPARIIPIAALNPYQGRWAIKARVTAKGDLRRYNNARGDGKVFSFDLLDSDGGEIRVTCFNAVVDRFYNVIEVGKVYMISKGSLKPAQKNFNHLKNEWEILLESSSMVELCPDEDGSIPRQQFSFRPISDIENVDNNSILDVIGVVTSVNPSVPILRKNGMETQRRILSLKDSSGSSVELTLWGEFCNREGQQLQDMVDAGFFPILAVKTGKVNDFSGKSIGSISTTQLFINPDFPEAHSLREWFELVGKDSASLSISKDIIPGALKNEVRKTVSQIKDEGLGRSDKPDWITVRAAILFIKTDTFCYTACPLMIGDRQCNKKVTRLGNTRWQCDRCNQEFEECDYRYLLQVQILDGTGLAWVTAFQEAGEEIMDYSAKDLYFLKHEEQDDEKFGEIIKSRLFNQFMFRLKIKEELYGDEQKVKITVVKADKVNYSSESRYMLDTISKFCRQ

SEQ ID NO: 141759 - protein, 46 aa, Glycine max
  Coding DNA Sequence Number=SeqID_24981
  Homolog annotation: Hit_ID=Q1RVB5; Match level="QueryCoverage=93%, HitCoverage=3%, E-value=7e-12, Identity=81%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MALGSKIHTKGGMPKVVKGNLVVMKAGKITANRYMLLGDTLQEADA

SEQ ID NO: 141760 - protein, 69 aa, Glycine max
  Coding DNA Sequence Number=SeqID_24982
MAEPVQIANGNGIFLHVLIQGKVIGSRAGQFGETQSSSRGGDESNFGPQREMRVGAGRTWGVRSGGWGD

SEQ ID NO: 141761 - protein, 332 aa, Glycine max
  Coding DNA Sequence Number=SeqID_24983
  Gene Ontology: Mol. function=transferase activity; Cellular component= intracellular; Biological process=DNA integration
  Homolog annotation: Hit_ID=Q1RVB5; Match level="QueryCoverage=99%, HitCoverage=32%, E-value=1e-100, Identity=50%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
  Pfam annotation: Domain name=rve; Domain location=1-111; Score=10.3; E_value=0.00083; Accession=PF00665.16; Description=Integrase core domain
  Pfam module annotation: Pfam domain module=RVT_2::rve; Domain location=214-332::1-111
MGGTKYFVPFIDDYSNRLWVYSIKMNSDLFLVFKEFKAHVELEIGKRIKCLRTNNGREYVDEQMNKTLLDRTRAMLGITGVAKSFLAEAINLINRSPSTTIGLKTSMETWKGKPIDYSLHVFGCLVYMMGYCLWDPIVHKVVVSMDVVFGENELESEQKNVSTTKDTTIVQIKKKLGEDNSSEAEHEHEEQEPNKANGGQAVSGLGASLLVTKMHEEMEALHTNKTCELVELLEGWLLEANWVYKIKRDGNDQVERYRAGLVVKGYAHKEGVDFNEIFSSVVRLTTIRVVLVICVAFDLHLEQLDVKIVFLHGELEEEIYMLQLEGFKEQGK

SEQ ID NO: 141762 - protein, 57 aa, Glycine max
  Coding DNA Sequence Number=SeqID_24984
MGRISGTIQIYVLFLTTLRMVLVKLTPWEWSPSWWSGGVHSKEFHTKISGKSELFVG

SEQ ID NO: 141763 - protein, 96 aa, Glycine max
  Coding DNA Sequence Number=SeqID_24985
MPPQNVFLNYTLPPLLLNDVQRGHALHGSNVAFMWWSYNIITIFGETITGMKCKGIFPAGAVGKSMNAKVVDDVLLGIFSTLSMSDHEVLRRSVTA

SEQ ID NO: 141764 - protein, 373 aa, Glycine max
  Coding DNA Sequence Number=SeqID_24986
  Gene Ontology: Mol. function=catalytic activity; Cellular component =cytoplasm; Biological process=spermidine biosynthetic process
  Homolog annotation: Hit_ID=Q70AG5; Match level="QueryCoverage=84%, HitCoverage=89%, E-value=3e-93, Identity=51%"; Hit description =Putative spermine synthase
  Pfam annotation: Domain name=Spermine_synth; Domain location=67-311; Score=176.8; E_value=5.6e-50; Accession=PF01564.7; Description =Sperminespermidine synthase
MLSFLISALILLFFPTFLNDNEEYFELDLVEDYMTLNAHVQEDEDEGGEQHNDQVAEDINVKQHKVNWFEQEIYSEVKWCLALDSVEFRGASEFQNLTVLSTKRFGKALVIDGHLQNTELDEYIYHENLVHPALLTHNNPKTVFIMGGGGGSAAREVLKHRHIEKVIICDIDRNIAGLIREHMTANHAAFKDERLQIVYNDAKYELEMSEEKFDVILGDLPELDESNSSGSSHLYTKSFYENVVIPKLKGNGLLVTQAGPAGIFTHKAMFSPLYNTLKQVFSYVVAYTAVMPSYGDSNGWIMASNEPINLDGEQLNNRIGERIKDELRYLDGPVIIASTVLNKTLKNSLMEETRILTDENVNVGFVRKRGVCN

SEQ ID NO: 141765 - protein, 156 aa, Glycine max
  Coding DNA Sequence Number=SeqID_24987
MLSFLISALIILFFPTFLNVNKEDYELDLLLNLYAPIPLLEDADEDEDEDEGGEQHNDQVAEVTNVEQHKDNWFEQEIYYKVIWCLALDSVASEFQNLTILSTKRFGKPPHLSPSSSAPPHSCPSPSASTAVTWRNSCSQSLVGPTVVHGVPLTLR

SEQ ID NO: 141766 - protein, 338 aa, Glycine max
  Coding DNA Sequence Number=SeqID_24988
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q5NA51; Match level="QueryCoverage=55%, HitCoverage=44%, E-value=4e-76, Identity=65%"; Hit description=Leaf senescence related protein-like
  Subcellular localization annotation: CTP_CleavageSite=34; ConfidenceScore=5.08e-01
MEIWNSWWVLQIMQFLGFFSFWISFAKFRTLFSRAFGYGHKVVKGDCSTWIFVSFNGLVTVGSFIFFLLVLSWAYLYAFPSSQSLIQSHEIPINSSDSLVQSYEIPSNSSDSLVQSYDVILKPNVSMDTCNVFEGSWVRDDSYPLYDASHCPFVERGFNCLANGRKDRDYTKWRWKPKNCEIPRFDARGILEQLRGKRVVFVGDSLSRTQWESMICLLMTGVEDKKSIYEIKGNKITKQIRFLGVRFSTFDVRIDFYRSVFLVRPGSVPRHAPQRVKTTLRLDKIDDISHEWIDSDVLIFNSGHWWTRTKLFDVFSKEKQRIRFGKGHGPVNITKERE

SEQ ID NO: 141767 - protein, 1082 aa, Glycine max
  Coding DNA Sequence Number=SeqID_24989
  Gene Ontology: Mol. function=transcriptional elongation regulator activity; Cellular component=intracellular; Biological process =regulation of transcription, DNA-dependent
  Homolog annotation: Hit_ID=UPI0000196BB2; Match level="QueryCoverage =85%, HitCoverage=89%, E-value=0.0, Identity=70%"; Hit description =structural constituent of ribosome / transcription factor/ transcriptional elongation regulator
  Pfam annotation: Domain name=KOW; Domain location=1030-1063; Score =18.7; E_value=0.021; Accession=PF00467.19; Description=KOW motif
  Pfam annotation: Domain name=KOW; Domain location=323-356; Score =25.6; E_value=0.00018; Accession=PF00467.19; Description=KOW motif
  Pfam annotation: Domain name=KOW; Domain location=474-505; Score =29.8; E_value=9.8e-06; Accession=PF00467.19; Description=KOW motif
  Pfam annotation: Domain name=KOW; Domain location=526-558; Score =30.5; E_value=5.8e-06; Accession=PF00467.19; Description=KOW motif
  Pfam annotation: Domain name=KOW; Domain location=647-678; Score =19.0; E_value=0.017; Accession=PF00467.19; Description=KOW motif
  Pfam annotation: Domain name=KOW; Domain location=750-783; Score =27.7; E_value=4.2e-05; Accession=PF00467.19; Description=KOW motif
  Pfam annotation: Domain name=Supt5; Domain location=204-243; Score =50.1; E_value=7.2e-12; Accession=PF03439.4; Description=Supt5 repeat
  Pfam annotation: Domain name=Supt5; Domain location=276-322; Score =59.3; E_value=1.3e-14; Accession=PF03439.4; Description=Supt5 repeat
  Pfam module annotation: Pfam domain module=KOW::KOW::KOW::KOW::KOW::KO W::Supt5::Supt5; Domain location=1030-1063::323-356::474-505::526 -558::647-678::750-783::204-243::276-322
MSRRGMDDDDEEEYEEQDEQVADFDEEEDEQVADFVEEEEEGSHRGRGGGGGRKRGRSGFIDDDAEEVDEDEEEEDDDDEDFDGRGGGGGRRRQYKKVSASNFFDEEAVVDSDEEEEEEEGEDGPLLMLDKDGKTIAVAIVGVVVIIAVEVATTVMVEGRDFIVEGGSDLPEEDDGRRMRSSRMLPHHQEDHEDLEAMARSIQERYGRRLTDYDEETTDVEQQALLPSVRDPKLWMVKCAIGRERETAVCLMQKYIDKGSELQIRSAIALDHLKNYIYVEADKEAHVREACKGLRNIFGQKITLVPIREMTDVLSVESKAIDLARDTWVRLKIGTYKGDLAKVVDVDNVRQRVTVKLIPRIDLQALANKLEGREVVKKKAFVPPPRFMNVDEARELHIRVEHRRDAYGERFDAIGGMMFKDGFLYKTVSIKSISAQNIKPTFDELEKFRKPGESGDGDVASLSTLFANRKKGHFMKGDAVIVVKGDLKNLKGKVEKVDEDNVHIRPEMEDLPKTIAVNEKELCKYFEPGNHVKVVSGAQEGATGMVVKVEQHVLILISDTTKEHIRVFADDVVESSEVTTGVTRIGDYELRDLVLLDNNSFGVIIRVESEAFQGIPDRPEVVLVKLRENKCKIDKKISVQDRFKNTVSSKDVVRIIDGPCKGKQGPVEHIYRGILFIFDRHHLEHAGFICAKAQSCVVVGGSRSSGDRNGDAYSRFASLRSPSRIPPSPRRFSRGGPMDWRHRGGRGHDSLAGTTVKVRQGPYKGYRGRVIDVKGTTVRVELESQMKVVTVDRNHISDNVAVTPYRDTSRYGMGSETPMHPSRTPLHPYMTPMRDPGATPIHDGMRTPMRDPAWNPYTPMSPPRDNWEDGNPGSWAASPQYQPGSPPSRPYEAPTPGAGWASTPGGNYSEAGTPRDSSAYANAPSPYLPSTPGGQPMTPSSASYLPGTPGGQPMTPGTGGMDMMSPVLGGENEGPWFIPDILVNVHRAGEESVGVIREVLPDGSYRVALGSSGNGEAITALPNEMEAVVPRKSDKIKIMGGALRGATGKLIGVDGTDGIVKVDDTLDVKILDLVILAKLAQP

SEQ ID NO: 141768 - protein, 308 aa, Glycine max
  Coding DNA Sequence Number=SeqID_24990
  Gene Ontology: Mol. function=diacylglycerol kinase activity; Cellular component=nucleus; Biological process=protein kinase C activation
  Homolog annotation: Hit_ID=Q8LJJ8; Match level="QueryCoverage=84%, HitCoverage=70%, E-value=4e-57, Identity=34%"; Hit description =Pentatricopeptide (PPR) repeat-containing protein-like
  Pfam annotation: Domain name=PPR; Domain location=137-171; Score =48.5; E_value=2.2e-11; Accession=PF01535.11; Description=PPR repeat
  Pfam annotation: Domain name=PPR; Domain location=172-206; Score =11.0; E_value=0.37; Accession=PF01535.11; Description=PPR repeat
  Pfam annotation: Domain name=PPR; Domain location=71-105; Score=13.4; E_value=0.19; Accession=PF01535.11; Description=PPR repeat
  Pfam module annotation: Pfam domain module=PPR::PPR::PPR; Domain location=137-171::172-206::71-105
MADGYARIGEMEAAREVFEMIPERNCFVWSSTINGYFKKGNVTEAEANGFGEKALQAFEGMGAEGFEPDEFTAVSVLSACAQLGNLDVGKQIHHMIEHKGIVVNPFVLSGLVDMYAKCGDLVNAMLVFEGFPEKNIFCWNAMISGFAINGKCKEALEFFGRMEESNIRPDGITFLTMLSACAHGGRLKEAYDLIVRMAMKPNDTVFGGMLGACRIHSDMKMAEQVMKLICEDPVTGASSHNVLLSNIYAASEKWEKAERMKSIDGGSQRIPGLTVSPTPRPMHGCSLHYGGKEVWFEATCKVLKASEG

SEQ ID NO: 141769 - protein, 263 aa, Glycine max
  Coding DNA Sequence Number=SeqID_24991
  Gene Ontology: Mol. function=kinase activity; Cellular component =integral to membrane
  Homolog annotation: Hit_ID=Q6ESQ4; Match level="QueryCoverage=62%, HitCoverage=34%, E-value=4e-37, Identity=45%"; Hit description =Putative MAP kinase activating protein
  Pfam annotation: Domain name=DUF300; Domain location=14-216; Score =31.1; E_value=1e-14; Accession=PF03619.7; Description=Domain of unknown function
MWPLKIGVESTGTITLAVFSSSIFVLVALVLSTYLIFEHLAAYNQPEEQKFLIGLILMVPVYALESFLSLLDSSAAFNCEVIRDCYEAFALYCFERYLIACLGGEDKTIQFMESMSLTESSTPLLKEAYAYGVVEHPFPVNCFLRDWYLGPDFYQSVKIGIVQYIVDDMKFTVSHVVEPVERGIAKINKTFHQISENVKRHEDERRKSTKVKDDSYLVALRSWRSEFSDVHDRLGEGSVSDSGLPSRKRQHLQSKASASRMRR

SEQ ID NO: 141770 - protein, 528 aa, Glycine max
  Coding DNA Sequence Number=SeqID_24992
  Gene Ontology: Mol. function=protein binding; Cellular component =Golgi-associated vesicle; Biological process=vesicle docking during exocytosis
  Homolog annotation: Hit_ID=O49048; Match level="QueryCoverage=99%, HitCoverage=92%, E-value=0.0, Identity=82%"; Hit description =Vacuolar protein sorting-associated protein 45 homolog
  Pfam annotation: Domain name=Sec1; Domain location=1-514; Score =411.4; E_value=1.3e-120; Accession=PF00995.13; Description=Sec1 family
SELLQKEVFLVELVDSISKSNESMSHLKAVYFLRPTSENIQLLRRQLASPRFGEYHLFFSNILKDTQIHLLADSDEQEVVQQVQEFYADFVAIDPYHFTLHVPSHYIYMLPAMVDPSTVQRFSDRVVDGLAALFLALKRRPVIRYQRTSDIAKRIAQEAAKLMYQEESGLFDFRRMEVSPLLLVIDRRDDPVTPLLNQWTYQAMVHELIGIQDNKVDLKSIGKFPKDQEEVVLSSEQDSFFKANMYENFGDIGMNIKRMVDEFQQVSKSNQNIQTIEDMAKFVDNYPEYRKMHGNVTKHVTLVTEMSKIVEERKLMSVSQTEQELACNGGQGAAFEAVTNLLNNESISDVDRLRLVMLYALRYEKDSPVQLMQLFNKLASRSAKYKPGLVQFLLKQAGVDKRTGDLFGNRDLMNIARNMARGLKGVENVYTQHQPLLFQIMESIVKGRLRDVDYPFIGNHFQQGRPQDVIIFIVGGTTYEESRSVALQNASNTGIRFILGGSSVLNSKRFLRDLEEAQRVARSSTTVI

SEQ ID NO: 141771 - protein, 104 aa, Glycine max
  Coding DNA Sequence Number=SeqID_24993
MRLPGKESLPMKSPITINEILDVSISFLNDHLEETLGLTKIEEIHSKCINLAQCGAKKKSLAHGILVDIVRSKDLSAHFFCFPSIPDQELSFLLLLPFLLSPIL

SEQ ID NO: 141772 - protein, 205 aa, Glycine max
  Coding DNA Sequence Number=SeqID_24994
MYHLRGTLDDEWKFDFSVSNARQMVYTNQADMTERLHAGSLAFECRIMHYLIVCILLPRSSNLAQVSEEDLRIMWVFLTGHQIDWAHLPFVKVKRSFSIGANVVSSFGYHKERDGSWVKKDALVQADEDHSPSPHSQRDDSSSLMHNILDRLDGLHTFVGERFDLLDSRIVAMDAQFAGMDTHITKLEEDVSFVCQCFDIPPPSS

SEQ ID NO: 141773 - protein, 84 aa, Glycine max
  Coding DNA Sequence Number=SeqID_24995
MLEEKFVTIIDVSSNEEKVHYKAWERSNRLSLMLMRMTVADSIKTTLPKIESAKKFMGLVEEYSQTADKSVVGTLMSTLNHHEV

SEQ ID NO: 141774 - protein, 143 aa, Glycine max
  Coding DNA Sequence Number=SeqID_24996
MTQELVAHGDTLRLSAPRHSVTPSVIDEQRPIWSSAPFPEMSAFSDGDFSSLTKAAGPMIRGDTLRLSAPFCHPEAAGPMTSRDQVWSFCTLVSSRGGGPDDTRRYLTVIHTLLSSRGGGPDDKQRPSLVILHPCIIQRRRAR

SEQ ID NO: 141775 - protein, 265 aa, Glycine max
  Coding DNA Sequence Number=SeqID_24997
  Homolog annotation: Hit_ID=Q5VN12; Match level="QueryCoverage=23%, HitCoverage=5%, E-value=3e-09, Identity=48%"; Hit description =Putative Importin 9
VHTWSVDANQLIADEEDATYSCRISSVLLLEEVVNSFDGEGILAITDGAKQWFTESQIRKVAVTCETKLTTIRRFNNLMTLLITSETYLTISATSTDQHNGYGQHNAMTVAAQRVEGRSKNFRDASNVYSFYFISFLEDTGEKDLSFEFKKWVGVREVFIVKNRNWSVRRYSFVRFKGADDVRKLERQLDNLILGRLKLHANLPKHGREWKLMEKTNKISTKGWQQNYGEEVVTEICASNENDIPLVNLVKYTNGKEDTVQQRLG

SEQ ID NO: 141776 - protein, 108 aa, Glycine max
  Coding DNA Sequence Number=SeqID_24998
MAGARRSIMHFFIPLFQLIPSYFSLRINWHFLERFASSFPVDYIVIFINKNQCYYIGAYITTDVEISYFNVAAYFKNDLESASYYISAYFTTDVETNAILQRSLMDRC

SEQ ID NO: 141777 - protein, 157 aa, Glycine max
  Coding DNA Sequence Number=SeqID_24999
MEVKNIKPKYLGGDIVLLMDLIDTRAEEILVDIDDDVEDLQQLDRARVLIKTSWHLIINHSVTTPINGDDYVINIIEETCYNPCMCKCNSGSLIGSSKEIFSNENEVGLALSLEVASSHDESPTITMLADADGGEQNKSGGEQQLSAGLYIMSAPMT

SEQ ID NO: 141778 - protein, 273 aa, Glycine max
  Coding DNA Sequence Number=SeqID_25000
  Gene Ontology: Mol. function=RNA-directed DNA polymerase activity; Cellular component=nucleus; Biological process=RNA-dependent DNA replication
  Homolog annotation: Hit_ID=Q1SQN7; Match level="QueryCoverage=98%, HitCoverage=53%, E-value=3e-41, Identity=34%"; Hit description=RNA -directed DNA polymerase
MLYNVVIANEVVKEAKRCNKNCLVFKVDYEKAYDLVCWDFLLYMMSQMGFCTKWIRWIQGCLKSASIFILVNGSPRAEFTPQRGLRQGDPLVSFSFNIVAKGLTGLMREAQEKNLFEECWSVPFPYLGIPIGAHPRHSEIWDPIVKKCERKLFKPKKVVDRLVRLQRWFLWGGHSDQKKIARVNWGSICLSKEKGGLSIEDLVKFNYALLGKGCWNLFHHQGELWPQVLESNYGAWRNLDVTRRNNRESLWWEDLSFICNSTEKGSWFKSETK

SEQ ID NO: 141779 - protein, 54 aa, Glycine max
  Coding DNA Sequence Number=SeqID_25001
MRKQPNFSWERKRKGQIRILPLSSFLKMKGLCFTRDESFISSNTTFVVKGRGVI

SEQ ID NO: 141780 - protein, 99 aa, Glycine max
  Coding DNA Sequence Number=SeqID_25002
  Gene Ontology: Mol. function=RNA-directed DNA polymerase activity; Biological process=RNA-dependent DNA replication
  Homolog annotation: Hit_ID=Q2HTR6; Match level="QueryCoverage=61%, HitCoverage=14%, E-value=1e-09, Identity=49%"; Hit description=RNA -directed DNA polymerase
MDCNFLDHCPILLRSTIVDRGLKLFQVLDCWFEDKSFRKETELERPRLAGVRFQSIGQQDNVLLVACFEEKEMKVAVWDCGSVKSSGSDGLNFKFIKEF

SEQ ID NO: 141781 - protein, 105 aa, Glycine max
  Coding DNA Sequence Number=SeqID_25003
MDAEKHEELEPEKRNANRGRILAFQSKTEKFRSSPSLSRSLLFFSSSTIVAQQSFNLWCQFPLQIAKGGHFRSREARLYVWDFEISGLGGLLSPLIFVGMGFWEI

SEQ ID NO: 141782 - protein, 212 aa, Glycine max
  Coding DNA Sequence Number=SeqID_25004
  Gene Ontology: Mol. function=catalytic activity; Biological process =trehalose biosynthetic process
  Homolog annotation: Hit_ID=Q9LX18; Match level="QueryCoverage=34%, HitCoverage=19%, E-value=8e-25, Identity=68%"; Hit description =Trehalose-6-phosphate phosphatase-like protein
  Pfam annotation: Domain name=Trehalose_PPase; Domain location=28-198; Score=-50.3; E_value=0.0012; Accession=PF02358.7; Description =Trehalose-phosphatase
MKQLHHPSALDMFDKIIDASKGKQFVMFLDYDGTLSPIVDDPDRAFMCDSMRKTMRKLARCFPTAIVTGRCKGKMHDLFWNLEATGMIGIVDYTNYDDMKYAIRKLDDSEFRNAFSRAFIRVILEVLVVIQGGAILEASAVVHISHEAAAIAATEVIAIVTGAEVGLRNQNTLDIQYLFQVNEYPCVIVTRVFLLESMFLSSFPIGSIMWLI

SEQ ID NO: 141783 - protein, 118 aa, Glycine max
  Coding DNA Sequence Number=SeqID_25005
METAENQGGISTVTRENIKIQGDSVHEKVRHKCNIIRSANGVNQSQHIGNNVHMNNQALSGKERDIQNVCDLEVQRAQALGKEVQGTFDSAGGARVQRKRFRGRGSGGARVQQNAVNA

SEQ ID NO: 141784 - protein, 1192 aa, Glycine max
  Coding DNA Sequence Number=SeqID_25006
  Gene Ontology: Mol. function=hydrolase activity; Biological process =protein amino acid phosphorylation
  Homolog annotation: Hit_ID=Q8GY37; Match level="QueryCoverage=87%, HitCoverage=79%, E-value=6e-89, Identity=28%"; Hit description =Putative deaminase
  Pfam annotation: Domain name=dCMP_cyt_deam_1; Domain location=1112 -1189; Score=26.6; E_value=1.6e-06; Accession=PF00383.13; Description= Cytidine and deoxycytidylate deaminas
MSNAYVSSTIYAVRCKEPFSLSFNGYSNFCYERFDRTASYCLSCCGCCDFCSVSTYRVPIKPCLINGLRQSALLQLSASRRLILGGGDHYLPRLPAYGVLRGCQELNSSVNERTVYNNSRWRIKGRCICATSPKGREFSHSFGSDDAEAVLSLLSEEADKDAIGSKCKNASSSKRVEVEKKRKNLSRERHFSSSEKVETEKNGNLKRHESSTIDLRREYGKANKEREAFAKSENHRKRRDASSCSSYYSLSSGDFGSELEVQDEIGLEESSLEYEKDEANHLEEQVKEEFNRQGDDSKKLQAVSNKRRIAFGVDIDWNLRNKSEKKLTEGTLQNTESTREQQDMHSREFRTLESGHKKSSISQKRVNIEDDKSSCVVNLDKKTNKAYIQTESGCDEVETILLSQKEFSGREGKLEISETILNETTDKHKKFVSSTSTTGKQTLTSKKVFSGREGNLAISETLLQETNDKHKKIVGSTSTTGKNVIDRSSQKYTGNLKIEDTERTSNTRMKDMEVKKDSVLSSVQGVEEQQYQKGEKIIKVKDKERRKKSEQFSEVSEAHKINVEDTSSIKSRTRLMNMEEKSNISSDARVTWLQTDKRTTQSFQHRKGSELVSTLSEGYASDEKQVSSSQKAYEKVRLIPKSKSTSVVRTRESSSQTDERIANFELARDDQRSSNLSISDETTSREESSSQGSLNLISGAGKHIILASGEKRRPATMLIPSSSEIGGDSAHVELTAGIASPEIFLGTSESGSSALYDNSGRRSALHPDAIDSADRLEKSSRQFVDEFAERIRHEVTTSEAQEMEVTGTKLNLEVGGDQIYSSRQQGTQNGAQSKEHDSSRSSGFPGTKGPSDEMWDVTEPSAEQVLVAKETEISKETGKAVVTRTGRSLWGMIADIVRLRWGSRAGSSTSAERNSPNKSDSDTWFSGQEHEETTKTNVIKETSVPPQAMTFDKLKPGKHYTQSEGEVSDNTKLKDKGKNVEVGLSSPNTLESGSMLVGVSYTSGEENASWTEDKKNLKVNTSGTQNMELPISVPARGPSIVGEIISIGGSDMSGAESVVPIKESVAPGQSELSGSERKDGELKQRKFQRNRQVLRDRFDDWEEAYQRELEQRRVDEMFMKEALLEAKKAADTWEVPVGAVLVQHGKIIARGCNLVEELRDSTAHAEMICIREASNLLRSWRLSASTSGTEST

SEQ ID NO: 141785 - protein, 110 aa, Glycine max
  Coding DNA Sequence Number=SeqID_25007
MNIDYAIRKEKPPDITETNTPNAIDLYEKWEHDNVKDSLKAIDEQFTTFDKSLTNTLIMQFSSMRLTGIQGVHYHIMRIREILAQMKALEITMSDSFLGMKNLRMPVGSD

SEQ ID NO: 141786 - protein, 75 aa, Glycine max
  Coding DNA Sequence Number=SeqID_25008
RSIQSEHSPHLSDGKTGESERATTSPDEESERSAAPPPGGIRLASAKRNTPGLSARKNPEEYELYRFAKCTTSSL

SEQ ID NO: 141787 - protein, 35 aa, Glycine max
  Coding DNA Sequence Number=SeqID_25009
MKLKNSVLSKYGCRTVSLCMVCLGSHYKDVCNSEL

SEQ ID NO: 141788 - protein, 303 aa, Glycine max
  Coding DNA Sequence Number=SeqID_25010
  Gene Ontology: Mol. function=transcription factor activity; Cellular component=membrane; Biological process=regulation of transcription, DNA-dependent
  Homolog annotation: Hit_ID=Q8UKC6; Match level="QueryCoverage=96%, HitCoverage=89%, E-value=5e-68, Identity=46%"; Hit description =Transcriptional regulator, LysR family
  Pfam annotation: Domain name=HTH_1; Domain location=8-67; Score=70.0; E_value=7.6e-18; Accession=PF00126.17; Description=Bacterial regulatory helix-turn-helix protein, lysR family
  Pfam annotation: Domain name=LysR_substrate; Domain location=92-301; Score=110.0; E_value=6.7e-30; Accession=PF03466.10; Description=LysR substrate binding domain
  Pfam module annotation: Pfam domain module=HTH_1::LysR_substrate; Domain location=8-67::92-301
MDFLGIDLNLLVAFDALMNERNVTRAAIQVGVSQPAMSAALSRLRTLFGDPLFMRSAEGLLPTARARDLSGPIAGALRQLEATLVAKPAFAAEKAQINFKLGVSEYPAFVLLPSLMQALQDVAPGVSLNVQAFTNRDHAVDLLDAGAIDVAIGVMPTHSDSRIISRPVLRDEFVTIVASNHPAARRGMDMESYLALPHILVSPEGELYGLVDQVLAQQGKKRRLGLTVQQMFTVPSIVAQTHMTATVMKRVALHAQASRQLVLFPPPLSLPEMVFNLIWHRRSDAHPAQQWFREFIELQAARL

SEQ ID NO: 141789 - protein, 148 aa, Glycine max
  Coding DNA Sequence Number=SeqID_25011
  Gene Ontology: Mol. function=transcriptional repressor activity; Biological process=regulation of nitrogen utilization
MDNARRQVDAIRQGKMFGPIDPNKKLPHTAACDSAAAAAALLIDRSWSGQQDVPVLGPEEHSYAELAAIISDVIGSEVRYVHQSYEAYKQAAIERGLTPAFAQGYVDMLRAKEEGMDNVAPRSTAIIGQTSFRQWVENELKPAVVRGN

SEQ ID NO: 141790 - protein, 147 aa, Glycine max
  Coding DNA Sequence Number=SeqID_25012
  Gene Ontology: Biological process=regulation of transcription, DNA -dependent
  Homolog annotation: Hit_ID=UPI000038DF4C; Match level="QueryCoverage =87%, HitCoverage=44%, E-value=2e-12, Identity=32%"; Hit description =COG5485: Predicted ester cyclase
  Pfam annotation: Domain name=SnoaL; Domain location=15-140; Score =104.4; E_value=3.4e-28; Accession=PF07366.3; Description=SnoaL-like polyketide cyclase
MNPAAEYVQRLKIERQAVETLYQAFSDNNPDLVDSVLAPSWEDIPLAPGQAPGPEGIKPIIRMLAQAFPDVQIVVHDMIQEPGRIAARAEISGTHLGEIFGIAPTGKKVSFRLHEFHALEDGRLITTWHMEDWFGLFLQLGQFPPQA

SEQ ID NO: 141791 - protein, 194 aa, Glycine max
  Coding DNA Sequence Number=SeqID_25013
MQEKTSSKKCFKFLGKGHITSQCLTKKTMIMRGQDICSCQDEATSSPSSSESEEAKREESSEEIYPQEEGQPLMVKEECKEVSVSSKRLAMKESHFAIKTKIKETSPLRQPPRFFLCKKTLVSTTTSLGLEVIPQVKKLLDEGLVRKSLNPCTLLVSKIGVEGRSPEYQESQNLRSNHFQEGGNDAILPPKGIG

SEQ ID NO: 141792 - protein, 46 aa, Glycine max
  Coding DNA Sequence Number=SeqID_25014
MVVKYIEAVKRRLHASKQWSPDEIRIVYIPIHNHNHLFIPDIYLPK

SEQ ID NO: 141793 - protein, 38 aa, Glycine max
  Coding DNA Sequence Number=SeqID_25015
MGDLPGSPRVAPLFRCDHTSNNAPDPIRTPQLSVLGRE

SEQ ID NO: 141794 - protein, 115 aa, Glycine max
  Coding DNA Sequence Number=SeqID_25016
MSQSDIQVKSYCRLNLFGDSIFSFEHLDILRDSIGHPSKKLLPFECGSNAFHGYFDDAKESRVKQIPKIQESRFKIQESSFKNQDSRIIKIKIQESREDSIKINYTILVIDYQSF

SEQ ID NO: 141795 - protein, 70 aa, Glycine max
  Coding DNA Sequence Number=SeqID_25017
MSHPIRALCPDVLQHKGDQLGSQCFARMLQPCGIGIGLKEHSNRVTPKVYTPKSPSGPLPSDSGPTQKTF

SEQ ID NO: 141796 - protein, 86 aa, Glycine max
  Coding DNA Sequence Number=SeqID_25018
MTDLVSAEDDVNLRVSTGLPAAIDEGCRMTIICLCVPSDTTVSEWQKGCGMTIICLRMSSGPPLLDDKRVQIDHNLSLRAIGHDCV

SEQ ID NO: 141797 - protein, 196 aa, Glycine max
  Coding DNA Sequence Number=SeqID_25019
  Gene Ontology: Mol. function=chitin binding; Cellular component =extracellular region; Biological process=chitin metabolic process
  Homolog annotation: Hit_ID=UPI000069F178; Match level="QueryCoverage =56%, HitCoverage=37%, E-value=6e-11, Identity=38%"; Hit description =UPI000069F178 related cluster
TTRPRLGEGLHVLPIKRGCTALTSRGLHVLRLEKGCTPSPWGCTPLTLGTSYPQRQRTTRPHHQRAATPLPPEDYMSSPLRGLHALAMRGQLVLTLRGLHVLALRGLHLPSPLRGLHVLALRGLHVLTIRGLHALTSRGLHVLALRGLHALTVGTSYPQRQRTTRPRLERTTSPYHQRAARPHLQRTTCPRLEKGY

SEQ ID NO: 141798 - protein, 97 aa, Glycine max
  Coding DNA Sequence Number=SeqID_25020
MKIKKRTKERKEGFPIKDRKEVKRGKEATLDQRKEENRKSPNPDCHSESFLTGNIPPHMNKEEKTETTSFLSKNADLEKILLISPMFPLRVCLKARS

SEQ ID NO: 141799 - protein, 158 aa, Glycine max
  Coding DNA Sequence Number=SeqID_25021
MKGITGAPYRARCDALTITNVSWLSYTEHRGVRAFELISSFQGQLRWGPKMVTARLERVVSADYMEWFFRISHPFMIPTQAGDQPRDAPAVDPEEYIQPPSPPVPVAFDPPPHADDYDCYEAIAQRLERVLNLRMVTADTELYDIRRGASADGSVRAR

SEQ ID NO: 141800 - protein, 96 aa, Glycine max
  Coding DNA Sequence Number=SeqID_25022
MVIGSRTQGAPAFSGRYSAEVIHAILPGKARTTFNKWVPVPETDTGVPPHKGGRSDQARATVYQKHRSPQSREPTTEAPVNGGRNYNGPKVAKFLV

SEQ ID NO: 141801 - protein, 140 aa, Glycine max
  Coding DNA Sequence Number=SeqID_25023
  Gene Ontology: Cellular component=chloroplast
  Homolog annotation: Hit_ID=UPI0000E45228; Match level="QueryCoverage =34%, HitCoverage=22%, E-value=7e-11, Identity=75%"; Hit description =conserved hypothetical protein
MSISPSLSPRQCPDRYAFRAGRNLPDKEFRYLRTVIVTAAVHRGFGRRLPCHQVTNFLDLPALGRRQPPYMVLRLCGDLCFWYPFVEGRSSFSWEYGMDYFSAVAPGTRTLARGIFSTPYYPEKAGAPCVLEPITIFRLT

SEQ ID NO: 141802 - protein, 176 aa, Glycine max
  Coding DNA Sequence Number=SeqID_25024
  Gene Ontology: Mol. function=DNA binding
  Homolog annotation: Hit_ID=Q1SDS1; Match level="QueryCoverage=70%, HitCoverage=22%, E-value=2e-11, Identity=35%"; Hit description=IMP dehydrogenase/GMP reductase
MGWLEYQGNVWKQRRGPWQATIDAFHAFYDRKESPIVAILADLYDTFGRRCEKNSARIVCCTPALYVWLVSHLFRQEVRHICLLEGHHSCTKKKEANWDKLLASKEGVSVNWFPRWKEGRTGILISCGEFPNVPLMGTSGCINYNPVCHTLISSGDHLLGGMQPLLDHFEVLDTHR

SEQ ID NO: 141803 - protein, 126 aa, Glycine max
  Coding DNA Sequence Number=SeqID_25025
MSGFTRNSPQISASPYQLDFTLYASGSYNAQWNAPGLLHDKHTLRSSRILRKVEVVFVIGSAVDRLCGRFRDGLCGYLGGGMGFSLFLTLFICPSFLSRPSRMIKFASFRTHIDPFTGEDQIRKAL

SEQ ID NO: 141804 - protein, 201 aa, Glycine max
  Coding DNA Sequence Number=SeqID_25026
  Gene Ontology: Mol. function=hydrolase activity, hydrolyzing O -glycosyl compounds; Cellular component=viral capsid; Biological process=carbohydrate metabolic process
  Homolog annotation: Hit_ID=Q9RMI4; Match level="QueryCoverage=76%, HitCoverage=40%, E-value=1e-32, Identity=47%"; Hit description=CbpD precursor
LPVGTTLALRVFNAGGNDVERVETTLASGQTSASQWPLALARKVNGSAQHARVGVLANGVITPSASATDNRVYLKDGNRFQLDTRVPDPGTPSPGGDFDHVYPAGIGSYVPGQTVVKSSDGKLYACRPFPEGAWCNVNAEAYRPGVGAAWRDAWIAECRPAAGTPRLLAADVLLAADLRVAQAGGLQQLGAGIDHVRVAAQ

SEQ ID NO: 141805 - protein, 401 aa, Glycine max
  Coding DNA Sequence Number=SeqID_25027
  Gene Ontology: Mol. function=DNA binding
  Homolog annotation: Hit_ID=Q1SWX1; Match level="QueryCoverage=48%, HitCoverage=41%, E-value=1e-18, Identity=30%"; Hit description=IMP dehydrogenase/GMP reductase
QGEGYGESRGVGPIIDVLALLIFGVVLFPNVDGLVDLAAIDAFLAYHHSKESPMVAILADLFDTFDEDVKRVVHGSSVVYPLFIVDWDQHLAGIGGRTVNWFPRWKEGKEGVLFSCGSYPNIPLIGMRGCINYNPALSIRQLGYPMRGAPTKESLSPFLVRDFGVQNFKVIQSVHKAWESPLRKDKELRGIRNGIIGGYHEWLKVRTRRLTLARQDEEVRALKAELGKARLAKEKFKLVATDVQKECAGLQEENAATAKALEQETKRARKEEHGHDKFRGALWGSNSEFKLRREERDRSRAHSMVLKEELAVCSRSKRNLSQRLCETETKLAIITKYQEELSLATAHEHRVADEYAQVYAEKEARGRVIDSSQELPRLLAKAKAMADTYSAPEEIHGLLDY

SEQ ID NO: 141806 - protein, 307 aa, Glycine max
  Coding DNA Sequence Number=SeqID_25028
MSAFIRQWLRTNPQEIEARLCIPRKGFVLNAEGQPWKLLRKDLKTLAKTWSVFPYSNLAPTSHTSDLDMDRGRLVYGLVTNRDMNIRALILGQIYSIAQSNSSRLRFPALMTALCRARGVTSHSLTYESLSLAINLAYIKKNCWNVDDLTVNFRGVRKARGLQVVAPPGSILSVEQFIEKVSWPGTLPSVVRKGEGPSAQVPQQVQDASSEATTHEPFIFEAGRAHVRQEAATPERSPQISPDPPSPVVDQSSLQQPADSPTLVLDLPADPCTPLLEIPEDPTTPVLGLTTTPPTTPVLHLTDEEGT

SEQ ID NO: 141807 - protein, 121 aa, Glycine max
  Coding DNA Sequence Number=SeqID_25029
MVTRNTSTLINVINEDSDQSSDNTTEVGSVSEKNINPINSKHWKTPSKLYYQRPTAPDLLLEERGENNFKSFSANNIYEWNIDAKSEYNIMNTLQHMTVVATTYQTSHECSEETIIDILVA

SEQ ID NO: 141808 - protein, 147 aa, Glycine max
  Coding DNA Sequence Number=SeqID_25030
  Gene Ontology: Mol. function=transition metal ion binding; Biological process=proteolysis
MVHLIVHLVREIKCCGPVYLWWMYSVKPYMKILKVYTKNLHCPEASIVERYIAEEAIEFCLEYIEKDKPFGLPQSWHDERVGGKGSRGLYVITPTVEDLQQAHLKLADGPKRNIITWQVYDINKYSFYTKAQDDQMYNAKQRGHPKG

SEQ ID NO: 141809 - protein, 224 aa, Glycine max
  Coding DNA Sequence Number=SeqID_25031
  Homolog annotation: Hit_ID=Q1SKD7; Match level="QueryCoverage=74%, HitCoverage=43%, E-value=5e-17, Identity=29%"; Hit description =Ankyrin
MTPRKLSVKRSRKDAAAEGTSAAPEFDSHRFKSAEHQQRFEAIKGWSFHRERCVQLRDDEYTDFHEEIARRRWTSLVTPMAKFDPDVVLEFYTNAWPTEEGVRDMRSWVRGQWIPFDVNALSQFLGDPLVLEEGQECEYSQRRNRADGFDEEVIAQLLCIPGQDFSQTAAGRRVWIMRTSMTTLTQTWMMLLLSNILPSDHNSDLPLPKCQLVYATHQAPSRPG

SEQ ID NO: 141810 - protein, 109 aa, Glycine max
  Coding DNA Sequence Number=SeqID_25032
MVGSLHPRPIATFHFLSPHSAVVAFCEEILKHGTAWEALRGDLAAQKAEMTLEEERAATEYKYIDFGSTITYGSYSVHSLRDGSDYQQKIKGRESKVGVPVKSICIVNR

SEQ ID NO: 141811 - protein, 76 aa, Glycine max
  Coding DNA Sequence Number=SeqID_25033
  Subcellular localization annotation: CTP_CleavageSite=36; ConfidenceScore=5.32e-01
MGFVTFQKKMCKIFKRRGKGSLLGYFSAPGPTRKLRAEVTSSPGRAKLAWVSKVTSKGSKQLAWASYCATSTPHFL

SEQ ID NO: 141812 - protein, 78 aa, Glycine max
  Coding DNA Sequence Number=SeqID_25034
MWTHGRKVFGQAPPLCERYMTLEVVRALCMKWFEIDDDRGIIFSEGYIALNSISALCISALSLRLIDALSQGYTILVD

SEQ ID NO: 141813 - protein, 59 aa, Glycine max
  Coding DNA Sequence Number=SeqID_25035
LWWWCMWVTLASLGLDLGQRWCSAYRLGAGTTGPKFGQSGGDLRCWILMEVEAHDSVGR

SEQ ID NO: 141814 - protein, 222 aa, Glycine max
  Coding DNA Sequence Number=SeqID_25036
  Gene Ontology: Mol. function=nucleotide binding; Cellular component =membrane; Biological process=small GTPase mediated signal transduction
  Homolog annotation: Hit_ID=Q9LH50; Match level="QueryCoverage=93%, HitCoverage=94%, E-value=1e-101, Identity=89%"; Hit description=GTP -binding protein-like
  Pfam annotation: Domain name=Arf; Domain location=2-174; Score=-64.6; E_value=8.7e-05; Accession=PF00025.11; Description=ADP-ribosylation factor family
  Pfam annotation: Domain name=MMR_HSR1; Domain location=16-129; Score=- 1.9; E_value=0.0015; Accession=PF01926.13; Description=GTPase of unknown function
  Pfam annotation: Domain name=Miro; Domain location=17-129; Score =90.2; E_value=6.2e-24; Accession=PF08477.3; Description=Miro-like protein
  Pfam annotation: Domain name=Ras; Domain location=17-176; Score =309.4; E_value=6.5e-90; Accession=PF00071.12; Description=Ras family
  Pfam module annotation: Pfam domain module=Arf::MMR_HSR1::Miro::Ras; Domain location=2-174::16-129::17-129::17-176
MSNLYGEYNQKIDYVFKVVLIGDSAVGKTQLLARFAKNQFSVDSKATIGVEFQTKTLIIDNKTVKAQIWDTAGQERAVTSAYYRGAVGAMLVYDMTKRQSFDNMAKWLEELRGHADKNIVVMLIGNKCDLGTLRAVPTEDAEEFAQRENLFFMETSALESTNVETAFLTILTEIYRLISKKTLTANDDADPSGISGLLKGTKIIVPSQEINAGEKKGKGGCC

SEQ ID NO: 141815 - protein, 62 aa, Glycine max
  Coding DNA Sequence Number=SeqID_25037
MTMIVTNHDHNGSGTSGSGNVDGGTSDDNDIGDDDDNDGVGGVNINNGDGHESADGAGRNSE

SEQ ID NO: 141816 - protein, 230 aa, Glycine max
  Coding DNA Sequence Number=SeqID_25038
MFGHAGDYSAVRASDNIEETTVIGSTTTSVKGVAEEPTRQRQTWCAYACFVRKVNGFRDLNALRDDLMELKPTLFAGVPRSKVTFDGLVTCTMFIQTRFHAKDEGDNKSKQVFEEIYKATCTWTCGSVVVIQDETLKLACKAMCKMLISIESGHELVTMHNEARKRIVNILEKNISERRSGIATHHEDFLQQLLDNKLNEDGVPADKEIKDNILPMIIADILRWLFEKSS

SEQ ID NO: 141817 - protein, 300 aa, Glycine max
  Coding DNA Sequence Number=SeqID_25039
  Gene Ontology: Mol. function=oxidoreductase activity
  Homolog annotation: Hit_ID=Q9C938; Match level="QueryCoverage=73%, HitCoverage=72%, E-value=3e-50, Identity=46%"; Hit description =Putative oxidoreductase; 33116-34434
  Pfam annotation: Domain name=2OG-FeII_Oxy; Domain location=156-248; Score=35.6; E_value=1.8e-07; Accession=PF03171.10; Description=2OG -Fe(II) oxygenase superfamily
MGSEGKPMLPVLDFTIEDLKPGTNSWLSTCTSVRQAFEENGYFVAVYDKASIELQNGVFGSMKELFDLPTETKRRNIFEGMPLKGYVGQHPKIPLHESMGIDPGTTLEGIQSFAEKMWPHGNDQFWYAEVLNRMVVRMIFESYGLLEHYDTFIGSTNYLLRLLAHKALEQNEPQLGFVAHTDKSFTTILHQNHVNALMVETTNGNWIDVDFSSPTSFVVMAGDALMGTSFVAQVEGKSTWVVILRTREGTSLVDQFKWRVHPLGCSKRTREGTSLVDLWLVKDFTRLKKSQEPLVAWGLD

SEQ ID NO: 141818 - protein, 53 aa, Glycine max
  Coding DNA Sequence Number=SeqID_25040
  Homolog annotation: Hit_ID=Q1T5H1; Match level="QueryCoverage=70%, HitCoverage=7%, E-value=3e-10, Identity=84%"; Hit description=Multi antimicrobial extrusion protein MatE
MVRRIVDAKGNSSDILCYLSNIIGCKTRFNSHGCISNMPTGNVGVTTELLVSL

SEQ ID NO: 141819 - protein, 766 aa, Glycine max
  Coding DNA Sequence Number=SeqID_25041
  Gene Ontology: Mol. function=monooxygenase activity; Cellular component=integral to membrane; Biological process=electron transport
  Homolog annotation: Hit_ID=Q1SJ90; Match level="QueryCoverage=64%, HitCoverage=97%, E-value=1e-166, Identity=59%"; Hit description=E -class P450, group I
  Pfam annotation: Domain name=Pkinase; Domain location=536-764; Score =67.1; E_value=5.5e-17; Accession=PF00069.15; Description=Protein kinase domain
  Pfam annotation: Domain name=Pkinase_Tyr; Domain location=562-765; Score=-54.9; E_value=4.2e-09; Accession=PF07714.7; Description =Protein tyrosine kinase
  Pfam annotation: Domain name=p450; Domain location=37-494; Score =353.4; E_value=3.8e-103; Accession=PF00067.12; Description =Cytochrome P450
  Pfam module annotation: Pfam domain module=Pkinase::Pkinase _Tyr::p450; Domain location=536-764::562-765::37-494
MAETDIQDYLQLFFLWLLSIIAVRAILTKLRHKPRRPPGPRSLPIIGHLHLISALPHQSFHALSTRYGPAVQVFLGSVPAVVVSCPELAKEFLKTHEPSFSNRFVSAAVHHLSYGSKGFLFAPYGSYWRFLKKICMSELLGGRTLDQFRHLREQETLRAKGEAHEAVDVSGELMTLTNSVISRMVLSRTCCESDGDVEHVRKMVADTAELAGKFNVADFVWLCKGLDLHGIKKRLVGILERFDGMMERVIREHEEERERRKERGEGEEIRDLLDILLEIHQDESREIKLSRENVKAFILDIYMAGTDTSAITMEWALAELINNHHVMEKARQEIDSVTGNQRLIQESDLPNLPYLQAIVKETLRIHPTAPLLGRESSESCNVCGYDIPAKSLVFVNLWSMGRDPKIWEDPLEFRPERFMNNNEEKQIDVRGQNFQLLPFGTGRRLCPGASLALQTVPTNVAAMIQCFEFRVDGTVSMEEKPAMTLPRAHPLICVPSGDDEFTTKSGYLFKLSATKADSLGEYRILKIAAVYSRKPLLVAHRLGNASVSATSILSWTAPSQCFRYRAFDELEGIEVAWNQVKVANLLHNFDDLERLYSEVHLLKTLKHKNIIKFYNSWVDTKNENINFITEIFTSGTLRQYRKKHKHVDLRAVKKWSRQILEGFLYLHSHNPLVIHRDLKCDNIFVNGNQGEVKIGDLGLEAILQQANSAHSVIGTPEFMAPELYEEEYNELVDIYAFGMCLLELVTVEYPYIECTNAAQIYKKVTY

SEQ ID NO: 141820 - protein, 203 aa, Glycine max
  Coding DNA Sequence Number=SeqID_25042
  Gene Ontology: Mol. function=protein binding; Cellular component =integral to membrane; Biological process=defense response to fungus
  Homolog annotation: Hit_ID=Q1SWI6; Match level="QueryCoverage=82%, HitCoverage=73%, E-value=6e-40, Identity=51%"; Hit description =Leucine-rich repeat, plant specific
  Pfam annotation: Domain name=LRRNT_2; Domain location=27-67; Score =50.1; E_value=7.2e-12; Accession=PF08263.3; Description=Leucine rich repeat N-terminal domain
  Pfam annotation: Domain name=LRR_1; Domain location=118-143; Score =7.1; E_value=13; Accession=PF00560.23; Description=Leucine Rich Repeat
  Pfam annotation: Domain name=LRR_1; Domain location=145-167; Score =16.5; E_value=0.094; Accession=PF00560.23; Description=Leucine Rich Repeat
  Pfam annotation: Domain name=LRR_1; Domain location=169-194; Score =11.6; E_value=1.9; Accession=PF00560.23; Description=Leucine Rich Repeat
  Pfam module annotation: Pfam domain module=LRRNT_2::LRR_1::LRR_1::LRR_ 1; Domain location=27-67::118-143::145-167::169-194
MNSSSIYILVFVQLWLLSLPCRESVCIPSERETLMKFKNNLNDPSNRLWSWNHNNTNCCHWYGVLCHNLTFHVLQLHLHTSDSVFYHYYDSYSHFDEEAYRRWSFGGEISPCLADLKHLNYLDLSANEFLGEGMSIPSFLGTMTSLTHLNLSHTGFNGKIPPQIGNLSKLRYLDLSGNYLLGGGMSIPSFLGTMTSLTHLDLS

SEQ ID NO: 141821 - protein, 32 aa, Glycine max
  Coding DNA Sequence Number=SeqID_25043
MGTHLHVIGDPMNGVQRSCSVSHSYDEVYYKL

SEQ ID NO: 141822 - protein, 96 aa, Glycine max
  Coding DNA Sequence Number=SeqID_25044
MAKFDPEIVLEFYANAWPTEEGVRDMRSWVRGQWIPFDADAIGQLLGYPLVLEEGQECEYGQRRNREASVNHAHQHDHPDPDMDDVAPQQHPAQRP

SEQ ID NO: 141823 - protein, 162 aa, Glycine max
  Coding DNA Sequence Number=SeqID_25045
  Gene Ontology: Mol. function=RNA-directed DNA polymerase activity; Biological process=RNA-dependent DNA replication
MCIKFVNYNVMINGDGVGRPITPKSGLRQGDLLSPSSFILCMEAFSSLLRKAKGCGDIHVVKVCRGTPLLLHLAMNKEVETLQGILSTFEKSPRLATNFQKDLKVIQLKELTSSTVQSSLVLRFLRVGKGHHHLSPTDMSFIHICASTVPPLPYHSRSELPR

SEQ ID NO: 141824 - protein, 312 aa, Glycine max
  Coding DNA Sequence Number=SeqID_25046
  Gene Ontology: Mol. function=chitin binding; Cellular component =extracellular region; Biological process=chitin metabolic process
  Homolog annotation: Hit_ID=UPI00006A17C9; Match level="QueryCoverage =69%, HitCoverage=100%, E-value=5e-27, Identity=30%"; Hit description= UPI00006A17C9 related cluster
AVTFIGPHALTFRELQVHAFRGLDVFALRSKGAHLKRPTRPHLQRTTRPHLGYSYPYLQRTTRPHLHRATRPRHQRATRPHLGYSYPHLQRTTRVHALAFRGLHVLAFRGLHALAFMGLHILAFVGIPVLAFRGPHVLPFIGLHALTFSGLCVLTFRGLHPLTFRGLHPLAFVRLHALTFRGLHIFGFIWLHALCFLGLHALAFRGLHVLPFRGLHVLGFGGLHVLTFRGQHVLGFRELHVLTIRGLHDLIFRGLHVLVLRGSHAFAFVGLHTITLRGLHVLEFIGLHALSFRGLLVLQLRRLHLLTFRGLQ

SEQ ID NO: 141825 - protein, 672 aa, Glycine max
  Coding DNA Sequence Number=SeqID_25047
  Gene Ontology: Mol. function=RNA-directed DNA polymerase activity; Cellular component=intracellular; Biological process=RNA-dependent DNA replication
  Pfam annotation: Domain name=RnaseH; Domain location=524-644; Score =35.6; E_value=2.8e-08; Accession=PF00075.14; Description=RNase H
  Pfam module annotation: Pfam domain module=RVT_1::RnaseH; Domain location=122-309::524-644
FSFIGADETKGTSFQGLTVENKEPEKNEVSFATWKSAHKVVQEGTGVGLGKVVQLLESKNREGLGFASFARSSKNSVGSSSISSTFCSAGFINDLPEANVVLEAVPKEIVPAFVTPGRLVRNWDAVNIPSVVHASKLKRRRMKKFQMKLVDKASPKDDFPLPHIDVLVDNTAKSKVFSFMDGFSGYNQIKMAVEDREKTSFITPWGTFCYRVMPFGLINAEVYVDDMIVKSGNEEEHVEYLLKMFQRLRKYQLRLNPNKCTFGVRFGKLLGFIVSQKGIEVDPDKVRAIREMPVPQTEKHVRGFLGRLNYISRFISHMTTTCRPVFKLLRKDQGVVWTEDCQKAFDRIKNYLLEPPILIPPVEGKPLIMYLIVLEDSMGYVLGQQDETGRKEHAIYYLSKKFTDCESRYSLLEKTCCALAWAAKRLRHYMINHTTWLYPRWTRSRRIARWQMLLSEYDIEYRTQKAIKGSVLADHLAHQPIEDYLPIKFDFPDEEIMHLKMKDCDEPLLGEDPDPESKWGLIFDGAVNVFGNGIGAVIITPEGNHLPFAARLQFDCTNNVAEYEACILGIEKAIDLKIKNLDIYGDSALVINQIKGEWETRHPGLIPYKDYARHLLTFFNKVELHHIPRDENQMADALATLSSMYEVNHRNNLPTIRIQRLERPAHVFAVEE

SEQ ID NO: 141826 - protein, 72 aa, Glycine max
  Coding DNA Sequence Number=SeqID_25048
MAQPPPRERTLREMAAPDFTYESLCIQYPDEDVPYALKTRLVHLLPKVHGLAEGVAKDWLYYLAPRVHHELG

SEQ ID NO: 141827 - protein, 91 aa, Glycine max
  Coding DNA Sequence Number=SeqID_25049
MLFTWFNETGWDKEGTKENTHLLEEIEKILCYVCDEVCICLLHSYGLLHSYHHRVVAMKCLKNVTSGDAEFWAEVIIIARMHHLNMELNLS

SEQ ID NO: 141828 - protein, 81 aa, Glycine max
  Coding DNA Sequence Number=SeqID_25050
MTLSGQNSKTSTSLPLGTLKRWQRHSKRHDFGYVAVVGAAGPLRLQVLHDGKQNIRVVAGRSSRRDEVVKAIAGALGFWRV

SEQ ID NO: 141829 - protein, 122 aa, Glycine max
  Coding DNA Sequence Number=SeqID_25051
  Homolog annotation: Hit_ID=Q1SJ90; Match level="QueryCoverage=55%, HitCoverage=13%, E-value=9e-07, Identity=38%"; Hit description=E -class P450, group I
MRHASPSLSHAFLLYKIHRFVLMMKVKGEACEVVNVGDELLKLINNIVMRMAIGESCFNNDDEAHKLTERIKESSKEIGKNTIRKYTFNIGYLWHSTLVLKPMLKVPMLNVLQLTSVLQNQC

SEQ ID NO: 141830 - protein, 163 aa, Glycine max
  Coding DNA Sequence Number=SeqID_25052
MFCVGCFLVLADYWAITRSVARNNTIRLGKSLVLKARIESGERGPKIINDDRRCLEVVVVGLCWLRRKNFVKGLLVDNRWVEEPMVVKRNIKEFFEKMFKEEERCRPKLDGANFKRIQRQNNLMLILVFKEEEVKEAIWAYGNDKSLDPDGFLSSLSKNFGRF

SEQ ID NO: 141831 - protein, 140 aa, Glycine max
  Coding DNA Sequence Number=SeqID_25053
  Gene Ontology: Mol. function=DNA binding; Biological process=DNA integration
  Homolog annotation: Hit_ID=Q1SKC8; Match level="QueryCoverage=99%, HitCoverage=33%, E-value=2e-33, Identity=52%"; Hit description =Integrase, catalytic region
MELKHRAYWALKFLNFNGSLSGEKRRLQLMELEEMRLNTYESSRHYKQKMKMYHDKKLLRKTVYPRQQVSLYNSRLRLFPGKLKSKWSGPFMVKEVKPSRAIELIKPATPNPEKNWIVNSQRLKIYNGGSVERLTTIIHL

SEQ ID NO: 141832 - protein, 511 aa, Glycine max
  Coding DNA Sequence Number=SeqID_25054
  Gene Ontology: Mol. function=monooxygenase activity; Cellular component=integral to membrane; Biological process=electron transport
  Homolog annotation: Hit_ID=Q1SJ90; Match level="QueryCoverage=99%, HitCoverage=99%, E-value=1e-165, Identity=54%"; Hit description=E -class P450, group I
  Pfam annotation: Domain name=AntA; Domain location=139-184; Score= -23.1; E_value=0.021; Accession=PF08346.2; Description=AntAAntB antirepressor
  Pfam annotation: Domain name=p450; Domain location=36-500; Score =316.2; E_value=6e-92; Accession=PF00067.12; Description=Cytochrome P450
  Pfam module annotation: Pfam domain module=AntA::p450; Domain location=139-184::36-500
MADFGDYFGLLFIWLASIFILRVILFTKSRIKSRLPPSPRALPVLGHLYLLTKLPHQAFHNISIRYGPLVYLLFGSKPCVLVSSPEMARQCLKTHETCFLNRPKRTNLDYITYGSSDFVLAPYGPYWSFMKRLCMTELLGGRMLHQHLPIREEETKLFFKSMMKKACFGEEVNIGKELAMLANNIITRMALGRRCCDDVEGEGDQLIELVKEMTELGGKFNLGDMLWFVKRLDLQGFGKRLESVRSRYDAIMEKIMKEHEDARKKEMGGDEAVRDLLDILLDIYNDESSEIGLTRENIKAFIMRKEETITSATTIEWALAELINHPDIMLKARQEIDSVVGKNRLVEESDILNLPYVQSIVKETMRLHPTGPLIVRQSTEDCNVNGYDIPAMTTLFVNVWAIGRDPNYWENPLEFKPERFLNEEGQSPLDLKGQHFELLSFGAGRRSCPGASLALQIIPNTLAGMIQCFEWKVGEEGKGMVDMEEGPGMALPRAHPLQCFPAARLHPFAEV

SEQ ID NO: 141833 - protein, 65 aa, Glycine max
  Coding DNA Sequence Number=SeqID_25055
MQGYLMVTRTFRQPGANELVDARGLTSSSAPFVVLPRELWSTRGKRARWRAEINIVLGTFIRLDP

SEQ ID NO: 141834 - protein, 192 aa, Glycine max
  Coding DNA Sequence Number=SeqID_25056
MTTLVTACYWTLESDGRNKTFSRSQPEDADISGKGANDDSRLEDAGISRKGADKDMLTSGKGADDDIDTDISGKGEDDHIGLCMSTGSLASNANISGKGADDHIGLYVCPRATGPLGHDSKIETYLRSRPEDADISEKGVFACHRTLGSQDSKKYARITIRCLRVPPDSQGEKVASAQDFGWQSKGEDYLKS

SEQ ID NO: 141835 - protein, 71 aa, Glycine max
  Coding DNA Sequence Number=SeqID_25057
MANSFNRMVERMDGKVDDEDIQEVLREAALIPDLSRQQWAKAIKWFDLLHLMMNEDYGMKNVVFFFKIWTL

SEQ ID NO: 141836 - protein, 135 aa, Glycine max
  Coding DNA Sequence Number=SeqID_25058
MYNTIITYIGLHCSAHWQMVVILSKENVVIWFCSLHNRPNNYLKGIINSALKGLEDTPQTKSKAGAWWVVVKCNEQKGSTGCSYYVMHWMSTIILGSFKNNWKKYFNYARPLEPERLKVLRIQWAKYYLKARNET

SEQ ID NO: 141837 - protein, 369 aa, Glycine max
  Coding DNA Sequence Number=SeqID_25059
MDGSLWKLSPSANCNCISQNMCNIFSFLDYYIHPSTTKLLSFDTIWMLKMFIRLCIGVLGVAAVQLCISVAFPGYFWYRGKGFKSAFLRHKKQIVLSSVFIVVSAGIFFIIQQPKDYKSKGAGVVIKGTLYTDLKIDSVKIFSKDFHKQVGSAIVKNGSFLWETRQQIPFDQYSLEFGTKRIDFMMGSGDHFDFDIRCNPLKIQYFLISNRSAEQQYNTEEDGFGYEFSYAVEQQKYNDNPSEFYQLAQSDWNKNIKRLEHYTDAENNALSDEYKSYRKQLLAIQYLNEINNYRKMTSWDDPKFAAPKEFLNELNSKIKNPTVLLSKNDDYLQYRLDKMLTDRDRLSNPDSILFVKLNALPDNIDKDRL

SEQ ID NO: 141838 - protein, 54 aa, Glycine max
  Coding DNA Sequence Number=SeqID_25060
MATARWALKHPVYGIVILRLGIYTNRPNVSKTTFLNEKLYTAPKFQQTLLTTTK

SEQ ID NO: 141839 - protein, 189 aa, Glycine max
  Coding DNA Sequence Number=SeqID_25061
  Gene Ontology: Mol. function=hydrolase activity, hydrolyzing O -glycosyl compounds; Cellular component=cell surface; Biological process=carbohydrate metabolic process
  Homolog annotation: Hit_ID=P94289; Match level="QueryCoverage=73%, HitCoverage=24%, E-value=7e-15, Identity=35%"; Hit description =Chitinase C precursor
  Pfam annotation: Domain name=Glyco_hydro_18; Domain location=23-188; Score=47.6; E_value=4.2e-11; Accession=PF00704.18; Description =Glycosyl hydrolases family 18
MKLLPLLAALPLLCASVVSAQSFMSVGYFNGGGDVTAGPGGDIDKLDVTQITHLNYSFGLIYNGEKDETNAVLKDPARRHQIYLSPKVMADLQRLPTLRKQNPELKVLLSVGGWGARGFSAAAATAENRAIFIRFALQVIAQYQLDGIDLDWEYPVNGAWGLVESQPADRDNFTLLLKELHQALVKASC

SEQ ID NO: 141840 - protein, 105 aa, Glycine max
  Coding DNA Sequence Number=SeqID_25062
ADPAGSFDTERYLRHLVRQQAANHRAHVQTHDSLYQHSLSLQSQGFASFPCPTPDQFRAEVAWPGDWPEAQAGEAPAEAPGEANEAREDKEMTDLLDFLGGSGAT

SEQ ID NO: 141841 - protein, 151 aa, Glycine max
  Coding DNA Sequence Number=SeqID_25063
MGDKLHRREGNSPDHQLRPLNDRSVIKEMNGAKRSAEAVGCKKESVGERSALEGRTRASSAGRSGSENVGLSNANVGENPMPRKPKGSSARPKGVVDGQQVNIPVLPFVGPEGRRRLGVEKMPRAKVRVPGATALKYPCHTPRKARTTFNK

SEQ ID NO: 141842 - protein, 270 aa, Glycine max
  Coding DNA Sequence Number=SeqID_25064
  Homolog annotation: Hit_ID=Q1RTB4; Match level="QueryCoverage=96%, HitCoverage=60%, E-value=4e-30, Identity=31%"; Hit description=IMP dehydrogenase/GMP reductase
MGTNQTGKRFYQVKVKSLDTTSIKELGRLMEPLQMQTFRKTYGYILELTIAEVSIEAIVSLTQYYDQPLRCFTFGDFQLVPTIEEFEEILGCPLRGKKTISFLRVSPLFEQNCNCGQGFSKRSTLEDKARGMANQGDWIPFMDVLALLIFGVVLFPNVDGLVDLAAIDAFLAYHHSKESPVVAVLADLLDTFDRRIDWDQLLAGIGGRTISWFPRWKEGKEGVLFSCGGYPNIPLVGTRGCINYNPALAIRQLGYPMRGAPTEESMSPFL

SEQ ID NO: 141843 - protein, 122 aa, Glycine max
  Coding DNA Sequence Number=SeqID_25065
  Subcellular localization annotation: CTP_CleavageSite=67; ConfidenceScore=5.39e-01
MERKMHNPTSSTVLTILLLGVLSQNLVVPVTCTPTSSPTPFTGTSYYWSSNPGRIKEVLGWVGTIGSAFGVGSSNNKIPSNVSLVHALSNTTSDGLGALCREGTASFLNSLVNNKFPYTTPQ

SEQ ID NO: 141844 - protein, 52 aa, Glycine max
  Coding DNA Sequence Number=SeqID_25066
MVHDIFVKVKLEVTRISTILNVFGSRRSNDKWVYDPNMVGSWYLTHATKSAS

SEQ ID NO: 141845 - protein, 292 aa, Glycine max
  Coding DNA Sequence Number=SeqID_25067
  Homolog annotation: Hit_ID=Q8TGM6; Match level="QueryCoverage=41%, HitCoverage=97%, E-value=1e-09, Identity=43%"; Hit description =Protein TAR1
  Subcellular localization annotation: CTP_CleavageSite=51; ConfidenceScore=5.50e-01
MSRVDRRTGSHRSTSDRDTSPAPIRFPPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLFPRVAPPDLRSRWERACTQRVVDGSRTDRLARDWSRAWLIPPFLSRRKSAMNPRISTKPRGRVLAGGQPYTPAQQHCYMFALGKRCVTPQAGVPLGLMASGATCVQRLDGSRDSAIHTKYRISLRSSSMQEPRYPLPRVIVCKCCVVTTPAGHRLRAPGSRT

SEQ ID NO: 141846 - protein, 179 aa, Glycine max
  Coding DNA Sequence Number=SeqID_25068
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=1e-15, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSCLLEFGMTGPLNESISCFLKRVDPWVLVPSPSQDYTSSPSEGCTPSPSEGYTPSPSEDYTSSPSEDYTSSPSEDNTSSPSEDYTSSPSENYTSSPSEGCMPSPSEGYASSPSEGYMHALKGLRVLTFKGLHALTFRGLHALTIRGIHVLAIRGLHVLAFRGLHALTFRGLTCPHPLE

SEQ ID NO: 141847 - protein, 73 aa, Glycine max
  Coding DNA Sequence Number=SeqID_25069
GERAVYAMMLVFPPEFSPLKTILFGNPSQDTVEQLMEALEEDSKYGNEINESRKFIGGVLDLEKRINRLDTLT

SEQ ID NO: 141848 - protein, 162 aa, Glycine max
  Coding DNA Sequence Number=SeqID_25070
MDDAAAQQCMVPTMHPLDPEKSIMALGFLALITGLCQSYGVPVTPSKAASAPPPPRQANPAGSLGVERYLQHLVRQQAANHRGQVQIHESLYRFNLSQQGQGFIPFVCLTPEQFEAKVAWPGDWLDAQTEEEPAGSPDGADEPQMDEDMNDLLGFLGGSGAT

SEQ ID NO: 141849 - protein, 178 aa, Glycine max
  Coding DNA Sequence Number=SeqID_25071
MASRKRRTSTSRPQEPYNTTRFISEVTWERYEQNIHARNILPERNTPVVLEPGERYSAYSRFCSTYPDPQELAARLSIPGRGFVLNAEGAPWKLLRKDLTTFAQTWSVFSYSNLAPTSHTFDLNMDRARLVYGLVMKMDIDVGSITLDQISQDVDTTPMPAQDAPRSPQDDPAPAQEE

SEQ ID NO: 141850 - protein, 65 aa, Glycine max
  Coding DNA Sequence Number=SeqID_25072
MYVPRWRRLRMRQLWWPELRFYKTLRAHQPPFIGYWGLAKRDSRAKPKNLSSCAINGIGLSESTR

SEQ ID NO: 141851 - protein, 148 aa, Glycine max
  Coding DNA Sequence Number=SeqID_25073
  Gene Ontology: Mol. function=metal ion binding; Cellular component =anaphase-promoting complex; Biological process=protein ubiquitination
  Homolog annotation: Hit_ID=Q940X6; Match level="QueryCoverage=51%, HitCoverage=91%, E-value=6e-47, Identity=98%"; Hit description =Anaphase promoting complex subunit 11
  Pfam annotation: Domain name=zf-C3HC4; Domain location=98-140; Score =15.1; E_value=0.0043; Accession=PF00097.15; Description=Zinc finger, C3HC4 type (RING finger)
MLHFQLLGRIRILENVVISEKKVGWKVLILSWWNLLGGVDKTFLVSIYSFALRLNQPHPDYHIPFCFVKCRWHAVASWTWDAQDETCGICRMAFDGCCPDCKLPGDDCPLIWGVCNHAFHLHCILKWVNSQTSQAHCPMCRREWQFKG

SEQ ID NO: 141852 - protein, 75 aa, Glycine max
  Coding DNA Sequence Number=SeqID_25074
  Pfam annotation: Domain name=zf-GRF; Domain location=15-49; Score =18.0; E_value=0.00019; Accession=PF06839.3; Description=GRF zinc finger
  Subcellular localization annotation: CTP_CleavageSite=22; ConfidenceScore=5.13e-01
MSANSSTRGNVTSNRLCYCRRRATIRTARTTRNNERLFYACPLPQVNIDVGATEIGRIEPIPDFGLRLRLKIMQR

SEQ ID NO: 141853 - protein, 734 aa, Glycine max
  Coding DNA Sequence Number=SeqID_25075
  Gene Ontology: Mol. function=transcription regulator activity; Cellular component=nucleus; Biological process=regulation of transcription
  Homolog annotation: Hit_ID=Q2HRT7; Match level="QueryCoverage=97%, HitCoverage=97%, E-value=1e-147, Identity=46%"; Hit description =Basic helix-loop-helix dimerisation region bHLH
  Pfam annotation: Domain name=HLH; Domain location=473-522; Score =62.5; E_value=1.3e-15; Accession=PF00010.16; Description=Helix-loop -helix DNA-binding domain
MPLYELYRLAREKLGKETTSTRAPDLCSSPENDFFELVWENGQISSQGQSSRVRRSPSCKSLPSHCLPSHCPKVRDKDVGYGTNTRMGKFGDLDSGLNEIPMSVPSREVDFCHDEDVLPWLDYTSMDGSLQHEYGSDFLHASNSFTLLDKKSNGNMAFRDSHKTSEEQGNVFKGSSAEQVETARPKASTSQLFPPSLHQCQTSFVSSRSRASDITENNNTSNANQDVSYGEITHILSSSSDLSSAKVQKCDPPITSNGSSSTIMNFSHFARPAAMVRANLQNIGLKSGLSSARSDSMEIKNKGAAATSSNPPESILVDSSGECSKEPTMQCQQVVEQSKPDVNSLQPKSVEQNAVPSKQSEPASKESATKIDQTPNQVLGDSGTKGQTAAEKSMEPAVASSSVCSGTGADQGSDEPNQNLKRKTKDTDDSECHSEFPSITKKTFYVKDVEEESAGAKKTAGGQGGAGSKRSRAAEVHNLSERRRRDRINEKMRALQELIPNCNKVDKASMLDEAIEYLKTLQLQVQIMSMGAGLYMPPMMLPAGMQHMHAPHMAPFSPMGVGMHMGYGMGYGMGMPDMNGGSSRFPMIQVPQMQGTHIPVAHMSGPTALHGMARSNPPGYGLPGQGYPMHMPPASVFPFSGGPLMNSPAQGLHARGSSGLVETVDSASASGLKDQMQNVDPQVKQSTGGCDSTSQMPTQCEAAAVGFEQSALAHSRGHASKANDNGAVNPDPGR

SEQ ID NO: 141854 - protein, 766 aa, Glycine max
  Coding DNA Sequence Number=SeqID_25076
MKSIKHKSNKTVCNKRILQRAFPLFPSLPVQYVKNEKDEGIAQKMASLANEDEVKHDKPEDEDTPSSKTEEDEVAAVEIEKSEDSPALEASAEDSVKHDKVEDAQSATSPPTDHKVEPAITIEKTEDSVPSVAVEDNVKEEKEVVPDSHSISDIEPVHKAPSTEPAAEETPPLELEKEPSNTDETSPLTESEGGVLKEAQVLETCAQVEEKPEPVSTPVAAEVDESQKEPEKQSLEQRVEEEKPDTSVVPQHSEESGDATEVKTRELEFEAEVLEKTNNSETEKPEPVEAEVAESQREAEKAEPVAAKVDEKQSETVKAEPVAAKVDENQSEPEKQEKEEKPKKVAPLTEAESAEQEGNIVEAHPPKDSGIEDVKDTGNSEPEAVPEKTEKPEPLPTEVEEKPREQLQVDEEVAEASKEMETKKEIVIETAKSEGTSDDTIKEEKTEKEEETSLTVNATQVSSNAEPQENPVETSSEVVLETSKSEGALDDTAKEEKTDKEEETSLTVNAAQVSSQVSPEAAEKIVEEVDDKKESSISNVIEAESNEAADIIKSPEQASIDEEAKTDLNEEREIYVPAAVEEKVAVDVAANDDVDKKEPEAPNNAVPESSQEEVVESKKVEEQNEAKAATTEAAESVKVDKVVDDKKEEKTETKVEEISRAINEPVRETLASKFEEESVEPGADKVEKEQTVEPEKTEVQATKENDATKTSKDLPKETPAKPAQKQSNNIISKVKQSLVKAKKAITGKSPSSKNLSSEPKGDIKVK

SEQ ID NO: 141855 - protein, 105 aa, Glycine max
  Coding DNA Sequence Number=SeqID_25077
MGTQKDTKFLETLGSSRIVTDEVFLIQMQQHCYLSGGDHFPVHISTGKLSKSNLFRPKRCLSSEKEKTQMDAESGERFAEKQCGRRQSKAVSGSDTNETDRNRKE

SEQ ID NO: 141856 - protein, 113 aa, Glycine max
  Coding DNA Sequence Number=SeqID_25078
MNDIDAVWEVTRKPGHDDVQHHTDHTIQSMTQDMTQTLRTDEHHHVIGSNDWSPDRCSFMCPLRPIDALQAQTLFLEEEDHRHEKKVMSSRIRFQELSSRRDDESYKGNTQTF

SEQ ID NO: 141857 - protein, 96 aa, Glycine max
  Coding DNA Sequence Number=SeqID_25079
MMMMKIEKIYRDVEEHVFLGKIQQIFFQLCELQERLHSQSPKHKAEWGVCLVWIWGLGFGKGWEVVVPGLGGYLMALETLVSGCEALPPYLLFYGS

SEQ ID NO: 141858 - protein, 302 aa, Glycine max
  Coding DNA Sequence Number=SeqID_25080
  Gene Ontology: Mol. function=oxidoreductase activity; Cellular component=cytoplasm; Biological process=gibberellic acid mediated signaling
  Homolog annotation: Hit_ID=O22377; Match level="QueryCoverage=99%, HitCoverage=86%, E-value=1e-134, Identity=78%"; Hit description =Gibberellin 3 beta-hydroxylase
  Pfam annotation: Domain name=2OG-FeII_Oxy; Domain location=202-287; Score=30.6; E_value=5.5e-06; Accession=PF03171.10; Description=2OG -Fe(II) oxygenase superfamily
MPSLSEAYRAHPVHVQHKHPDLNSLQELPESYTWTHHSHDDHTPAASNESVPVIDLNDPNASKLIHHACITWGAYQVVNHAIPMSLLQDIQWVGETLFSLPCHQKQKAARSPDGADGYGLARISSFFPKLMWSEGFTIVGSPLEHFRQLWPQDYHKYCDIVKRYDEAMKKLVGKLMWLMLDSLGITKEDLKWAGSKGQFKKTCAALQLNSYPTCPDPDRAMGLAAHTDSTLLTILYQNNISGLQVHRKGGGRPPPHIVERVVPECAPPGLSEPDPAKAFSCVFMWAPSECGDMSTCEASGPK

SEQ ID NO: 141859 - protein, 216 aa, Glycine max
  Coding DNA Sequence Number=SeqID_25081
  Gene Ontology: Mol. function=nucleoside-triphosphatase activity; Cellular component=integral to membrane; Biological process=transport
  Homolog annotation: Hit_ID=Q76CU2; Match level="QueryCoverage=99%, HitCoverage=14%, E-value=1e-60, Identity=56%"; Hit description =Pleiotropic drug resistance protein 1
  Pfam annotation: Domain name=ABC2_membrane; Domain location=1-158; Score=80.5; E_value=5.1e-21; Accession=PF01061.14; Description=ABC-2 type transporter
MYNAIIFLGIQNAFFVQPVVAIERTVFYRERAAGMYSAIPYALAQVVIELPYIFVQAVTYGIIVYAMIGFELTASKFFWYLFFMYFTFLYFTFYGMMTVAVTPNQHIASIVATAFYGVSNLFSGFVVSRPFYIPVWWRWYYWACPVAWSLYGLVASQFGDVTSAVELNETVKEFFRRYFGYRDDFVGVAAGVVVGFALLFATIFAFSVKVFNFERR

SEQ ID NO: 141860 - protein, 178 aa, Glycine max
  Coding DNA Sequence Number=SeqID_25082
  Gene Ontology: Mol. function=nucleoside-triphosphatase activity; Cellular component=integral to membrane; Biological process=transport
  Homolog annotation: Hit_ID=Q76CU2; Match level="QueryCoverage=90%, HitCoverage=14%, E-value=4e-45, Identity=53%"; Hit description =Pleiotropic drug resistance protein 1
  Pfam annotation: Domain name=ABC_tran; Domain location=24-159; Score =1.5; E_value=1.3e-07; Accession=PF00005.17; Description=ABC transporter
MKNQGVIEDRLVLLKGASGAFRPGVLTALMGVSGAGKLEGTLRGVSQFQGTLKIKKHMLESLATMFIEEVMELVELNLLREALVGLPGVSGLSTEQHKRLTIAVELMANPSIIFMGEPTCGLDARGAAIVTRTVRNIVDTGRTILCTIHQPSIDIFEAFDEVSSALDHIILSFLTFLI

SEQ ID NO: 141861 - protein, 736 aa, Glycine max
  Coding DNA Sequence Number=SeqID_25083
MAEAEDYGFLPEEMAVNENLGYPKAFAKLCRDRGFSPYSHGPPFTFIPYVLPEDEAERARDLDEMFPIIDPKAKATSKPKIFVSVLWKQLRHLGNAGFDPAVIRVDGYGNVLYYHADSASPLAWDVDHWFPCSRGGLTVLSNLRILQRQACKRKKNKLEFLVPWWDFQLGISVNQFLHRAFSFLFYEGENQELNASQIVDSHSFPQHFFPLKEEVGLAPAAIVESRREPCDALVLRQLDYNRKPRPMSPAIAARKRNGNFLKENEDPDFVKNPYQAIVMARDSLKQREETTKMQAEIQKIDDEVNEMKLKNEEEKLAIQDLEMALIKRRRKAEKCRRLAEAQSSYRTMLEKMIRDSMHQSVIYKEQVRLNQAASNALMARLEAQREICDAAEKDLHKKYKQRDDIEKQIRPEWEQGRKRSRIDDATYEERDSKPALYLPGPIPRTPLHKELGVFLEEEQRSSEVDLSANEEEQKQEEKEEKMKMPDNNDLEEKLEEHTKSSVALDEENSIEQRLQKLKISEGKRSYGISFSGLHKTATEEDEETRKQRGRGNVEKWLQMLLENGQQQERTDPLETSENASCGTEEKIIQQLNQKFPQKELKISKVSDSDYKENQLQLLQNRNGWTEKEDRIENEARSVMPTGYKNYSGEACIGANCTLNVEGMERKEQHKKEKKLPRSESARTLRRIPSSPSLLLGIKKGVDYIRKKPMASDDADLAASNSFLKSSIKTIKKAVKL

SEQ ID NO: 141862 - protein, 474 aa, Glycine max
  Coding DNA Sequence Number=SeqID_25084
  Gene Ontology: Mol. function=nucleoside-triphosphatase activity; Cellular component=integral to membrane; Biological process=transport
  Homolog annotation: Hit_ID=Q8GU90; Match level="QueryCoverage=88%, HitCoverage=63%, E-value=1e-106, Identity=46%"; Hit description =Pleiotropic drug resistance protein 3
  Pfam annotation: Domain name=ABC_tran; Domain location=31-249; Score =23.6; E_value=1.4e-09; Accession=PF00005.17; Description=ABC transporter
  Pfam annotation: Domain name=PDR_assoc; Domain location=384-447; Score=106.1; E_value=1e-28; Accession=PF08370.2; Description=Plant PDR ABC transporter associated
  Pfam module annotation: Pfam domain module=ABC_tran::PDR_assoc; Domain location=31-249::384-447
MHIAHLKKSVPAPDNGNYSICLSYFTIAFIRMILLLGPPSSGKTTLLLALAGKLDPDLKVSGHVTYNGHGMNEFVPQRTDAYISRHDFHIGEMTVRENLGFLCKVPKDLLSELSRREIATNIKPDPNIDIYMKAVASVGQEANQMVTEYVLKILGLEMCADIVVGDEMLRGISGGQTKCVTTGEMLVGPTNALFMDVISSGLDSSTTVQIIKCLRQIVHILDGIAVISLLQPEPETYELFDDISLLSDGQIVYQGPREFVLEFFESKGFRCPERKAIFLQEEGSAVPFDKRKNHPAALTTMKYGVNKKELLKANFSREYLLMKRNALVYIFKLSQDSCELKCTRILWIKGEFTPDVKKWWIWGYWISPIMYEQNAMMVNEFLGGRVLPNSTESLEVEALESRGFFTHASWYWIGAGALLGFVVLLNITFTLALTYLNPLEKPRAVIFNESHGNRHKDRTLDDIGLSLRFTGNAP

SEQ ID NO: 141863 - protein, 154 aa, Glycine max
  Coding DNA Sequence Number=SeqID_25085
  Subcellular localization annotation: CTP_CleavageSite=34; ConfidenceScore=5.37e-01
MASFSHMQSQLQSQMQSQGIVVPPDPLVGPSGPRVSTKGSCVDPSGNDPETDADAPVPVPTDEVSLVGQALHTFLAWPTHLVKSLSQQVAVSPTKPPPKPDPEVDDPLYLMTLTIPELLLRPYQVRWDATVFGVFNPDFPLYIKHADLSEIAHG

SEQ ID NO: 141864 - protein, 123 aa, Glycine max
  Coding DNA Sequence Number=SeqID_25086
MVVSLFLTHLLFEVASPIMFLPSSFRCHDLQAAKDSIDEEDPRPTSSTRNYITNPMLSCMHTHTVSSLMHRICLVIIVTGSYKVHLTFLSACIGHHGNVCERTMIPNALWVRRGGLPNSCVRR

SEQ ID NO: 141865 - protein, 74 aa, Glycine max
  Coding DNA Sequence Number=SeqID_25087
RASPRTIAYFYSINNFDRRQEPAMYNYYEKGRAPDLESVLADFMTYQDTSKGDCYSMQQQGTQFERDYSSTDYQ

SEQ ID NO: 141866 - protein, 92 aa, Glycine max
  Coding DNA Sequence Number=SeqID_25088
MNNEAGRDSCSVHASFHVKPKEHRVRHKESGSSEKQQLVSGPALDPVVESLTESEEELKVKDEKKKETTINLSEQEKEEKNKEKEKEKEEEK

SEQ ID NO: 141867 - protein, 119 aa, Glycine max
  Coding DNA Sequence Number=SeqID_25089
DRELNETRQQIIGGYHKWLRVRTQGLDWLPNLKTVRDDEVKASEESDEVQALKAELERAWVVEEKFKSIAIKARKEEHDQSKVLRGLYRAAIVSSSSEEVKGIITGQRHDLEGRAKGLP

SEQ ID NO: 141868 - protein, 118 aa, Glycine max
  Coding DNA Sequence Number=SeqID_25090
  Gene Ontology: Mol. function=actin binding; Biological process =cytoskeleton organization and biogenesis
MAIRDILLNKVRSAITRLCFFFNAIYSKVIDPVKLDDLENKVAIKLCGPVYLWWMYPVQRYMNILKGYTKNLYCPKASIAERYISKEAIEFCSHYIERAKLVGLLESQHDKRVGGKGS

SEQ ID NO: 141869 - protein, 237 aa, Glycine max
  Coding DNA Sequence Number=SeqID_25091
  Subcellular localization annotation: CTP_CleavageSite=81; ConfidenceScore=5.39e-01
MHPPTLESGVPRVDCLALFANSPFSTFIRSPMNSLPSAAHVSSTFESGAPRIYCLALFANSPFSTFIRSPINSLSSTVHASSTIESGVPRIDCLALFANSPFSTFIRSPMNSLPSAVHVSSTFESGAPRIHCLAKFANSPFSTFIRSPMNSLPSAVHVSSTFESGAPRIDCLALFANSPFSTFIRSPMNSLPSAVHVSSTIESGALRIDCLALFANSPFSTFMRSPMNSLPHVSSSF

SEQ ID NO: 141870 - protein, 211 aa, Glycine max
  Coding DNA Sequence Number=SeqID_25092
  Gene Ontology: Mol. function=RNA-directed DNA polymerase activity; Biological process=RNA-dependent DNA replication
MVENEKFDHIEERLRAIEGGRDYPFADMVELCLVPDVIIPLKFKVSDFDKYKGTTCPKNHLKMYSRKMGAYSKNEKLLMHFFQESLTGAAVNWWRDLAAQVAPPMMEREMITMIVDTLLEFYYEKMVGYMPSSFADLVFAGERIKVGLKRGKFDYVASMNSGDRRPRANGGNKKEGDTHDVVVVPAWPNFSLAQQYQYSASISPSHYLPPY

SEQ ID NO: 141871 - protein, 136 aa, Glycine max
  Coding DNA Sequence Number=SeqID_25093
  Gene Ontology: Mol. function=steroid binding; Cellular component =periplasmic space; Biological process=transport
  Homolog annotation: Hit_ID=Q5J3T1; Match level="QueryCoverage=99%, HitCoverage=100%, E-value=4e-58, Identity=80%"; Hit description =Putative exported protein
  Pfam annotation: Domain name=Transthyretin; Domain location=25-135; Score=162.8; E_value=9e-46; Accession=PF00576.11; Description =Transthyretin precursor (formerly prealbumin)
MKKTTPLLFLAAMAFAPAAFSAPAGTLSVHILDQQTGMPPSDVTVTLEKQQQDKWTPVASGKTDHDGRIKSLYPQDQDMQPGVYKVTFKTAEYFHGKKLDTFFPEIPVLFTVTRTNEKLHIPLLLSQYGYSTYKGS

SEQ ID NO: 141872 - protein, 140 aa, Glycine max
  Coding DNA Sequence Number=SeqID_25094
  Gene Ontology: Mol. function=transcription factor activity; Cellular component=intracellular; Biological process=regulation of transcription, DNA-dependent
  Homolog annotation: Hit_ID=Q5J3T2; Match level="QueryCoverage=99%, HitCoverage=58%, E-value=3e-69, Identity=90%"; Hit description =Putative transcriptional regulator
MMYDAGREYPRPELVANVLRPLRSQVSANVAAAMTLRAILDGIIIAYTSFRLEGDKKAPGDNILLSGWHLNDPCEIWLEALTRTGQGHRIDIMPVPPATLAPEIFPERKWILVTSGKLTAGRKKQLEQWQQQVSLEVIIL

SEQ ID NO: 141873 - protein, 173 aa, Glycine max
  Coding DNA Sequence Number=SeqID_25095
TNIFDLTFAHDKYTLICKPKVERKDIDLIEEEEAQIGGDRSSATSNKAKIYYEEARKKTQKHKPKRVESVNADAEAFAEALEHTKKRDTGHQSVALDNETGVSTMLKMGDSAKVVIKQDMKGREHKYGFNNNEREKPEKKRVVDDETGDKHQLDEVLRRQIETKNRCLNKRKM

SEQ ID NO: 141874 - protein, 531 aa, Glycine max
  Coding DNA Sequence Number=SeqID_25096
  Gene Ontology: Mol. function=methyltransferase activity; Biological process=metabolic process
  Homolog annotation: Hit_ID=Q1SNV1; Match level="QueryCoverage=91%, HitCoverage=97%, E-value=0.0, Identity=86%"; Hit description=SAM (And some other nucleotide) binding motif
  Pfam annotation: Domain name=CMAS; Domain location=283-530; Score= -115.2; E_value=1.8e-07; Accession=PF02353.10; Description =Cyclopropane-fatty-acyl-phospholipid synthase
  Pfam annotation: Domain name=MTS; Domain location=289-451; Score= -89.8; E_value=0.047; Accession=PF05175.4; Description=Methyltransfera se small domain
  Pfam annotation: Domain name=Methyltransf_11; Domain location=328 -424; Score=91.1; E_value=3.4e-24; Accession=PF08241.2; Description =Methyltransferase domain
  Pfam annotation: Domain name=Methyltransf_11; Domain location=99-197; Score=56.9; E_value=6.6e-14; Accession=PF08241.2; Description =Methyltransferase domain
  Pfam annotation: Domain name=Methyltransf_12; Domain location=328 -422; Score=61.8; E_value=2.2e-15; Accession=PF08242.2; Description =Methyltransferase domain
  Pfam annotation: Domain name=Methyltransf_12; Domain location=99-195; Score=36.2; E_value=1.1e-07; Accession=PF08242.2; Description =Methyltransferase domain
  Pfam annotation: Domain name=Ubie_methyltran; Domain location=305 -478; Score=-99.5; E_value=4.3e-05; Accession=PF01209.9; Description =ubiECOQ5 methyltransferase family
  Pfam module annotation: Pfam domain module=CMAS::MTS::Methyltransf _11::Methyltransf_11::Methyltransf_12::Methyltransf_12::Ubie _methyltran; Domain location=283-530::289-451::328-424::99-197::328 -422::99-195::305-478
MEVRTNEVAKQRIEDEGYRAHNNPFGLNLFLFSSFCQPYMASLATVQDERCVQRSYWIEHTTDLSVESMMLDSNASDLDKEERPEVLSLLPAYEGKSVVELGAGIGRFTGELAKKAGQLLAVDFIESAIKKNESINGHHKNVKFMCADVTSPNLHISEGSVDLMFSNWLLMYLSDKEVENLAARMIKWLKVGGYVFFRESCFHQSGDSKRKYNPTHYREPRFYTKVFKECHTSDDTRNSFELSLVGCKCIGAYVRNKKNQNQICWIWKKVRSQDDRGFQRFLDSVEYNHKDILLYESVFGQGFVSTGGLETTKEFVAKLGLKPGQKVLDVGCGTGGGDIYMAENFDVEVVGIDLSINIISLAIERAIGLKCCVEFECADCTKKTFPVNTFDVIYSRDTLLHIKDKPSLFRSFYKWLKRGGTLLITDYCKSEGSLSLGYAEYIKKGGYYIHDMKTYCRMLENAGFDDVVAEDRTNLFMKTLQQELNALHSKKDDFIDDFSEEDYNEITERWKAKQMRGADGEQIWSLFIAKK

SEQ ID NO: 141875 - protein, 155 aa, Glycine max
  Coding DNA Sequence Number=SeqID_25097
  Gene Ontology: Mol. function=molecular_function; Cellular component =retromer complex; Biological process=vacuolar transport
  Homolog annotation: Hit_ID=Q1SNV0; Match level="QueryCoverage=98%, HitCoverage=51%, E-value=2e-61, Identity=75%"; Hit description =Vacuolar protein sorting-associated protein 26
MAIFYITQDTQRHPLLPELKSGGFRVTGKISTQCSLSGPISGELTVETSAVPIHSIDIQLFRVESVLLGEKIVTETSLIADGDVCHNLTLPIYVILPRLLTCPTTLAGPFSVEFKVAIVISFQSELSKLHKKSDAKTPRLWLAMETLLLELVRTK

SEQ ID NO: 141876 - protein, 61 aa, Glycine max
  Coding DNA Sequence Number=SeqID_25098
  Subcellular localization annotation: CTP_CleavageSite=39; ConfidenceScore=5.24e-01
MDTELIPGTYPVPIPLLSTVSVQYSYSLLRKKVKRRRTRSRSTAPNHKQIGLHTFKANHLF

SEQ ID NO: 141877 - protein, 65 aa, Glycine max
  Coding DNA Sequence Number=SeqID_25099
  Gene Ontology: Mol. function=fructose-bisphosphate aldolase activity; Biological process=metabolic process
MSIELKTCIHLGVRKFNVNTEVRKAYMDSLVTPKNDLVHVMASAKEAMKVVVAEKMHLFGSAGRA

SEQ ID NO: 141878 - protein, 163 aa, Glycine max
  Coding DNA Sequence Number=SeqID_25100
  Gene Ontology: Mol. function=transcription factor activity; Biological process=regulation of transcription, DNA-dependent
  Homolog annotation: Hit_ID=Q1XW78; Match level="QueryCoverage=97%, HitCoverage=91%, E-value=2e-61, Identity=71%"; Hit description =Regulatory protein, TetR
  Pfam annotation: Domain name=TetR_N; Domain location=1-42; Score =42.5; E_value=1.5e-09; Accession=PF00440.13; Description=Bacterial regulatory proteins, tetR family
MKLFSTQGYNSTGINQIISEASVAKASFYQYFKSKEDLCVEFLNTRHTYWFNELETFTAGKRGAKSKVMAAFDFLIDMNRKENFRGCSFLNILSEIPTDNTKILNVIQHHKTDLRNYFMKIVDDAEISDHIYMLFESSIIESQLFRSNELIEKSKKIITNLIS

SEQ ID NO: 141879 - protein, 598 aa, Glycine max
  Coding DNA Sequence Number=SeqID_25101
  Gene Ontology: Mol. function=phosphogluconate dehydrogenase (decarboxylating) activity; Cellular component=nucleus; Biological process=valine metabolic process
  Homolog annotation: Hit_ID=Q1LMB2; Match level="QueryCoverage=93%, HitCoverage=95%, E-value=3e-56, Identity=40%"; Hit description=6 -phosphogluconate dehydrogenase, NAD-binding precursor
  Pfam annotation: Domain name=F420_oxidored; Domain location=323-502; Score=-48.7; E_value=0.036; Accession=PF03807.7; Description=NADP oxidoreductase coenzyme F420-dependent
  Pfam annotation: Domain name=NAD_binding_2; Domain location=321-486; Score=161.9; E_value=1.6e-45; Accession=PF03446.5; Description=NAD binding domain of 6-phosphogluconate dehydrogenase
  Pfam module annotation: Pfam domain module=F420_oxidored::NAD_binding_ 2; Domain location=323-502::321-486
MHVNTKLLLIHSINGNAVKNMLKCDTTNINDPVIEELVKLGGVKCPSPSEAGRDVSALVVLISHVDQTNHLIFGEKGALKDLKSDTVLILRSNILPSFLQKLEKDLAEIHKIAYVVDAYVSYGRSDDLNEKVTIASSGRLDAIARARPILSAMCEKLFTFEGEIGGGSKVKMVTVMLEGIHFINAVEALSLGAKIGIHPWIIYDIISNAAGNSWAFKNYVPLLLKGEVNHQILNTFVEELEIILNMAKSLTFPLPILAATHLQLIHGTELGVSLVGSEDDLTAIIKVWEKVYGVKISDAANADVYNPEQLASEFTTDSKSGRRVGFIGLGAMGFGMATHLLSSKFCVVGFDVYKPTLTRFSNAGGLIGNSPAEVSKDADVLIIMVTNEAQAESVLYGEYGAVSALPPGATIILSSTVSPAYVSQLEHRLHNEGKNLKLVDAPVSGGVVRASMGTLTIMASGTDDALKSAGLVLAALSEKLYIIKGGCGAGSGVKMINQLLAGVQIASAAEAIAFAARLGLNTRLLFDFIATSGGTSWMFENRGQHMIDNDYTPCSALDIFVKDLGIVTRESSSWKVPLQLSTIAHQLYLAGAVYYFES

SEQ ID NO: 141880 - protein, 82 aa, Glycine max
  Coding DNA Sequence Number=SeqID_25102
MPSIYNPRLSEILASGSYPEGSTQLPFVLTWALEGATFGLTRCDVWELCDGAPKYCLMVTPILAAQTWPKCFGHPMVVVSIS

SEQ ID NO: 141881 - protein, 39 aa, Glycine max
  Coding DNA Sequence Number=SeqID_25103
MASRKAIGFVGLDELSLEMAAKAIRHGYDVQAFEMKKEN

SEQ ID NO: 141882 - protein, 215 aa, Glycine max
  Coding DNA Sequence Number=SeqID_25104
  Gene Ontology: Mol. function=RNA-directed DNA polymerase activity; Cellular component=mitochondrion; Biological process=RNA-dependent DNA replication
MDRFPAFLQSLEDMNNVDMMYKVDMSASTSVITKALVLKAVKPFVGDNDYVFRLVSSLLELPIYTKDGDKVLVGSDDIPPPLGEVSRLLFNFVLMDLFDREFVKCFPEIRFRRFSHEVFVATADIYDVFFSEKSCYALLGKIGLRGEIYSISRGGGYLTSGGVNEILLQVTRVNYHKPALTKLMTARKSIETFTKMLGNSLTKDLIELMHPNAKE

SEQ ID NO: 141883 - protein, 68 aa, Glycine max
  Coding DNA Sequence Number=SeqID_25105
VSSSKEDLEEDPGELSPEPAMDAPDLPEDDEDPLPDVDSPEDIMPASEANSTEESGPRGTANSDDSSS

SEQ ID NO: 141884 - protein, 275 aa, Glycine max
  Coding DNA Sequence Number=SeqID_25106
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=5e-33, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVVTIRELQVHAFRGLHALTFRGLHVHTFRGLRALTFRGLHALSLRGLQVLAFRGLHTLTFRGLQVLTFRGLRTLTFRGLHVHTFRGLRALTFRGLHALTFRGRHVLTLSWLHALSFRGLHVLAFRGLHALTFRGLHVHTFRGLRALTFRGLHALTLRGLQVLAFRGLHTLTFRGLHVLTFRGLHTLTFRGLHVLAFRGLHPLTFRGLHVLTFKGLRALTFRGRHVLTLRGLHALSFRGTTRPRLQRVGRPHLLSTARPRLLRATRPHLQRTT

SEQ ID NO: 141885 - protein, 142 aa, Glycine max
  Coding DNA Sequence Number=SeqID_25107
  Subcellular localization annotation: CTP_CleavageSite=45; ConfidenceScore=5.50e-01
MNLLPSAVHASSTNESGALRIDCLALFANSPFSTFIRSPMNSFPSAVHASSTNESGAPRIDCLALFANSPFSTFIRSPMNLLPSAVHVSSTFETRALRIDCLALFANSPFSTFIRSPKNSFPSAVHASSTNESGVPRIDCLA

SEQ ID NO: 141886 - protein, 87 aa, Glycine max
  Coding DNA Sequence Number=SeqID_25108
MYIKYGPKYIMKHSQQNMLVVSFKTRKGKQGSKGLSKELIQGKSIWLEAYENKIALIISKYACELGSINKNQAKAIVQAINGAKHTK

SEQ ID NO: 141887 - protein, 667 aa, Glycine max
  Coding DNA Sequence Number=SeqID_25109
  Gene Ontology: Mol. function=protein binding; Cellular component =intracellular; Biological process=defense response
  Homolog annotation: Hit_ID=Q1S351; Match level="QueryCoverage=98%, HitCoverage=87%, E-value=0.0, Identity=64%"; Hit description=Disease resistance protein; AAA ATPase
  Pfam annotation: Domain name=LRR_1; Domain location=505-527; Score =6.7; E_value=16; Accession=PF00560.23; Description=Leucine Rich Repeat
  Pfam annotation: Domain name=LRR_1; Domain location=529-551; Score =12.2; E_value=1.5; Accession=PF00560.23; Description=Leucine Rich Repeat
  Pfam annotation: Domain name=LRR_1; Domain location=577-599; Score =15.4; E_value=0.2; Accession=PF00560.23; Description=Leucine Rich Repeat
  Pfam annotation: Domain name=LRR_1; Domain location=601-622; Score =6.6; E_value=17; Accession=PF00560.23; Description=Leucine Rich Repeat
  Pfam annotation: Domain name=NB-ARC; Domain location=7-301; Score =55.5; E_value=7.9e-14; Accession=PF00931.13; Description=NB-ARC domain
  Pfam module annotation: Pfam domain module=LRR_1::LRR_1::LRR_1::LRR _1::NB-ARC; Domain location=505-527::529-551::577-599::601-622::7-301
MEETAQQVKRPFDVPEEPEFIVGLDAPLSELKMELLKEGVSIIVLTGLGGSGKTTLVTKLCWDELVIGKFKGNILFVTISKTPKLKIIIERLFEYYGCQVPAFQSDEDAVNHLGILLRKIDVSPMLLVLDDVWPGSEGFIEKVKVQISDYKILVTSRVAFPRFGTPFILKNLVHEDAMTLFRHHALLEKNSSNIPEEVVQKIVRHCKGLNLPLVIKVIGRSLSNRPYELWQKMVEQLSQGHSILDSNTELLTSFQKILDVLEDNPTIKECFMDLALFPEDQRIPVAALVDMWVELYGLDNDGIETVAIVNKLASMNLVNVLVTRKNTSDTDSYYYNNHFIILHDILRDFGIHQSNQEQVEQRKRLMIDITENKPEWWPREKQIPAQTLSISTDETCTSYSSHLQPAQAEVLILNLQTNQCTFPKLLKEMRKLKVLIVMHYGFHPSKMNNLELFGSLSHLKRIRFERIWVPPFVTLKNLKKLSLYLCNTRQAFGNRNMLISYAFPNLVDLNVDYCKDLVELPKGLCDITTLKMLSITNCHKLSALPQEIGNLDNLKLRRLSSCTDLEEIPNSIGKLSNLRHMDISNCINLPNLPENFGNLCNLRNLYMTSCARCELPPSIVNLKNLKEVVCDEETTVSWEAFKDMLPNLKIYVPQIDVNLNWLHEIHS

SEQ ID NO: 141888 - protein, 457 aa, Glycine max
  Coding DNA Sequence Number=SeqID_25110
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=57%, HitCoverage=46%, E-value=1e-81, Identity=50%"; Hit description =Receptor protein kinase like protein
  Pfam annotation: Domain name=Pkinase; Domain location=59-293; Score =102.3; E_value=1.4e-27; Accession=PF00069.15; Description=Protein kinase domain
  Pfam annotation: Domain name=Pkinase_Tyr; Domain location=59-293; Score=26.0; E_value=4.6e-14; Accession=PF07714.7; Description =Protein tyrosine kinase
  Pfam module annotation: Pfam domain module=Pkinase::Pkinase_Tyr; Domain location=59-293::59-293
QAFAVGVTSIVFVLIIGFGYVAFFVLRRRKTQEEVEDWELEYWPHRIGFHEIDAATRGFSEENVVAVGGTGKVYKGVLHGVEVAVKRIPQEREEGMREFLDEVSSLGRMKHRNLVGLRGWCKKEKGNLILVYDFMSNGSLDKWIFECEEGMMLTWEERIQVLKNVATGILYLHEGWEVKVLHRDIKANNVLLDKDMNARLGDFGLARMHDHQGQVVSTTRVIGTLGYIAPEVIQRGTAPIEEHKPGLIEWLMSLMVQGQLHSAVDERLKAKGGYTIEEDPSIRPTMRQVVKILEVEIDSIESDEDNMEMSLLGKIRSATTWSRVECALPYSGYPSFDEVKMFSFNSRTSRSGSNTTKHEDSKSEAQIKHHGFHQVQCTNLDQTLNETDNVAQDDTPLMKDGSRLFPKVVHSLPARIHKEELNAPIPLSATASNGTRRNGYEMVVVGDDGLCRRRCSV

SEQ ID NO: 141889 - protein, 69 aa, Glycine max
  Coding DNA Sequence Number=SeqID_25111
MTLLMKKIQALQACRPWIFFINGVLCFLKINDSGMQKEESVKKDSRREAELKQHAKREINPLSESSVSC

SEQ ID NO: 141890 - protein, 126 aa, Glycine max
  Coding DNA Sequence Number=SeqID_25112
MDVDADIIDFAKLGDDESFGAEDNSRSFCFNKIRVCAGLARGHAQRARALGEPQWLGPSGMKMTWMALLVRTSRWRKKRCGCVLVEFIERTMSEARASETKYAMATCTMVVMTRFEDLTKLWTQRE

SEQ ID NO: 141891 - protein, 171 aa, Glycine max
  Coding DNA Sequence Number=SeqID_25113
  Homolog annotation: Hit_ID=Q9SXL9; Match level="QueryCoverage=22%, HitCoverage=27%, E-value=2e-09, Identity=71%"; Hit description=Csf-1 protein
MAVFVQPFRFLIRTRSFTTHNFKIPKTLTLINHLRSILLKSIPTIKKIVNNNQSAPYDTTSHALCRNLASEMLHPSRVSSEFGLNALYDSVNGGGDVWINENCFRIPFKRYVKIGRVAQINYGKEYGRLIVIVDVIDQNKMLRPSERRVYGAGNSLSEREGHPSMILIGSR

SEQ ID NO: 141892 - protein, 98 aa, Glycine max
  Coding DNA Sequence Number=SeqID_25114
  Subcellular localization annotation: CTP_CleavageSite=30; ConfidenceScore=5.29e-01
MNPLLFSVTTTQVDIPSTCTTKDVPSNVLRQSSQAGKGRIKRILRLCPFEFFEKGEERHKRIQAVIDYQNHAIDYTKHFMKRCDSSQLNLNFNVQIHW

SEQ ID NO: 141893 - protein, 158 aa, Glycine max
  Coding DNA Sequence Number=SeqID_25115
MQENNTQCLCNFVNSTTLFQSLGGSKDEILKLPQACGINFDPSKCNNTGGGGSQVASTPSLARMLTHLRRAAAACGGATSDHFLALRQFSSAVVAVSSVSDSDPTLPSSSDSQRKASRWLLFLPGAITFGLGTWQIGRREEKGEGIGGRKGMMLIDTM

SEQ ID NO: 141894 - protein, 88 aa, Glycine max
  Coding DNA Sequence Number=SeqID_25116
MGKKPNARMHNYSPMLVKKYYLDSWKEIKHDTKHQTEEVKDRRDVAQCTGTTTMIGKRWAARHVGEATWGNGGAKSPKNQEMCHMSKF

SEQ ID NO: 141895 - protein, 791 aa, Glycine max
  Coding DNA Sequence Number=SeqID_25117
  Gene Ontology: Mol. function=protein serine/threonine kinase activity; Biological process=protein amino acid phosphorylation
  Homolog annotation: Hit_ID=Q9LVI5; Match level="QueryCoverage=87%, HitCoverage=51%, E-value=0.0, Identity=52%"; Hit description=IRE homolog; protein kinase-like protein
  Subcellular localization annotation: CTP_CleavageSite=51; ConfidenceScore=5.80e-01
MVFKGRFFSSKKSDSSSPDASSNSPRSFSSNSPSRSDKKKSKSAASQTLVAAAAGGSGGGGLASCRQTQVKDGTKKKDTVKGKESQTPPPESRKDSPAKKLTAAEGRESPSSSSVSPILASSLGLNRIKTRSGPLPQESFFGFRGEKGTAALGGSNLSRPGVSARAGDGKKKEVASQSRVGFHEGSVGSAAAGGWGDNGGNSDNVSTSGSLPSREQSPVVLPRSRLQNGESSSEAAGKQVSSRAQSGGLKSADVCTPETAYDFENPKESESPRFQAILRVTSAPRKRFPSDIKSFSHELNSKGVWPFPFSKPRRLNNLEEILVVIRAKFDKAKEDVNSDLAIFAADLVGILEKNADTHPEWQETIEDLLVLARSCAMTSSGEFWLQCESIVQELDDRRQEHPPGMLKQLHTRMLFILTRCTRLLQFHKESGLAEDEPVFNLRQSRVLHSAGKCIPPSVGRDTKSSSATKVLKPSSKKAFSQEQSMMGWKKDVMQPENLSIPADDDNAKHFNSSSGRNRMASWKKFPSPTGRSPKEAVQLKDQNYGRIESSKASNNKRFSSDVDTAKPSELHPVKDSLDHASKHQHKVSWGHWGDQQNNNSEENSIICRICEEDVPTSHVEDHSRICALADRCDQKGLSVNERLGRIAETLEKMMESCTQKDTQQMVGSPDVAKVSNSSMTEESDVPSPKLSDWSRRGSEDMLDCFPEADNSVFMDDLKGLPLMSCKTRFGPKSDQGMTTSSAGSMTPRSPLMTPRTSQIDLLLAGKGAYSEHDDLPQACHFLILFLRCFYF

SEQ ID NO: 141896 - protein, 117 aa, Glycine max
  Coding DNA Sequence Number=SeqID_25118
MSKNTLVVALEFKDDFDRYVSDLMVLLLSRAKIKEVRDTYPIAIQNSMYGSQIFVNTDMKEILEFKGSQILGSSVYSLADRFLHNAQVKCFDEPNQLKKDCMRVIVATISKLLVANR

SEQ ID NO: 141897 - protein, 95 aa, Glycine max
  Coding DNA Sequence Number=SeqID_25119
MAIGGEKSLSDPLSFTNVQHFWVRLETMRMSKLILGNTPSSDHGALRNFLDPHFVEGSCSHSYFVSSRENERPSEGTVMCQECKRPMKNFVVYQP

SEQ ID NO: 141898 - protein, 95 aa, Glycine max
  Coding DNA Sequence Number=SeqID_25120
MDVMRSGVVRTPHDGFSNHAGGEVGAPVRKNAPTCGFDFGVSNVDLLRWFLFDLKVGIPCGSLHCYVKGIVKVARNGEYIKEKGEESYDAIGCII

SEQ ID NO: 141899 - protein, 684 aa, Glycine max
  Coding DNA Sequence Number=SeqID_25121
  Gene Ontology: Mol. function=protein kinase activity; Cellular component=integral to membrane; Biological process=protein amino acid phosphorylation
  Homolog annotation: Hit_ID=Q8LD58; Match level="QueryCoverage=89%, HitCoverage=92%, E-value=1e-120, Identity=66%"; Hit description =Receptor kinase, putative
  Pfam annotation: Domain name=GRP; Domain location=280-369; Score= -23.6; E_value=0.02; Accession=PF07172.2; Description=Glycine rich protein family
  Pfam annotation: Domain name=LRRNT_2; Domain location=28-65; Score =38.9; E_value=1.7e-08; Accession=PF08263.3; Description=Leucine rich repeat N-terminal domain
  Pfam annotation: Domain name=LRR_1; Domain location=119-141; Score =10.3; E_value=3.4; Accession=PF00560.23; Description=Leucine Rich Repeat
  Pfam annotation: Domain name=LRR_1; Domain location=143-165; Score =14.6; E_value=0.35; Accession=PF00560.23; Description=Leucine Rich Repeat
  Pfam annotation: Domain name=LRR_1; Domain location=167-188; Score =14.8; E_value=0.32; Accession=PF00560.23; Description=Leucine Rich Repeat
  Pfam annotation: Domain name=LRR_1; Domain location=190-212; Score =6.2; E_value=20; Accession=PF00560.23; Description=Leucine Rich Repeat
  Pfam annotation: Domain name=LRR_1; Domain location=70-93; Score=2.8; E_value=87; Accession=PF00560.23; Description=Leucine Rich Repeat
  Pfam annotation: Domain name=LRR_1; Domain location=95-117; Score =12.9; E_value=1.1; Accession=PF00560.23; Description=Leucine Rich Repeat
  Pfam annotation: Domain name=Pkinase; Domain location=387-653; Score =108.5; E_value=2e-29; Accession=PF00069.15; Description=Protein kinase domain
  Pfam annotation: Domain name=Pkinase_Tyr; Domain location=386-653; Score=73.4; E_value=7.4e-19; Accession=PF07714.7; Description =Protein tyrosine kinase
  Pfam module annotation: Pfam domain module=GRP::LRRNT_2::LRR_1::LRR _1::LRR_1::LRR_1::LRR_1::LRR_1::Pkinase::Pkinase_Tyr; Domain location= 280-369::28-65::119-141::143-165::167-188::190-212::70-93::95 -117::387-653::386-653
  Subcellular localization annotation: CTP_CleavageSite=63; ConfidenceScore=5.49e-01
MQQHSQTLFATFTIIFFAFFFPSTFSDISSERAALLALRSAVRGRTLLWNATAPSPCAWPGVQCDVANASVVELHLPAVALSGELPAGVFPALKNLHTLSLRVNSLSGTLPADLSACTALRNLFLQQNHFSGEVPAFLSGMTGLVRLNLASNNFSGPIPARFGNLTRLRTLFLENNRFNGSLPSFEELNELAQFNVSYNMLNGTVPKKLQTFDEDSFLGNTLCGKPLAICPWDDGGGESGVNGSSNSSGVGGGEGSVIGGEKKKKGKLSGGAIAGIVVGSVVILLLVVFALILLCRSGDKTRSVDNVNNIVGLKEEQQLHGEVGIERGNVENGGGGGGGNSVVAAATAVAAVSGSRGGGGGGGGRGDKKLVFYGNKVKVFDLEDLLRASAEVLGKGTFGTTYKAVMEDGPVVAVKRLKDVTVSEKEFKEKIDVVGVMDHENLVPLRAYYYSRDEKLLVHDYMPMGSLSAILHGNKGAGRTPLNWEMRSSIALGAARGIEYLHSQGPSVSHGNIKSSNILLTKSYDARVSDFGLTHLVGSSSTPNRVAGYRAPEVTDPRKVSQKADVYSFGVLLLELLTGKAPTHALLNEEGVDLPRWVQSVVREEWSSEVFDIELLRYQNSEEEMVQLLQLAVDCVVPYPDNRPSMSQVRQRIEELRRPSMKEGTQDQIQQPDLINDIDDVSSR

SEQ ID NO: 141900 - protein, 84 aa, Glycine max
  Coding DNA Sequence Number=SeqID_25122
  Gene Ontology: Mol. function=RNA-directed DNA polymerase activity; Cellular component=chromatin; Biological process=RNA-dependent DNA replication
ALNAITVRDRFPIPTVDELLDELGGAVWFSKLDLMQGYHQILMNESNTSKTAFHTHHGHYEFRVMPFRLCNTPSSFQATMNRLF

SEQ ID NO: 141901 - protein, 76 aa, Glycine max
  Coding DNA Sequence Number=SeqID_25123
  Gene Ontology: Mol. function=DNA binding; Cellular component=nucleus
MFWNRQNIEKVSDPAVKSSNFTARSNVSPYAPPMITMDNDDGISYIAIGGPTGDLLEQNAQALNQISTNLSAFQVN

SEQ ID NO: 141902 - protein, 149 aa, Glycine max
  Coding DNA Sequence Number=SeqID_25124
MLLRKKVLPQERFPSCGRTFFRSNIWKNLLSRLCAEEPSSTTSHGRTFFHSYARSSSVNSYGRTSSVSSYTYGRTSSAINGWEGETNLNGREEAEKCSSKRPRTEKMKTRGGEQRSAAETEKMKTHRGEQRSAAERKGRRRTREKMLGA

SEQ ID NO: 141903 - protein, 161 aa, Glycine max
  Coding DNA Sequence Number=SeqID_25125
  Gene Ontology: Mol. function=DNA binding; Cellular component=nucleus; Biological process=regulation of transcription
  Homolog annotation: Hit_ID=Q0GYP2; Match level="QueryCoverage=51%, HitCoverage=20%, E-value=1e-30, Identity=81%"; Hit description=LEAFY- like protein
MASFSFAGGFDAVAFTDEEVPAKNLGEAVHHVVELLVLHQRAHREPELGDLRRHVVADAISLKELLQFSELARRRRPRGMEHRGWKLRSAKVCVWYCLGGDKGIKAVKGIRRTKRETIATQLRLSDGSEFRHRVHACEQGHDGVALGELAKKRKKEVERKS

SEQ ID NO: 141904 - protein, 464 aa, Glycine max
  Coding DNA Sequence Number=SeqID_25126
  Gene Ontology: Mol. function=RNA-directed DNA polymerase activity; Cellular component=chromatin; Biological process=chromatin assembly or disassembly
  Pfam annotation: Domain name=RVP_2; Domain location=266-373; Score= -63.8; E_value=0.093; Accession=PF08284.2; Description=Retroviral aspartyl protease
MAEATRSKTSVDCWEDAFAKLSASMTLKFDELLNCMNQLETLHTNPHVPPAFASPSSATTANSAYRLKLEVPRFDGSVLTDGYSRLHNSSNIMQQQTMIDLRFLRSTWKDPTGVLCKLTQCSIVSAYLSEFEALANRVIGLPASFVLSCFVSGLSPAIRRKVQVMQPHSLAQAVSFTRLHEEKLLDSHRPRPRSSTIPFKQLTPTELALRREQGLYFNCDEKYSRGHKCASSLFLFVTEEDEYAQEIDPRPLSPTLPPSSQDSSPAQISLHVLSGQGAPETLRVTSLIENHHVQILIDGGSTHNFLQQELELQFNQVCMDVSVQIQKHDLKVDFHVLPIRGADVVLGVQWLKSLGPVLTNYTTLTMKFIYDGKLIELTGDHYTTIDQISPSQLRRLVDTSNTSTYFHIQMEPHTTTSLPLVYPIPTIQKLITKYSSLFQPLLTLPPSRPTDHTITLLPNSANVN

SEQ ID NO: 141905 - protein, 123 aa, Glycine max
  Coding DNA Sequence Number=SeqID_25127
  Gene Ontology: Mol. function=DNA binding; Cellular component=nucleus; Biological process=regulation of transcription
  Homolog annotation: Hit_ID=Q0GYP2; Match level="QueryCoverage=49%, HitCoverage=15%, E-value=1e-21, Identity=84%"; Hit description=LEAFY- like protein
  Pfam annotation: Domain name=FLO_LFY; Domain location=1-121; Score= -261.4; E_value=0.078; Accession=PF01698.7; Description=Floricaula Leafy protein
MAAKITELGFTVSTLVKDEELDNMMNSLTQIFRWDLLIGERYGIKAACKAERRHVEDDNIKRLDIEDCRVQKKENSKRRKDDHNLTRKSKDKKIAYMPVENPPNVGLAPASALRIHLETCFCF

SEQ ID NO: 141906 - protein, 311 aa, Glycine max
  Coding DNA Sequence Number=SeqID_25128
  Gene Ontology: Mol. function=heat shock protein binding; Cellular component=chloroplast thylakoid membrane; Biological process =response to heat
  Homolog annotation: Hit_ID=P92424; Match level="QueryCoverage=77%, HitCoverage=48%, E-value=4e-73, Identity=51%"; Hit description=DnaJ homologue precursor
  Pfam annotation: Domain name=DnaJ; Domain location=67-128; Score =130.9; E_value=3.5e-36; Accession=PF00226.21; Description=DnaJ domain
  Pfam annotation: Domain name=DnaJ_CXXCXGXG; Domain location=201-285; Score=44.5; E_value=3e-10; Accession=PF00684.9; Description=DnaJ central domain (4 repeats)
  Pfam module annotation: Pfam domain module=DnaJ::DnaJ_CXXCXGXG; Domain location=67-128::201-285
  Subcellular localization annotation: CTP_CleavageSite=61; ConfidenceScore=5.81e-01
MPLIHTTPPLHYAISTLINAPSSSSSTLSAATFGSNFLRKIHNPIFRFSTARNRSRAAVVRAKAGTDYYSTLNVGPNATLQEIKASYRKLARKYHPDMNKSPGAEDKFKEISAAYEVLSDDEKRSLYDRFGESGLQGDNGGSTGAPGVDPFDLFDTFFGRSDGVFGVGDEGSFNFNFRNKRNHVHDIRYDLHLSFEESIFGGQREIEVSCFQTCNMCDGTGAKSKNCIKQCTNCGGRGGEMKTQRTPFGMMSQVSTCSKCGGLGKIITDQCRRCDGSGQVQSKQTMEVEIPPGVNDGDTMQIQGQGNFDKK

SEQ ID NO: 141907 - protein, 86 aa, Glycine max
  Coding DNA Sequence Number=SeqID_25129
MPHPHNSTIITSNNTLYYNFKANITTNPNNKVIVHYAKIEAIASCKGSDFGLVSLAPFDQQGHNKNTTFPQVVFEWHSVRNFIIPN

SEQ ID NO: 141908 - protein, 99 aa, Glycine max
  Coding DNA Sequence Number=SeqID_25130
MTNARMICPLRCHEEMHDAIKENARSYAQEHKRNKGKPTKGKVMILHKIRRPNSLKIVPSGVSNCCDLPSGGGAKRPLKRAKGASSVEGKRVESPPTFI

SEQ ID NO: 141909 - protein, 61 aa, Glycine max
  Coding DNA Sequence Number=SeqID_25131
MGKVDNVQERIKANLEAMKEQIATMMQTLSWPAREAFSRPRRRAGRNSDDWMLLIKMVERC

SEQ ID NO: 141910 - protein, 131 aa, Glycine max
  Coding DNA Sequence Number=SeqID_25132
MRKRIPSKKIVKKENHFATKGDIKRALLLKQSFYHLLSRETSLSTAIPLELEVIPQVKDLLDEDLVRKSLIPCALARLTGALSKGGKMRGVATNEGISTSHVDKSGAFAPTYPPLERKSDLRSSFLCVNQV

SEQ ID NO: 141911 - protein, 75 aa, Glycine max
  Coding DNA Sequence Number=SeqID_25133
MSVSTSSASVSRARVSLLLRALLQISSGLRLHGPEIGLRPRQGRRPAEAPGDAEEARMDEEMTDLLGFLGGSGAT

SEQ ID NO: 141912 - protein, 80 aa, Glycine max
  Coding DNA Sequence Number=SeqID_25134
GAQPIDEEGNLHGGEDSSLLQKILDRFDGLQTFVGERFDTLELQVDMRFDEMESRITKVKEDVSYIRTSFDLPPPPPPSS

SEQ ID NO: 141913 - protein, 110 aa, Glycine max
  Coding DNA Sequence Number=SeqID_25135
  Homolog annotation: Hit_ID=Q1SKA6; Match level="QueryCoverage=55%, HitCoverage=7%, E-value=8e-10, Identity=50%"; Hit description =Rad21/Rec8 like protein, C-terminal; Rad21/Rec8 like protein, N- terminal
IFYKKVEYVLEDCNEVLVKINKFVVNKEGLVCVETLCMPVTKPERFELDAFELDEPEDAGRYIVRKSIKSAKDIVRFPFQQNATILYLLHTVYRGRENLPLLTVHYVSLI

SEQ ID NO: 141914 - protein, 42 aa, Glycine max
  Coding DNA Sequence Number=SeqID_25136
EKWARLVKYKIYELVEPRHVLGEPSTKRTILRLSTQKNLEEG

SEQ ID NO: 141915 - protein, 63 aa, Glycine max
  Coding DNA Sequence Number=SeqID_25137
MVTPRNKDKDDECNPRGVTTRAQEQKPLGFKVGKVHVAYPTAEFERNCRFFNIQHSTLVLNKC

SEQ ID NO: 141916 - protein, 147 aa, Glycine max
  Coding DNA Sequence Number=SeqID_25138
MQRLQVVAPPGTILTVEQFMEKVAWPRTQPSLIEGRWRSQCSEATIPEPFVFKAGGTQVRQEVATPERSPQISPDPPSPVVDQSSPQQLADPPTQVHEMSTDPSTPLLEIPEDPATPVLGLTTTPPTTPVLHFIDETTQDQDTQQND

SEQ ID NO: 141917 - protein, 782 aa, Glycine max
  Coding DNA Sequence Number=SeqID_25139
  Gene Ontology: Mol. function=nucleic acid binding; Cellular component= chromatin; Biological process=DNA integration
  Homolog annotation: Hit_ID=Q1T010; Match level="QueryCoverage=98%, HitCoverage=56%, E-value=0.0, Identity=44%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=525-688; Score =157.8; E_value=2.8e-44; Accession=PF00665.16; Description=Integrase core domain
  Pfam annotation: Domain name=zf-CCHC; Domain location=285-302; Score =24.9; E_value=7.7e-05; Accession=PF00098.13; Description=Zinc knuckle
  Pfam module annotation: Pfam domain module=rve::zf-CCHC; Domain location=525-688::285-302
MASNGPFPLNLPILTGKNFNRWSVQMKVLLGFQDLTGVIENGIEIPKEGASDLQKTEFKDLKKKDCKALVILHQCVDDSHFEKIENAKSAKEAWDILNKAYAGADKIKKVRLQTLRRQFELLQMEETESIGDYFGRLQVLANSITSCGDTITNLTLVEKVLRTLNPRFNHIVVAIEESKDLESLSVDELQRSLEAHEQRLQERANDKATEQALQAHHQSRNGGSDNRRGKKGRGRFQNTRGRGGYSKDKGKPQPDQRSGDNCSKRSGGSGTRGRGGKKKWDKRNVECFNCGKRGHYAEECWYKEKNADDEAQLATGAVSDTEPVLLMVITKTGADAKDQWYLDTGCSTHMTGHKDWFVSLDESVNHKVRFADDSTIRVEGHGKVVIKRRDGTVSYIEDVLYVPNMRCNLLSLGQLLDKKYRMVMEDKEMKIYDKDKRLIIKAPFNRNRTFKVGIQVMKHNCLQAETCREEWLWQYRFGPLNFKDLSQLHRMAQGIPHLRQMTDNCRECLECKQPRNAFQKFVPVKSTHKLEVIYSNVCGPLQVESLGGNKYFVTFIDDLTRMTWIYIIKKKNEVPIIFKKYKASVEKCSGHCIKTLRTNGGGEYTSKEFAEFCDEAGITHEFTPPYTPQHNGAVERRNRTILNMVRSMLKTKKLPHFLWSEAAATTVYILNKCPTKRLKGVTPEEAWTGTKPKVNQLRIFGSFCYKHVPEQLRQKLDDKGEQMILIGYHATRGYKLLDPRTKQVSVSRDVIFDELKEYEWKEDPINNTTKILVDSFIPRRIE

SEQ ID NO: 141918 - protein, 866 aa, Glycine max
  Coding DNA Sequence Number=SeqID_25140
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=84%, HitCoverage=22%, E-value=2e-98, Identity=53%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=Hin1; Domain location=720-827; Score =2.5; E_value=0.00095; Accession=PF07320.4; Description=Harpin -induced protein 1 (Hin1)
  Pfam module annotation: Pfam domain module=Hin1::RVT_2; Domain location=720-827::248-392
EYESDLVILCLYVDDLLITGNNKVEIDKIKQLLKNQFEMTDLGSLSYFLGIEFKETEAGIVMHQSKYATDLLKKFRMTNCNAAATPAETGLALSLRDEGEPVDETQYRQIVGSLRYLCNTRPDLAFSVGLISRLMQTPKTPHMMATKRILRYIRGTINYGILLPNTITSSNMELLGYTDSNWIRDNDDRKSTAGYIFLLGDALVSWSSKKQDLIALSTCEVEYIAASMCLCQGLWLRKLLKEMKIQKNEAINILVNNKSAISLAKNPIDHGRSKHIETRYHFIRDKIGFSKCISEHGVYVKGEYESDLVILCLYVDDLLITGNNKVEIDKIKQLLKNQFEMTDLGSLSYFLGIEFKETEAAIVMHQSKYATDLLKKFRMTNCNAAATPAETGLALSLRDEGEPVDETQYRQIVGSLRYLCNTRPDLAFSVGLISRFMQTPKTPHMMATKRILRYIRGTINYGILLPNTITSSNMELLGYTDSNWIRDNDDRKSTAGYIFLLGDALVSWSSKKQDLIALSTCEVEYIAASMCSCQGLWLRKLLKEMKIQKTEAINILVNNKSAISLAKNPIDHGRSKHIETRYHFIRDKIGFSKCISEHGVYVKGEYESDLVILCLYVDDLLITGNNKVEIDKIKQLLKNQFEMTDLGSLSYFLGIEFKETEAAIVMHQSKYATDLLKKFRMTNCNAAATPAETGLALSLRDEGEPVDETQYRQIVGSLRYLCNTRPDLAFSVGLISRRIKAIAWYKDNDFGWVSLTPFDQGHKNTTFLQAVFEGQRVIKLKPKQLGEYKDETSVGIYEDLAVDFDLRIKANFGRFKSSRFDPPVVQCRRLKVPLISNGKTAPPFSVTKCKIDGSFFADRDSQAEAR

SEQ ID NO: 141919 - protein, 109 aa, Glycine max
  Coding DNA Sequence Number=SeqID_25141
  Gene Ontology: Mol. function=nucleic acid binding; Biological process= DNA integration
  Homolog annotation: Hit_ID=Q1S4N1; Match level="QueryCoverage=72%, HitCoverage=6%, E-value=3e-18, Identity=60%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MGHEVVICINWNQPHNEAAKAAEAEEEYSFVATCFSSIKSSQNWLIDNSCTNHMTNNKDLFKELSNISTLMVLVGDDKFIAVNANVTIAISTNIGTKLISDVLYVLEID

SEQ ID NO: 141920 - protein, 249 aa, Glycine max
  Coding DNA Sequence Number=SeqID_25142
  Gene Ontology: Mol. function=nucleic acid binding; Cellular component= nucleus
  Homolog annotation: Hit_ID=Q2QNI2; Match level="QueryCoverage=67%, HitCoverage=14%, E-value=2e-44, Identity=56%"; Hit description=Zinc knuckle family protein, putative, expressed
  Subcellular localization annotation: CTP_CleavageSite=68; ConfidenceScore=5.80e-01
EQVRLCSHFSGFGASCSSKKTASAAATSASSPAAPTRSENSSTTSAAPSSSPVSSTSKSAPTSIPRTTSSAPSNALLKVDVPLVFRGEDALGYGRALSEHILLDAGLIPSTKVSKDRTWDDATVQALVQAVVRLEDWMQDVILGELVPEGYILMQNKNLGKDSSISQPRSVSQMYDEFCPILLNQFKSKDYTKFETFDAALDEFYGKIESQRSEQQQKAKENLASQKLNKIRQDQAAKFLDDATFSEGR

SEQ ID NO: 141921 - protein, 279 aa, Glycine max
  Coding DNA Sequence Number=SeqID_25143
  Homolog annotation: Hit_ID=Q1S6N9; Match level="QueryCoverage=46%, HitCoverage=12%, E-value=2e-36, Identity=50%"; Hit description =Integrase, catalytic region; Zinc finger, CCHC-type; Peptidase aspartic, catalytic
  Pfam annotation: Domain name=Hin1; Domain location=1-107; Score=38.9; E_value=1.8e-08; Accession=PF07320.4; Description=Harpin-induced protein 1 (Hin1)
FHVTDASLTQFNLRSNNTLDYNLKVSITVRNPNNNIIVYYGRITSIAWYKDNDFSWVSLTPFGQCRKNTTFLQAVFEGKSVIKHKSKELANYGKYGSSSFNSPIVQCCGLRVPFIFNGKSTPPFGVTKCNTGSFFGLGTYEIDVESSFSQIAHRVFDEERYDLWKVNMKSYMKSFDLWDAVKENYKMPSLPKHSTMAQIKYHNEKKTKKEEYEGDKHVCGMQVPNLMKEFEMQKMKESKTIKWYSDRLLDIANKVTLPSTTFANSRIVEKDSSYIDGEI

SEQ ID NO: 141922 - protein, 141 aa, Glycine max
  Coding DNA Sequence Number=SeqID_25144
MRPANVPFINLSNVDLQLSAENSARRCDSKDRGSVYNPILGICCHFCRFTVWWYMLYIRIGFDNDFQQERLIVLSVTLALVFFVEPVSRFDMVKFNMPEERKMPPTGIAVYRVADLLMEELKNLEDVRSRLDVINSYFLTW

SEQ ID NO: 141923 - protein, 131 aa, Glycine max
  Coding DNA Sequence Number=SeqID_25145
MGKTTTLDAYYKRQRDEAPQVASNPSTLPSSSQEQQFKGPRIEEVDISSLKKDSGKRLSIWKYQTISDVSSIGACRPRIFFINEFLCFLENDNGMEKEERKEMPLQGEDDSRRSSPLYEAMDKSLEEEGDE

SEQ ID NO: 141924 - protein, 264 aa, Glycine max
  Coding DNA Sequence Number=SeqID_25146
  Gene Ontology: Mol. function=protein serine/threonine kinase activity; Cellular component=membrane; Biological process=protein amino acid phosphorylation
  Homolog annotation: Hit_ID=Q240Y9; Match level="QueryCoverage=78%, HitCoverage=33%, E-value=7e-12, Identity=30%"; Hit description =Protein kinase domain containing protein
  Pfam annotation: Domain name=Pkinase; Domain location=56-264; Score= -38.7; E_value=2.9e-06; Accession=PF00069.15; Description=Protein kinase domain
  Pfam annotation: Domain name=Pkinase_Tyr; Domain location=52-240; Score=-106.1; E_value=5.8e-06; Accession=PF07714.7; Description =Protein tyrosine kinase
  Pfam module annotation: Pfam domain module=Pkinase::Pkinase_Tyr; Domain location=56-264::52-240
MNIIDFSKLILSLGACLDKLYGVIECLTTWIPGSPGPDYSFPSLTTCDELETKASTTLVKCKFGSVEAATKVRTLEEQGSLADKIKNFEYNCLREIRILGALKHPCIVEMYGHQISCQWFVSADGNPKHRVLRSAIFMEYVEGGSLKNYLEKLLEAGEKHVPVELALHIAKDVSFALSELHSKHIIHRDIKSENILFDLGRKRDDGTPTVKLYDFDSAVPLRSTLHVCCIAHAGTRPPCICVGTPRWMAPKVMRTMYKKNPMDW

SEQ ID NO: 141925 - protein, 158 aa, Glycine max
  Coding DNA Sequence Number=SeqID_25147
  Gene Ontology: Mol. function=protein serine/threonine kinase activity; Biological process=protein amino acid phosphorylation
KISFCGIEDHLSDDFYDAGQDRLFMPVECYEQNHCLASREVILLDRKIDEELDAVMLAAQALMASLLALFVSDHFGGSDRSGIVERTRKSVSGSNYNKPFVCTCSAGSSTSISSPTEPVANTIEDITLSKMRAKARLTGALSKGGKMRGVATNVYLWK

SEQ ID NO: 141926 - protein, 123 aa, Glycine max
  Coding DNA Sequence Number=SeqID_25148
MARSPLSCLSFVLRKYFFEPGNSFSKTLPSFRFEQILVIPFIINLTAFPNFATVLREPKLSLTDPISYQTLRKNHPLSDLQCRKDKQFRLLGNGTVLQSGTTERRWFQNHKVTPNTQKPGNRR

SEQ ID NO: 141927 - protein, 81 aa, Glycine max
  Coding DNA Sequence Number=SeqID_25149
MTSNNPNVPTLLRYVVGVVVEVIERKTVNPTYRVTIKLRDNRLDVGMSFYAGGLSNQGSVSQSQYSQYSQRSSMDKFLHNA

SEQ ID NO: 141928 - protein, 176 aa, Glycine max
  Coding DNA Sequence Number=SeqID_25150
MGSSLSTEVLFAYNGSSYIVKVRKADNKYFFADGLKEFRKVLNIQEGIVITYAAPERYWIFNLHFMLPLDNQTCGSHPTTRRTHVWMVKLTEAMISTPRPLVLPMHALSYLGVSRKNMTVLVNDGHTLLWKLTLHDAENRLQCVAESWYQYLRHNDFSVGDEICLYFREIVSTMDS

SEQ ID NO: 141929 - protein, 103 aa, Glycine max
  Coding DNA Sequence Number=SeqID_25151
MECVLADVLRDQRNLSNKGDGGWKRSALNVVAAVLSTSFNVNVTSDNVKNHIKLWRSWYGISHKSAKPFRFKVLQNWEDIVDLCAKDRVTGHGAEIAMMLMKR

SEQ ID NO: 141930 - protein, 86 aa, Glycine max
  Coding DNA Sequence Number=SeqID_25152
MAKERTTNGVGIDHGCDLEAFRPCFLFFLLLSGPLDFRELQEPLTSAFLGLFIAKQATWNEGSSPRRADNFILKQIARLGELVTSS

SEQ ID NO: 141931 - protein, 171 aa, Glycine max
  Coding DNA Sequence Number=SeqID_25153
  Subcellular localization annotation: CTP_CleavageSite=53; ConfidenceScore=5.31e-01
MVTPRRSPPQSDDNTKPQPKKTRQSTRLRRLTLRTREKIPIVHSNWKNVPKTLKDMVWGEILAKFDIPEAEKAQEKGKQIENASVKYGMDKQTWDKFVASRKTPDWQDSLEEQTTQGSFVPYGRDDILNTAIVKPEHPSRVRAAGSGMTLTQFYGRATRTSSSSSATLMQQ

SEQ ID NO: 141932 - protein, 243 aa, Glycine max
  Coding DNA Sequence Number=SeqID_25154
  Gene Ontology: Mol. function=ionotropic glutamate receptor activity; Cellular component=integral to membrane; Biological process=ion transport
  Homolog annotation: Hit_ID=Q8GXJ4; Match level="QueryCoverage=92%, HitCoverage=23%, E-value=5e-75, Identity=58%"; Hit description =Glutamate receptor 3.4 precursor
MQRLKTKDTPSFNSYALYAYETVWLVARALDAFVKKGGVVSFSFDPTLLETNGSMLHLHLLRVFDDGPLFLETILSTNFSGLTGTAHFDIERNRNHPAYDMLNIGRSGMRKIGYWSNYSGLSVVTPEILYKKPVNTSTSSQQLYGVIWPGETAAKPRGWVFPNNGKPLIIAVPNRVSYKEFVSNDNNPPGVTGYCIFLEAAINLVPYPVPREYILFRPGNRNPSYDDLASQVALNGWLRSLQT

SEQ ID NO: 141933 - protein, 117 aa, Glycine max
  Coding DNA Sequence Number=SeqID_25155
MTKARQKGVRKENRGEACHPARPGELGCFLQKQPPSGGIFWKAQVGLNFMNCLTMGAKYLEVAKRGLHPNNGWSPDEIRGTKDKTLISFERNTIQPVNLPASGTCKNLKMISTDTSS

SEQ ID NO: 141934 - protein, 202 aa, Glycine max
  Coding DNA Sequence Number=SeqID_25156
  Gene Ontology: Mol. function=nucleic acid binding; Biological process= aromatic amino acid family biosynthetic process
  Homolog annotation: Hit_ID=Q1S567; Match level="QueryCoverage=77%, HitCoverage=31%, E-value=6e-48, Identity=61%"; Hit description =Contains similarity to RNA-binding protein from Arabidopsis thaliana gi|2129727 and ...
  Homolog annotation: Hit description=contains RNA recognition PF|00076 domain
MSGRAGRRGIDERGICILMVDEKMEPSTAKNMVKGVADSLNRFCQIMVYSSILLEILMILKLRKQIEFEPEYLVEFDNPDIDEKEPIPLRDALEKAKPFLMSYEGIQSQEVWEKTMEETMARVPLLKKIVDHYSGPDRVTTKKRQEELDRVAKTLPESAPSSVEQFTNRSVISLQLFPSCVDNLFISISANDVLLLAHAVQC

SEQ ID NO: 141935 - protein, 321 aa, Glycine max
  Coding DNA Sequence Number=SeqID_25157
  Homolog annotation: Hit_ID=O22300; Match level="QueryCoverage=21%, HitCoverage=15%, E-value=2e-23, Identity=75%"; Hit description =Homeobox protein knotted-1-like LET12
  Subcellular localization annotation: CTP_CleavageSite=71; ConfidenceScore=5.02e-01
ARVYRGFRFVPSSLLQQWRNLGEVVALPPVPFPAPLPPPTPVPPLARAPFLGPVLPRAPYRLPPPPPLPPAAAALPRRGAEEYRDCAEGIAILEIAPKLPQLQPSPAEISFYGVSPGEGMGATTSDDEDEQVDSDANLFDGALDGPDSMGFGPLIPTENERSLMERVRHEVKHELKQPALTVIRDKESKCLLVFIRGTQSLKYTLTDAIGAPVSFNHFICNDDGELKRNNKVAGHGHRGMVAAARWIKKHCTTILLEDLRRHPPISKSRYCGVPNLAMVESVDNQKVANHLDRMVSTLGRNPLKVLVQVSSLPLGVRKILA

SEQ ID NO: 141936 - protein, 208 aa, Glycine max
  Coding DNA Sequence Number=SeqID_25158
  Gene Ontology: Mol. function=transferase activity, transferring hexosyl groups; Biological process=carbohydrate biosynthetic process
  Homolog annotation: Hit_ID=Q5BMA3; Match level="QueryCoverage=99%, HitCoverage=41%, E-value=1e-66, Identity=50%"; Hit description =Secondary cell wall-related glycosyltransferase family 8
WIWGGSDPRYMSNVATDWDDILKIIEKLIGEDEVEGVGLVNFNKTELAQWEHLIPEATHVVLPLEYAARNVTWESLYPQWIDEEEETQVPVCPSLPSLRNGGNWSIDVARLHLQLAAAALATFFKGNYPVHLPIGSCELALPMRGKELVYNGNAPREAYATILHSAHVYVCGAIAVAQSIRKSGSTRDLVILVDETISSYHRSGLEAA

SEQ ID NO: 141937 - protein, 102 aa, Glycine max
  Coding DNA Sequence Number=SeqID_25159
MTDKIFQEWDDLLNWIRCVRKEHMFVIVVHKSKRFSQLDVSGKITLKTKVRELVFSDTTSMCPPATKIKTKGAPKYLKSIKCEPSMWECVDEMNTMVGSLRM

SEQ ID NO: 141938 - protein, 112 aa, Glycine max
  Coding DNA Sequence Number=SeqID_25160
MENMKMNKDERFAQKGVPIHSQVMKIRQESEKIVDWSPGKPEIRPVLREISRQISRSPLGISGRPISVAFIFWFDMFYQVDIGRVWGIGFEGSSILNGLVIYLERGLKEEEK

SEQ ID NO: 141939 - protein, 179 aa, Glycine max
  Coding DNA Sequence Number=SeqID_25161
MAMTMGAKSKPHMTIGARLEAHMRQREKKVGAWLEEGEREDKGRKELKQRRRGCAEEEGGFVERGKRERKKEEKVDKKERRIGASIKVSETDTPSRIPHPMGQKGSQEEDQREMSILFYTGIGLSCYERDNEGNKCCPKKITETVEMDDITKLHDILMKLTSNMTKEECSKQKITCNYI

SEQ ID NO: 141940 - protein, 101 aa, Glycine max
  Coding DNA Sequence Number=SeqID_25162
MSRMVGVRLVCSWNGISVNEGFGMVTMVFLKVLISDFGWDNIRWSSICGACLRCCLCSVRGLIAGAICRWSFVRSQNQGIVVYVEKLSSQQGECKFWVRME

SEQ ID NO: 141941 - protein, 180 aa, Glycine max
  Coding DNA Sequence Number=SeqID_25163
PLEEKEHVISSMTENVSQFVRLIVKECINCIPAMFDCDSLVAKKLMARASSTEKLGSRQICPKFGGDTGGLSVHPLLSVASARQKNQAEHRYWPHAKREISVLSATVVFSQAQRTTGAKLKSTYSCYARRIPEHTIVPFFEKRVLEAARGATFAEIPRGVQIAIKPTWAFQDVLTEGGAF

SEQ ID NO: 141942 - protein, 90 aa, Glycine max
  Coding DNA Sequence Number=SeqID_25164
MASPPQNSDLTFPAADIAGELNPGRNTHVHVDSKSSEVAASKEQAEAKQKKNERQKKDALQTIKSAILISGIVVAVSGAAFAITKKLREK

SEQ ID NO: 141943 - protein, 85 aa, Glycine max
  Coding DNA Sequence Number=SeqID_25165
MALNEKLGASGNEKEQLTSDDDVGVILRRKAARELRLRFHGGGGGVTLRRKESVDRARGADSLEARGKQHVLTARGSKEFEARLG

SEQ ID NO: 141944 - protein, 134 aa, Glycine max
  Coding DNA Sequence Number=SeqID_25166
  Gene Ontology: Mol. function=ATPase activity, coupled to transmembrane movement of substances; Cellular component=integral to membrane; Biological process=transport
  Homolog annotation: Hit_ID=Q9LZB8; Match level="QueryCoverage=99%, HitCoverage=20%, E-value=5e-47, Identity=73%"; Hit description=ABC2 homolog 12
  Pfam annotation: Domain name=ABC_tran; Domain location=1-108; Score =40.8; E_value=4.2e-11; Accession=PF00005.17; Description=ABC transporter
MDRVKHAAQTAHADEFIKKLPEGYKTNIGPRGSTLSGGQRQRLAIARAFYQNSSILILDEATSSLDSKSELLVRQAVERLMQNRTVLVISHRLETVMMAKRVFLLDNGKLKELPQSTLLDGHHKDSLLSSGLVI

SEQ ID NO: 141945 - protein, 88 aa, Glycine max
  Coding DNA Sequence Number=SeqID_25167
  Homolog annotation: Hit_ID=Q10SS1; Match level="QueryCoverage=78%, HitCoverage=10%, E-value=5e-16, Identity=61%"; Hit description =Expressed protein
MTFHLVLPKVRYALQWESKNLIAVSTAIQDWLTSRLAMELMKRGAMMTVLSSLLTALAWQAALLAATDFINSKWTIAINRCIISPYSV

SEQ ID NO: 141946 - protein, 158 aa, Glycine max
  Coding DNA Sequence Number=SeqID_25168
MKTPDEAMDLIESMAASDIAILRDRAHIPTKKSLLELTSQDALLAQNKLLSKQLEALTETLSKLPTQIHFAQPSHSSILQGINPEAISIQVDFQDFRTTSSINNIDSGKITLVGQLAKQLAERPSNSFTANTEKNRKEKCKVVTTRIRMAIQAEESRA

SEQ ID NO: 141947 - protein, 177 aa, Glycine max
  Coding DNA Sequence Number=SeqID_25169
MELLLLRAGLREEERTSIARFPGGLNMEVRVKVKLLPYRDLDDLVQLCIREEQQLKRKPTSKSYGSHSYPKKDQGQGILGAPPSKPKDDKGKTIEKQPPKASMQEKTSSIKCKTSHACTHVDTQASSFYGHVTLGLRIHFSYLSQPNVSKICSFINLCIHPSPFWVFGKIFIAFTLQ

SEQ ID NO: 141948 - protein, 79 aa, Glycine max
  Coding DNA Sequence Number=SeqID_25170
MAWCKLSTPVDEGGLGLRSLKSINQVALLKQAWAVNEIKEVIIPCIPCIDHPIWCPAALGESFFKVANDFVRESSSKVS

SEQ ID NO: 141949 - protein, 134 aa, Glycine max
  Coding DNA Sequence Number=SeqID_25171
MWVFLTGRQIDWAHLVRYHMHKALQSNAPLPYPHLITLFLQHFNVPLNSKPFVKVKRSFSISANVVSSFGYRKERDDSWVKKDAPVLAVEDRSPSLHSQRDDSSSLMHNILDRFDGLQTYVGERFDSLERQVDS

SEQ ID NO: 141950 - protein, 188 aa, Glycine max
  Coding DNA Sequence Number=SeqID_25172
LVINYQRPPQCSSPLSKPGNRLHPLVIDYQKPSWLPDLIFKPGNRLHPVELACLGTSQVLTDRLCPGWVGIGQAWFWAIAPHLTAPRSPDPRDISPGGGPGRWCTTSFPHPQCAHKPTHPPYCPPPTELTYSPRSPHILRFSQHRVPINPSQASTTSKQNNIQTAQAIIAQAKQSKGRKLCSTHQQKS

SEQ ID NO: 141951 - protein, 263 aa, Glycine max
  Coding DNA Sequence Number=SeqID_25173
  Gene Ontology: Mol. function=zinc ion binding; Cellular component =cellulose and pectin-containing cell wall
  Homolog annotation: Hit_ID=Q653G1; Match level="QueryCoverage=79%, HitCoverage=35%, E-value=4e-41, Identity=40%"; Hit description =Dehydration-responsive protein-like
  Pfam annotation: Domain name=DUF248; Domain location=3-263; Score= -76.1; E_value=3.4e-21; Accession=PF03141.7; Description=Putative methyltransferase
MWKQQLSTSIKPWTSQRTNAQSVCMDAGDAKRGGMLGSTCNVWDLNPTLEVWDGILLKELNRLLRFNGYFVYSAPPAYRKDKDYPVIWDKLMNLTTAMCWRLIARQVQTAIWIKENNQSCLLHNVEQKHINLCDAADDFKPSWNIQLKNCVLVRNSKTDSYKLPPSHERHSVFSENLNTIGINRNEFTSDTVFWQEQIGHYWRLMNIGETEIRNVMDMNAYCGGFAVALNKFPVWILNVVPASMKNTLSGIYARGLIGIYHDW

SEQ ID NO: 141952 - protein, 76 aa, Glycine max
  Coding DNA Sequence Number=SeqID_25174
MEKSDKMNFKEKKEKKGYITWEDNAINYSSDSEKKIISLDIMMKDYENGEEQSRYIDSNFSKHMACIKVYSFFSPR

SEQ ID NO: 141953 - protein, 76 aa, Glycine max
  Coding DNA Sequence Number=SeqID_25175
MVLGIGHKVGGGGGKCNTRPRFTPLPCLPAHTLLVLRLWKKSFQAYFDNAKDSSQESRYKQVSRIKESFNQESKFK

SEQ ID NO: 141954 - protein, 74 aa, Glycine max
  Coding DNA Sequence Number=SeqID_25176
MRKLIKVRMENKVVNFVGLNQVVLGIKWMNGMVDFLELWFERTRVKMKGRKESLFPARATYKGCESPLIQPGCS

SEQ ID NO: 141955 - protein, 169 aa, Glycine max
  Coding DNA Sequence Number=SeqID_25177
  Subcellular localization annotation: CTP_CleavageSite=41; ConfidenceScore=5.08e-01
MEESSKKRKGSSSTITVAGHRRHKPSEAPTTPIHPSLSSPRSSTLFSSDDQYLRYLSQFSFRIILDPKYLDIDFFNDETFDCYQVFQNSGLVDFMSLKLPYYPELVKVFYSNLKIQEDIISSKVHVISMIIDQSLFFSLTKLPSHGAPFEGTIVDDWKFDYSSHDARRM

SEQ ID NO: 141956 - protein, 271 aa, Glycine max
  Coding DNA Sequence Number=SeqID_25178
  Gene Ontology: Mol. function=sequence-specific DNA binding; Cellular component=exocyst; Biological process=exocytosis
  Homolog annotation: Hit_ID=Q9FFX6; Match level="QueryCoverage=99%, HitCoverage=37%, E-value=2e-41, Identity=37%"; Hit description =Putative leucine zipper protein
MKRYETNEAKLGENAEEKSSFLECVNRISKLMKHFSEYAQSHQEEDQEENKDKVKGKTDLIINGLGALQQRAMSFLEDEFRSLMEESRNQAKPAEQNQNQKGKQQQVAESSEPESPAEMVTDFPGLPEETVTKLSKIAKEMITGGYGKECCHVYALSRRHAFEDGMHKLLGYEKLSIDEVQKMQWEPLEREIPLWINTWKECTSVWFPGEWRLAESVFGEEKEQDSSLSTNNIAASLFANLSRGIMIQLLNFAESVAMTKRASEKLFKFLD

SEQ ID NO: 141957 - protein, 75 aa, Glycine max
  Coding DNA Sequence Number=SeqID_25179
KVTKEEGTQPSRPAAPLRCSTKWAPIETRPSRLHKTQAAAELEQPMADYSRSASATQRDGMGLFSPNSHWRSLDS

SEQ ID NO: 141958 - protein, 330 aa, Glycine max
  Coding DNA Sequence Number=SeqID_25180
MSKITGLHEAMSRLDEAWSGADESRNLSREQLIAVNDAIGLLQRRLDALHTDVAADIARESRPELGPDSLAKQQGFRTPAKLIAATTGVSTGEAMRLVAVGEATAPRTDLIGAQLPARYPVVREALASGALGAQSAALIIGLLDRCRIAAGADRINEGERMLTAAAEGLALDDVRKLIIRAEAWLDPDGVEPRGDEQRARRSLTIFERNGMVHVNAQLDAETAAPVVTAIRGYVSAAFAARVDAPDKDAPDADRRTVPMLQADALAVFCAHVLGCDRRVPLAGATVVVRINLSDLETGTGSATVDGIDQPVSAGVARRMAADGGVIPCVL

SEQ ID NO: 141959 - protein, 114 aa, Glycine max
  Coding DNA Sequence Number=SeqID_25181
  Homolog annotation: Hit_ID=Q1H441; Match level="QueryCoverage=84%, HitCoverage=7%, E-value=7e-41, Identity=85%"; Hit description=FAD linked oxidase-like protein
MNAPVNADLLKHDSTPLTRLREIPYNYTSFSDREIVIRFLGEEVWGILNILRAERKTGRSARMLFEVLGDLWVVSRNPYLQDDLLENPKRRKALIEALYHRISAINERSGGNDK

SEQ ID NO: 141960 - protein, 89 aa, Glycine max
  Coding DNA Sequence Number=SeqID_25182
  Gene Ontology: Mol. function=electron carrier activity; Cellular component=integral to membrane; Biological process=electron transport
  Homolog annotation: Hit_ID=Q3SG72; Match level="QueryCoverage=80%, HitCoverage=43%, E-value=1e-21, Identity=63%"; Hit description =Putative thioredoxin precursor
  Pfam annotation: Domain name=AhpC-TSA; Domain location=1-87; Score =15.7; E_value=2.7e-05; Accession=PF00578.11; Description=AhpCTSA family
  Pfam annotation: Domain name=Redoxin; Domain location=3-89; Score= -12.3; E_value=0.034; Accession=PF08534.1; Description=Redoxin
  Pfam module annotation: Pfam domain module=AhpC-TSA::Redoxin; Domain location=1-87::3-89
MGSATDCIDIVCRMQALRGKTVLVNFWATDCPGCIKEMPELIDTYQQYKDKNFVVIAVAMPYDPPAQVANYTKEKNLPFAVMHDGYGEM

SEQ ID NO: 141961 - protein, 52 aa, Glycine max
  Coding DNA Sequence Number=SeqID_25183
MSTAPIEWPLVVCGGLGGGIGVWVVIHVWWNGRYGGETLRVHKKCILIIEKV

SEQ ID NO: 141962 - protein, 63 aa, Glycine max
  Coding DNA Sequence Number=SeqID_25184
MEMRLGRICTHDYALKCALCWFWAVVNKKRRPFSLHKEPKTKTGSGATYENASVGLWRLLLFL

SEQ ID NO: 141963 - protein, 325 aa, Glycine max
  Coding DNA Sequence Number=SeqID_25185
  Pfam annotation: Domain name=NOZZLE; Domain location=1-323; Score= -96.7; E_value=0.047; Accession=PF08744.1; Description=Plant transcription factor NOZZLE
MASDQHNTFHEEGGGKSACSRSRKGPKKPPQRGLGVAQLERLRLQESWKKMNEGSSSGGGVLQVPLPTLHDHHHHQQQQLFQCHPPPVFAASGGVPMRYGAPSPNLGFQYFQHLQQHVINGHNNTIGGDCMLPSFGSGPPLLVGTPLETSKELSSIPNLHSQPECFDFCLKKTRFNEYNEKGSSNERGERALEIGPNGNGHDFLGFMPQSSAPSFVGETCDFYNKLVYHDAAASASAYSCATTPNLDECVEVVAVHRRGNSGSGRVFMEYEFFPVKDGNDTTSKELELPSIGSVVVGGAEASSITAAAYGDSASNYVDLSLRLSR

SEQ ID NO: 141964 - protein, 108 aa, Glycine max
  Coding DNA Sequence Number=SeqID_25186
  Gene Ontology: Mol. function=methyltransferase activity
  Homolog annotation: Hit_ID=Q2HVP8; Match level="QueryCoverage=77%, HitCoverage=12%, E-value=6e-35, Identity=83%"; Hit description=SAM (And some other nucleotide) binding motif
MILVIRVVNVYYVANKCNDQQSYAFRGIYKNRPKDGEYTLPLIHVYGFSKARDPEFDFHERIRIALLEVAVNVDMRRVRLVAPGKWMLCASFILPKSVAFADTAAVDT

SEQ ID NO: 141965 - protein, 399 aa, Glycine max
  Coding DNA Sequence Number=SeqID_25187
  Homolog annotation: Hit_ID=Q9SXN7; Match level="QueryCoverage=36%, HitCoverage=35%, E-value=5e-10, Identity=32%"; Hit description =NtcycD3-1 protein
  Pfam annotation: Domain name=Cyclin_N; Domain location=16-147; Score =1.1; E_value=0.00012; Accession=PF00134.13; Description=Cyclin, N -terminal domain
MDSKTEFPIPSDKERQAINNYLQIEREFMATKGFYKAERNLLHRKHAVATIAKLSQGQVVDAYVAYLAMNYFDRYASSTNPFAVGLGSSVTDTVCFVATCCFMLSAKMRSNQFDLQQFLFEKDLNYQPTRLAAMELSILSGLNWRMLPITPFYFLDHYYPTFSEIGGFKRRSINEIIVQSQGVHQFTEFKPSHIAISAFLAATFVGYPSEFNAIQKSLDKPGKLEGCWRQLVHLCHRSAIEICSASGTVISATKIRTKLPIQSEEAAAEEASEIQTRKSEVQKYSTTKFIQFTVLDTEEEENVAPLIRRRRRERVEATEEGAEPEAETEATKQQGLDQGKAVTVGDSSEQKDAEAETKVNPKEHDKGIGEIEEICEEHVEAESELRLRKAKGKAKVGEE

SEQ ID NO: 141966 - protein, 737 aa, Glycine max
  Coding DNA Sequence Number=SeqID_25188
  Gene Ontology: Mol. function=ribonuclease activity
  Homolog annotation: Hit_ID=Q8H885; Match level="QueryCoverage=59%, HitCoverage=39%, E-value=1e-113, Identity=68%"; Hit description =Putative mitotic control protein dis3
  Pfam annotation: Domain name=Arm; Domain location=112-152; Score =26.8; E_value=7.9e-05; Accession=PF00514.13; Description =Armadillobeta-catenin-like repeat
  Pfam annotation: Domain name=Arm; Domain location=154-189; Score=6.8; E_value=1.7; Accession=PF00514.13; Description=Armadillobeta-catenin -like repeat
  Pfam annotation: Domain name=Arm; Domain location=191-242; Score=3.2; E_value=4.8; Accession=PF00514.13; Description=Armadillobeta-catenin -like repeat
  Pfam annotation: Domain name=Arm; Domain location=70-110; Score=22.1; E_value=0.0019; Accession=PF00514.13; Description=Armadillobeta -catenin-like repeat
  Pfam module annotation: Pfam domain module=Arm::Arm::Arm::Arm; Domain location=112-152::154-189::191-242::70-110
MAAASAAFSRNIRVFWLTVTRSQRQFKTMIIIYDEIVKHLNWHKSCPICSPLVGLLRIVANAICYLASDNTNIKTLVRMEGGIPPLVELVEFNVTELQKAVASGLATLAYDNHDNKKQIVECGALRTLVLMLQSEDSKMHYEAGVVIEKLVHSSPDITKEVLAAGALEPVICLLSSKKQAARLIGIFAATDSDCKVHIIQRGVIPQLLDMLNSHGEMAVFALGSLAPESHNQAVLSLYGLADNELADFIEAGGFQKLKDGHFKYQHLHHSKVEKASKRTHSQSRVTQRRAISSAVNMLHNKSFVKKTKGGKVIKYQVREHYLRDDIYCGAPFCTVCDSSSARLSASPSTILFVDTNVVLNQIDLLENPAIDDVVVLSIVLEEVKNKNMSVYNRIRAICSHSMRKFFGEIVLQYYIGEEGKLKDAVRDTYIKEMSGETKNDRNDRAIRVATQWYQNHLGGAVKVLLITNDQENKRKASEEGILAETVESYVKSLDQPDLLDLLVRPASEDVDMEEVEDLRPSKRKVIYSEHKPMSEITSGLHRGIYHQGKLRVNRYNPFEAYVGSESIGDEIIIYGRSNMNRAFDGDIEAAELLPQDQWQGVSSLSIAHEATKIWSGSRILDVIRWSVVVERGGDGGYAATVEYLHALRRPIRQLWSHGPYDLSRVTCSTLAPLLVLCASQVIGPEDEDEDEDVHLAPNSADDAPRTIPQQGSSEQVNAVPSRPSGRIVGIIKRNWHS

SEQ ID NO: 141967 - protein, 567 aa, Glycine max
  Coding DNA Sequence Number=SeqID_25189
  Gene Ontology: Mol. function=methyltransferase activity; Cellular component=cellulose and pectin-containing cell wall; Biological process=metabolic process
  Homolog annotation: Hit_ID=Q8H636; Match level="QueryCoverage=86%, HitCoverage=83%, E-value=1e-132, Identity=46%"; Hit description =Dehydration-responsive protein-like
  Pfam annotation: Domain name=DUF248; Domain location=92-567; Score =952.4; E_value=1.8e-283; Accession=PF03141.7; Description=Putative methyltransferase
  Pfam annotation: Domain name=Methyltransf_11; Domain location=209 -304; Score=32.7; E_value=1.3e-06; Accession=PF08241.2; Description =Methyltransferase domain
  Pfam module annotation: Pfam domain module=DUF248::Methyltransf_11; Domain location=92-567::209-304
  Subcellular localization annotation: CTP_CleavageSite=51; ConfidenceScore=5.60e-01
MGHSNSSSSSSPSKRGHALRQWRLLDLVSGVFFFLVLLFFTMVFTPLGDSLAASGRQTLLRSGADPQQRHRLVAAIEAGGRGVEACPAADADHMPCEDPRLNSQLSREMNYYRERHCPRPEDSPLCLIPPPHGYRVPVPWPESLHKIWHSNMPYNKIADRKGHQGWMKLEGQHFIFPGGGTMFPDGAEQYIEKLGQYIPISEGVLRTALDMGCGVASFGGYMLSKNILTMSFAPRDSHKAQIQFALERGIPAFVAMLGTRRLPFPAFGFDLVHCSRCLIPFTAYNASYFIEVDRLLRPGGYLVISGPPVQWPKQDKEWSDLQAVARALCYELIAVDGNTVIWKKPVGESCLPNENEFGLELCDDSDYPSQAWYFKLKKCVSRTSVKGDYAIGIIPKWPERLTAIPPRSTLLKNGVDVYEADTKRWARRVAHYKNSLKIKLGTRFVRNVMDMNALFGGFAAALKSDPVWVINVVPALKPPTLDVIFDRGLIGVYHDWCEPFSTYPRSYDLIHVASIESLIKDPASGQNRCTLVDLMVEIDRMLRPEGTVVVRDAPEVIDRVARIASAV

SEQ ID NO: 141968 - protein, 73 aa, Glycine max
  Coding DNA Sequence Number=SeqID_25190
  Gene Ontology: Mol. function=nucleic acid binding; Biological process= DNA integration
MLKVFGCPTYYHVSEGMLDPRAKKEFFIGYGDGVKGFQVWSSYERKVILSRDVVFDELYMMHSKRFGQGQECH

SEQ ID NO: 141969 - protein, 212 aa, Glycine max
  Coding DNA Sequence Number=SeqID_25191
MAQQFQEPPLFSHVANTCINHVVYITIILTSFDPSSAAEVCRMQSPPIERDIFNHPSICHDILRQLLAYSFVPINFYIGQDCDLIPNLSTRLCESVLQRSGVHINYFQVFITVFQTHCCYNVVGTPFFFQADELPSREMVQRMTCDGGEHSLPAGAMALKRFLIQDEQEDPCAICIKDFNSGDNAARRVRALCAVSLVVVSLDTVMISIYVL

SEQ ID NO: 141970 - protein, 170 aa, Glycine max
  Coding DNA Sequence Number=SeqID_25192
  Homolog annotation: Hit_ID=Q2QXX4; Match level="QueryCoverage=39%, HitCoverage=40%, E-value=1e-07, Identity=36%"; Hit description=Zinc finger, C3HC4 type family protein, expressed
  Pfam annotation: Domain name=zf-C3HC4; Domain location=114-152; Score= 8.3; E_value=0.022; Accession=PF00097.15; Description=Zinc finger, C3HC4 type (RING finger)
MTRQFQEPTLFSNVANTFINHMVYISIFVSTFDPSFGVRLCRMQLPIQHDIFNHQCSHCCYNVVGTPFIFLADGLPSRGLVQRMACDGGEHLSLPAGATTLERFMVEDEQEDPCAICIKDFNSGDNAARLPCSHVFHPDCILQWEKQKNAEKKKSQNIDHRESRNESRGK

SEQ ID NO: 141971 - protein, 106 aa, Glycine max
  Coding DNA Sequence Number=SeqID_25193
MMSMKKIMEANAVAAAATSVVAKVNPIYSRQRFGKYGRPLNVQIQNEHAFPPYGLPPNYTPPNAAYTPNENINNSTPIPIESQQPRTIMQMSLNPWGRHMKFPATI

SEQ ID NO: 141972 - protein, 270 aa, Glycine max
  Coding DNA Sequence Number=SeqID_25194
  Gene Ontology: Mol. function=nucleobase transporter activity; Cellular component=membrane; Biological process=nucleobase, nucleoside, nucleotide and nucleic acid transport
  Homolog annotation: Hit_ID=Q74S68; Match level="QueryCoverage=97%, HitCoverage=52%, E-value=1e-117, Identity=78%"; Hit description =Putative permease
  Pfam annotation: Domain name=Transp_cyt_pur; Domain location=2-270; Score=-106.2; E_value=8e-05; Accession=PF02133.6; Description =Permease for cytosinepurines, uracil, thiamine, allantoin
MGGYVVAASFFTLGLASWQVLICLLAGIVIVQLCANLVAKPSQIAGVPYAVICRQAFGVFGANIPAVIRGLIAFAWYGIQTYLAANALMLVLLKFWPSLAAMTQTSLLGLSSLGWICFATMWLLQAMVFWHGMSAIKRFIDIAGPAVYVVMLALAGWIVYKTGLDGISFTLASKTLTASEQSWQMITATALVVSYFSGPLLNFGDFSRYARSMGEIRRGNRWGLPFNFLLFSVVTVVIVSGTQSLFGRMIPDPIETMNHVGNDLAEPSAC

SEQ ID NO: 141973 - protein, 248 aa, Glycine max
  Coding DNA Sequence Number=SeqID_25195
  Gene Ontology: Mol. function=gamma-glutamyltransferase activity; Cellular component=integral to membrane; Biological process=response to antibiotic
  Homolog annotation: Hit_ID=Q6D1F1; Match level="QueryCoverage=100%, HitCoverage=46%, E-value=1e-79, Identity=61%"; Hit description =Putative gamma-glutamyltranspeptidase
  Pfam annotation: Domain name=G_glu_transpept; Domain location=14-248; Score=-106.7; E_value=4.3e-11; Accession=PF01019.11; Description =Gamma-glutamyltranspeptidase
MAVAPHHLASQSALSVLREGGSAIEAMVAAAATIAVVYPHMNGLGGDGFWLIVPPQGDPIAIDASGAAGSLATPEAYAGLTHIPHRGPRSALTVAGTVSGWDEALKVSQSLTGKSLPLSRLLQDAIGYADNGIPVTASQASATAGKLDELQRQPGFAETFLVNGRPPQSGSRFCQPALASTLKRLVAEGLDSFYRGSLAEQLADGMARYGLPITLDDLRQHRARRPQPLRLQHQHGELWNLAPPTQGL

SEQ ID NO: 141974 - protein, 64 aa, Glycine max
  Coding DNA Sequence Number=SeqID_25196
VDYQGCQGMAEDLGAIVEDLERVINLRMVTEGTDLYDFMTRCLRRARGDAADGSLRSRQRRRID

SEQ ID NO: 141975 - protein, 35 aa, Glycine max
  Coding DNA Sequence Number=SeqID_25197
  Homolog annotation: Hit_ID=Q9ZSP5; Match level="QueryCoverage=98%, HitCoverage=4%, E-value=1e-07, Identity=68%"; Hit description =Subtilisin-like protease
SWEFLGLEKNGRIPANSAWRKARFGENIIIANIDT

SEQ ID NO: 141976 - protein, 107 aa, Glycine max
  Coding DNA Sequence Number=SeqID_25198
MQSQMQSQGFALPPEAEVGPSAARVSTKESCVDPSGVYKGLATFHNVPLGNDLVKGVNDSQESKSKVAARWIVVKCNKQKGSTTCGYYVVHLMSTIVLGGFKDNSEM

SEQ ID NO: 141977 - protein, 186 aa, Glycine max
  Coding DNA Sequence Number=SeqID_25199
  Subcellular localization annotation: CTP_CleavageSite=57; ConfidenceScore=5.63e-01
MALRDRNLRKHRTDSKAKQGSNRFQKTSTQPTNFMETPTKPTESMAMLGVTPNQPTRSMKIFGVTLTQPTESMAAPSVTHIQPIDQSMEIPCVTHIQQIEPMEMPGLIPIQPTSSMTMPGVTPTQQTLTIEMPSETPPSLEFMKQRLEMMASTMETSGHTLSPQMRAQLDSGIKNLLRRVNARLNA

SEQ ID NO: 141978 - protein, 187 aa, Glycine max
  Coding DNA Sequence Number=SeqID_25200
MYLSRRAPGSQQIKGKQDHKARRLVVAGQLLENEVRKLRKPLIVMVAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDLLEGDEDPLLEVDSPEEVMSASEADSTEDSGPREMAISGGSSS

SEQ ID NO: 141979 - protein, 136 aa, Glycine max
  Coding DNA Sequence Number=SeqID_25201
  Subcellular localization annotation: CTP_CleavageSite=63; ConfidenceScore=5.54e-01
MRLADKRNLEGNLSCRHALSASSAHSASRLSSSRLSVSLALSDYSFTRVKQNVRRLERALNSRKSLKSEIHRGKEQSKEANFYSFRKICEFLSDCEVPRGGGDIPTPLGFSIERCIVSLELDRAGLGYCMFGHGVW

SEQ ID NO: 141980 - protein, 238 aa, Glycine max
  Coding DNA Sequence Number=SeqID_25202
  Gene Ontology: Mol. function=catalase activity; Cellular component =spore wall (sensu Fungi); Biological process=response to oxidative stress
  Homolog annotation: Hit_ID=UPI0000687FB8; Match level="QueryCoverage =100%, HitCoverage=33%, E-value=1e-122, Identity=86%"; Hit description=probable catalase C protein
  Pfam annotation: Domain name=Catalase; Domain location=1-238; Score =213.1; E_value=6.3e-61; Accession=PF00199.9; Description=Catalase
MVHAVKEEPDRAFPQAQSAHDNFWDFISLTPESMHMIMWIMSDRAIPRSFRFMEGFGVHTFRFVNDRDQSTFVKFIWKPKLGLQSIVWNEAVKINGADPDFHRRDLWNAIQAGDFPEWELCVQLFDQDFADSFDFDVLDPTKLIPEEIIKPMPVGRLVLNRMPDNFFAETEQVAFMTQNVPPGIDFSNDPLLQGRNFSYLDTQLKRLGSPNFTHIPINAPKCPFHHFQQDGHMAMRNP

SEQ ID NO: 141981 - protein, 143 aa, Glycine max
  Coding DNA Sequence Number=SeqID_25203
VHTFYPPSLFIMSHSKKGSMHSVRGRMLLPEESSIPLGGTTVVGGIAHLVIDIVAPASEGEPHPNPWAHSLPREEETESSLPIPPHNVIDLDSEANVVQVLEVGSYECSFLTYESITDFLESVEFYHIEGLDVMVITSCLANF

SEQ ID NO: 141982 - protein, 79 aa, Glycine max
  Coding DNA Sequence Number=SeqID_25204
MPAEPRSLVVNPPPSPELEVVPPSPPLIIISDASSDETIAPPDSPAGETADPPNSSVGGIAYLSDSSSGEVVALTDSPV

SEQ ID NO: 141983 - protein, 119 aa, Glycine max
  Coding DNA Sequence Number=SeqID_25205
MSISPCEGIGWSVSSQHRAWGFQLRLRASVSPTGCPSPPARSYHRDIGKDHARKTPSGPEEVQQGLGVASSDYGPLSVLRSACRLQQGHHAPTNRAFIKKYCAPRQAQGETPQQHWDGR

SEQ ID NO: 141984 - protein, 153 aa, Glycine max
  Coding DNA Sequence Number=SeqID_25206
  Gene Ontology: Mol. function=transcription factor activity; Cellular component=nucleus; Biological process=regulation of transcription, DNA-dependent
  Homolog annotation: Hit_ID=Q9LTC5; Match level="QueryCoverage=88%, HitCoverage=88%, E-value=3e-19, Identity=39%"; Hit description =Nicotiana EREBP-3-like protein
  Pfam annotation: Domain name=AP2; Domain location=16-81; Score=144.5; E_value=2.8e-40; Accession=PF00847.10; Description=AP2 domain
MEGGRGVVNGNPSNADVRYRGIRRRPWGKFAAEIRDPTRKGARIWLGTFDTAEQAARAYDAAAFHFRGHKAILNFPNEYGNVTPNPNNNYSSTSLPLPLLSSSSSSSSSFPSYYGEGSSQQQQGNDDDTFELECLDNKLLEELLQQAPDRSGN

SEQ ID NO: 141985 - protein, 67 aa, Glycine max
  Coding DNA Sequence Number=SeqID_25207
MAMMPFTLMLVEVNLRATIAESEMNLSNCRKGMINISIMGDANSITKMKLKWPHSVIHTSSYLSFGD

SEQ ID NO: 141986 - protein, 278 aa, Glycine max
  Coding DNA Sequence Number=SeqID_25208
  Gene Ontology: Mol. function=DNA binding; Cellular component=nuclear pore; Biological process=DNA integration
  Homolog annotation: Hit_ID=Q1RYT8; Match level="QueryCoverage=98%, HitCoverage=70%, E-value=4e-65, Identity=42%"; Hit description=IMP dehydrogenase/GMP reductase
MNAKIEALEANHTWILTDLTSNKFAIGCKWVYKLKHKADGSVKRYKVRLRLPWYCALAAINNWHLKQLDVNNAFFHGDLHEEVYMTLPPGMHSTKSNQVCRLQRSLYGLKQADIQWLIGRLIYLTNTGLDITYAIQHVSQFVAYHSSAHQQATYKILRYLKATPGSGLFFSASSIFQLKAFSDSDWSGCIDTRRSIIGYSVYLGSSFISWKSKKQDTVSRSSSSEAEYCALVSATCELQWLTYLLDDFGIVYTWLVLLFCDNCVALHISTKRIHKRYY

SEQ ID NO: 141987 - protein, 996 aa, Glycine max
  Coding DNA Sequence Number=SeqID_25209
  Gene Ontology: Mol. function=nucleic acid binding; Cellular component= proton-transporting two-sector ATPase complex; Biological process=DNA integration
  Homolog annotation: Hit_ID=Q1SRN1; Match level="QueryCoverage=46%, HitCoverage=34%, E-value=1e-153, Identity=53%"; Hit description =Integrase, catalytic region
MASITLSKSVLSRVIGSIHSYQIKNIVDELVGIDNPVPHEEHIDAILKGLPQDYAPMIFIIESKFETPPVAEVEALLAHESQSNRFHKQSFSPSINYTQGYVLPNLNDTSTRNNSSGGYGRGGGGRGNNGGRRGGATPSAMLSNVSSTGVAHSAWIPDLGASFHVIGEPHNIHQLGHFEGLDQIFIGNGQGLHINGSGSSSFLSPINSHGTHETLLQGVVGVDGLYSFPNLNLQESFVLLSSAAKSPSSSVDLSSSSRVVFNSSDQSPTQATSFSQYFTLNPDLSPPCHNSPLTSPTPTHQLSISSPISVDVSSQQPNLSSNNNLHNNEASPTFVSQPESDSSSPRESLEHGEPVSRTTNAHPMQTRSKSRIYTPQIHHSLFLAHSEPKGVKQALTDSNWLSAMKLEYAALLKNHTWDLVPLPSNRKAVGCKWVFRIKENANGSINKYKTRLVAKGFHQVHELFQLDVNNAFLNGLLDEIVYMVQPLGFEVEDKSLVCKLKKALYGLKQAPRQWFDRLKVTLIQFEFQASKCDPSLFIYKRQAHTIFLLVYVDDIILTSNSSSLIQQITTQLHSAFSLKQLGQLEYFLGIEIKYLPDRSLLMTQSKYIRDLLHKTHMAEAHFISSPMASSCKLSKTGVCQFMENPLDTHWGAVKRILRYLKGTLSHGFLMKPAAVGKPLSITAMCDADWASDVDDKRSTSGSAIFLGPNLISWWSRKQQVTFRSSTEAEYRSIAQTSAKLTWVQALLQELQVPFSTPILLCDNHSAVAIAHNPIFHSKTKHMEIDVFFVREKDYLTIQEWHNLTLLSKLPQRLPVKPLVLLFKSLTVFRDLRAILIIFDMEAFDFVNVCREVGVNVKNASVTWPTDPLPPPCLSSKDVVPSANKNKKKRGRKESEEEKFFNSAYHPQALMPSGVVSDFGKDMLQGANASSARLKKELEGMTKERDQALHANIDLAADNSNLKADSKKFEDREASWGRKIKREKDVDAAVREKYVQI

SEQ ID NO: 141988 - protein, 371 aa, Glycine max
  Coding DNA Sequence Number=SeqID_25210
  Gene Ontology: Mol. function=nucleic acid binding
  Homolog annotation: Hit_ID=Q9LHL2; Match level="QueryCoverage=60%, HitCoverage=58%, E-value=1e-70, Identity=62%"; Hit description =Similarity to RNA binding protein
  Pfam annotation: Domain name=NID; Domain location=81-153; Score=7.5; E_value=0.013; Accession=PF07292.3; Description=NmiIFP 35 domain (NID)
  Pfam annotation: Domain name=RRM_1; Domain location=127-198; Score =74.5; E_value=3.4e-19; Accession=PF00076.12; Description=RNA recognition motif. (a.k.a. RRM, R
  Pfam annotation: Domain name=RRM_1; Domain location=45-108; Score =42.9; E_value=1.1e-09; Accession=PF00076.12; Description=RNA recognition motif. (a.k.a. RRM, R
  Pfam module annotation: Pfam domain module=NID::RRM_1::RRM_1; Domain location=81-153::127-198::45-108
  Subcellular localization annotation: CTP_CleavageSite=43; ConfidenceScore=5.57e-01
MASRKFDNPHSGDGASPGFALFSLCSLSSFSLSRFASHFPLFHAAKSSSEETFVKYFEKYGEITDSVIMKDRHTGRPRGFGFITYADPSVVDQVIQENHVVNGKQVEIKRTIPKGSSQANDFKTKKIFVGGIPTSVSEDELKNFFSKYGKVVEHEIIRDHTTKRSRGFGFIVFDSEKVVDNILADGNMIDMGGTQVEIKKAEPKKSSNPASLPPFASDSRARSYNDGFGGFGDSYGSFGGSGYGPGSYRSLGGFGGRLGDYGGYGAGDEFGGSFGGYGGAGAGGYAGFRGESSFGYSSRYGSYMGGLGAGYGGSGLGAYGRGGGAYGTYGGPSAGGGYESGPGAGYGGAGGGMYPSRGSYGGSSRYHPYAR

SEQ ID NO: 141989 - protein, 147 aa, Glycine max
  Coding DNA Sequence Number=SeqID_25211
  Gene Ontology: Cellular component=integral to membrane; Biological process=transport
  Homolog annotation: Hit_ID=Q7XI54; Match level="QueryCoverage=81%, HitCoverage=53%, E-value=5e-38, Identity=58%"; Hit description =Putative transmembrane protein
  Pfam annotation: Domain name=EMP24_GP25L; Domain location=58-124; Score=35.7; E_value=1.7e-07; Accession=PF01105.14; Description =emp24gp25Lp24 family
MAAMSDSVRSLALLSLAVMCSVANSMRFDLQSGQTKCISEDIKTNAMSVGKYSVVNPQEGYPLPDSHRIIVKVTSPHAHTYHFGDHVDSGNYAFTASEAGDYSACFWVQDTRDAPSVVTIEFEWRTGVAAKDWSKVAKKGQIEPSQA

SEQ ID NO: 141990 - protein, 233 aa, Glycine max
  Coding DNA Sequence Number=SeqID_25212
  Gene Ontology: Mol. function=nucleic acid binding; Biological process= DNA integration
  Subcellular localization annotation: CTP_CleavageSite=40; ConfidenceScore=5.36e-01
MDPCPSINKVFSYRAQQESQFASSNAFHNLSLVNATANTRSSNSCSYCGRDNHTTETCYRKNDFPPNFFSNRGFGRGGLGGKSNNGKVYTHCGITNHIVDECYKKHGYPPSHELYKPEGALVNNTVMEEENVLSSETSNGGQDIKITQQYNNSSHGSQVNQIGTSSTYTSSIDIWGPCATTVLNGHKYFLTIMDDHTRFVWIFIMTSKAETQTHLQAFVSNVERQFNTKVKAI

SEQ ID NO: 141991 - protein, 595 aa, Glycine max
  Coding DNA Sequence Number=SeqID_25213
MEFSFGLPAQKEGNVTDVKKPERKNEEIPKVSPYFRNHYGNNGGNGEENQGKVATRKIVLALPAYCPQKLPTVVDLKEPMRTNKEAYNNIKIGHDLQSSGNEIGTGNTTTNNGKRTSIKHEEVQKVSPYFWNDYGKKGDNGKENGDEIAIETVKSKRKRRLKNRLKKYELHGDNEKKNGSESCCYGSDRNGDETAIGKIKPKQKRRLKSHEAQGDNEKKVDTELCYGSQENGDEIPIEKIKSKRKKRSKKCKPQGENKENIDPELSCYGCDIGFVEDKLLTDGKIKSKEKKKKSLEDKLWENIAADEGDDAEISKYILKKREPQGDEEKIDPEFFCYGCNIGFGKDKLLAGGKIKSKEKKKKTVEVEDELQENIVHNGTAKKTKVKPLDIESMSEPIALPTYGDLKRDKLEEDGSEVQINHRPGHASYAVSVVLTSASGDCFEDKLKENGNGLESISIEFKKSKFNCQKTVEESVKVRKVSPYFQSDNVKNKVFADKLLNKRNDAETSNVKPMKMESVVQKRLEVNISGEKSEQQGQDSHIDSVVVTVASGDLEEVQEIGSGIETIKVELMKKRKSNNPKTAEEGDKIRKVFPYM

SEQ ID NO: 141992 - protein, 180 aa, Glycine max
  Coding DNA Sequence Number=SeqID_25214
MKKIQGLQAPHGATSPRIFGLCEALWAFYKNGSFGSFVTLLWIIILAPCRVLSFRVDNSVTLKGQVDSEVGSYYSRYNDKASLLHLINHVSVRTLMDKDNSPIHLCCCRTDAYEKLDWVFLEKESIVDMPPTRDFFYVYDCIFHNLNVELPFDDFTMSILRILNMAHLQLHPNGWATMQV

SEQ ID NO: 141993 - protein, 50 aa, Glycine max
  Coding DNA Sequence Number=SeqID_25215
MPVEHENRTGWHEPCIEWNMGEGEYGCGRRRGFQGEIDDTHKHRHGCACM

SEQ ID NO: 141994 - protein, 1341 aa, Glycine max
  Coding DNA Sequence Number=SeqID_25216
MEYILALPAQKEGSLVDVKKPKMKNEEASNNKKRLMEHDLPKSGNEMGAANTKTNNGKRTSKKHEKEKVPKIYPYFRHNYEKKGDNWEENKDEIATEKIKSKRKRRPKKHEPEGDCEEKIDPESCCYGSDIGLVEDMLLADGKIKSKERRKKKKKKKAVQDKLWENGDDAETKKFKLKKREPQGDNREKADPELCCYGSNIGFVEDMLLADGKIKSKQKKKKKAVQDKLWENGDDTETSKFILKKRESQGDNREKIDPESCCYDCDIEFVEDKLPADGKIKSKEKKNKKVVEDNLWENGDDTEIDKFILTKCEPQGGNEEKIHPESCCGCDIGFAEDKLLADGKIKPKEKKKKKKKVQNKLWENGDDTEISKFILKKRESQGDNVEKIDPESCCYGCHIEFVEDKLPADGKIKSKEKKKKKAVEDELWENGDDAEPSQLKLKKTGPEVHKHKVQVGVRYVSPYFHNDNAKKINFESFDKVKENGNGSKSISIISKKRKSNSQKTVEESAKVRKVSPYFQIDNVKKTVEVDALDHENEFDSAALMGTCGYMVQDREEENGDNIAIEKIKSKCKGRYKKLEPVEHDPVHKFLPFFQCDNEKKVDADSHFEIGSIASQGIGSSFLRDKLLEDENEMKNGTIKFKKKKKKNKAFTNKLQENGNDAETCNVKPRKMESVVQKNIAQVGVRYVSPYFHNDSEEKIKGKPLDMESKSGSIALPTFGNSIENKLDGNNSGEKIKQHGLDSHIDSVVVRSASGDFEELYGNGNEIEIIKVKSKKRRKSNSKKTYKEHDKVRKVSPYFQNDKEKTVNVEALDRENVFDSVSLVGKYGDKVAFEKFKFQGKKTSAKNKILEHAQIQKVSPFFQSNKGKKVDDGSCCYDSEIGFSALPGTGGGFLEDKLPEDGNAIEKAMTKLKKKKVIANKLQENGNDAETFNVKPKMTKSVVQENIVQVGVRYVSPYFHNDSGKKFNVQPSNKESKSESMVLPTFGNFVEDKLVENNGGKNVKQQSIETHADSVVLTAASGNFSEDGLQKIRNEIATIKVKSKKRKSNSRKTAEELAKVRKVSPYFQNDNEKTVNVKEHDHESDLDSVALMGTCTFGGKIPIEKFRYEGKRTSKKDETAGHTQIQKVSPFFETDNVKKIGAESSCTAGRLLEHKLQEDGNVTENGMINVKRKVISNKLQENGNNATTSKVKPKKKKPLVQKNGHGIRYVSPYFCNNSGKKVNVKPFDKGSTSESIALHTCKNFVEDKLEENKSNCSNKSIEIKRFPPASEKWDEAYKRKTPDNTWKPPRSEIVLIQEDHLHDPWRVLVICMLLNRTAGGQGVIVEGVFGGCQPSWGSLPSH

SEQ ID NO: 141995 - protein, 122 aa, Glycine max
  Coding DNA Sequence Number=SeqID_25217
MMPTFFRVLWWVVVINVVEDDVTSEALLLVERDVKFVKVAEKLRGEATQLKGEIALKKRLVLKAVRVVAGFEGFEGCEVRNVKKKMMMRVEEKRRNSGERSLVGLFLFQTFAIEKDCVRYGS

SEQ ID NO: 141996 - protein, 374 aa, Glycine max
  Coding DNA Sequence Number=SeqID_25218
  Homolog annotation: Hit_ID=Q1T6P2; Match level="QueryCoverage=18%, HitCoverage=16%, E-value=3e-25, Identity=78%"; Hit description =Stress protein DDR48 , related
MSFFSRGRRDDDTVDDYDEYDPTPYGGGYDIALTYGRPIPPSDETCYPLGASSSDDNFDYDRPQYTSNAEPSAYGDEALATEYSSYSRPKPRPAPAGFNPAAGSGYGGSGSGYGRKQESEYGSGYGGRKEEGEYGSGYGGRKEEPEYGSGYGRRKEEGEYGSGYGGRKEEPEYGSGYGRKEEGEYGSGYGSGYGGRKEESEYGSGYGGRKEEPEYGSGYGGRKEESEYGSGYGGRKQESEYGSGYGGRKEEPEYGSGYGGRKEESEYGSGYGGRKQESEYGSGYGGRKEESEYGSGYGGRSEYEEKPSYGRSNYESQGGGGRVEYGYEGRPPRQEEEEGFRKPSYERKADDDDDEGYGRKKYVSTSTTLSIPYS

SEQ ID NO: 141997 - protein, 236 aa, Glycine max
  Coding DNA Sequence Number=SeqID_25219
  Gene Ontology: Mol. function=pectinesterase activity; Cellular component=cell wall; Biological process=cell wall modification
  Homolog annotation: Hit_ID=Q9LVQ0; Match level="QueryCoverage=92%, HitCoverage=69%, E-value=1e-103, Identity=76%"; Hit description =Pectin methylesterase-like protein
  Pfam annotation: Domain name=Pectinesterase; Domain location=3-218; Score=116.6; E_value=7.3e-32; Accession=PF01095.10; Description =Pectinesterase
MDARVIGTGTFGCGTIIVEGGDFIAENITFENSSPQGAGQAVAVRVTVDRCAFYNCRFLGWQDTLYLHYGIQYLKDCYIEGSVDFIFGNSTALLEHCHIHCKSAGFITAQSRNSPQEKTGYVFLRCVVTGNGGTSYAYLGRPWRPFARVVFAFTYMDQCIKPAGWNNWGKIENEKTACFYEYRCFGPGWCPSQRVKWARELQAEAAEQFLMHSFIDPESERPWLAQRMALKIPYSA

SEQ ID NO: 141998 - protein, 100 aa, Glycine max
  Coding DNA Sequence Number=SeqID_25220
  Gene Ontology: Mol. function=protein tyrosine/serine/threonine phosphatase activity; Biological process=protein amino acid dephosphorylation
  Homolog annotation: Hit_ID=Q8GSD7; Match level="QueryCoverage=68%, HitCoverage=12%, E-value=1e-17, Identity=52%"; Hit description=MRNA capping enzyme-like protein
MVVHVHVGWLDCPSYGQEIFCMIPSKVTLGESFNDCIPPGKRYSFKQVIHQQRVLGRKLDTVKLRRNVIRSIKIACIFHFEEFLKRDKVTYMCYTGHLKV

SEQ ID NO: 141999 - protein, 186 aa, Glycine max
  Coding DNA Sequence Number=SeqID_25221
MMTTKDDDKGDEQKAQKIKEQLNKWYIYLGLTENKRGYISCESVLVEGTSTRFKENKGGYIPCGSFLVKGDHISWMMWNLWKGHHVYSEWPIFFVVIVDQIWRRHNNYIFNGVVRFSEDGNLYSDHVLTSLVLSWAPLEMDWFKVNINRVIRRARMEAACGGVVGDHHGKFLIGFQTGLGMKFFLY

SEQ ID NO: 142000 - protein, 146 aa, Glycine max
  Coding DNA Sequence Number=SeqID_25222
  Gene Ontology: Mol. function=pepsin A activity; Cellular component =lysosome; Biological process=lipid metabolic process
  Homolog annotation: Hit_ID=Q8H948; Match level="QueryCoverage=91%, HitCoverage=77%, E-value=7e-73, Identity=98%"; Hit description =Aspartic proteinase 5
  Pfam annotation: Domain name=SapB_1; Domain location=41-79; Score =57.6; E_value=4e-14; Accession=PF05184.5; Description=Saposin-like type B, region 1
MVRPDDVCSQVGLCFKRTKSESNGIEMVTEKEQRELSTEDTALCTSCQMLVVWIQNQLKQKKTKEIVFNYVNQLCESLPSPNGESVVDCNSIYGLPNITFTVGDKPFTHTPEQYILKTGEGIAEVCLSGFIAFDIPFIFLIVQNSA

SEQ ID NO: 142001 - protein, 75 aa, Glycine max
  Coding DNA Sequence Number=SeqID_25223
IMVRIRHLDWTLCRIIGRALGREANCDSDEASSGEGPQHLHVGNKKLHLLLRMFNMWIMQLTRSMNNLKKQLLMM

SEQ ID NO: 142002 - protein, 152 aa, Glycine max
  Coding DNA Sequence Number=SeqID_25224
MLCIEDIDDRWIQFSEYLAPVGQICVVLRQCATNYIEWFYMISHPFMSLAQPTDPPRHPFMVHDDTFIEPDIPQHPVAEACQAITERLQQMLNLRIMTEGTKAYTITKDCLRIAKGVIAKCNATALLENHSVHTITKLLTVKDNDLLEILVT

SEQ ID NO: 142003 - protein, 69 aa, Glycine max
  Coding DNA Sequence Number=SeqID_25225
MPHGIVLSQLLQQNFIQMKSLKAMEDACDMQMKQRCHIIEVTKPSFSGAGLPNFSIFLPWEDNFNSGCS

SEQ ID NO: 142004 - protein, 130 aa, Glycine max
  Coding DNA Sequence Number=SeqID_25226
  Gene Ontology: Mol. function=RNA-directed DNA polymerase activity; Cellular component=signal recognition particle, endoplasmic reticulum targeting; Biological process=RNA-dependent DNA replication
MRNEMYRERRSHKRYGGRQREETIEGVKVKIPTAKVAYDPEVYLEWEMKVKQGYALVWWNQVRNDVKRMKMPLINTWLDMERVLRERFMLSYYGRDLHNKFQRPIQENRSGDEYYKEMEISLIKAQIEES

SEQ ID NO: 142005 - protein, 444 aa, Glycine max
  Coding DNA Sequence Number=SeqID_25227
  Gene Ontology: Mol. function=DNA binding; Cellular component=nucleus; Biological process=regulation of transcription
  Homolog annotation: Hit_ID=Q1S2G2; Match level="QueryCoverage=99%, HitCoverage=100%, E-value=1e-124, Identity=58%"; Hit description =Homeodomain-related
  Pfam annotation: Domain name=Myb_DNA-binding; Domain location=14-77; Score=28.6; E_value=2.2e-05; Accession=PF00249.21; Description=Myb -like DNA-binding domain
  Pfam annotation: Domain name=Myb_DNA-binding; Domain location=83-128; Score=34.7; E_value=3.1e-07; Accession=PF00249.21; Description=Myb -like DNA-binding domain
  Pfam module annotation: Pfam domain module=Myb_DNA-binding::Myb_DNA -binding; Domain location=14-77::83-128
MGRHSCCYKQKLRKGLWSPEEDEKLLNYITKHGHGCWSSVPKLAVVHYEVQFTTLIVNMPGLQRCGKSCRLRWINYLRPDLKRGAFSQQEENMIVELHAVLGNRWSQIAAQLPGRTDNEIKNLWNSCLKKKLRQRGIDPNTHKPLSEVENEKDMMPPSTDKSTQKASVGSNEVSLVDHHQQQPKIMPNSSSERYPLEVSTTSSTQELFLDRFGTPTTCHHHHNNNNTSDVVGSYFSFQHLNYGTTTNMSLSANPNASLCFVPASTSSDLNNNSTITSSMLPSIFPTQHVKLQSNNNNPSISSDGVQNWETSNLNNSNSTNKNNGSMQLQSCTNFIDNTWGVGESMKVVNINKDADQMPLQAEQEDLKWSEYLNTPFILGNNTAQNHQIHTSQSIYSEVKPETGFITDESCATWHHYQNQTPAFQLSDIYSKDLQRFSVTFGQTL

SEQ ID NO: 142006 - protein, 169 aa, Glycine max
  Coding DNA Sequence Number=SeqID_25228
EDKENKQRWVVDETISELVVARGGLTRVNRRFNYYRKPTSIRTSYFGDVLSGTNGGVGSNVGNVDCGSNVDVNHLLSQMEELKLKVATNEERICLYEEQIMEFKKMLAKEEHQSQENSKVVVELRKKIAKQYTDIHIERKMIKVFRMHCSVPLGFIECYYHCIYNEIVF

SEQ ID NO: 142007 - protein, 177 aa, Glycine max
  Coding DNA Sequence Number=SeqID_25229
  Homolog annotation: Hit_ID=Q1T493; Match level="QueryCoverage=83%, HitCoverage=26%, E-value=6e-07, Identity=23%"; Hit description =Nucleic acid-binding, OB-fold, subgroup
  Pfam annotation: Domain name=Rep_fac-A_C; Domain location=1-131; Score=-67.1; E_value=0.055; Accession=PF08646.1; Description =Replication factor-A C terminal domain
MDNHSWCYPACVQCHRKTDIQTGPFTCGCGKDNDQPVLRYRVEVMVTQNNESSKFLLWYRECAELIGETADDVNRVKIELVDLSCFWQDGDLDLNASPQALDKLLGHVFAFKVRIQSKFKNAVVLRYSNDLDLINVVLEMLPDNEACSKIDPSNVDCNNTTHVECFMLYAVISVCHN

SEQ ID NO: 142008 - protein, 182 aa, Glycine max
  Coding DNA Sequence Number=SeqID_25230
MSKDKEESRNIPPAQDLNKENVEKKRIAENGGVKSADLSTTSPVANYEIKEHYGNGKTKPKDDKNVEGPSGVKSGDLSATSPGVNAPPHSDDETEFVDIIGIDEDENKGLTAAQVLRAQLDAEEQRWNMQRASRQRQRQAQLDEQEWRRRNEQRSERQRQTSSSSSNDIESCDENSVNPIVD

SEQ ID NO: 142009 - protein, 121 aa, Glycine max
  Coding DNA Sequence Number=SeqID_25231
MEAMMSMKKIMEANAVTIVATSAVAKVNPMPPSDLNQMNHPTSNMVGKDLGSTDDPMMRKFKTSTPSCHMACLPTIHHPMWRTLLMRMSITPLPYSLRADNLLMYMSLNPWGRHMKFPTTI

SEQ ID NO: 142010 - protein, 242 aa, Glycine max
  Coding DNA Sequence Number=SeqID_25232
  Homolog annotation: Hit_ID=Q5ZC72; Match level="QueryCoverage=76%, HitCoverage=34%, E-value=2e-29, Identity=40%"; Hit description=Light stress-responsive one-helix protein-like
MLLAVEGGGFFSASASGYTKGLSLLLLGQRNEDKPMRVAPWNQYQLVDQESDPELQLASTKNRLSRGCASFVCFGRTSAGLDTPSPLKVGPAQQHDVSPGPLVSNKGKDPSAHVDDESDNRKATLKSSIKKPQNRKSVPVEVANEHEASSGQGICTPGGQPERRKVQWTDNCGSELVEIREFEPRFYGILELSSAQEDMTFLDALYKAIAFKFQHQLEAMLLNNRYSAAIVAFFNPSAIGNL

SEQ ID NO: 142011 - protein, 162 aa, Glycine max
  Coding DNA Sequence Number=SeqID_25233
  Homolog annotation: Hit_ID=O64580; Match level="QueryCoverage=42%, HitCoverage=58%, E-value=2e-07, Identity=45%"; Hit description =Expressed protein
MVASPISTKCVPLPTLPMTLMILKAQKGTIKHHTWGATTQDHDVDVSSPSLSKNPQPACAIFAYVIQIFPVSCTERSKRSKSFPEYSCSYTEFGFSERSNSYNFNGPNQKGNGFSASSDPEIKRKKRIKAYNVLTVEGKLKTNVRNSFKWIKNKFSDIRYGV

SEQ ID NO: 142012 - protein, 151 aa, Glycine max
  Coding DNA Sequence Number=SeqID_25234
  Homolog annotation: Hit_ID=Q8S268; Match level="QueryCoverage=88%, HitCoverage=67%, E-value=5e-17, Identity=39%"; Hit description =Putative holocarboxylase synthetase
MNGIELWQESLCLGLIGWVWRQQESGSRVATVDILSYIQNELDYCGEEPCMSPRAPLHQQQSQPVMQVTTGAGFPVTTGFSGQTIVGQEVRPEHCDNQSKNSMFSNALSNPVRQIGEGGNHPSGLSMGNGNQSTDSAAFSSNDSAMDMHAD

SEQ ID NO: 142013 - protein, 125 aa, Glycine max
  Coding DNA Sequence Number=SeqID_25235
  Homolog annotation: Hit_ID=Q9FGF5; Match level="QueryCoverage=42%, HitCoverage=30%, E-value=3e-07, Identity=54%"; Hit description =Arabidopsis thaliana genomic DNA, chromosome 5, P1 clone:MVP7
MGKQQQSLIPPPSELGYMDYTTPFSSEVDGMERGIAYKGVAFTGLEGEFLVVHGESVEVREGIGGTGEGRVDGSIHLVEACGYGFSLLGHASAVPNGKKGLVGFMWERRGKGVAVFIGFHPKHST

SEQ ID NO: 142014 - protein, 334 aa, Glycine max
  Coding DNA Sequence Number=SeqID_25236
  Gene Ontology: Cellular component=integral to membrane; Biological process=response to nematode
  Homolog annotation: Hit_ID=Q6K5X9; Match level="QueryCoverage=99%, HitCoverage=96%, E-value=1e-117, Identity=64%"; Hit description =Transmembrane protein-like
  Pfam annotation: Domain name=TPT; Domain location=156-311; Score =131.0; E_value=3.4e-36; Accession=PF03151.7; Description=Triose -phosphate Transporter family
  Subcellular localization annotation: CTP_CleavageSite=36; ConfidenceScore=5.17e-01
MAPASKAEKKATVDAAAWVFNVVTSVGVIIVNKALMATYGFSFATTLTGLHFATTTLMTTLLRILGYVQPSHLPLPELLKFVFFANFSIVGMNVSLMWNSVGFYQIAKLSMIPVSCLLEVFFDNIRYSRDTKLSIGVVLLGVGVCTVTDVSVNTKGFVSAFMAVWSTSLQQYISYSCTATLPREYVHFLQRKYSLSSFNLLGHTAPAQAASLLLLGPVLDYWLTNNRVDRYAYNAGSLIFIFMSCTIAVGTNLSQFICIGRFTAVSFQVLGHMKTILVLIMGFFFFGREGLNVHVVLGMVIAVFGMIWYGNASSKPGGKERLNHTLPTNKIENR

SEQ ID NO: 142015 - protein, 236 aa, Glycine max
  Coding DNA Sequence Number=SeqID_25237
  Homolog annotation: Hit_ID=Q0KIN0; Match level="QueryCoverage=23%, HitCoverage=3%, E-value=4e-14, Identity=63%"; Hit description =Integrase core domain containing protein
MVNPIETEDGSNHVVALDKHGSAAASEGPSWQWNNMSRGGKKKRKGRGNNYKTSRRGLGFVHLNLASLALKTMAGFPAMRWEQGLFDCCLAQQKEVHESVSVVLSRRCQWRGVDRQKVVQIRGLFGQKGRWSTSSSRRQSPENLKQESTTWCILDVSKNVHDSIPMAITRGIKELTYHTYCKGDVWPGERKAIESTKHGPTAELETEPSEAMKTEAKQHKGGSLEEGVAHLLGESA

SEQ ID NO: 142016 - protein, 448 aa, Glycine max
  Coding DNA Sequence Number=SeqID_25238
  Gene Ontology: Mol. function=carboxypeptidase A activity; Cellular component=integral to membrane; Biological process=proteolysis
  Homolog annotation: Hit_ID=Q1S2R2; Match level="QueryCoverage=93%, HitCoverage=86%, E-value=0.0, Identity=83%"; Hit description =Peptidase M14, carboxypeptidase A; Carboxypeptidase regulatory region
  Pfam annotation: Domain name=Peptidase_M14; Domain location=72-336; Score=257.3; E_value=3.2e-74; Accession=PF00246.14; Description=Zinc carboxypeptidase
MDMKMNMLFFLVLFASAISSSLAKGSLQQTLLPSEEFNDGSNASSARHLLEDESQAQTSVDLAQGFMSNDELEWAIQEFGQRCSNISRGFLEWAISIGKSVNGFPLWVIEISDKPGEEETEPAFKYIGNVHGDEPVGRELLIFLANWLCDNHLKDPLATLIVENVHLHLLPSMNPDGFSLRKRGNANNIDLNRDFPDQFVFINDDEDSRQPETRAIMNWLRDIRFTASATLHGGALVANYPWDGSDDKRTKYYGCPDDDAFRFMSSIYSHSHYNMSSSKEFLGGITNGAAWYPLYGGMQDWNYIHAGCFELTLEISDNKWPNAAELPFLWRYNKMSMLNLVASLVKTGVHGRIYSSGDGRPLPGSITVSGINYTVRAGNTFGDYHRILAPRDKYEVVATMPGYKSKNTTIWLDEGPVTLDFVLDPERRQKVKFSTSRQSAGAKRTVEV

SEQ ID NO: 142017 - protein, 314 aa, Glycine max
  Coding DNA Sequence Number=SeqID_25239
  Gene Ontology: Mol. function=binding; Cellular component =mitochondrial inner membrane; Biological process=transport
  Homolog annotation: Hit_ID=Q94AG6; Match level="QueryCoverage=94%, HitCoverage=86%, E-value=2e-98, Identity=63%"; Hit description =Putative mitochondrial carrier protein
  Pfam annotation: Domain name=Mito_carr; Domain location=125-211; Score=71.0; E_value=3.8e-18; Accession=PF00153.17; Description =Mitochondrial carrier protein
  Pfam annotation: Domain name=Mito_carr; Domain location=216-306; Score=115.3; E_value=1.7e-31; Accession=PF00153.17; Description =Mitochondrial carrier protein
  Pfam annotation: Domain name=Mito_carr; Domain location=27-103; Score= 61.1; E_value=3.7e-15; Accession=PF00153.17; Description =Mitochondrial carrier protein
  Pfam module annotation: Pfam domain module=Mito_carr::Mito_carr::Mito_ carr; Domain location=125-211::216-306::27-103
MSVQKDQDKFFLSISQGEKKPFDFLRVLYDGCIAGGAAGVVVETALYPIDTIKTRLQVARDGGKIVLKGLYSGLAGNIVGVLPASAIFIGVYEPTKQQLLKSLPENLSAVAHFVHFNICKQNVEDTAKCKAAGAIGGIASSVVRVPTEVVKQRMQIGQFKSAPDAVRLIVANEGFKGLFAGYGSFLLRDLPFDAIELCIYEQLRIGYKLAAKRDPNDPENAMLGAVAGAVTGAVTTPLDVVKTRLMVQGSQNHYKGISDCVRTIVKEEGSHALFKGIGPRVLWIGIGGSIFFCVLEKTKKILAQKRHSKAETQN

SEQ ID NO: 142018 - protein, 117 aa, Glycine max
  Coding DNA Sequence Number=SeqID_25240
YQQEPFTRLLKQENGPTLTNPLLITGRLKADLVLLKERALSIPSWPAPVLSYSIRKLMILEQVTSISNPPEVMLNRKVIKKCHSTIAIDRTFTIALPEWNGSSLLSPNPCAFKNKPI

SEQ ID NO: 142019 - protein, 192 aa, Glycine max
  Coding DNA Sequence Number=SeqID_25241
MTLTIPELFLRPYQVRWDATVFGVVNPDFPLYIKHEDLSEIAHGGQCLSISVLQLWILHLTETCMRVGNSDIYGFLDPQSIQRSAQSQFESESYIKSWMQSSQRDVYLGAYLNGFHCSGHWQMVAILPKEHLVVWFCSLHNRPDNYLKGIINSTIKGLDDGPQPKSKASARWIVVKYFNDPRPLELERLKAL

SEQ ID NO: 142020 - protein, 71 aa, Glycine max
  Coding DNA Sequence Number=SeqID_25242
MAALPIHIIVEILRDEHGVLNPCSHELVVVEVVVPTRKVTFKESYNFHSKIVLELCLKPMTLKVIDGRRQL

SEQ ID NO: 142021 - protein, 262 aa, Glycine max
  Coding DNA Sequence Number=SeqID_25243
  Gene Ontology: Mol. function=transporter activity; Cellular component= membrane; Biological process=transport
  Homolog annotation: Hit_ID=Q1H1L0; Match level="QueryCoverage=92%, HitCoverage=50%, E-value=2e-45, Identity=40%"; Hit description=RND efflux system, outer membrane lipoprotein, NodT
  Pfam annotation: Domain name=OEP; Domain location=42-229; Score =132.1; E_value=1.5e-36; Accession=PF02321.8; Description=Outer membrane efflux protein
FRPAAPVPETYPGQPANESVTNVPVTEAPPLTWQSYFPDADLQKLIQVGLQHNRDLKTAVLRMDEAKATYGVQKADRLPTIQGNLNYDRSRTVFSSSQAFEAELFRVGVGISEYEIDVFGRVKSLTQSALEQYLAVAENRQAVQVTLVTEIATQYVNYLAIQAQLKVSQQTLADRQQMLQRTQRRFDAGLDQVLDVKAAQIQVEQVQAQLAQWQRQLATTQNALYLLLGEPSQRTPLPVKPLEDLKLTSPNCSRIPAVMGIL

SEQ ID NO: 142022 - protein, 137 aa, Glycine max
  Coding DNA Sequence Number=SeqID_25244
MSMKEHESFKEYAQRWRDLVAQVAPPMMEREMIKMIVDTLLVFYYKKMVGYTPSRFADLVFAGERIKVSLKRGKFDHPAMMNKKPGANGENKEGGTHAVNVVPTWPNFPPAQQCQYSPNINPPHYPPPYQPRTLNHP

SEQ ID NO: 142023 - protein, 52 aa, Glycine max
  Coding DNA Sequence Number=SeqID_25245
MHVHHCCPVSRRIGEDLVDTTPSPRPKVRADIGPVIDRLSSYVWLKTLKKRY

SEQ ID NO: 142024 - protein, 191 aa, Glycine max
  Coding DNA Sequence Number=SeqID_25246
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=3e-18, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MITRPRLQRATRLYLRGLHALTFRGLHVLILKGLHALTFRGQNVLTFRGLHALTIRGLHVLAFTLLRVLSIRGLHALAFRGLDILAFRGLDVLAVRGLHFLAIRGGLHALAIRRLHVLAFRGLHVLPFRGLHAPVFRGMHVLTFIGLQVLAFRGLHVLAIRGLLALAIRGLHALTFRELHVLALRPTRSHL

SEQ ID NO: 142025 - protein, 117 aa, Glycine max
  Coding DNA Sequence Number=SeqID_25247
  Homolog annotation: Hit_ID=Q1RY20; Match level="QueryCoverage=49%, HitCoverage=12%, E-value=4e-13, Identity=45%"; Hit description =Proteasome/cyclosome, regulatory subunit
MKIEFKHLLLVQGFLLLVRCKDYVKAWKRLTVKCAPNILTIALKRFQVLDSVEEIIEVSKTFNEKIRKCSDMTLLSCAYAGIGNVLKNIRRAIPLALGLLCISNPKVGKNIEQTSYQ

SEQ ID NO: 142026 - protein, 225 aa, Glycine max
  Coding DNA Sequence Number=SeqID_25248
  Pfam annotation: Domain name=PPR; Domain location=135-169; Score =20.6; E_value=0.0058; Accession=PF01535.11; Description=PPR repeat
RVCKSYYLLCNVILFVLISTTAIRQGNLTSQAVAVRNKDNLIKTPKSKYGWPRRRSTESTPSLTINVEVEYNIDNNHGSDDEGDRKSNNEGHRKSDSEGLGQDETNEGVGNICLPMSADQLRESAAAPPRWNPTTAWNNQLRQLSKQRQYREALTLYRHMLRSSFFPNTFTFPFLLKSCAFLSLPLAASQLHAHVIRTGSQPDPYTRSSLINTYAKCSLHHHAPQ

SEQ ID NO: 142027 - protein, 102 aa, Glycine max
  Coding DNA Sequence Number=SeqID_25249
  Subcellular localization annotation: CTP_CleavageSite=25; ConfidenceScore=5.04e-01
MNSTQLPILGTLQKRCWLIPTFTVPSESAFSVGGQKWSSLKMVVLAQAILFFMRIKIEILSILVLEDSMLESRERCMQLEEAVISFNFYYDVHDCSDLTVEG

SEQ ID NO: 142028 - protein, 125 aa, Glycine max
  Coding DNA Sequence Number=SeqID_25250
  Gene Ontology: Mol. function=phosphopantetheinyltransferase activity; Biological process=macromolecule biosynthetic process
  Homolog annotation: Hit_ID=Q1SIY2; Match level="QueryCoverage=83%, HitCoverage=77%, E-value=1e-32, Identity=67%"; Hit description=4' -phosphopantetheinyl transferase family protein, related
MGHWCTKRVKRFYLILALKILEAYVKAIGRGFSASPFKTFTIRLRDLMKGDNHARDMSRSCKAPDVTVEPSDDVKNPSSNWQFVVLELAGSHYAAVCIEQDGTDAGNGSIPINLTLRKTIPYVED

SEQ ID NO: 142029 - protein, 81 aa, Glycine max
  Coding DNA Sequence Number=SeqID_25251
  Subcellular localization annotation: CTP_CleavageSite=40; ConfidenceScore=5.04e-01
MAKHTAVSNTGFGHSLTCSHSKRILSQKRRLYAAIAVALKCGHGTSSMKCKIDPNSEVNKKLKSTSFSTTNASYPSQAKFD

SEQ ID NO: 142030 - protein, 486 aa, Glycine max
  Coding DNA Sequence Number=SeqID_25252
  Gene Ontology: Mol. function=catalytic activity; Cellular component =intracellular; Biological process=metabolic process
  Homolog annotation: Hit_ID=Q8LQE8; Match level="QueryCoverage=97%, HitCoverage=74%, E-value=1e-128, Identity=50%"; Hit description =Pentatricopeptide (PPR) repeat-containing protein-like
  Pfam annotation: Domain name=PPR; Domain location=18-52; Score=1.4; E_ value=5.2; Accession=PF01535.11; Description=PPR repeat
  Pfam annotation: Domain name=PPR; Domain location=185-219; Score =42.6; E_value=1.3e-09; Accession=PF01535.11; Description=PPR repeat
  Pfam annotation: Domain name=PPR; Domain location=220-254; Score =15.0; E_value=0.13; Accession=PF01535.11; Description=PPR repeat
  Pfam annotation: Domain name=PPR; Domain location=256-290; Score =13.7; E_value=0.18; Accession=PF01535.11; Description=PPR repeat
  Pfam annotation: Domain name=PPR; Domain location=84-118; Score=43.7; E_value=6.5e-10; Accession=PF01535.11; Description=PPR repeat
  Pfam module annotation: Pfam domain module=PPR::PPR::PPR::PPR::PPR; Domain location=18-52::185-219::220-254::256-290::84-118
MRREEEDGLDVDVNVNAVTLLSLVSGCSVATHLTIGVCLHGCCVRFGFVTDLAVANSLVTMYVKCGEVELARKVFDEMLVRDLITWNAMISGYAQNGHARCVLEVYSEMKLSGVSADAVTLLGVMSACANLGAQGIGREVEREIERRGFGCNPFLRNALVNMYARCGNLTRAREVFDRSGEKSVVSWTAIIGGYGIHGHGEVALELFDEMVESAVRPDKTVFVSVLSACSHAGLTDRGLEYFKEMERKYGLQPGPEHYSCVVDLLGRAGRLEEAVNLIKSMKVKPDGAVWGALLGACKIHKNAEIAELAFQHVVELEPTNIGYYVLLSNIYTDANNLEGVSRVRVMMRERKLRKDPGYSYVEYKGKMNLFYSGDLSHPQTKQIYRMLDELESLVKEVHPPNEKCQGRSEELLIGTGVHSEKLAIAFALLNTKSGTEITVMKNLRVCVDCHLFIKLVSKIVNRQFIVRDATRFHHFRDGICSCKDYW

SEQ ID NO: 142031 - protein, 80 aa, Glycine max
  Coding DNA Sequence Number=SeqID_25253
  Subcellular localization annotation: CTP_CleavageSite=33; ConfidenceScore=5.17e-01
MREGSFGWKETPPPSFLCFQVQGCSPRRAQLAQASSARPSELTLILGCLPATLSACPEMGMGRRSIDRDPSLYSRPSPST

SEQ ID NO: 142032 - protein, 109 aa, Glycine max
  Coding DNA Sequence Number=SeqID_25254
  Gene Ontology: Cellular component=intracellular; Biological process =signal transduction
  Homolog annotation: Hit_ID=Q9FMR1; Match level="QueryCoverage=80%, HitCoverage=19%, E-value=5e-16, Identity=52%"; Hit description=Rac GTPase activating protein
  Pfam annotation: Domain name=PBD; Domain location=76-106; Score=25.3; E_value=0.00013; Accession=PF00786.18; Description=P21-Rho-binding domain
LPFNVATLVPTLVVPRWRMMHAKEEEEEGDLKMNIERDKEGDDHVSILALLVVALRKSLIGCSKYSSSSCDPSSMEIGLPSNVRHVAHVTFDRFNGFLGLPVEFEPEVP

SEQ ID NO: 142033 - protein, 116 aa, Glycine max
  Coding DNA Sequence Number=SeqID_25255
  Gene Ontology: Cellular component=intracellular; Biological process =signal transduction
  Homolog annotation: Hit_ID=O82458; Match level="QueryCoverage=96%, HitCoverage=22%, E-value=8e-31, Identity=66%"; Hit description=Rac GTPase activating protein 1
MADPLTALMHVVQVMNFLKTLEMKTLREREGSTVKSNTVSDLNSFGDDNHQSSSQLKLKDGSENGSDFSEEDKVFVAEEPSQPSYPSHLIEYYGYETKSGSKDLHTPTKNIIPREN

SEQ ID NO: 142034 - protein, 150 aa, Glycine max
  Coding DNA Sequence Number=SeqID_25256
  Gene Ontology: Cellular component=intracellular; Biological process =signal transduction
  Homolog annotation: Hit_ID=Q2HTG0; Match level="QueryCoverage=78%, HitCoverage=29%, E-value=8e-48, Identity=71%"; Hit description =RhoGAP; Wiscott-Aldrich syndrome, C-terminal
  Pfam annotation: Domain name=RhoGAP; Domain location=14-129; Score =11.9; E_value=1.5e-06; Accession=PF00620.17; Description=RhoGAP domain
MQLSYDATRGNSVPTLLLLMQRQLYAQGGLQVEGIFRINAENSQEELAWFRELLTGVLDPLSPEQVMQSQSEEECAQLVRFLPQTEATLLDWGINLMADVAQLEHLNKMNARNVAMVFCTKHDSRKEDEDMEMEKTQDTSNMKSFVVGDV

SEQ ID NO: 142035 - protein, 123 aa, Glycine max
  Coding DNA Sequence Number=SeqID_25257
  Gene Ontology: Biological process=auxin mediated signaling pathway
  Homolog annotation: Hit_ID=Q2HTF3; Match level="QueryCoverage=97%, HitCoverage=94%, E-value=2e-38, Identity=68%"; Hit description=Auxin responsive SAUR protein
  Pfam annotation: Domain name=Auxin_inducible; Domain location=17-107; Score=92.8; E_value=1e-24; Accession=PF02519.5; Description=Auxin responsive protein
MVSLKKLAKRVKGVGGADHSDPPYQECLLKGYEEGKESPSSTTPTGFFALYVGEERQRYVVPTSYLSHPLFKMLLEKAYNEFGFAQRNGLVVPCSVSTFQEVVNAIECNNGKFDLGKIFEDFA

SEQ ID NO: 142036 - protein, 103 aa, Glycine max
  Coding DNA Sequence Number=SeqID_25258
MRLEALIKEKEEREKEHGSWPCRCRWCRCSPPQSGERENEEDEGAVFLLQLAHRHALKSSITHTRWKMEVKEEKMEMKPGFITTEVEDGETLAQKCEVGTQSE

SEQ ID NO: 142037 - protein, 83 aa, Glycine max
  Coding DNA Sequence Number=SeqID_25259
MLALREKLFFSRRNPESFREKDPSHVGPWNRDFNLFSFSLTFGNPNRAIGGGTLESTENVPIDNGECLSDYIEIKDELFIFGE

SEQ ID NO: 142038 - protein, 226 aa, Glycine max
  Coding DNA Sequence Number=SeqID_25260
MDFWLVRTIEETGIEMMLSWVSNACAHVNTKESCVDPSGNDPETGDSDKCGLVGVEEVKDAEASVPVPTDEVMWDATVFGVFNQNFSLYIKHEDLSEIAHGAGNFDVYEFLEPQSIQRSGQSQFESEVTSRVGCRVQNAIHLQMVIIPPKENLVVWFCSLHNMPDNYLKGIINSALKGLDDTPQPKSKATAWWIVVKCNRQKGSTECDYYVMHWMSTIILGTFNNN

SEQ ID NO: 142039 - protein, 116 aa, Glycine max
  Coding DNA Sequence Number=SeqID_25261
MAKVVTTKCWNARKRSKHSGEAKRRKEENRREEANRQEREEEENVHLLESVPEQNIARAPLVNMGCLDYVVGYLYTDNHRIVLYRSTLGGVLAHFGIAKMSIANALSMICDLLAVR

SEQ ID NO: 142040 - protein, 73 aa, Glycine max
  Coding DNA Sequence Number=SeqID_25262
MTTGDPPQQKTRQGNEKKKEDENVTQGDSPQEERILRIEIEEELKNITEGDPPKQKRSQGNEKKIEDDNITQG

SEQ ID NO: 142041 - protein, 55 aa, Glycine max
  Coding DNA Sequence Number=SeqID_25263
MRIWATWEYVSSVGGGQQGMSGTWRYVAGVKRPWGRQVGCYCPKPSLTNPDPTRA

SEQ ID NO: 142042 - protein, 55 aa, Glycine max
  Coding DNA Sequence Number=SeqID_25264
GYGLLRSRYIGTDASGDRVTTDRSLPLPGAKQAENVAARQPSILCIRSFFYNCLF

SEQ ID NO: 142043 - protein, 150 aa, Glycine max
  Coding DNA Sequence Number=SeqID_25265
  Subcellular localization annotation: CTP_CleavageSite=48; ConfidenceScore=5.16e-01
MDRARLIFGLVSQLDMNVGALISGQITSMAQSNSSRLGFPALITALCRSRGVASDSLVFERLIPVINLAYIRKNYWNPTDLTVTIRGARRARARPVEAPSTFAAPPPAPWPETQPPLHREDEGLTAQVPQQREDESSETSMPKPLIRRKR

SEQ ID NO: 142044 - protein, 72 aa, Glycine max
  Coding DNA Sequence Number=SeqID_25266
GLVGACALSTNLDRLACISEFRLSVRLLAQRVDSSGALSRITACSENMHSSSFLQILPCAQPKECCTQRMAR

SEQ ID NO: 142045 - protein, 188 aa, Glycine max
  Coding DNA Sequence Number=SeqID_25267
LFVLQIAKKNVYTEYHSGISARQRDSKVSMTDLVSAEDYAFGLTDSKKVYTDNHSGISARQRDSKVSMTDPVSAEDDAFRLRDIKKVYTDNHSGISARQRDSKVSMTDLVSAEDDVNLRVSTGLSAAIDEGRRRRPKRNVYTDNHSGISTRQRDSKVSMRDLVSAEDDVNLRVSTGLSAAIDESRRRR

SEQ ID NO: 142046 - protein, 80 aa, Glycine max
  Coding DNA Sequence Number=SeqID_25268
MGAKYLKVVKRGSHPNKRKAQNDHNLSLCAIGHDRAWMERHRMTVICLCAPSDTIASGWRKGVRNDHILSPPATQLTAPE

SEQ ID NO: 142047 - protein, 202 aa, Glycine max
  Coding DNA Sequence Number=SeqID_25269
RQNLHKHLANLQEGSIDVAVVKEFYASFYSLADQAPKCARIRGHLIKIDADSLNEFLQTPVLLEEGESLPTYYRFYNLRSDPIEIEASLCIPSKGFILNTEGQPWKLLRKDHTTLAQTWSVFSYSNLAPTSRTSDLNIDRARLVYGLITRMDMHIGGLIFGQMTMMAQSNSSRLGFPALITALCRSRGVGSDAFTSNENLRP

SEQ ID NO: 142048 - protein, 206 aa, Glycine max
  Coding DNA Sequence Number=SeqID_25270
  Gene Ontology: Mol. function=transferase activity, transferring glycosyl groups; Cellular component=membrane; Biological process =polysaccharide biosynthetic process
  Homolog annotation: Hit_ID=Q46632; Match level="QueryCoverage=100%, HitCoverage=68%, E-value=4e-84, Identity=71%"; Hit description =Amylovoran biosynthesis glycosyl transferase amsB
MVGRQRFGDHHKFVAHAVGADAEVIILMANIARIKLDSGGIFAFQHDSTGLDKAVTAKQVLRHGLIFPRRLHRHHFEEAAVLMNIDLAEDDIARFTLRFQLADGIAHFQQLVRVPLVVGIEEADEVALRQFNTFVARAGTVEFDLRQFQFDVQILIALTAHHLRQFRGIGGFVIHDDDFKVAIGLRFDAIQRRDNRFRRVISGNYN

SEQ ID NO: 142049 - protein, 296 aa, Glycine max
  Coding DNA Sequence Number=SeqID_25271
  Gene Ontology: Cellular component=membrane
  Homolog annotation: Hit_ID=UPI00003CCEE6; Match level="QueryCoverage =98%, HitCoverage=91%, E-value=1e-112, Identity=69%"; Hit description= COG0697: Permeases of the drug/metabolite transporter (DMT) superfamily
MLGGQRLGLDPHRAQYADHQQHDAGQRQRLRQAASQDEGIGQRGQRLEHDQLPGQRGRQALAGFVPAQRAQPRGEQADDDHEPQEHLGTRPQRHVEATAGGGHAAPQQAIAGQRQRQGGHALGGGPGARTAARMVAQPVGVAQRIPGPARHRAQRQHGADRVARQVGIGLLAQGLQFRLVDASDAQCDQRQRGRQPLPGQPAVAARVAQVGADGDHHWQRADDHGRHRAAGALDGAGQAQVVQQVADGGQLQGLDPVSATELAQRLAVQPGQRQGDQAEGQVARHRLQGGGVFRQQ

SEQ ID NO: 142050 - protein, 95 aa, Glycine max
  Coding DNA Sequence Number=SeqID_25272
MHTRGSRPQDTQWTRKSPTGPWDFQLWLRASISPIGCPSPPARSCHRDIGKDHARKTPSGPGEVQQGLGVSSSDYEPLSVLRSAYRPQQGHQAPY

SEQ ID NO: 142051 - protein, 336 aa, Glycine max
  Coding DNA Sequence Number=SeqID_25273
  Gene Ontology: Mol. function=DNA binding; Biological process=DNA integration
  Homolog annotation: Hit_ID=Q1SS72; Match level="QueryCoverage=92%, HitCoverage=22%, E-value=1e-54, Identity=35%"; Hit description =Integrase, catalytic region
  Pfam annotation: Domain name=zf-CCHC; Domain location=278-295; Score =8.6; E_value=0.037; Accession=PF00098.13; Description=Zinc knuckle
  Pfam module annotation: Pfam domain module=Retrotrans_gag::zf-CCHC; Domain location=66-175::278-295
MSEEQDESLSIHSPYYLHPSENPAIALVSPLLDPTNYNSWSRSTLMALSPKNKVEFVMVPFLDQPRIIDFATSICQSILWMDNAVDIWKDLKARYSQGDLLRISHLQHKLTSIKQGDMNITDYFTKLRTIWDELESYRPDLVCTCASKCGCDALVEVKKRKDQDRIMEFMRGLNDQYNHVRSNIIIMDPLPLINKALSYMAQQERKFASFDALGNLSLVNAVANTRLSNSCSYYGRDNYTVEICYKKNGFSPNFFSNRGGGGRGFGRGKTGGKSTNDKVCTHCGIINHTVDECYKKHDYPPGHKFYKPQGASVNNTIKEEENVSVQRLVIMAKTLK

SEQ ID NO: 142052 - protein, 266 aa, Glycine max
  Coding DNA Sequence Number=SeqID_25274
  Gene Ontology: Mol. function=helicase activity; Biological process =protein amino acid phosphorylation
  Homolog annotation: Hit_ID=Q1SN45; Match level="QueryCoverage=60%, HitCoverage=9%, E-value=5e-34, Identity=42%"; Hit description=AAA ATPase
  Pfam annotation: Domain name=DUF889; Domain location=1-184; Score =149.1; E_value=1.1e-41; Accession=PF05970.5; Description=Eukaryotic protein of unknown function (DUF889)
MCLQNNMEATDQEEIAAFAQWIIDIGDGIIGDENDGYATIEIPQELLITEYNDPIHSIISSTFPDLSCHHNDPEYFQTRAILASTNETVQRVNDYMLTMIPGEQMEYLSSDSVDKSKTIESCHFRSLSTKFLNSLTTSGLPNHCLKLKIGTPIILLRNLDQTQGLCNAIKIPLHLPPPPQSFILIILPIHVQSLNGTFNAPQFSNHLTCRHLHPAPPKSNDPSTTHYFTLSDHGSFLCHLHFNSNQIILSKQLPPCLALHPLPQAK

SEQ ID NO: 142053 - protein, 240 aa, Glycine max
  Coding DNA Sequence Number=SeqID_25275
  Gene Ontology: Mol. function=transporter activity; Cellular component= integral to membrane; Biological process=transport
  Homolog annotation: Hit_ID=Q0B322; Match level="QueryCoverage=76%, HitCoverage=44%, E-value=7e-60, Identity=61%"; Hit description=Major facilitator superfamily MFS_1
MAGESFRLAHAAANHKRHQRRQQANQEHTAPANHAQQRRRDKGRQQYAELPADTDPRRGAVALLLRPGFGNQRHADAKLTAQPHAGQRTIRQQIPVALRHGAQPGKQREHQDRHGQNADAAVAIAQMTKHNAADHRADQRPGHQRTGLRRIQRQRHADRRQHKAQNQQIKSIHGIAADGSHHRFRRRNGGFVVICRGHKTAPGRKMCAKYKESGRLRTGRNQAHCLSASALTGSHHVNQE

SEQ ID NO: 142054 - protein, 109 aa, Glycine max
  Coding DNA Sequence Number=SeqID_25276
MVIQTLLGSALREPYFARALFFDLYLISSSSPSKVSSSPSKLLLLHRALNPDSSPPYIGENPLLPVIVIYIANTGEINVLIIIEQAVKVQEWSFCVSSGLVVNLFEFNF

SEQ ID NO: 142055 - protein, 128 aa, Glycine max
  Coding DNA Sequence Number=SeqID_25277
MPLGGWIALVHPLCSSGGYIHLVVQREQGRVHPLWIFACKGFYKVIGNLKNRWLLGDWIKDTFIINSTPLLDYSEALYPTINLVCNKVDDAILPPRALDKRLQEDWAKDARESPRILMSLRVDFGLMG

SEQ ID NO: 142056 - protein, 40 aa, Glycine max
  Coding DNA Sequence Number=SeqID_25278
VQKRKVIAPQFDARASWWTQGPDAIMQLVSLDICGHLHVA

SEQ ID NO: 142057 - protein, 53 aa, Glycine max
  Coding DNA Sequence Number=SeqID_25279
MKEQMTTMMEAMMSMRKIMEVNTTTVVAARIAIEVHPTHPPGFNQVNHPALDM

SEQ ID NO: 142058 - protein, 58 aa, Glycine max
  Coding DNA Sequence Number=SeqID_25280
MTLPDSYHHVKYGGVDASIFKIGFALFIIRDVSVDLPELLAPTIRGAKTILKNGSQRI

SEQ ID NO: 142059 - protein, 117 aa, Glycine max
  Coding DNA Sequence Number=SeqID_25281
MATTRWALKHPVYGIVILRLRIYTDRPNVSKLCSFISSMNSSILISDDVPKWKTLHDSGISKNTIDNNEVNTNVTVQTTSSHATGLLGHGNKKWGGRQKQGFCSYVSSMCDEELRPT

SEQ ID NO: 142060 - protein, 181 aa, Glycine max
  Coding DNA Sequence Number=SeqID_25282
EETQRSIMLDGGKSSEESTLASRKGSTRRSSSYEKFSIKDNREKCYIYYKWSRHIKDNCFELLGREKVLERMGGHQDPAQTFNTRDLHVHGHQVEPSDLISVVGKSRGVVVQNQHAPIISIIQSFLDHDLKQTLLGYKFWVKVWYQVLLCGGSWSIGVNLPGVYSPRISPTTGIRVVGSTW

SEQ ID NO: 142061 - protein, 790 aa, Glycine max
  Coding DNA Sequence Number=SeqID_25283
  Gene Ontology: Mol. function=5-methyltetrahydropteroyltriglutamate -homocysteine S-methyltransferase activity; Cellular component =cytosol; Biological process=methionine biosynthetic process
  Homolog annotation: Hit_ID=Q71EW8; Match level="QueryCoverage=99%, HitCoverage=99%, E-value=0.0, Identity=87%"; Hit description =Methionine synthase
  Pfam annotation: Domain name=Meth_synt_1; Domain location=2-318; Score=590.8; E_value=1.3e-174; Accession=PF08267.2; Description =Cobalamin-independent synthase, N-termina
  Pfam annotation: Domain name=Meth_synt_2; Domain location=432-781; Score=709.0; E_value=3.4e-210; Accession=PF01717.8; Description =Cobalamin-independent synthase, Catal
  Pfam module annotation: Pfam domain module=Meth_synt_1::Meth_synt_2; Domain location=2-318::432-781
MASHIVGYPRMGPKRELKFALESFWEGKSSADDLQKVAADLRASIWKQMTDAGIKYIPSNTFSYYDQMLDTTAMLGAVPPRYGLNNGEIEFDTYFSMARGNASVPAMEMTKWFDTNYHFIVPELGPDVNFTYASHKAVNEYKEAKALGVDTVPVLIGPVSYLVLSKPAKGVDKSFCLLSLLPKVLAIYKEVVADLKEAGASWVQFDEPIFVLDLDSQTLQAFSTAYAELESTLSGLNVLIETYFADITAEAYQTLTALNGVTAFGFDLVRGTKTLDLIKGGFPSGKYMFAGVVDGRNIWANNLAASLDTLNSLEGIVGKDKLVVSTSCSLLHTAVDLVNETKLDNEIKSWLAFAAQKIVEVNALAKALSGQKDEAFFSSNAAAQASRKSSPRVTNEAVQKAAAALKGSDHRRATNVSARLDAQQKKFNLPILPTTTIGSFPQTVELRRVRREYKANKISEEEYVSSIKEEIRKVVELQENLDIDVLVHGEPERNDMVEYFGEQLSGFAFTVNGWVQSYGSRCVKPPIIYGDVSRPKPMTVFWSSTAQSMTKRPMKGMLTGPVTILNWSFVRNDQPRYVQTNSRAQKENMVISNMVLTPIYRSETTYQIALAIKDEVEDLEKAGITVIQIDEAALREGLPLRKSEQANYLDWAVHSFRITNIGVQDTTQIHTHMCYSNFNDIIHSIIDMDADVITIENSRSDEKLLSVFRDGVKYGAGIGPGVYDIHSPRIPPTDEIADRINKMLAVLEKNILWVNPDCGLKTRKYPEVNPALTNMVAATKLIRNQLASGK

SEQ ID NO: 142062 - protein, 182 aa, Glycine max
  Coding DNA Sequence Number=SeqID_25284
MAIPVRLFWKKCINNFPSFAYAPIFLQYISDFSPISLNTEGPTSSSASLMPIYSKKRALGGLTARPSELVPSPLSNLGAHESQRLAWESQASSNEEIKKICHVSIILSSTFVPLGSSLRIYRTCLLLKIGPIPRPCSSGSELLGSRPQPNAARMRASRAPSFACELRWTLRMVVDMEAVILP

SEQ ID NO: 142063 - protein, 611 aa, Glycine max
  Coding DNA Sequence Number=SeqID_25285
  Gene Ontology: Mol. function=helicase activity; Cellular component =mitochondrion; Biological process=protein amino acid phosphorylation
  Homolog annotation: Hit_ID=Q6Z7E0; Match level="QueryCoverage=88%, HitCoverage=90%, E-value=1e-128, Identity=43%"; Hit description =Putative pentatricopeptide (PPR) repeat-containing protein
  Pfam annotation: Domain name=PPR; Domain location=115-149; Score =18.5; E_value=0.024; Accession=PF01535.11; Description=PPR repeat
  Pfam annotation: Domain name=PPR; Domain location=150-184; Score =32.6; E_value=1.4e-06; Accession=PF01535.11; Description=PPR repeat
  Pfam annotation: Domain name=PPR; Domain location=217-251; Score =42.6; E_value=1.3e-09; Accession=PF01535.11; Description=PPR repeat
  Pfam annotation: Domain name=PPR; Domain location=252-286; Score =50.4; E_value=6.2e-12; Accession=PF01535.11; Description=PPR repeat
  Pfam annotation: Domain name=PPR; Domain location=287-321; Score =30.9; E_value=4.4e-06; Accession=PF01535.11; Description=PPR repeat
  Pfam annotation: Domain name=PPR; Domain location=322-356; Score =41.2; E_value=3.5e-09; Accession=PF01535.11; Description=PPR repeat
  Pfam annotation: Domain name=PPR; Domain location=357-391; Score =31.4; E_value=3.2e-06; Accession=PF01535.11; Description=PPR repeat
  Pfam annotation: Domain name=PPR; Domain location=392-426; Score =40.7; E_value=5.2e-09; Accession=PF01535.11; Description=PPR repeat
  Pfam annotation: Domain name=PPR; Domain location=427-461; Score =46.4; E_value=1e-10; Accession=PF01535.11; Description=PPR repeat
  Pfam annotation: Domain name=PPR; Domain location=462-496; Score =46.1; E_value=1.2e-10; Accession=PF01535.11; Description=PPR repeat
  Pfam annotation: Domain name=PPR; Domain location=497-531; Score =31.9; E_value=2.2e-06; Accession=PF01535.11; Description=PPR repeat
  Pfam annotation: Domain name=PPR; Domain location=532-566; Score =35.6; E_value=1.7e-07; Accession=PF01535.11; Description=PPR repeat
  Pfam annotation: Domain name=PPR; Domain location=567-601; Score =12.4; E_value=0.25; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=115-149::150 -184::217-251::252-286::287-321::322-356::357-391::392-426::427 -461::462-496::497-531::532-566::567-601
MYNVACKFHVFGLYDGVIDFRKPKGTWSRKHLGNCVFAVSKYENSGLKGNLQHSERFSKGALNGVESSPDRVNTSLNFEESEIRHLRRLIRNGELEEGSRFLEYMTNKGKSPDVIACTALIREFCKIGRTKNASQIMGILEESGAVIDVTSYNVLISGYCKSGEIEEALRVLDRMGVSPNAATYDAVLCSLCDRGKLKQAMQVLGRQLQSKCYPDVVTCTVLIDATCKESGVGQAMKLFNEMRNKGCKPDVVTYNVLIKGFCKGGRLDEAIRFLKKLPSYGCQPDVISHNMILRSLCSGGRWMDAMKLLATMLRKGCLPSVVTFNILINFLCQKGLLGKALNVLEMMPKHGHTPNSRSFNPLIQGFCNGKGIDRAIEYLEIMVSRGCYPDIVTYNILLTALCKDGKVDDAVVILSQLSSKGCSPSLISYNTVIDGLLKVGKTECAIELFEEMCRKGLEADIITYNIIINGLLKVGKAELAVELLEEMCYKGLKPDLITCTSVVGGLSREGKVREAMKFFHYLKRFAIRPNAFIYNSIITGLCKSQQTSLAIDFLADMVAKGCKPTEATYTTLIKGITYEGLAEDASKLSNELYSRGLVKRSLVEKVSLEVE

SEQ ID NO: 142064 - protein, 135 aa, Glycine max
  Coding DNA Sequence Number=SeqID_25286
MITPVVVRGYPLVLSVKEKGEEKGKGRDEVRGKGVIGKGGLEGKGKGSGDTHLVGLWLNVSMDPIVGDGQARDHFWMRSKTPVEDSEVDTLSRIVYPMGQKEAKRKSKGKRVGTSTNPVDLTGVEEGKEMFSMSN

SEQ ID NO: 142065 - protein, 289 aa, Glycine max
  Coding DNA Sequence Number=SeqID_25287
  Gene Ontology: Mol. function=nucleic acid binding; Cellular component= intracellular; Biological process=DNA integration
MELAFPGEVWKKLESQYMLKSLTNKLYLMQKLYGLKMQEGADLQQHVNAFNQIISDLARLDVNVEDEDKTCILLCSYEHLVTTLTYEKDSITLEAIQIAIMSHSQGRQNAVGKIIDATMPVFDEAYPNSMEVQVDLKHQPVILERAEPCSPRPEATPILEPGSMSLGKKFKARPVAKGYAQHKEVDYNEIFLPVIRHTSIRAVLTLVASRDMHLEQMDVKTAFLHGDLKEQIYMEQPKGFNKGGSNKLVYKLKRSLYGLKQSPRQWYKRFDSYMLQIGYRQVSMTDVFM

SEQ ID NO: 142066 - protein, 234 aa, Glycine max
  Coding DNA Sequence Number=SeqID_25288
MDLVVPHIQFCSYKHFYPESYSTGSAFNSVRVCNMACKSQIFVLPDHIRVIDFRKPNGTWSTKHLGNCVFAVSKYENSGSKGILQRFERLPKGALNGVESSSANGVNTSLNFEESEIHHLHVLIKNGELDEASRTKNATRIMGILEESGAVIDITIYNVFDWNIGGVDADLSCPMCHGDDVTTTHLFSCRLRSLDDILVSGYLVDLVAEEHHHFPREAGLCAGGCDSLCSKRGA

SEQ ID NO: 142067 - protein, 53 aa, Glycine max
  Coding DNA Sequence Number=SeqID_25289
MTVRDPWTWKSLVSKVFLVSESMHVGQASGLAGVATEQEIFTKFISTATLGDH

SEQ ID NO: 142068 - protein, 104 aa, Glycine max
  Coding DNA Sequence Number=SeqID_25290
MSSSDRNLDDARSMHKNYLVAPAQTQAAGEEVSGCYIVAVAHGATQISIYPTNVPSEQSFSGLSSIKDHLPPKNNDLQRCFRSPQHIKELHDNTNQKHCKLLYQ

SEQ ID NO: 142069 - protein, 132 aa, Glycine max
  Coding DNA Sequence Number=SeqID_25291
  Gene Ontology: Mol. function=transcription factor activity; Cellular component=nucleus; Biological process=regulation of transcription, DNA-dependent
  Homolog annotation: Hit_ID=Q9FPP0; Match level="QueryCoverage=86%, HitCoverage=52%, E-value=1e-33, Identity=62%"; Hit description=MADS -box protein AGL16
  Pfam annotation: Domain name=K-box; Domain location=1-63; Score=10.2; E_value=6.1e-05; Accession=PF01486.8; Description=K-box region
  Pfam annotation: Domain name=Rho_N; Domain location=5-48; Score=9.8; E_value=0.036; Accession=PF07498.2; Description=Rho termination factor, N-terminal doma
  Pfam module annotation: Pfam domain module=K-box::Rho_N; Domain location=1-63::5-48
MMGEELSGLTVKELQNLENQLEISLRGVRMKKDQLLMDEIQELNRKGNLIHQENVELYQKVNLICQENMELKKKVYGTKDDNKTNRDSVLTNGLGIGEDLQVPVNLQLSQPQQQHYKEPSGTTKLGYELSII

SEQ ID NO: 142070 - protein, 324 aa, Glycine max
  Coding DNA Sequence Number=SeqID_25292
  Gene Ontology: Mol. function=double-stranded RNA binding; Cellular component=intracellular
  Homolog annotation: Hit_ID=Q5N8Z0; Match level="QueryCoverage=73%, HitCoverage=48%, E-value=7e-15, Identity=35%"; Hit description =Putative dsRNA-binding protein ODB1
  Pfam annotation: Domain name=dsrm; Domain location=245-311; Score =62.8; E_value=1.1e-15; Accession=PF00035.15; Description=Double -stranded RNA binding motif
  Pfam annotation: Domain name=dsrm; Domain location=89-155; Score =63.9; E_value=5.2e-16; Accession=PF00035.15; Description=Double -stranded RNA binding motif
  Pfam module annotation: Pfam domain module=dsrm::dsrm; Domain location=245-311::89-155
MKVEEEEEKPGGREEEKKRWVHEIFKKIKGQFCLFALSAGCTSIATPLILLSLSYYEGFDCSSFVVSSVVEVVKNVEGEGGTASERAMYKTRLQELCQRRSWTLPTYDNSREGPDHNPRFTSTVNVNGVSFHTPSPTRSAKQAQNDAAMLAFLHFSPPSPSTSCPTFPQHSLSISALSSFPQPSLFASSSGSPDPSSVVDDILLTNGVLQPKLEEVCQTSQISGPVIAVRDTITAEDQKNMLHLYKNQLQSYVQKNNLSLPVYSSEWEGPPHAMRFKCKVTVDGQTYESDKFYSTLKDAEHAAAEAALISLSPGRVQEASLSHL

SEQ ID NO: 142071 - protein, 626 aa, Glycine max
  Coding DNA Sequence Number=SeqID_25293
  Homolog annotation: Hit_ID=Q5XM22; Match level="QueryCoverage=18%, HitCoverage=90%, E-value=2e-22, Identity=41%"; Hit description =Resistance-like protein HAAS-2
MVKTRGLGCVLGRVVARGLGREGDGDDTDGAPQRRRPTASACRRRVPVIIDDVVPVVPTDLPAVPEAEAAVAGDEPMDTGAQDIGDELEGFPGGPRDPSVLTKYADHVAPTYGLDRPVPAIEDMVAGTGLSPLIACSIDTGDQGLISSFVERHSVHPGHFVHFEHFEHSEYFVAGDFEYFDFEHSTTNFHTENMAQPPPRERTLREMVAPDFIYESLCIQYPDECVPYVLKTGLIHLLPKFHGLAGEDPHKHLKEFHIVCSTMKPPDGVAKDWLYYLAPRSIFSWDDLKKTSSFHLPVGEISIMLDDVAALLHLPIVDALHDFQPLRTDEAVLLLVELFMVSPEVAMAKTGQCDGPYVCLQWLRDIYQCRCQTRHWTAAARAYLLHLLSCTLFANKSTTYVHVVHLQALCDLTLARRLNTNRQLVGYITLLQCWIYKHFLSVVECNADPDYDEVSPRACRWIATKKTMKKVSTAMYRQCLDRLQIPHVRWGPIVVKYRLKRVMRQFGYIQCIPAHPVHPWVSYDDVDDTWTHYSDHLATADDPCVVPGPKVRYPSGPESDIPQVSDDPVRSDVDEPRHAVEACDAIAERLERHLSLGVVTSGTSTYEVIKECLKIARSVTQDHIVY

SEQ ID NO: 142072 - protein, 82 aa, Glycine max
  Coding DNA Sequence Number=SeqID_25294
MEKSSSSPRTGLLSCLGCLKLKLPWTRRTSTYKPVGGFGYDPLSYAQNFDEGCMDDEEESTSRRRFSDRFAAPSSSSTKTLK

SEQ ID NO: 142073 - protein, 89 aa, Glycine max
  Coding DNA Sequence Number=SeqID_25295
CVCGHRGWAGGLVLQELGIEVLKLPKLGLHSLDGMIIDHGGGGKRGGRRREPQQRRQREERAEARLSERWATERRRLRDMAWLRTRNWV

SEQ ID NO: 142074 - protein, 384 aa, Glycine max
  Coding DNA Sequence Number=SeqID_25296
  Gene Ontology: Mol. function=glycine hydroxymethyltransferase activity; Cellular component=mitochondrion; Biological process=L -serine metabolic process
  Homolog annotation: Hit_ID=Q45FE6; Match level="QueryCoverage=100%, HitCoverage=75%, E-value=0.0, Identity=85%"; Hit description=Serine hydroxymethyltransferase
  Pfam annotation: Domain name=SHMT; Domain location=45-384; Score =809.9; E_value=1.4e-240; Accession=PF00464.10; Description=Serine hydroxymethyltransferase
MAMALRRLNKPFSNATSIYRQSSSLSAHEKHKSRADWIKQLNDPLEAIDPEIADIIELEKARQWKGFELIPSENFTSLSVMQAVGSVMTNKYSEGYPGARYYGGNEYIDMAETLCQKRALEAFQLDPAKWGVNVQSLSGSPSNFQVYTALLKPHERIMALDLPHGGHLSHGYQTDTKKISAVSIFFETMPYRLNESTGYIDYDQLEKSAALFRPKLIVAGASAYARLYDYARVRKVCDKQKAVLLADMAHISGLVAAGVIPSPFDYADVVTTTTHKSLRGPRGAMIFFRKGVKEINKQGKEVLYDYEDKINQAVFPGLQGGPHNHTISGLAVALKQAMTPEFKNYQKQVLSNCSAFAQSLLEKGYELVSGGTDNHLVLVNLRNK

SEQ ID NO: 142075 - protein, 571 aa, Glycine max
  Coding DNA Sequence Number=SeqID_25297
  Gene Ontology: Mol. function=nucleic acid binding; Cellular component= chromatin; Biological process=DNA integration
  Homolog annotation: Hit_ID=Q1RSG2; Match level="QueryCoverage=90%, HitCoverage=89%, E-value=2e-65, Identity=43%"; Hit description =Integrase, catalytic region; Zinc finger, CCHC-type
VVETPNVDVALTETQQKELEGLKLKGLKEKNYLFQAIDRSILETILCKETSKDIWDSMNKKYQGSNRTKRAQPQALRKEFEMLHMKSDESVTNYFARTMTIANKMCFHGGNMEDVVIVEKILRSMAPKYNYVVCSIEESKDVDTLSLDELQSSLLIHENSQQPIHHNKMVYQRGRIGQFLTWQQPTQVFLDENDEKGQTSASGTSERIAPIVTETSPTNSDNEEELPPRIRKRPAWMDDFLVTGIPYSITHFALFSDCDPTTFESVVKEEKWQKTMNDEIDAIERNDTWELCDLPKEHKTIVARHDTIRLMIALATQNSWPIFQLDVKSTFLHGYLTEQVFIEQPPGYVKIESEHKVYRLKKALCGLKQAPRAWYSCIEAYFLKAGFTKCPNEHTLFVKSEDKDFKKSMMDEFEMIDLGMMHYFLGIEVNQIAGGIFICQKKYVGEVLDMFQMKDCNPANTPSDFSLKLHKDLEGKKVDSTLYRQIAGDQDDRKSTSGYVFVLGTSAISWLSKKQPIVTLSSTEAEFVAATVCACPTIWLRRILEELKFKQPGNEAMMAPLIYNIVKARIR

SEQ ID NO: 142076 - protein, 146 aa, Glycine max
  Coding DNA Sequence Number=SeqID_25298
MASQIRVLHFHFQLIKGQAPEFSSDHSESNVVTALQYNADPNSLVDPGLVTWNQHSKDKLKNVSSSSENTNGCTEDSSLSSDKSAPSLSGSTKVVSDSSNTYSTAVERVVVYSRKTNVEIEDGGTILPISDDRKLKQISYYSVINS

SEQ ID NO: 142077 - protein, 379 aa, Glycine max
  Coding DNA Sequence Number=SeqID_25299
MEITNIHIDNEPSIHVEHFFDIQELEKVGSTYHEGWRGLRLPCNQGSVQRKCRESGVYHVFDWMNKDSKHTIIVKGLVVAKQHKFNKTNFKAMKVVVNKSLKKVPQVDEETINRRKQKRLAKAITDEDKSLLSFSIAKKIYKRMEHKTMKRQKPTGASIPSRLAREKIAPQGLKDLNETDDEEEDNVKPYFDPNVFGMPPITNEWKVRQSFINCLKNLPIVFHETTYNLSKMEEQAFIDHQAAIDQTKVVYDNIVNKVIIDVTDTVVIEEILEDAPDVIIIYSTSSSPTALNYAPPTIENEQFRLSMQNAITTQFSNLGVTLLQNLQQAQMPMLGYVATPTPIVTTHALALIQQPPFVERTPHLPPSSTLPIPPPEVQR

SEQ ID NO: 142078 - protein, 641 aa, Glycine max
  Coding DNA Sequence Number=SeqID_25300
  Gene Ontology: Mol. function=binding; Cellular component =intracellular; Biological process=metabolic process
  Homolog annotation: Hit_ID=Q2R497; Match level="QueryCoverage=99%, HitCoverage=89%, E-value=0.0, Identity=39%"; Hit description=PPR986 -12, putative, expressed
  Pfam annotation: Domain name=PPR; Domain location=118-152; Score =30.0; E_value=8.2e-06; Accession=PF01535.11; Description=PPR repeat
  Pfam annotation: Domain name=PPR; Domain location=17-51; Score=30.6; E_value=5.4e-06; Accession=PF01535.11; Description=PPR repeat
  Pfam annotation: Domain name=PPR; Domain location=188-222; Score =12.0; E_value=0.28; Accession=PF01535.11; Description=PPR repeat
  Pfam annotation: Domain name=PPR; Domain location=331-365; Score =39.0; E_value=1.7e-08; Accession=PF01535.11; Description=PPR repeat
  Pfam annotation: Domain name=PPR; Domain location=366-400; Score =12.1; E_value=0.27; Accession=PF01535.11; Description=PPR repeat
  Pfam annotation: Domain name=PPR; Domain location=402-436; Score=9.9; E_value=0.5; Accession=PF01535.11; Description=PPR repeat
  Pfam annotation: Domain name=PPR; Domain location=468-502; Score=5.9; E_value=1.5; Accession=PF01535.11; Description=PPR repeat
  Pfam module annotation: Pfam domain module=PPR::PPR::PPR::PPR::PPR::PP R::PPR; Domain location=118-152::17-51::188-222::331-365::366 -400::402-436::468-502
MEDARRVFDNMLRRNVVAWTTLMVGFVQNSQPKHAIHVFQEMLYAGSYPSVYTLSAVLHACSSLQSLKLGDQFHAYIIKYHVDFDASVGSALCSLYSKCGRLEDALKTFSRIREKNVISWTSAVSACADNGAPVKGLRLFVEMIAVDIKPNEFTLTSALSQCCEILSLELGTQVYSLCIKFGYESNLRVRNSLLYLYLKSGCIVEAHRLFNRMDDASMVTWNAMIAGHAQMMELTKDNLSACHRGSEALKLFSKLNLSGMKPDLFTLSSVLSVCSRMLAIEQGEQIHAQTIKTGFLSDVIVSTSLISMYSKCGSIERASKAFLEMSTRTMIAWTSMITGFSQHGMSQQALHIFEDMSLAGVRPNAVTFVGVLSACSHAGMVSQALNYFEIMQKKYKIKPAMDHYECMVDMFVRLGRLEQALNFIKKMNYEPSEFIWSNFIAGCKSHGNLELGFYAAEQLLSLKPKDPETYVLLLNMYLSAERFEDVSRVRKMMEEEKVGKLKDWSWISIKDKVYSFKTNGKTHPQSSLICKSLEDLLAKVKNVGYEMLESVEISDEEEEEEKTSSPNIYHSEKLAITFGLENLPNSSPIRVVKSTLICRDSHNFIKYVSTLAGREIIVKDSKRLHKFANGECSCGNFGGFL

SEQ ID NO: 142079 - protein, 99 aa, Glycine max
  Coding DNA Sequence Number=SeqID_25301
  Gene Ontology: Mol. function=glycine hydroxymethyltransferase activity; Cellular component=mitochondrion; Biological process=L -serine metabolic process
  Homolog annotation: Hit_ID=Q45FE6; Match level="QueryCoverage=97%, HitCoverage=16%, E-value=2e-24, Identity=61%"; Hit description =Serine hydroxymethyltransferase
EPPALTSRGFVEEDFEKVAEYFDAAVNFKSIASVLTLRKSLFFLMVTSTSGTKLKDFVAAMQSDEQIQSKIANLCHEVEDYAKKFPTIGFNIETMKYGK

SEQ ID NO: 142080 - protein, 354 aa, Glycine max
  Coding DNA Sequence Number=SeqID_25302
  Homolog annotation: Hit_ID=Q2HTU9; Match level="QueryCoverage=47%, HitCoverage=39%, E-value=2e-21, Identity=37%"; Hit description =Octicosapeptide/Phox/Bem1p
  Pfam annotation: Domain name=PB1; Domain location=48-140; Score=82.3; E_value=1.5e-21; Accession=PF00564.15; Description=PB1 domain
MDSRDSSPCSRDPDAADNHHHHRRPSFDDAPPKVKLMCSFGGRIQPRPHDNHLTYVAGDTKILSVDRHVKFPSLIAKLSSLANNALSNHSFFKYQLPGEDLDALISVTNDDDLHHMMIEYDRLSRSSSRPARLRLFLFPLHNNNNNNFAPTELKSERQWFVDALNSVHVPEDSPAPPPTANPDFLFGLEKPPAEDAPAKDSECFPEDREAEPEIQNENNNEQRKMKTEEDNDNGRVYGVNGGDCFVQKNAEKVTPLVAHSHAHAHAQFVHPGSVTGTGTGTVSFMQERNNNAGYSLAVPTTGNEIYLIHTPSGMFQAVRPMTGPVGQPVYLVHAPGPVSHSELGAAVGRGGARW

SEQ ID NO: 142081 - protein, 268 aa, Glycine max
  Coding DNA Sequence Number=SeqID_25303
  Homolog annotation: Hit_ID=Q1RUD8; Match level="QueryCoverage=43%, HitCoverage=24%, E-value=1e-09, Identity=35%"; Hit description=IMP dehydrogenase/GMP reductase
WDQHLAGIGGRIVNWFPRWKEGKEGVLFSCGGYPNIPLIGTRGCINYNPALAIRQLGYLMRGAPTEESLSPFLVRDFGAQNFKVIQRVHKAWESPLRKDKELRGIRNGIIGGYHEWLKVCTRGLDWLFKLKIINKENFEAPEEDEEVRALKTELGKARLAKEKFKLVATDVRKECAGLREENAATAKALEKETKRARKEEHGRDKFRGALWGQQQSKRNLSQRLCETETNMLAIITKYQEELSLAMAHEHRVVDEYAQVYAKKEARGR

SEQ ID NO: 142082 - protein, 353 aa, Glycine max
  Coding DNA Sequence Number=SeqID_25304
  Gene Ontology: Mol. function=catalytic activity; Cellular component =cytoplasm; Biological process=carbohydrate metabolic process
  Homolog annotation: Hit_ID=Q9KZE3; Match level="QueryCoverage=96%, HitCoverage=64%, E-value=1e-119, Identity=62%"; Hit description =Alpha glucosidase
HEEVLRFWFDRGVAGVRIDSAALPVKDPALPDLPVGSAPVVGHPHIDRDELHDIYREWRAVADEYDGERVLVGEVWLDDAERFARYLRPGEMHTAFNFGFMTQPWSARAMRESITRTLAEHAPVGAPATWVLSNHDVTRPVTRYGRADSSFAFDRKRLGVATDLARGTNRARAAALLVAALPGSLYIYQGDELGLPEVELPLDAIEDPMHFRSGGIDPGRDGCRVPLPWAGAASPYGFGGSPWLPQPVDWAPLTVEAQEADPSSTLNLYREAIALRRRVADLAGEQLEWLELGADVLAFRRGDGTVSITNLGAVPVPLPAHHEVLLASAPLDGVLPPDCTAWLALHAAPGRSS

SEQ ID NO: 142083 - protein, 44 aa, Glycine max
  Coding DNA Sequence Number=SeqID_25305
MEFLELKHGNMTVAEYAAKFEELVRKGIFREIAYIPRRSGMVWA

SEQ ID NO: 142084 - protein, 373 aa, Glycine max
  Coding DNA Sequence Number=SeqID_25306
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-49, Identity=33%"; Hit description= UPI00006A17C9 related cluster
FRGLHVLTFIGVHVLAIRGVHVLPIKGLHVLAISGLDVLAIRGLHALTFRGLHVLAIRGLHDVAFRGLHALTFRGLHVLTFRGLHALTIRGLHVLAFRRQHTLAIRGLHILAFRRQNVLTFRGLHVLAIKGLHVLTIRGQHALAIKVLHTLTVRGLHTLTFRGLHIHKFRGLHALTFRGLQVLTFRGLLILTLRGPHVLALRGLHVLTFRGLHDLAIRGLHVLAIRGLHALAIRGLHVLAIKLLHALTFRGLHVLTFRGLHALTLRRLHVLAFRMLQVLTFRGLHVIAIRGLHVLTIRGQHALAIRGLHVLAIQVLHALTFRGLHTLTFRGLHVHTFRGLHALTFRGLQVLTFRGLLILTLRGLHVLALRGLH

SEQ ID NO: 142085 - protein, 82 aa, Glycine max
  Coding DNA Sequence Number=SeqID_25307
MEDCLEGPHLGNHETRLQTRKWRTHERKRNSWSSGKGGEWRIALRVCSQAIMKHSSKLESGGHRNQNAIHGAPKKGENGGLP

SEQ ID NO: 142086 - protein, 216 aa, Glycine max
  Coding DNA Sequence Number=SeqID_25308
  Homolog annotation: Hit_ID=Q1SPB9; Match level="QueryCoverage=71%, HitCoverage=27%, E-value=5e-14, Identity=32%"; Hit description =Transposase
STKCDPSYWEYVDAFHSTQNSNSSVKRSASSFEQPNPRRIMPMLDQFQPFIHDFIDNIIDVQADGNYGYWSVSGLLGMGEDSWSLVRTHLLIELGKFLEDYIKLFGGTDKFEELRISLHVDGLTKVTMDKWMDITDMGYVIASSVGLIELLCTIGRTPDGILNILEATMTPTRQNEFVGYLLTGINPKKFDIPSGCTMDEPKDLIKQIAPHGIPPY

SEQ ID NO: 142087 - protein, 143 aa, Glycine max
  Coding DNA Sequence Number=SeqID_25309
  Gene Ontology: Mol. function=RNA-directed DNA polymerase activity; Biological process=RNA-dependent DNA replication
MDQGRRKSMLRGVVVDGVWEENPTLVKEKGEEVKLNFDGIEFSRISMEDNLMLTSPFEELEFKEATWDSGGSKSPRSNGCNFNFLKAFWGTLKGDILGFVQGFYANGVFPKGTNASFVSFIPKVDEPQGLGEYRPISLVAVHV

SEQ ID NO: 142088 - protein, 69 aa, Glycine max
  Coding DNA Sequence Number=SeqID_25310
  Gene Ontology: Mol. function=RNA polymerase II transcription factor activity; Cellular component=transcription factor TFIIA complex; Biological process=transcription initiation from RNA polymerase II promoter
  Homolog annotation: Hit_ID=Q39236; Match level="QueryCoverage=74%, HitCoverage=49%, E-value=2e-20, Identity=96%"; Hit description =Transcription initiation factor IIA gamma chain
  Pfam annotation: Domain name=TFIIA_gamma_N; Domain location=2-50; Score=129.4; E_value=1e-35; Accession=PF02268.7; Description =Transcription initiation factor IIA, ga
MATFELYRRSTIGMCLTETLDEMVQNGTLSPELAIQVLVQFDKSMTEALETQVKSKVSIKLVVVRVEVT

SEQ ID NO: 142089 - protein, 98 aa, Glycine max
  Coding DNA Sequence Number=SeqID_25311
MQEWCNMMHGGSWVTWWWWVEAQWWVWCGVEVVLDGCGGGVWGEVGSHGHGVYFITKILCIEIPRIKTGHMATHPILKTPYSSYHPIIYEVISKDWLG

SEQ ID NO: 142090 - protein, 99 aa, Glycine max
  Coding DNA Sequence Number=SeqID_25312
MHKALRLNALLPYPHLVTLFLQHFNIPLDFEPYVPIKRSFLIGADVVASFGYRKKRDGSWVKKGAQPNDDEGHLLVEGDSSLLQSNLDRFDGLQTCVGE

SEQ ID NO: 142091 - protein, 120 aa, Glycine max
  Coding DNA Sequence Number=SeqID_25313
  Homolog annotation: Hit_ID=Q8L7A5; Match level="QueryCoverage=50%, HitCoverage=31%, E-value=7e-20, Identity=63%"; Hit description =Expressed protein
MEAVSDQDTSICTHCDRAIPAANIDLHYAHCSRKLEKCKVCGDMVPRKNAEDHYLSTHAPLCLVHVVSTFHSVGSSSREKLQIVAFTFYLTIDVKQTPDAHMQEQAARNPERVLSSYRES

SEQ ID NO: 142092 - protein, 104 aa, Glycine max
  Coding DNA Sequence Number=SeqID_25314
  Gene Ontology: Mol. function=binding; Cellular component=protein complex; Biological process=regulation of progression through cell cycle
  Homolog annotation: Hit_ID=Q1RY20; Match level="QueryCoverage=98%, HitCoverage=11%, E-value=6e-38, Identity=86%"; Hit description =Proteasome/cyclosome, regulatory subunit
MLRQLPKFQRLSMKKIRKCSDMTLLSYAYAGIGNVLKVKNLLGHCSQHLDKGETHQGPIVLGIAMVAMAKELGVKMEIRLEHLLQYGEQNIRQAVPLALGLLCI

SEQ ID NO: 142093 - protein, 99 aa, Glycine max
  Coding DNA Sequence Number=SeqID_25315
MITSKKPRKEDWRQATYCFELSFEDSAPIKLFFSVRWSGGKQRWLVAVTGGQWWWRRRLGMSGEGLREEMESWVASLQSKCEGNPTVNKSRIAVLVEHV

SEQ ID NO: 142094 - protein, 352 aa, Glycine max
  Coding DNA Sequence Number=SeqID_25316
  Gene Ontology: Mol. function=RNA-directed DNA polymerase activity; Cellular component=chromatin; Biological process=RNA-dependent DNA replication
  Pfam annotation: Domain name=RVP_2; Domain location=225-333; Score= -30.8; E_value=0.00025; Accession=PF08284.2; Description=Retroviral aspartyl protease
  Pfam module annotation: Pfam domain module=RVP_2::Retrotrans_gag; Domain location=225-333::79-153
MVERPNLATQHLLDRMTIVLKTLIHDRKARPVEYHGLSTFTKHGPPRFKGGFNPKGAQLWLSEIEKIFAVDCYEEHKVTYATYMLRGEAEDWWIFALQTLPATDDEFLELKQGNIIIREYASKFNELMKFQPHYKKGENDEDICTQFENGLRANIQTTVHRGMIESIMGITRSPTTSQISLLGEVPNKGTIQWEGSTSLTTTIMLLSASSMEDHIKIRKALSLNSSGKLRVAEKVFAMCAYEVMAFNDFIQGLSLSSLPYEIVVATPTNEPITTSHACLDCLVWIEGRIFFVNLIFLPLSHLDVMLGMDWLSSNHIPLNCKDKTLIFGASTPSSLRSRSLETVKDEVVNHVI

SEQ ID NO: 142095 - protein, 78 aa, Glycine max
  Coding DNA Sequence Number=SeqID_25317
MCPPPSRWELCFMIAYVRTLKAILHSPPLSEPHECYCRELFMCPPPSRLELCFMIAYVRTLKAILHSPPFSSPMNVIA

SEQ ID NO: 142096 - protein, 65 aa, Glycine max
  Coding DNA Sequence Number=SeqID_25318
MSRVGGGNEEGNDTRESVGNAVTPQADNQQHFTHSHTNASKDNVITLFTLKMGLYYVSNPSSAKL

SEQ ID NO: 142097 - protein, 128 aa, Glycine max
  Coding DNA Sequence Number=SeqID_25319
  Gene Ontology: Cellular component=periplasmic space; Biological process=conjugation
  Homolog annotation: Hit_ID=Q4L1T5; Match level="QueryCoverage=81%, HitCoverage=52%, E-value=3e-17, Identity=44%"; Hit description =Conjugative transfer protein
MQRGCQYSANFDPKLKAWADETGIKVYPYTLDGYGDTSFPVALIPRKAGPNEPIAGEILTFFGNGLPIATPTTFMVNVNTNMAYPLYQGDTDIGTVSQRLAQMIEADIDHLPPDTLGPVPSSASLTPQ

SEQ ID NO: 142098 - protein, 97 aa, Glycine max
  Coding DNA Sequence Number=SeqID_25320
MFFHVQLQHFFRRKGPEKGMQVRAGAVKAAVSHESVPAQRDADQRAAAKAAGKGKQKQQRVELQPAQQQRIGAVSDTGGQAGKVAGKPGVNPGRRQH

SEQ ID NO: 142099 - protein, 73 aa, Glycine max
  Coding DNA Sequence Number=SeqID_25321
MDAWTKKSKLAVFLAGSKSKEHLTKNLKEVLQLLQDQEEEESSLKKEDAKSANSSDDFYQNKDDCFAINLVED

SEQ ID NO: 142100 - protein, 131 aa, Glycine max
  Coding DNA Sequence Number=SeqID_25322
MDRVTSLLRLLPNTFRTVDALVTSSFTLTKADMKALKEQMTIMMEAMMSIKEIMEVNVVAVAAASAVAKVNPTPPSGLKQMNPPTLGMVGKDLGSTGGPHYVQIQNKHAFSPYGLPPNYTPPNVAYTPNEN

SEQ ID NO: 142101 - protein, 105 aa, Glycine max
  Coding DNA Sequence Number=SeqID_25323
  Subcellular localization annotation: CTP_CleavageSite=79; ConfidenceScore=5.16e-01
MNSIPTLLILIWVCLRLPQGLLLPGKPLARILAATSLLTVNTVSQRSSKNKGKRGALGVPALVTSGREGESLSHLLRILARRKRKNSGFSDGKAFGNYSSARNSP

SEQ ID NO: 142102 - protein, 248 aa, Glycine max
  Coding DNA Sequence Number=SeqID_25324
  Gene Ontology: Mol. function=zinc ion binding
  Homolog annotation: Hit_ID=Q1S0W0; Match level="QueryCoverage=97%, HitCoverage=22%, E-value=5e-95, Identity=68%"; Hit description=PHD -finger, putative
  Pfam annotation: Domain name=PHD; Domain location=137-184; Score =30.4; E_value=6.2e-06; Accession=PF00628.19; Description=PHD-finger
MASNGNAVLEASVDVSYPIKCHEAATESCCLFWSRVLQRFASVKTHDASELKSIIENLVTDLLTTLNLPEYPASAPILENAGPKSKDVSARSLAIDILGTIAARLKRDALVCSQENFWILQDLLSQDAAAQHHPKDTCCVCLGGRVENLFICHGCQRLFHADCLGIKEHEVSSRKWSCQTCICHKQLLVLQSCCNSQQKNDVKKNHDTDSEVSKQEIVQQLLLNYLQDVTSADDLHLFICWFVLTTDF

SEQ ID NO: 142103 - protein, 115 aa, Glycine max
  Coding DNA Sequence Number=SeqID_25325
MVSGCKWCHFINDKNVDNRTVAQLLESILFIIDAVLPMLGKLPPSIVGELEQDLKQMIVRHSFLTVVHACIKCLCSVSKMSGKGAAVVEQLIQFFFKCLDTQAVDNKQVYCKIRV

SEQ ID NO: 142104 - protein, 172 aa, Glycine max
  Coding DNA Sequence Number=SeqID_25326
MIFDERIKRKALGSLKNALWDFILQHCPVNPIVATLVWAEHHHLQHRRCYCILSQKSNHKKVWAQAALGSPEDGVTTRELRASPFRRRRWRDSDKAMREKVETALFRERRFSDMGESVLHVHIDMTGEAWTARHVGEATRELSEIKWGVRNPSIRESHVAGTTGKKWCKKWM

SEQ ID NO: 142105 - protein, 590 aa, Glycine max
  Coding DNA Sequence Number=SeqID_25327
  Gene Ontology: Mol. function=steroid hormone receptor activity; Cellular component=nucleus; Biological process=regulation of transcription, DNA-dependent
  Homolog annotation: Hit_ID=Q01EI2; Match level="QueryCoverage=56%, HitCoverage=20%, E-value=5e-29, Identity=27%"; Hit description=[BDL] KOG1020 Sister chromatid cohesion protein SCC2/Nipped-B
ALGFVLIARPEYMLENDVGKVLEETLSSASDTRLKIQGLQNMFEYLLDAESQMGTDKDNENVAGYSVGAGKSVPVAAGAGDTNICGGIVQLYWDNILGRCLDFSEHVRQSALKFLFLQIFWIGGVRYKGDEKLGRCFSEEFKGESCCCKLVSWNVIVEVVLRQGLVHPITCVPYLIALETDPLESNSKLAHHLLMNMNEKYPAFFESRLGDGLQMSFMFMQSICGSSENVDHKIQSKTSTSGKGKPEAGSLAQAKLGVSRIYKLIRGNRVSRNKFLSSIVRKFDNPRWNKLLIAFLIYCTEVLALLPFISPDEPLYLIYAINRVVQVRAGPLEANFKAWTSSISRHCTPHGNGMYQQGTDEPTVASQVMPLDLNGTFQQNVDLQPNMNDMRTLDLNGSNHQLTDYPLSYNGSSEANLHSVGYTDPFSFAKDDLEKVQADCLSAIALQLLLKLKRHLKIMYSLDDARCQAYSPTEQPKPGEVISRQNIAFNIGDSQFSLPTSPQELIQRYQEFKHALREDTVDYSHYTANIKRKRPTTTPRRVQVRKPVYVAGGYDNGDDDEDYTGGSATRKISFSGRRSSLKNSRQYGLM

SEQ ID NO: 142106 - protein, 350 aa, Glycine max
  Coding DNA Sequence Number=SeqID_25328
  Gene Ontology: Mol. function=catalytic activity; Cellular component =peroxisome; Biological process=metabolic process
  Homolog annotation: Hit_ID=Q84P23; Match level="QueryCoverage=96%, HitCoverage=61%, E-value=4e-57, Identity=38%"; Hit description=4 -coumarate-CoA ligase-like protein
  Pfam annotation: Domain name=AMP-binding; Domain location=73-350; Score=-40.6; E_value=7e-06; Accession=PF00501.18; Description=AMP -binding enzyme
  Subcellular localization annotation: CTP_CleavageSite=42; ConfidenceScore=5.40e-01
MEQRKSIWSPVTDPRSGFNRESRTFHSLKPPLRLPPPNAAVSAAAFALFLRRNSQFPDSSTAFIDSATGHRLSYGELLHRAKTLASNLATILKLTKGDTALVLSPNILQVPILCFALLSLGVVVSPANPLSTRSELTRFFNISNPSIVFTVTSVVEKTREFQVKTVLLDSPEFDTLTKSQIHTKYIQEGLVSNMQVTQSDVAAILYSSGTTGTIKGVMLTHRNLTAIAAGYDTVREKRKEPAVVLYTVPFFHVYGFTFSLGAMVLSETVVIMERFSMKAMLSAVERFRVTHATMVPALVVAMTKDCVIAGYDLTSLEGIVCGGSPLRKETDEAFKAKFPNVLVMQVGLPS

SEQ ID NO: 142107 - protein, 100 aa, Glycine max
  Coding DNA Sequence Number=SeqID_25329
MAHDRRKVYVPMPDSIPSGTITFGGNKKELITRVGKIGIPPYHPINNVLFVERMSASYRIVTSPYFFLFSTKRKSNLYKIRLDELSDQNVSCLLFVKGDH

SEQ ID NO: 142108 - protein, 208 aa, Glycine max
  Coding DNA Sequence Number=SeqID_25330
MVFFIIELKTPQQNGLVERNKGSLQEMAKTMLNELDESFADLILDDDSIETSTSRHNPKIKASTEQVVQEEVMQDELDQFQKNDAWKLVELPKGNKVVEVKWIFYNKLDENAYRNMKLHQMDVKVHFSIALSNRKLSQPILLWASEARLTGASSKGGKCAESPPTFICGKCRKNRRKPVIKNIPDSGVVFTFEKGIGISHVCPKGQQP

SEQ ID NO: 142109 - protein, 159 aa, Glycine max
  Coding DNA Sequence Number=SeqID_25331
MKNYAGPLESLDATKKFIGRALGMVCHQKKKIENADERSKAMNIQLKNMKIKKTKKLEMALASNAKVKFDDLSSEIIVVQTKNKTSKEEKKSVEDILISANEELTNLKKIVARLKDFDYKRIDVNCDLLDGEIIRESQLCSDEEEEEEEKNEVDSTMVN

SEQ ID NO: 142110 - protein, 151 aa, Glycine max
  Coding DNA Sequence Number=SeqID_25332
  Pfam annotation: Domain name=zf-CCHC; Domain location=13-30; Score =29.1; E_value=1.5e-05; Accession=PF00098.13; Description=Zinc knuckle
MPKEKKDKDKNSIICYECKKPGHFKFECPKLEKGQGKKKHYKTKEKEGLMITWEDLDDTSSDEDDEEANICLMADTTLEESKSDQEDESKICLEIETITKEESTLLKNSQELENKLKDLQKDLKELNELHDYQNEEKNDMWIECAQAYKDY

SEQ ID NO: 142111 - protein, 95 aa, Glycine max
  Coding DNA Sequence Number=SeqID_25333
  Homolog annotation: Hit_ID=Q2V997; Match level="QueryCoverage=39%, HitCoverage=20%, E-value=1e-11, Identity=89%"; Hit description =Adenine phosphoribosyltransferase-like
MEMKRVSEFPHTYMDRRPRKRVPKVVDLVKFVYIGIMFQDITTLLLDPRAFKDTIDLFVEQYKGKNIYVVAGYFLLQSYSLSSSLSLCFLLQLNV

SEQ ID NO: 142112 - protein, 189 aa, Glycine max
  Coding DNA Sequence Number=SeqID_25334
MSISPCRCIGWSVPSWHRDRAHETPNGLEEVQQGPGVSNSGYGPLSVLQGAHSPSEGSCPQDAQWTRRSPTGPWGFQLWLRASVVLQGARFPPADGSGSCPQDTQCTRRSPTGSWSFQALITGLCQFYGVPVTCSKGIRPPTNRAFIKKYCIPRQAQGETPQQPGDGRQRATDAPPSPLEFTSAHPQKG

SEQ ID NO: 142113 - protein, 61 aa, Glycine max
  Coding DNA Sequence Number=SeqID_25335
MVRMAMWVGENISQRGVEIEESVRVRNLRRHRKRTFSLDFYKCGFDDYDASGALTINVTQF

SEQ ID NO: 142114 - protein, 173 aa, Glycine max
  Coding DNA Sequence Number=SeqID_25336
  Gene Ontology: Mol. function=structural constituent of ribosome; Cellular component=ribonucleoprotein complex; Biological process =translation
  Homolog annotation: Hit_ID=Q9SGA6; Match level="QueryCoverage=98%, HitCoverage=98%, E-value=5e-65, Identity=73%"; Hit description=40S ribosomal protein S19-1
  Pfam annotation: Domain name=Ribosomal_S19e; Domain location=5-173; Score=286.4; E_value=5.5e-83; Accession=PF01090.9; Description =Ribosomal protein S19e
MATARTVKDVSPHDFVKAYASHLKRSGKIFWKLGELMFYIWGSFKSENSLVYSGVWKKMELPEWTDIVKTAKFKELAPYDPDWYYIRAASMARKIYLRGGLGVGAFQRIYGGSKRNGSRPPHFCKSSGAIARHILQQLQNMSIVEIDTKGGRKITSSGRRDLDQVAGRIVVAA

SEQ ID NO: 142115 - protein, 113 aa, Glycine max
  Coding DNA Sequence Number=SeqID_25337
MSLSGFAEEQHRDRGPRCPCSQLNIEFAAYSVKQTKPQSHTSEQNRERPMTEVQPRKMWTNSLLTDQLQFQDVRLTRSNISMKNPQEYFCYDIQIRVHPPHIPRSEQAATICH

SEQ ID NO: 142116 - protein, 108 aa, Glycine max
  Coding DNA Sequence Number=SeqID_25338
MGPSWWIHDETHLLSYKLKGYSFYLDISEVNFEKEEHPEEDPKMVGKDLDMSRRTLQRSIHSLVIFLIEAQPQPQPDAPQPHRTSTSSSLNLTHLNLIKADAPEPHRS

SEQ ID NO: 142117 - protein, 201 aa, Glycine max
  Coding DNA Sequence Number=SeqID_25339
  Gene Ontology: Mol. function=transferase activity, transferring glycosyl groups; Cellular component=chloroplast; Biological process =carbohydrate metabolic process
  Homolog annotation: Hit_ID=P53535; Match level="QueryCoverage=83%, HitCoverage=17%, E-value=7e-86, Identity=88%"; Hit description=Alpha- 1,4 glucan phosphorylase L-2 isozyme, chloroplast precursor
  Pfam annotation: Domain name=Phosphorylase; Domain location=1-197; Score=-370.9; E_value=1.5e-12; Accession=PF00343.10; Description =Carbohydrate phosphorylase
MTCESEIGTQRALGNGIQVQQKYTNLCSLFCSCSTAGMEASGTSNMKFAMNGCILIGTLDGANVEIREEVGADNFFLFGAKAHEIAGLRKERAEGKFVPDPRFEEVKEFVRSGIFGSYNYDELMGSLEGNEGFGRADYFLVGKDFPSYIECQEKVDEAYRDQTKWTRMSILNTAGSYKFSSDRTIHEYAREIWNIEPVQLP

SEQ ID NO: 142118 - protein, 792 aa, Glycine max
  Coding DNA Sequence Number=SeqID_25340
  Gene Ontology: Mol. function=transferase activity, transferring glycosyl groups; Cellular component=chloroplast; Biological process =carbohydrate metabolic process
  Homolog annotation: Hit_ID=P53536; Match level="QueryCoverage=98%, HitCoverage=80%, E-value=0.0, Identity=76%"; Hit description=Alpha-1, 4 glucan phosphorylase L isozyme, chloroplast precursor
  Pfam annotation: Domain name=Phosphorylase; Domain location=183-792; Score=735.7; E_value=3e-218; Accession=PF00343.10; Description =Carbohydrate phosphorylase
  Subcellular localization annotation: CTP_CleavageSite=66; ConfidenceScore=5.91e-01
MASSSTTMRFSAASTGAAAALPRRSSVAGFIGVAARSSAKSRLRFIGRNANLSLRMRRMSSFSVVKCVSGSEAKVQDTVAKQQEATTSLSSFTPDASSIASSIKYHAEFTPLFSPENFDLPQAFLATAQSVRDSLIINWNATYDYYEKLNVKQAYYLSMEFLQGRALLNAIGNLELTGPYAEALSKLGHKLENVAYQEPDAALGNGGLGRLASCFLDSLATLNYPAWGYGLRYKYGLFKQRITKDGQEEVAEDWLEMGNPWEIIRNDVSYPVKFYGKVVSGSDGKKHWIGGEDIKAVAHDVPIPGYKTKTTINLRLWSTKAASEEFDLSAFNAGRHTEASEALANAEKICYILYPGDEPIEGKILRLKQQYTLCSASLQDIIARFERRSGANVNWEEFPEKVAVQMNDTHPTLCIPELMRILIDVKGLNWKDAWNITQRTVAYTNHTVLPEALEKWSLDLMQKLLPRHIEIIEMIDEELVRTIIAEYGTENSDLLEKKLKEMRILENVELTAEFADILVKSKEAIDIPSEELQSSEQAEAEDEKDDDEVEAVAKKNGTDESSIEDEKEELPEPVPEPPKLVRMANLCVVGGHAVNGVAEIHSEIVKDDVFNAFYKLWPEKFQNKTNGVTPRRWIRFCNPDLSKIITEWIGTEDWVLNTGKLAELRKFVDNEDLQVQWREAKRSNKVKVAAFIREKTGYSVSPDAMFDIQVKRIHEYKRQLMNIFGIVYRYKKMKEMSAAEREANFVPRVCIFGGKAFATYVQAKRIVKFITDVGATVNHDPEIGDLLKAYCC

SEQ ID NO: 142119 - protein, 264 aa, Glycine max
  Coding DNA Sequence Number=SeqID_25341
  Gene Ontology: Mol. function=DNA binding; Cellular component =chromatin; Biological process=DNA integration
MVKECIFLGHKLSHVGIEVDHAKAEVVAKLPPQNCEFLRTFNILKESLVNASLVTTPDWSLPFELVCDVRDTIVGVVLGQRTDEEFYTIYYASRTLDDAQKNYTTTKNKLLAVVFAFDKFRNYLVLCKVFPIDINYQTKKRLMCEARKYFLDDPYLFKAGGHLGPSRTTHKVLQCRFFWPTIHVDAHAFIATCDRCQCTEALSRKMEMPLNNMLVVEMFDVFGTPRAIISDGGIHFYNKFFDDLLAKYGVTTKVITPYHPQTSG

SEQ ID NO: 142120 - protein, 281 aa, Glycine max
  Coding DNA Sequence Number=SeqID_25342
  Gene Ontology: Mol. function=DNA binding; Biological process=DNA integration
  Homolog annotation: Hit_ID=Q0ZCB7; Match level="QueryCoverage=96%, HitCoverage=29%, E-value=4e-25, Identity=25%"; Hit description =Integrase
VEGVTVSLPFPHKVKNDQRDVQFRKFLEVMRKMHINLPFIEAISQMPSYVKHLKEMESYFDKCLCDLGASVNLMPYSVFKKLGITNLEPTNISLHLANHSIVCPKGVTIILGQPFQSTCDFLVESVDKSDALIEGAFSSVGMPNDLERVLTNEGLDWELNPKSSVEEPPKLELKPLPSNLENIFLNPPSSLQVVIIAGLHETKEEKLLWVLKGNKEAFGWSIHDIKGLHHTLCPNKINIREGFPPKWLPQRKLNPNMMEVVKGKIIKLLDIGIIYPISDSP

SEQ ID NO: 142121 - protein, 75 aa, Glycine max
  Coding DNA Sequence Number=SeqID_25343
MAHQNPPYLAFCTPGQNEIKNKIQGYQRETNKNIYIFLNEHQGMKGMAHAYEDQKVFKGCNGAKDKVGKKYGISS

SEQ ID NO: 142122 - protein, 105 aa, Glycine max
  Coding DNA Sequence Number=SeqID_25344
MSTKTAIHSDDGSCKIGVKGGEKHIEKERTRRKAPSSQNAQNQGISNQNVLILTNQITRKETKEEEVKLYLMADTTLEGSNSKSDEEVNINNHETDAILSHKCIG

SEQ ID NO: 142123 - protein, 87 aa, Glycine max
  Coding DNA Sequence Number=SeqID_25345
MYKDNWTQPWPVGSEIYPEVHQNPRAFFNSSSPILSEPLAHGSSDCVLPSPFCCHDLQEVKDSIDEEDPRPTSSTLSYIMWYQSIFV

SEQ ID NO: 142124 - protein, 126 aa, Glycine max
  Coding DNA Sequence Number=SeqID_25346
  Subcellular localization annotation: CTP_CleavageSite=49; ConfidenceScore=5.43e-01
MTTPPRSPPPPIDATSYSPSTLKRTRKATRLRSLATRPVGAERPLVHVDPATGKADGPHRKKLRTYLGIVACDKVDVTYENWKQVTTAQKDLIWEDIQPTRTVSMTLYAKSTTLARRSGPNFAKAA

SEQ ID NO: 142125 - protein, 124 aa, Glycine max
  Coding DNA Sequence Number=SeqID_25347
YRYGKTENSKQYPPLQRHAFVKWWSQFDTSKTAPDQVKNWFQSNPEFLKPADPKTSLFLNQKSQLAAFLASSKSKESLAQNLKEVLQLLQQEVEEEPSKKEAESSETNDDQEDDPFYQNEDDCF

SEQ ID NO: 142126 - protein, 56 aa, Glycine max
  Coding DNA Sequence Number=SeqID_25348
MASYGEISGIKSNGQVGSKNAISRAHRSGLQTQVFENKETEAAAEPHRIGEGRREI

SEQ ID NO: 142127 - protein, 76 aa, Glycine max
  Coding DNA Sequence Number=SeqID_25349
MECSICGVKIKYARPANTRVGNGIFEGAGGIIGISVEEEGGSVEEKGLPVSSAEVEGASNLFPLAFLSPLKDFEPD

SEQ ID NO: 142128 - protein, 284 aa, Glycine max
  Coding DNA Sequence Number=SeqID_25350
  Gene Ontology: Mol. function=transcription regulator activity; Cellular component=nucleus; Biological process=regulation of transcription
  Homolog annotation: Hit_ID=Q1T110; Match level="QueryCoverage=97%, HitCoverage=94%, E-value=5e-79, Identity=55%"; Hit description=Helix- loop-helix DNA-binding
  Pfam annotation: Domain name=HLH; Domain location=134-183; Score =36.0; E_value=1.3e-07; Accession=PF00010.16; Description=Helix-loop -helix DNA-binding domain
MDKMNFHQDPLVHIKDFEVHDFVEDPNLDQFIDLIRWEHKDAIYNFNSKSINEAFIVDNSFLSHPAIPFDHCNSNSVNVYHPISYTHSSFSCFDGEAKEEGGGEEDNMGDSSATTTTTTTTTKSVNPKPIPKTDRSKTLISERRRRDRMKQKLYALWSLVPNITKMDKASIIGDAVSYMHELQAQANMLKAEVQFTNSNRSICKKIIKMDMFQVDEKGFYVKIVCNKGEGVAASLCKSLESLTGFNVQSSNLATVSDSFQLTFSLNAKGPEPEFNLPNLEVMGD

SEQ ID NO: 142129 - protein, 155 aa, Glycine max
  Coding DNA Sequence Number=SeqID_25351
  Homolog annotation: Hit_ID=P10792; Match level="QueryCoverage=28%, HitCoverage=20%, E-value=4e-18, Identity=100%"; Hit description =Superoxide dismutase [Cu-Zn], chloroplast precursor
  Pfam annotation: Domain name=Sod_Cu; Domain location=1-48; Score= -53.6; E_value=0.0039; Accession=PF00080.10; Description=Copperzinc superoxide dismutase (SODC)
MQIPLSGPNSVVGRALVVHELEDDLGKGGHELSLTTGNAGGRLACVCDENIWCEKALGRLIISRALIIPLNARLGIGAGRLLGQVWLLPMQTVKHNVLLKMSVQMNRENMLVLYWRFIMQSSVYSPIKFIMRSDVYSPTKLICVVLVACLRKNLC

SEQ ID NO: 142130 - protein, 57 aa, Glycine max
  Coding DNA Sequence Number=SeqID_25352
  Gene Ontology: Mol. function=metal ion binding
  Homolog annotation: Hit_ID=Q9FFB6; Match level="QueryCoverage=50%, HitCoverage=9%, E-value=2e-11, Identity=89%"; Hit description=PGPD14 protein
MEPEILNFGYFFMSYDDDHFQFFPAFVSGACITEGDARSECRAVMRFLTVGIAIMKL

SEQ ID NO: 142131 - protein, 99 aa, Glycine max
  Coding DNA Sequence Number=SeqID_25353
  Gene Ontology: Mol. function=transferase activity, transferring hexosyl groups; Biological process=metabolic process
  Homolog annotation: Hit_ID=Q1RXH6; Match level="QueryCoverage=79%, HitCoverage=16%, E-value=3e-30, Identity=79%"; Hit description=UDP -glucuronosyl/UDP-glucosyltransferase
MTADESYLTNGYLDTKVDCIPTNCRYICNEWDIGVENDTNVKREEVEKLVNELMVGEKGKKMRQKVMELKKKAEDDTSTNGRSYMKLDKEISEVLLRQN

SEQ ID NO: 142132 - protein, 230 aa, Glycine max
  Coding DNA Sequence Number=SeqID_25354
MDMNLEYLICHQISLIAQHDTSRLGFSALIIALCKARGVQSDSRSLENLSHTINLAYIKKNYWNLDDPTVTFRGPRKARGKRSEVPTTSAAPETPTPTSSTAPVPLIQTPVIPPTFTQLPLPAPLYAGPSDFSFTPQMLHSMAQSLHRGQSIIMQSLQGLGLPSIMSMDEFNMQEEGTSIDQILKPSPAPVPEETQPSTPVTEPEQPIQDSSAAPTLDHNEDQAQDEQDV

SEQ ID NO: 142133 - protein, 185 aa, Glycine max
  Coding DNA Sequence Number=SeqID_25355
MVRFVRVSKNVVFGLTSKEDDLLNRRRSTKKIKEDLKTYMDGVSISFADKLLQLVGGSEVPIEMDLGVHKDVIEEVPKENDCHGTQTMDGPVIPLFDVELLHWSSTWLNTLVVNVLGKRVNFRILETKVQRDWERKGTIQIIDLHDAWGVLVLVAIGIWKLSPKVVEQKGFRMFMEEESIAEKEA

SEQ ID NO: 142134 - protein, 202 aa, Glycine max
  Coding DNA Sequence Number=SeqID_25356
  Homolog annotation: Hit_ID=Q2QN55; Match level="QueryCoverage=29%, HitCoverage=14%, E-value=2e-15, Identity=59%"; Hit description =Glycosyl transferase family 8 protein, expressed
MPNQFIQNLKHIHSTTTTKALSNIPSALSDIHPVEVGYMDHPISLGSGLSDIHPGEVGCYMDHAIPLGSGNKSSENKDKGQQESEDEDGVEEGSIGNVASCDLDLHQVNKPIFARYRDASHARREVKLHRRLCCCRTTTGSLPPTTTLQPPETIFITHVPTIIRSTIFLLQGGSPPPTTPHWSFQPIGYRSLAQRFQLSSGF

SEQ ID NO: 142135 - protein, 298 aa, Glycine max
  Coding DNA Sequence Number=SeqID_25357
  Gene Ontology: Mol. function=transferase activity, transferring hexosyl groups; Cellular component=integral to membrane; Biological process=carbohydrate biosynthetic process
  Homolog annotation: Hit_ID=Q10Q30; Match level="QueryCoverage=100%, HitCoverage=51%, E-value=1e-119, Identity=67%"; Hit description =Glycosyl transferase family 8 protein, expressed
  Pfam annotation: Domain name=Glyco_transf_8; Domain location=32-297; Score=214.4; E_value=2.6e-61; Accession=PF01501.10; Description =Glycosyl transferase family 8
MQKFEREIRESKFSELMNKHFAASSVPKGIHCLSLRLTDEYSSNAHARKQLPPPELLPTLSDNSYHHFIVSTDNILAASVVVTSTVQSSQKPENIVFHVITDKKTYAGMHSWFALNPATPAIVEVRGIHQFDWLTRENVPVLEAVENQNGIRNYYHGNHFAGTNLSDTNPYKFASKLQARSPKYISLLNHLRIYIPELFPNLDKVVFLDDDVVVQRDLSPLWEIDMNGKVNGAVETCRGNDQWVMSKHFRNYFNFSHPLIAEHLDPDECAWAYGMNLFDLRTWRTTNIRETYHTWLKE

SEQ ID NO: 142136 - protein, 228 aa, Glycine max
  Coding DNA Sequence Number=SeqID_25358
  Pfam annotation: Domain name=DUF1635; Domain location=4-223; Score =275.1; E_value=1.4e-79; Accession=PF07795.2; Description=Protein of unknown function (DUF1635)
MWAQSMEELKQSLMYTTLELEQTRATVQEELRKRDDQLLTLKELLNKVIRERDEAQEKCQRLVLEKMVFQHQTAPASGVSSIEDEPRRGINDSSNNGLSSSDCEESIVSSPVMEHLPPQQQQLPESMIELISPDKPLPEKGKLLQAVMKAGPLLQTLLLAGPLPQWRHPPPPLESFEIPPVTIPSPPQPQLPHQDSFTSNCGRVIVGVGVGGMVWPTTKSDGHEFCVS

SEQ ID NO: 142137 - protein, 127 aa, Glycine max
  Coding DNA Sequence Number=SeqID_25359
  Gene Ontology: Mol. function=RNA-directed DNA polymerase activity; Biological process=RNA-dependent DNA replication
  Pfam annotation: Domain name=AT_hook; Domain location=66-78; Score =14.9; E_value=0.061; Accession=PF02178.9; Description=AT hook motif
MRMLRWMCGKTRQDKIRNEVIRERVGVAPIVEKMVENRLRWFGHVERRPVDSVVRRVDQMERRQTIRGRGRPKKTIREVIKKDLEINGLDRSIFSVKSGYNLVLGIFGDVDHFKADVDHFLLLLLAL

SEQ ID NO: 142138 - protein, 213 aa, Glycine max
  Coding DNA Sequence Number=SeqID_25360
  Gene Ontology: Mol. function=RNA-directed DNA polymerase activity; Cellular component=extracellular region; Biological process=RNA -dependent DNA replication
MIKKEHIDMICIQETKKEIIEKSMCQALWGDLEVSWEAQPASNTAGGILCIWSEKTFKLERKVIDSGLLAKRLKKMMPLIMDERQFAFIGGRHLLHSAIITNEVVKEAYRSQKSCLMFKVDYEKAYDSVSWDFLIYMLRRIGFCSKWIQWIDGCLRSASISVLENGSPSAEFIPQRGLRHPLVSLLFNIVAEALNGLMRVAVEKNLFRRFLVG

SEQ ID NO: 142139 - protein, 222 aa, Glycine max
  Coding DNA Sequence Number=SeqID_25361
  Gene Ontology: Mol. function=nucleoside-triphosphatase activity; Cellular component=mitochondrion; Biological process=protein metabolic process
  Homolog annotation: Hit_ID=Q4LDR0; Match level="QueryCoverage=82%, HitCoverage=18%, E-value=6e-90, Identity=91%"; Hit description=Heat shock protein
  Pfam annotation: Domain name=AAA; Domain location=35-218; Score=0.9; E_value=0.00018; Accession=PF00004.19; Description=ATPase family associated with various cellular activities (AAA)
MATNCWMMQHSYCGHGSEIWRQQHTLTNGPLILEKLCLTNRLAQRIVQGDVPQALMNRRLISLDMGALIAGAKYRGEFEDRLKAVLKEVTESDGQTILFIDEIHTVVGAGASNGAMDAGNLLKPMLGRGELRCIGATTLDEYRKYIEKDPALERRFQQVYVDQPSVEDTISILRGLRERYELHHGVRISDSALVDAAILSDRYISGRFLPDKGINTVFPGKY

SEQ ID NO: 142140 - protein, 140 aa, Glycine max
  Coding DNA Sequence Number=SeqID_25362
  Homolog annotation: Hit_ID=Q10NV3; Match level="QueryCoverage=87%, HitCoverage=67%, E-value=9e-39, Identity=65%"; Hit description =Expressed protein
GESRGEGGRDDDDDGRSSINSIVAMWLYLRTLHSTSTLYLLWPLWHCRGEDYRLIKLTITDFNAKKEQATVVECKGHDAAWFHSIDHAHGWDKDITGMIEPKDGKKRISVSFECETLKAEKAAEDHIRKFMPKLAGLDAV

SEQ ID NO: 142141 - protein, 129 aa, Glycine max
  Coding DNA Sequence Number=SeqID_25363
SDIEGPPQNIRAWIRCVTACCLIRSKKAIFSTVEAEEIVEIIICLFLDRQFQGLLVLLNDCMEAIVNYFTDQEWCSSCENIAKFIACSVSCDLSVMRRKLGLSNTWVKEQRLVFLISVLYNMDTGAEID

SEQ ID NO: 142142 - protein, 380 aa, Glycine max
  Coding DNA Sequence Number=SeqID_25364
  Gene Ontology: Mol. function=RNA-directed DNA polymerase activity; Cellular component=chromatin; Biological process=chromatin assembly or disassembly
  Pfam annotation: Domain name=zf-CCHC; Domain location=218-235; Score =7.3; E_value=0.061; Accession=PF00098.13; Description=Zinc knuckle
MADSTRSKVASDQLEDAIAKLTSHQFSLSETLHTMTLKIDKLIHKMTPSELPLPSPTSSTTTQSPATSIPHRMKLDTRFVLSRYDDPTDALFKLTQRTTINNYLFELEDLANRIIGLPPTFLLSCFISGLTPKIHRQVQAHQQLTLTQAAGLAWLQEEKLLNSRAQARSRPPFSPPRPSAQPLPSMQPPLLVAPSKPSSTFPLKRLSPEELASRRECGLCFNCDEKFHRGHKCASWVFLVIADDEDEATLDASVPLDPPPDPPDINSPTSDQISLHSFSGHVAPETLRLLGHIANHQCHLLCEVVPVTIQTVTFLIDLLRCWPYRTSQFHSRSRRMHLALAWEPCFRRTVTPSLSLASLSLLTFCGPPLMFENYLPSRPP

SEQ ID NO: 142143 - protein, 131 aa, Glycine max
  Coding DNA Sequence Number=SeqID_25365
  Gene Ontology: Mol. function=catalytic activity; Biological process =cellular metabolic process
  Homolog annotation: Hit_ID=O65075; Match level="QueryCoverage=52%, HitCoverage=25%, E-value=2e-18, Identity=62%"; Hit description =Hypothetical protein Sb50
MKKKRRMHVILALTTSSEKRNNHLVIRSNVKTVLLNLESMKYISIPLTPPWHRLAWWPLRLPGLGRLKNRASLKANIALLKPTHVFNAANIMGRPNVDRCESHKVKTIQTNVVETLILVEVCRDYDLFLVN

SEQ ID NO: 142144 - protein, 103 aa, Glycine max
  Coding DNA Sequence Number=SeqID_25366
MQRKISVVKKKINTIKKDKHSKHQQKHNKEAEQAATTNNNGIIQAATITNKHRKKDNLPRRTNQVEEEEAATHTNSSNFMYSCHRSTNHKSYGVGRRSTKPKI

SEQ ID NO: 142145 - protein, 96 aa, Glycine max
  Coding DNA Sequence Number=SeqID_25367
MLVVTTCPSVGGRREAHGCIFQGRRMRGVASNVYSRKTLEKPKCCLQTLIVKGSRVVFTHGEGVVDKSRAFAPTYPRFVVRNSDLPSSCKSGKVTC

SEQ ID NO: 142146 - protein, 150 aa, Glycine max
  Coding DNA Sequence Number=SeqID_25368
MNVEERSRTTKNDEEFPQNRLRKRYGSTSTRFFFTKTCFLPKIAEMHSQRGLEHFETAPPSPIYRKKGRCLPPRDLMKKISKRTRITKFTPLFVFYGKVMEALRKGIYLPKVFRNFTEVLRKPRKPFFKNVEELCNILEILPGVYGNDVF

SEQ ID NO: 142147 - protein, 134 aa, Glycine max
  Coding DNA Sequence Number=SeqID_25369
MFCVIWVFLGFFKLKKIIGLDDLLKDHYIEQDKLLEKRNKQKKKAKTKAKKIESSYDDEDSKEARLTRIVEKSFGEEQEIPPWGVKVFGDKKAFPPLESPDLGSCNLLQSFLNNKLNSMVELTADKGCSSVFVC

SEQ ID NO: 142148 - protein, 593 aa, Glycine max
  Coding DNA Sequence Number=SeqID_25370
  Homolog annotation: Hit_ID=Q10Q34; Match level="QueryCoverage=95%, HitCoverage=96%, E-value=2e-27, Identity=33%"; Hit description =Expressed protein
  Pfam annotation: Domain name=CaM_binding; Domain location=468-581; Score=112.9; E_value=9.2e-31; Accession=PF07839.2; Description=Plant calmodulin-binding domain
MANESGELPVTPEVTESPGVEIRRHSDGKASSGTSVEKFVPNYLRASTGSCHDFCKYGKKHAFDSKERRSIPNRATRKLLHHSSEGSVGGTMMPVARLSASVDSTKSTKISTVKLKLSVDSKTWISDISDTYKQERPTKSFDGQKVTRNEVLVNRNKSSLAKVKLSILPNLQTSPSVRQEISSIKEVRSLSNSTSKKVETPSKSTANKTETPSKPTFNKVGNPLKSTSKVKTSSKPTSNMVKMSSQLSSLKGKETKLSEKQVTYLNSSSVRRKQISSMNSSEGVGGQRYSKIKTGKEATSSNSKAASKKLMSPSKALLSPRPSLIRVASINSRKHKSLKIASHLKNQCTARKDENEEHNNNVLEEKTLHVIKMESENKTLQSDQNASYDDESYLPQLSSPKSSVSSISKSLSQEDQEESEYTTSEFEQDSFSGNHEIECMENEETLGVEKKGKPKKDGVVYSRGKGNQMIKLKFRRGKVVENQTEISSPRRLKFRRARVLGEKANGKVNVRKSFEGNEACDDSNGATTGPEKVVLRHQDMQDKKDAQGLLNNVIEETASKLVEARKSKVKALVGAFETVISLHEKKPSANTVS

SEQ ID NO: 142149 - protein, 75 aa, Glycine max
  Coding DNA Sequence Number=SeqID_25371
MDQNKIYRYSREKKGTSIVAVEEALGDRDEEEPLSVVTSSLATKVEAVMVGDEGLKPPATNHFSGTEVREFWTSP

SEQ ID NO: 142150 - protein, 104 aa, Glycine max
  Coding DNA Sequence Number=SeqID_25372
MTERRSIVGRERRRRRRSYEEEEEDEWVSSGRRNTNKKKKVVGIERRRMRAVADRRNRKKKDARAVAGRNRNMRKKKGIFSILPYVMDAPAKMLGAPSNSRDLI

SEQ ID NO: 142151 - protein, 797 aa, Glycine max
  Coding DNA Sequence Number=SeqID_25373
  Gene Ontology: Mol. function=DNA binding; Cellular component=beta -galactosidase complex; Biological process=DNA integration
  Homolog annotation: Hit_ID=Q1SLU3; Match level="QueryCoverage=97%, HitCoverage=89%, E-value=1e-143, Identity=45%"; Hit description =Integrase, catalytic region
  Pfam annotation: Domain name=zf-CCHC; Domain location=110-127; Score =9.4; E_value=0.027; Accession=PF00098.13; Description=Zinc knuckle
  Pfam module annotation: Pfam domain module=RVT_2::zf-CCHC; Domain location=359-552::110-127
MWEELDNYRPFPVCTWDAKKYHQQDFIIHFLKGLDDRFSVVRSQILLMDPFSAINRVFSMVVQQERQLHVPSSASSEPNSFVNATANSFQGKGRGGYGSTSTVKGAVFSKKCAYCHRAGHTADVCWGKHGYPLGHPRYPGHPRFNNHNSSSSANSVVVDEVVEGSCSHSGTSSSNPINLTQAQYQSLMALIQPMQLKSTSDSIGPHSPHQANLLHAIPNGPKRVSKSNGASSSSPSRQTFFSPSPIPEFTNPISPPLCTSHPSPIHSPIPQSSPNNRIPFVPRCSSRPYQPLVRLVDYICGSVQNQPSQSSSTCLYPIQSALSYSHVSESDRHYLMNLSSEIEPRNYQEAISQQCWHDAMRDEIAALKLNNTWEIVDTLANVKPIGCKWVYKIKRNSDGSVERYKARLVAKGFSQVEGIDFFETFSPIVKMTTVHVILALASIYRWDLQQLDVSNAFLHGDLSEEVYMSIPPGLQGHGSPRCCKSKKSLYGLKQASRKWYEKLSTLLVSSGYQQVNQYDEGICVSQRKYCLELLTDSGMLGCKPSSTPMDSSMRLRQNDSSYFLDDPLSYRSLVGRLIYLTTTCLDIVYATQQLSQFMAHPTKSHLGATRRVLRYLKSCPSKGLFFKRDSHTHLIGFSDADWATCVDTRRSITVEYRALATSTCELQWLSYLLDDLKITCTKSAVLYCDNQSALYIAANPVFLERTKHLEIDCHLVREKSQAGLMRLLPIPSCHQLADMFTKALPPRSFTSNVSKLELVDLYTPPTCGGLTENGPKPLEETHDNLAHINPVDTSNCK

SEQ ID NO: 142152 - protein, 260 aa, Glycine max
  Coding DNA Sequence Number=SeqID_25374
  Gene Ontology: Mol. function=ATP-dependent helicase activity; Cellular component=nucleus; Biological process=mRNA transport
  Homolog annotation: Hit_ID=Q93ZG7; Match level="QueryCoverage=75%, HitCoverage=36%, E-value=2e-64, Identity=64%"; Hit description=DEAD -box ATP-dependent RNA helicase 38
  Pfam annotation: Domain name=DEAD; Domain location=130-255; Score =56.0; E_value=1.3e-13; Accession=PF00270.19; Description=DEADDEAH box helicase
MAEPSSTAATAATAATASTADPPAPVTKSWADEADEETNNTSTAESESSSINLEALTIDDKENNSSKFLDDPDDSNIQAGFELNIIRVLNCVQVTSGDTPYTSAARFEDLSLSPELLKGLYVEMKFEKPSKIQAISLPMILSPPHRDLIAQAHNGSGKTTCFVLGMLSRVDPKVQAPQALCVCPTRELAIQNVEVLRRMGKYTGIASECLVRLDRDAVHVSKRAPIMAQVVIGTPGTIKKFISFKKLGDLEVEDSCFRRG

SEQ ID NO: 142153 - protein, 737 aa, Glycine max
  Coding DNA Sequence Number=SeqID_25375
  Gene Ontology: Mol. function=nucleic acid binding; Cellular component= intracellular; Biological process=DNA integration
  Homolog annotation: Hit_ID=Q1SEE1; Match level="QueryCoverage=80%, HitCoverage=95%, E-value=8e-56, Identity=30%"; Hit description =Integrase, catalytic region; Zinc finger, CCHC-type; Peptidase aspartic, catalytic
  Pfam annotation: Domain name=LRRNT_2; Domain location=675-716; Score =22.7; E_value=0.0013; Accession=PF08263.3; Description=Leucine rich repeat N-terminal domain
  Pfam annotation: Domain name=rve; Domain location=398-552; Score =28.9; E_value=1.7e-05; Accession=PF00665.16; Description=Integrase core domain
  Pfam module annotation: Pfam domain module=LRRNT_2::rve; Domain location=675-716::398-552
METTRRWLDMDEWRMHDLYGQGGLRIMEQMLLTLLSCVIQDEGSCHSYGDMFKLTVENYSYWKLMMEDHLYYKDLHEPITHKNKAKGKKDNEWELLNRKDVAMICKYIDRSLFEHGSTYTNAYELWTKLESLILKKTLMNKAHLVKYLVKLEYMDGQNMIKHLNTFMSWDTLVVTLNNSALDGKLSMDNVIDSLLNEESRQKERGLSSHSEANIVENRRRSEHHGHKKFECKFLKRDQKAGIVHANQIDPKKKNEGGTTTVVASEDENVFLIGNENYLNIASDDCIWIIEFGASFHVTPHEGFFSSYQKGDFGSKTLLEMHLNLISIGKLDEAGMTNQFNADKWKLSRGSMVVAQDMQRRDGYCSRYNQRLWHKRLGHMSEKGLEFLTKHHFPNIKGQPLESYEECLVDVCSTSKKSLGGAQYFVTFIGDHSKKVWVYPWKTKDQVPQTFYEFQASIEQETERKLKCLRLDNGGEYRGPFEAYCKAHGIQHGKPIVRNSRGETLIKETEPTKMIETNQTKQPPQIEQPDQMEQSLMEHLTWMMEESTMETVHSEDESQVRQSIRVRQPSKRYFSDEYVNLIDDGEPQSFKKSFKEMLWMKKFLNELGHDQDDYVVNYDNQSAIHLAKNPMFHSRSKHIDIRYHWIREVTMMGMMKVSIFVFLTLMITMDCYGVTNPNDLRILNDFRKGLKNPKLLKWPDNGNDPCGPPSWSCVYCSGGRVTQIQTKNLGLEGSLPPK

SEQ ID NO: 142154 - protein, 56 aa, Glycine max
  Coding DNA Sequence Number=SeqID_25376
MESSVTLVEDVSHCFELEAHVNKVTIFDDSDKYCSPTKKTKRSTRNALRQRERRSV

SEQ ID NO: 142155 - protein, 281 aa, Glycine max
  Coding DNA Sequence Number=SeqID_25377
  Gene Ontology: Mol. function=ubiquitin-protein ligase activity; Cellular component=ubiquitin ligase complex; Biological process =protein ubiquitination
  Homolog annotation: Hit_ID=Q9LF41; Match level="QueryCoverage=99%, HitCoverage=27%, E-value=1e-93, Identity=61%"; Hit description =Ubiquitin-fusion degradation protein-like
MAAAKPQRTPQEVEDIVIRKIFLVSITEIATTTDSRIVYLELTAAEILSEDKELRLSRDCMERVLIDRLSGEFAGAVDESPFQYLVGCYHRAHEEGKKIANMKDKTLRSEMEAVVRQAKKLCVNYCRIHLANPELFPSRGSANSGGANSPLLSLILAEVGGGNVFGGGGGGAKSPPGFLEEFFRDPDFDSLDKILKGLYEELRGSVMKVSALGNFQDSLRALLYLVRFPVGAKSLVNHEWWIPKGVYMNGRAIEMTSILGPFFHISALPDHAFFKGQPDVG

SEQ ID NO: 142156 - protein, 77 aa, Glycine max
  Coding DNA Sequence Number=SeqID_25378
MAVAMRHNVQRRRSNREGGTHGEETLSLSCVLRLGIRMNWVGGLANGWWLQYHSNENASRTTQEYQRIEDIFVGTIL

SEQ ID NO: 142157 - protein, 92 aa, Glycine max
  Coding DNA Sequence Number=SeqID_25379
  Gene Ontology: Mol. function=protein serine/threonine kinase activity; Biological process=protein amino acid phosphorylation
  Homolog annotation: Hit_ID=Q1SK93; Match level="QueryCoverage=90%, HitCoverage=16%, E-value=5e-26, Identity=67%"; Hit description=EPS15 homology (EH); Protein kinase
MAIMDHRHDLPAEVGSDVLGVVALDDDPVEVLASAVELHDEVDKVAILVRTLELHDVVVASKVVHDLHLSLDIPQVVIVDKFTRGSQQSTTA

SEQ ID NO: 142158 - protein, 51 aa, Glycine max
  Coding DNA Sequence Number=SeqID_25380
MEYEINKLLPEPSQPGFYTGGRDHSTVTNSSSRNCEAYSLNEMSDSLLKPR

SEQ ID NO: 142159 - protein, 555 aa, Glycine max
  Coding DNA Sequence Number=SeqID_25381
  Gene Ontology: Mol. function=ubiquitin-protein ligase activity; Cellular component=ubiquitin ligase complex; Biological process =protein ubiquitination
  Homolog annotation: Hit_ID=Q9LF41; Match level="QueryCoverage=99%, HitCoverage=55%, E-value=0.0, Identity=77%"; Hit description =Ubiquitin-fusion degradation protein-like
QQCFSDASTRRPADLLSSFSTIKTVMNNLYDGLAEVLLILLKSQDTRESVLEYLAEAININASRAHIQVDPITCASSGMFVNLSAVMLRLCEPFLDANLTKRDKIDAKYVHCSNRLKLSGLTALHASSEEVTEWLNSKNPATTGATNQYSDDQKRLQQSQEASSSGSNNFGELSNENSARAEKTKYSFICECFFMTARVLNLGLLKAFSDFKHLVQDISRCEDALATLKAMQERTPTPQAELDINRLEKEMELYSQEKLCYEAQILRMPLPPTCPMEFATMPEHFVEDAMELLIFASRIPKALDGVVLEEFMNFIIMFMASPEFIKNPYLRAKMVEVLNCWMPRRSGSTATATLFEGHQLSLEYLVRNLLKLYVDIEFTGSHTQFYDKFNIRHNIAELLEYLWQVPSHRNAWRQIAKEEEKGVYLNFLNFLINDSIYLLDESLNKILELKELEAEMSNTVEWERRPVQERQERTRLFHSQENIIRIDMKLANEDVSMLAFTSEQITAPFLLPEMVERVASMLNYFLLQLVGPQRKSLSLKDPEKYEFRPKHLLKQ

SEQ ID NO: 142160 - protein, 618 aa, Glycine max
  Coding DNA Sequence Number=SeqID_25382
  Gene Ontology: Mol. function=protein serine/threonine kinase activity; Cellular component=membrane; Biological process=protein amino acid phosphorylation
  Homolog annotation: Hit_ID=Q1STT5; Match level="QueryCoverage=99%, HitCoverage=81%, E-value=1e-150, Identity=44%"; Hit description =Protein kinase; S-locus glycoprotein; Curculin-like (Mannose -binding) lectin; Apple-like
  Pfam annotation: Domain name=B_lectin; Domain location=73-184; Score =125.1; E_value=1.9e-34; Accession=PF01453.15; Description=D-mannose binding lectin
  Pfam annotation: Domain name=PAN_1; Domain location=338-418; Score =3.7; E_value=0.067; Accession=PF00024.16; Description=PAN domain
  Pfam annotation: Domain name=PAN_2; Domain location=338-407; Score =109.2; E_value=1.2e-29; Accession=PF08276.2; Description=PAN-like domain
  Pfam annotation: Domain name=Pkinase; Domain location=503-617; Score=- 93.3; E_value=0.0053; Accession=PF00069.15; Description=Protein kinase domain
  Pfam annotation: Domain name=Pkinase_Tyr; Domain location=503-616; Score=-139.7; E_value=0.00067; Accession=PF07714.7; Description =Protein tyrosine kinase
  Pfam annotation: Domain name=S_locus_glycop; Domain location=198-329; Score=60.1; E_value=7.1e-15; Accession=PF00954.11; Description=S -locus glycoprotein family
  Pfam module annotation: Pfam domain module=B_lectin::PAN_1::PAN _2::Pkinase::Pkinase_Tyr::S_locus_glycop; Domain location=73-184::338- 418::338-407::503-617::503-616::198-329
MENFDILGVCLLFLSLITMSSTLDMVTTIQPIRDGKNENETLVSTNGTFEAGFFSPENFDSRYLGIWYTNIFPRTVVWVANKEKPLKDHSGVLEVDTDQGILSIKDGTGAKIWFSSASHTPNKPVAAELLESGNMVLKDGDNNFLWQSFDYPGDTLLPGMKIGVNFKTGQHRALRSWRSFTDPTPGNFSLGVDTRGLPQLVITNENTNSNDIAYRPGSWNGLSITGLPGEITDQLTKSLFVMNQDEVFYEIQLLNSSTKLMRSRLLPEGYQVRFIWSDEKKIWDSQFPKPFDVCQTYALCGANAICDFNGKAKHCGCLSGFKANSAGSICARTTRLDCNKGGIDKFQKYKGMKLPDTSSSWYDRTITTLLECEKLCLSNCSCTAYAQLNISGEGSGCLHWFSDIVDIRTLPEGGQNFYLRMATVTASELQLQDHRFSRKKLAGIVVGCTIFIIAVTVFGLIFCIRRKKLKQSEANYWKDKSKEDDIDLPIFHFLSISNATNQFSESNKLGQGGFGPVYKGILPDGQEIAVKRLSKTSGQDSTRRTLLGWAKRFEIIGGIARGLLYLHQDSRLKIIHRDLKTGNVLLDSNMNPKISDFGMARTFGLDQDEANTNRVMGT

SEQ ID NO: 142161 - protein, 215 aa, Glycine max
  Coding DNA Sequence Number=SeqID_25383
  Homolog annotation: Hit_ID=Q8LGI2; Match level="QueryCoverage=25%, HitCoverage=12%, E-value=1e-16, Identity=71%"; Hit description =Probable mitochondrial saccharopine dehydrogenase At5g39410
MILSLSSHQNEQASQKSSRLSFFQPSQHSHSTQEDHGGIQLELKVFFQQELHLLKLVYYSMYVHVERLAREILRGANSVEGLEAKLLQHSLPPQATASPAAASFAWTPLPFENHRVEDECRRCRKKWGKGADGETSGRSVRGSSGTSGRTFSGNFPEEVFFRKKPNVFRKNPASGNFPEEGFFRKRLGFPEEVSGRSVLPELFRKNSSSGKFYEK

SEQ ID NO: 142162 - protein, 58 aa, Glycine max
  Coding DNA Sequence Number=SeqID_25384
MFLLTSVFKGFEDIQGCKSKAIVGLIAVKCNKQRESTKSGYYVMHWMPTIILGGFKDN

SEQ ID NO: 142163 - protein, 87 aa, Glycine max
  Coding DNA Sequence Number=SeqID_25385
GVVLAEVLLADSRFTRPDMGFHPTKLNFVPSDADEAPLDVSICLHAFGIVGCGSFSGVKSCEREAFVAYVLTIGSCVAYLPNGIRVA

SEQ ID NO: 142164 - protein, 265 aa, Glycine max
  Coding DNA Sequence Number=SeqID_25386
  Gene Ontology: Mol. function=protein transporter activity; Cellular component=membrane; Biological process=protein secretion
  Homolog annotation: Hit_ID=Q47GU8; Match level="QueryCoverage=98%, HitCoverage=67%, E-value=8e-53, Identity=43%"; Hit description =Secretion protein HlyD
MDSPDVGGAVADVRKSQADLQLKQQALERSRMLVDHGVLAKKEVEVAQADWASSRAESERATARLKNLGVSTAANDNYAVRSPIAGMVADRKINPGSEVRPDAADPLFIVTDPNYLWASIDLPERDLSRISQGQKLSIQVDAYPDEVFSGEVKTIGVMVDPTTRRIPVRCMVESKGKLKPEMYARITPLDSSQHRVIRLPNSALITEGLYSYVFVEERPLHFKKRKVTLDLQRREYATVKEGLKLGERVVVGGAILLNSDLSVSK

SEQ ID NO: 142165 - protein, 238 aa, Glycine max
  Coding DNA Sequence Number=SeqID_25387
  Gene Ontology: Mol. function=RNA-directed DNA polymerase activity; Biological process=RNA-dependent DNA replication
MTLAALASLRQADDESLRKFIGKFGRTVVQIRNLNPEIKLHSMLLALHPSKFVDSLCKKLPGSMDEPHERAKGYIQIEEMSKFWNEVQSKHQDRLAQVGQEAQARQAPTSLQKARYERYVPLTANRTTILEEAFDLEVPVRLPQMKSLRPGSDATKYCRFHRGIEHNTKDCWALNGKIEELIQAGYLAQFVKRPDHYQEGVRPKGHQEEQHKNQEVDKRRLEDRGRQRQQPQRHERSP

SEQ ID NO: 142166 - protein, 119 aa, Glycine max
  Coding DNA Sequence Number=SeqID_25388
SKEFQRPPTAWEEKYQHRQDEILQHSTKEGTSTRDSPNTATFVNDNEIYLNADGGPNYKGNVYELGTLSKRFSCSKSAPSTSIAPVEDQIEKMRETINKLNVELLAKANKEKILEEKML

SEQ ID NO: 142167 - protein, 262 aa, Glycine max
  Coding DNA Sequence Number=SeqID_25389
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=3e-32, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLTFRGLHILTFRGLHVLAFRGLHVLAIRGLQAPTFIGLHVLTFRGLHVLAFRGLHVLTIRGLHALTFIRLHALTFRGLHVLTFRGLRVLTFRGLHVLAFRGLHVLTFKGLHAPAFRGPYVLTFRGLHVLAFGGLHAVAVRGLHVLAFRGLHVLTFRGLYVLTIKGLHAITYIGLHTLTFRGLDFLAFRGLDVLAFRGLDVPAFEGLHALAFKGLHVLAFRGLHALTFKGQHVLDFERLHAPSPLDGYTSSFSVGSISTP

SEQ ID NO: 142168 - protein, 113 aa, Glycine max
  Coding DNA Sequence Number=SeqID_25390
MESETSEEVPGSATNEVVPLSYPNFVRGLLLDGMQPLIDRFEILPPEGGCFWRKQPSSPGRAGKGFSLLGTSYSLEIAEKNFFREENSSRDASIFNCSSSFIVRSSLFFGLQP

SEQ ID NO: 142169 - protein, 98 aa, Glycine max
  Coding DNA Sequence Number=SeqID_25391
GRSLPPSSPRRARLLPPEATAFWRKNLEGPSGPAFKELRKLTDCVTILPFDFRHVTKFHGLRNNASFRFPARLGTSQIVQQRVPNSMATNDIASITNP

SEQ ID NO: 142170 - protein, 87 aa, Glycine max
  Coding DNA Sequence Number=SeqID_25392
MKQNLENEVKRQIVCILEELSTSESPTNSSAQIWKIRKLYTDELTDAVLPYEFTEEVLPWKWPGNEEEEKRQATDTNQQNEEEEAEA

SEQ ID NO: 142171 - protein, 163 aa, Glycine max
  Coding DNA Sequence Number=SeqID_25393
MAWYQSNTIIYLNMQLPMNFETSQSSRATNIVQPECNPANTPIPHMTNYVPPTYTPIPPMTNYDSLSASNMDYTPPIVQPDDFLSNVFGTDFVELILARQHQLVNTCIAYKTKWNQVSTLCLARMYKTIIHHCLTYQMNTHVEIQDVTRDALHVEQDTIIGIK

SEQ ID NO: 142172 - protein, 170 aa, Glycine max
  Coding DNA Sequence Number=SeqID_25394
MISCLARPRYKPIKVLSDPPSISRKNFKHSPQTLVRREKHYPSEENYGKCRKDQLKEFEKIGAIESVGAFGACSHFCFCLRTSKVLIWGIVITAKYELSQPTLLQASEVRLSGVFSKVGKCAESPPMFICGKHRKKRRKPVIKNILDSGVVFTFEEGISTSHVCPKGQQP

SEQ ID NO: 142173 - protein, 360 aa, Glycine max
  Coding DNA Sequence Number=SeqID_25395
  Gene Ontology: Mol. function=protein serine/threonine kinase activity; Cellular component=nucleus; Biological process=protein amino acid phosphorylation
  Homolog annotation: Hit_ID=Q6T2Z4; Match level="QueryCoverage=91%, HitCoverage=66%, E-value=1e-138, Identity=74%"; Hit description=Wee1
  Pfam annotation: Domain name=Pkinase; Domain location=110-354; Score =152.9; E_value=8.5e-43; Accession=PF00069.15; Description=Protein kinase domain
  Pfam annotation: Domain name=Pkinase_Tyr; Domain location=110-354; Score=-23.3; E_value=4.9e-11; Accession=PF07714.7; Description =Protein tyrosine kinase
  Pfam module annotation: Pfam domain module=Pkinase::Pkinase_Tyr; Domain location=110-354::110-354
MVVLDDAISGDTLSSTSSGDNQPIVELGNDFVGEYITDKPKARNYVSRSAVALRCRVMPPPCIRNPFLKCLSEKEIDPFESQRSKFAGLFPALVGGGGGGDCLSRYRNDFHEIEQIGIGHFSNVFKVIKRIDGCLYAVKHSTRKLCKETEREKALMEVQALAAIGSHENIVGYYSSWFENEQLYIQMELCDHSLSIKNCPSLVTAGHEIEALYQVASALQFIHKKGIAHLDVKPENIYVKNGVYKLGDFGCATLLDNSLPIEEGDAHYMPQEILNENYDHLDKVDIFSLGASMFELISSSCLPEPESGIQFFNPKEGKVPFLPGVSVQFQNLLTVMMDPDPVKRPSATKLLKRVLEMARN

SEQ ID NO: 142174 - protein, 122 aa, Glycine max
  Coding DNA Sequence Number=SeqID_25396
MAFLGETSSQTIANSRLAFIFPNGPITHNQTGVYFQSLTPTPITPDGILNLLQSTITPTHYAIMYYNRKWNIPRQGGFLGYSFTGTNPIRFDIPLGCSMDKLKDLIKRVAPMGVPPYGIHES

SEQ ID NO: 142175 - protein, 89 aa, Glycine max
  Coding DNA Sequence Number=SeqID_25397
AQPSPSGKGGASEAQEPELEQPTVAAEGEDELTPPEPFYFDANPHMAQEERTSTDKKPEPSPAPIPDDAIPSTPASELEQSIPQDSPTA

SEQ ID NO: 142176 - protein, 96 aa, Glycine max
  Coding DNA Sequence Number=SeqID_25398
  Homolog annotation: Hit_ID=Q1T493; Match level="QueryCoverage=96%, HitCoverage=21%, E-value=5e-10, Identity=31%"; Hit description =Nucleic acid-binding, OB-fold, subgroup
MSRSFDMIRAIDDSKDTFKLAVRIVDLWDRIHAIVKKEDLECWEVEVKEGKTYYMYNFRVVPNDDQYRVCAHPFKFYFTCGTTMRKVDLAEIPLQL

SEQ ID NO: 142177 - protein, 127 aa, Glycine max
  Coding DNA Sequence Number=SeqID_25399
  Pfam annotation: Domain name=zf-CCHC; Domain location=96-113; Score =6.6; E_value=0.08; Accession=PF00098.13; Description=Zinc knuckle
MSLVTLIGKLQEHEMELMRLHQHEENDIKRKGIALRASLSSSQEESDKEDLTEIEEDDDDFRFFVKRFNKFIINKRNKRESNINTKKKEEDSSLAPTCYESNQLGHMRFDCLVFKRRMEKSDKRNLK

SEQ ID NO: 142178 - protein, 156 aa, Glycine max
  Coding DNA Sequence Number=SeqID_25400
  Gene Ontology: Mol. function=oxidoreductase activity; Biological process=metabolic process
  Homolog annotation: Hit_ID=Q84YJ8; Match level="QueryCoverage=50%, HitCoverage=28%, E-value=7e-21, Identity=55%"; Hit description =Putative alcohol dehydrogenase homolog
  Pfam annotation: Domain name=adh_short; Domain location=15-154; Score= -50.2; E_value=0.011; Accession=PF00106.15; Description=short chain dehydrogenase
MAGLRMLIPYCSSVKSTSIHITEQLCRVFLCASSRHADIGGAGDLVFEKNLSLPLDRNSWIRAVGIFCCEGIQHQLVGNVKSPLELSEEEWNHAFRTNLTGTWLVSKYVCKRMRDAQRKGSIINIASIAGLNRGQLPGGAAYSSSKAGVNMLTRIP

SEQ ID NO: 142179 - protein, 116 aa, Glycine max
  Coding DNA Sequence Number=SeqID_25401
MAKQPARLGELQPPQNGFFSINSHDGGCFKGLEDSTLKGIKRIERKEEEREAEGEERRGNEAEALPNHDRDQSPCHFLFCVLHATVAFAKRNTQWLSARKNPEEDELSGLLSAPFQ

SEQ ID NO: 142180 - protein, 402 aa, Glycine max
  Coding DNA Sequence Number=SeqID_25402
MESKESSSTLRGLDEEVFVMSSCSNSMESYSLSLTILFVEEGSFDFLAFLDSLPEHIVDNLSRGTSGVADVMSDAPNHLVRAPQRYFMVEEEEDETQVEVVTQKSQRVQVEKKKYPSITLPQYSWMDGEVGTFFSRASDFERGPYPASSEWLGCHLSVLGLMPITHVPCQYNEFPLDYLSGEELGNLAFLESLPRRLPSKAIMNLFKSPNPIRNLEAYAISLLTREAKQKDQGKHYDQRQGSVQPSGHEGSKKMKQQALEFSSAHPLSNILILTNIDFFTNDFVSIHMVEPTHISKQGCHVLNRSDDAANWTNFWVFMHEWWPSLNTFKVPDESIFDMDKDVYNGELIPIDDILEDGAPCAELLATPPSKIQMTKGLERRKVTMMKMVKCRPGVVTMEKMPK

SEQ ID NO: 142181 - protein, 285 aa, Glycine max
  Coding DNA Sequence Number=SeqID_25403
  Gene Ontology: Mol. function=iron-sulfur cluster binding
  Homolog annotation: Hit_ID=Q1H2D6; Match level="QueryCoverage=91%, HitCoverage=35%, E-value=1e-119, Identity=78%"; Hit description =Radical SAM
MYRLSCKSEEIEKNCRKLSCVYPGVCENLNTDHSALIQLYRKARNLRGVKKILIGSGLRYDLAVKSPEYVKELVQHHVGGYLKIAPEHSEDNVLSKMMKPGMGAYDEFKRMFEKFSAEAGKKQYLIPYFIAAHPGTTDEDMLNLALWLKRNDFRLDQVQTFTPTPMAMATAMYHSGKNPLRKVTADSEPVPVPKTGTIRKLHKAFIRYHDPQNWPMLREALKKMGRADLIGNGKKHLVPAYQPAVLPKIVQSDGSRFQAKPLPKGFNQTKSFASPKKHTGGRHKH

SEQ ID NO: 142182 - protein, 80 aa, Glycine max
  Coding DNA Sequence Number=SeqID_25404
VAATTPERSLEATSEHSAPVVNLPFPQPAADPSTPLLQMPDDPTTPVLAVDTSPPTTPMLQLTDEEDGQTQDTQDQSQEF

SEQ ID NO: 142183 - protein, 79 aa, Glycine max
  Coding DNA Sequence Number=SeqID_25405
MKKIQGLQAPHGATSPLREDLLVSKPSPTLYIEAAEEALETSFQGLEIVNAIYAKDGKTITQSLGASMMVAKVMLENGY

SEQ ID NO: 142184 - protein, 103 aa, Glycine max
  Coding DNA Sequence Number=SeqID_25406
MTPAIVLRQLKWTQVVPKVEELGGLSFQYALGNTNVDQAKVRTTWDKVKKKREKESGKLRVTASSEYKEWRKLRGVPTPILAETPCGDSSSYESVQMIASLTF

SEQ ID NO: 142185 - protein, 269 aa, Glycine max
  Coding DNA Sequence Number=SeqID_25407
  Gene Ontology: Mol. function=RNA-directed DNA polymerase activity; Cellular component=intracellular; Biological process=RNA-dependent DNA replication
MTLFINTLREPFYDKMIGCTSSKFFDIVVIGERVENGMWKGRIDYPRSANSKTLLSGSGKTRREHQCSDVSFSWGTFTVRSKESLSVLIKKTKRYQGRGQKGTPNYIVSGPKLITIQVSKAFPYKDNKAVPWRCEVKVCVDSFDENMTQSIRIYSPSESRTEPSKEIKGKEVVRSPKEQRKEIYDEKSCEFIILIKQSEYIVMDQLNCTIAKISLLSLMLNSEPHMKVLLKILNEAHVIHDISEEIFEGIVGNVTTRNYLMLTDEEMQA

SEQ ID NO: 142186 - protein, 137 aa, Glycine max
  Coding DNA Sequence Number=SeqID_25408
MHGFSPVDGFVEISNCLAEVIKYVGNESSTGLFFIQHHTQNAVPNVIKLKNNIIDKSHETTLHTEDLEDSVSMPLCICKGKAAYNILPSYLRIAKSLWAMGFSKQKTNSLKWPQLDSTGSVRSNAEKPQMYRSIFTS

SEQ ID NO: 142187 - protein, 840 aa, Glycine max
  Coding DNA Sequence Number=SeqID_25409
  Gene Ontology: Mol. function=oxidoreductase activity; Cellular component=nucleus; Biological process=electron transport
  Homolog annotation: Hit_ID=Q58T18; Match level="QueryCoverage=89%, HitCoverage=98%, E-value=0.0, Identity=66%"; Hit description =Flowering locus D
  Pfam annotation: Domain name=Amino_oxidase; Domain location=205-632; Score=312.7; E_value=6.8e-91; Accession=PF01593.14; Description =Flavin containing amine oxidoreductase
  Pfam annotation: Domain name=DAO; Domain location=197-612; Score= -37.9; E_value=0.0018; Accession=PF01266.14; Description=FAD dependent oxidoreductase
  Pfam annotation: Domain name=SWIRM; Domain location=87-179; Score =89.7; E_value=8.7e-24; Accession=PF04433.7; Description=SWIRM domain
  Pfam module annotation: Pfam domain module=Amino_oxidase::DAO::SWIRM; Domain location=205-632::197-612::87-179
  Subcellular localization annotation: CTP_CleavageSite=71; ConfidenceScore=5.53e-01
MDPPLQFSSPQNPNPNPNHNVFLDPTSDSIPNLLQNPIHYLSFSVPKKRRRGRSQRNPASFRLPPLTTLPTAANPSPSASDEIIFINKEPKTEALIALTAGFPADSLTEEEIDAAVLPVIGGIEQVNYTLIRNHIIAKWRENVSNWVSKKTFLDYIPPHYHSLLDSAYNYLVSHGYINFGVASSIKERVPAEASRPAVIVVGAGLAGLAAARQLLRFGFKVTVLEGRKRAGGRVYTKKMEGGNRMCAAADLGGSVLTGTLGNPLGIVARQLGELLHKVRDKCPLYCVNGMPVDPDMDVKVESAFNRLLDKASRLRQLMGEVSVDVSLGAALETFSQVYKDAVSDEEMNLFNWHLANLEYANAGLLSNLSLAFWDQDDPYDMGGDHCFLPGGNGKLVQALSENVPILYEKTVHMIRYSGDGVQVTAGSQVFEGDMALCTVPLGVLKKGFIKFIPELPQRKLDGIKRLGFGLLNKVAMLFPHVFWEMDLDTFGHLSDDPSRRGEFFLFYSYVTVAGGPLLIALVAGEAAHKFESMPPTDAVTRVLQILKGIYEPKGITVPEPIQTVCTRWGSDPFCFGSYSNVAVGASGDDYDILAESVGDGRLFFAGEATTRRYPATMHGAFLSGLREAANMAHHDNIRTLKMKVDKAPSNAHSCASLLADLFREPDIEFGSFSVIFARKNTDPKSPAILRVTFNEARKKCHEVAKQDQQHSNKLLFQQLQSHFNQQQQLHVYTLLSRQQVIDLREVRGGDEMRLNYLCEKLGVKLVGRKGLGMNADSIIDSIKAERGNRKPVSTSLALKPGGGVVKAKGGGHYEAQVSQKGKSGEEKQWVHKCAECHQSI

SEQ ID NO: 142188 - protein, 66 aa, Glycine max
  Coding DNA Sequence Number=SeqID_25410
MKCISWNCRSLRAPQEVRALRKLLASEVPDMVFLMETRKKRKREGKDWRLDDARMRPWRLISSRAP

SEQ ID NO: 142189 - protein, 114 aa, Glycine max
  Coding DNA Sequence Number=SeqID_25411
MLLIDHLARKRSPHLYRFEQAWLRSEDCREIVQRTWRIGGAITSNLNRVGGVLGEWGKMTFKEIPRRILMSCHSLWVLRSTSTKEKQASEVSTEDFRKVSRVVKFMACLRLLCF

SEQ ID NO: 142190 - protein, 134 aa, Glycine max
  Coding DNA Sequence Number=SeqID_25412
MEAMKEQMAKMMEAMMSMKKIMEANTVAIAATSAIAKVNPMPPSGVNQMNHATSAMVGKDLGSTGGPIMCKFKTSMPSHHMACLPTIHHPMWRTLPVRMSITPLPYSLRANNPKLIMHMSLNPWVRHMKCPTTI

SEQ ID NO: 142191 - protein, 51 aa, Glycine max
  Coding DNA Sequence Number=SeqID_25413
MAKEFVKDSVHQNDIAIITLDHPKDVNVFCFVCGFPSYEMIHEGASTRQVC

SEQ ID NO: 142192 - protein, 49 aa, Glycine max
  Coding DNA Sequence Number=SeqID_25414
MAAIIPAKVPQPPFFRGYNSNATLACALELISNSVQSEIARSPRLVRVP

SEQ ID NO: 142193 - protein, 125 aa, Glycine max
  Coding DNA Sequence Number=SeqID_25415
  Homolog annotation: Hit_ID=Q1S7B1; Match level="QueryCoverage=68%, HitCoverage=45%, E-value=6e-11, Identity=41%"; Hit description =Transposase
MEVFGTRDDVLQWARTVAHENGFVAVIMRNEEFVRKDTGSRKCGCPFRLRGKPVHGGEVDGEPTNILLTLKEHNANSCTTIKQFYNAKSAYRSSIRGADIEMQHLMKLLERDQYIHWHRLKDEVV

SEQ ID NO: 142194 - protein, 158 aa, Glycine max
  Coding DNA Sequence Number=SeqID_25416
  Subcellular localization annotation: CTP_CleavageSite=66; ConfidenceScore=5.02e-01
MLGAPSNTQKMVMNWPTGPLSQITCWDMLGAPSNIASAPNNLLKAFSLLHFSLPRKLLKFFSSLFRDELGGGLLLRQPLDPFAFEKTPKKWQKLGDGGAFRKTRLGFFRNFRKKGSSGSNETSSESTGLPKSSRNTSSGKFPEEVVLPGTFRKKGSSI

SEQ ID NO: 142195 - protein, 776 aa, Glycine max
  Coding DNA Sequence Number=SeqID_25417
  Pfam annotation: Domain name=DUF1666; Domain location=576-775; Score =216.5; E_value=6.1e-62; Accession=PF07891.2; Description=Protein of unknown function (DUF1666)
GFGVALMGSRNLVMLKTHIGSINLSFANGFVYENVLWALASLWVFFCNYVMYYLGLILRYIFRFHVEDRKSEHFVPHDLLDQTKRNQTEDPKVDGVAQELANLLFPIFENFHVAIDEREGETECPVLLEVDSDIKIHQDARKLEGETDCSVLMEIDSDVNEDAKKLVGETECSVLKENDSDMHEDGRKREGETDESVFLKSVAYVHEDVKKIGENETESSVFLEGDSNFSQDNREKVEEEETEESIFIDTYFVEASSLVEEPRILTFTFQQNYIAANASYNAFSSTQNIAKMEFHEKNLEKTLVAQEEENEHCVLEQRNITSNSTSGQIFQINAVGRSDSSDDDHVRHDGDAFQSDFRSESCSGSIDDSLKHRIPSSNHSCEGFDFVSHKDERVEDIEETQYSCESEVSNSQKTKETMWEDNLDESDFDEAEDEDEDDFEWEHDEVVEQLRMELKNARQGGLATILEEEEEEETESPKNVEDLKPLKIEEKLEFKDHIIEIQKVYRCYAEKIRKLDVLNYQTMHAIGLLELKDPLKLMSIPKSTVQSAKPLSQNLWPRKAQKQISDPILKFVQELHGDLELVYVGQVCLSWEILCWQHKKVQELKQYDSQWPRSYNLVAGDFQLFQVLMQRFLEDEPFQGPRIQNYVKNRCVIRNLLQVPVIKDDNTKDKKIIKLGEEHAIDSERLAQIIKESMRVFWEFVRADKDYGNVIKISHQIGVDVKDPAISDLLGNVRTQLQKKERKLKDIVRSGNCIVRKFQKHHEEQIQLDEEQLLAQ

SEQ ID NO: 142196 - protein, 105 aa, Glycine max
  Coding DNA Sequence Number=SeqID_25418
  Subcellular localization annotation: CTP_CleavageSite=20; ConfidenceScore=5.49e-01
ALAPKMNGAKAICRSCGMTRASSAGRSGSENVGLSNANVGENPMPRKPKGSSARFVHGGVIRGRENASSQSSSTRRYSAEVIHAILPGKARTTFNKWVPVPETDT

SEQ ID NO: 142197 - protein, 210 aa, Glycine max
  Coding DNA Sequence Number=SeqID_25419
ADAPVLVPTDEVSLVGQALHTFLAWSTHLVKSLSKHVVVSPAKPPPKPDPEVTWDATVFGVFNLDFPLYIKHEDLSEIAHGGQCLSISVLQLWIPHLTDTSMRAGNSDIYGFLEPQSIQSGHWQMVVILPKEHLVVWFCSLHSRPDNYLKGVINSALKGLDDAPQPKSKAPARWIVVKCNRQKGSTECGYYVMHWMSTIILGTFRNNWEA

SEQ ID NO: 142198 - protein, 185 aa, Glycine max
  Coding DNA Sequence Number=SeqID_25420
MKPINSVYFHFPWQEKPRGGSTHLRVTGCTICGEAHEIGQCIPIEENTQEVHYMGNQQRQGYTQGGFSGFQQGPYNQQGQWRSHPDNQFNKDQGGPSNKPIQQGPNIFQRTTKLEETMTQFMQLLEEATWSFLGKNAAQPSLTVGSSRNLGLQLHKTLVHDLTVGIFAKMSGVCSTLPFPRAFLI

SEQ ID NO: 142199 - protein, 319 aa, Glycine max
  Coding DNA Sequence Number=SeqID_25421
  Gene Ontology: Mol. function=aspartate-tRNA ligase activity; Cellular component=cytoplasm; Biological process=tRNA aminoacylation for protein translation
  Homolog annotation: Hit_ID=Q2URG4; Match level="QueryCoverage=94%, HitCoverage=35%, E-value=1e-90, Identity=59%"; Hit description =Aspartyl-tRNA synthetase
  Pfam annotation: Domain name=tRNA-synt_2; Domain location=210-319; Score=-162.8; E_value=8.5e-05; Accession=PF00152.11; Description =tRNA synthetases class II (D, K and N)
  Subcellular localization annotation: CTP_CleavageSite=85; ConfidenceScore=5.37e-01
SSSSDSYPSRRAPPSPGILSGFLRDRGGYASSSDDFSDDSSSPTTGTMSKNQQKRLARQQRRQERSRLSEEHHSEESERHKEAVAAAAREETAEMKARYGELPLLQSRSRPRELRTKFEDISVDSVGQGGPLHGALAYHPSHECQAVQVRGTIQAPEVPVLGCTIHDVELAIDAVHVVVRREEPVPFSVYEAEIQTPEEERVEGRRSHIPDRTRLTNRLLDLRTPTSQSIFRIQSAVGNLFRTALDEQNFIEIHTPKLQGSATESGASVFEVNYFGRDAFLAQSPQLAKQMAIAADFGRVYEIGAVFRAENSNTHRHLT

SEQ ID NO: 142200 - protein, 81 aa, Glycine max
  Coding DNA Sequence Number=SeqID_25422
  Gene Ontology: Mol. function=protein serine/threonine kinase activity; Cellular component=membrane; Biological process=protein amino acid phosphorylation
  Homolog annotation: Hit_ID=Q6W0C7; Match level="QueryCoverage=76%, HitCoverage=18%, E-value=1e-22, Identity=89%"; Hit description=Pto -like serine/threonine kinase
MKWQKKGQLEQIIDQTLAGKIRPNSLRKFGETAEKCLADYGVDRPSMGDVLWNMLSNFKRSWCTLLAGERAESASAANFSD

SEQ ID NO: 142201 - protein, 646 aa, Glycine max
  Coding DNA Sequence Number=SeqID_25423
  Homolog annotation: Hit_ID=Q2HU30; Match level="QueryCoverage=36%, HitCoverage=92%, E-value=2e-93, Identity=70%"; Hit description=2-S globulin
  Pfam annotation: Domain name=CBFD_NFYB_HMF; Domain location=446-509; Score=5.0; E_value=0.053; Accession=PF00808.13; Description=Histone -like transcription factor (CBFNF-Y) and archaeal histone
  Pfam annotation: Domain name=Histone; Domain location=443-512; Score =67.1; E_value=5.7e-17; Accession=PF00125.14; Description=Core histone H2AH2BH3H4
  Pfam annotation: Domain name=TAF; Domain location=446-510; Score= -6.7; E_value=0.023; Accession=PF02969.8; Description=TATA box binding protein associated factor (TAF)
  Pfam module annotation: Pfam domain module=CBFD_NFYB_HMF::Histone::TAF ; Domain location=446-509::443-512::446-510
MEDGAWGTSVIELVEDAGRRVGHVVLAVGSKVGSKHGLEGGVDNGARLGCMVQSMVAELVWKTEATMVTARRKKMGSINNAKVIAKLLDTPSSSLGIFVWDATPFSPPSGPIHGQSSGCPLRLKESLSLLENVHATEKEDDRRQSGPVLVLGAVASKEFSSGIKLALHQRGWVEHWFELALELVIDPVNEEGHSAVQQGIIFFVQSKRGRNRSLAHYALFFEVPYELSHALDKVTGGGIDVLVKHVDAVHVEVVVFVLDEVREGLGGVVDPGVLGAAVADADEDFDVNVGVLVLEARDGFGGDLAQVPGRSENAVGGGTLVVVVAGEGQSDLVLLQEFRRHKHLRERVVERVLPENRQHCAKRPIYGIAIWVLCQKLPSPRCPYILHLCPGHIRINMEYLSHFDSIRFDSVEVLSSSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGVGFGRVLATSKSKVGHEYGSMTHLPLRPTFVNLNKWPESEVVDRFSCRQMYLRSYKFSREKKVGVTEKTLKCFDKLKEKVVCVRNKLNLKNKYKVLMRATDVTYAAFSIFQSFLPCSAKFDVLHDF

SEQ ID NO: 142202 - protein, 107 aa, Glycine max
  Coding DNA Sequence Number=SeqID_25424
MALFEMVVESYGSAMVARKCQLVAFALCTTAKPGAFHRNRPWDLGIAFRSHDLKIQHLEDKNPLEGVELSGGYWFTGRWGEFQYGRKEAKRHFGICAFIIEAKSNFG

SEQ ID NO: 142203 - protein, 833 aa, Glycine max
  Coding DNA Sequence Number=SeqID_25425
  Gene Ontology: Mol. function=protein serine/threonine kinase activity; Cellular component=membrane; Biological process=protein amino acid phosphorylation
  Homolog annotation: Hit_ID=Q1SHR4; Match level="QueryCoverage=99%, HitCoverage=99%, E-value=0.0, Identity=72%"; Hit description=Protein kinase
  Pfam annotation: Domain name=Pkinase; Domain location=493-763; Score =129.8; E_value=7.7e-36; Accession=PF00069.15; Description=Protein kinase domain
  Pfam annotation: Domain name=Pkinase_Tyr; Domain location=493-763; Score=118.6; E_value=1.7e-32; Accession=PF07714.7; Description =Protein tyrosine kinase
  Pfam module annotation: Pfam domain module=Pkinase::Pkinase_Tyr; Domain location=493-763::493-763
MTDWRNIGFFICVLSIFPLVCFCATFVPVDNYLIDCGATTSTSVGTRNFIADNKDLLSTQKDIVATTSSKSATSSSDDSSLYQTARVFTASSKYTFKINQKGRHWIRLYFLPFAYEKYNLRAADFTVSTQNHVLFRSLNMQKDPVMKEYSVNVTSDSLVLTFAPSGSSIAFVNAIEVVSVPDDLIVDDGFALDPSVTSSGLVTQALETVWRVNMGGPTVTPINDTLQRTWVPDQSFLLQSNLASFSSNIKGVKYENHGQATENTAPPTVYGTLTQMNSTYDPRNIFNVTWQFDVSPGFQYLVRLHFCDVVSKALNELYFNAYVDSKLAASSADPSTTSNNALGVPYYRDLVTAVAVSKTLRVSIGPSEVNKEYPNAILNGLEIMKMNNSMGSLIPGAVAITSGSSSKKTGMIVGVSVGVVGAVVLAGVFFVLCRKRRRLAQRQSKTWVPLSINDGTTFHTMGSKYSNGTTLSAASNFEYRVPFVAVQEATNNFDESWVIGIGGFGKVYKGELSDGTKVAVKRGNPRSQQGLAEFQTEIEMLSQFRHRHLVSLIGYCDERNEMILIYEYMEKGTLKGHLYGSGLPSLSWKERLEICIGAARGLHYLHTGYAKAVIHRDVKSANILLDENLMAKVADFGLSKTGPEIDQTHVSTAVKGSFGYLDPEYFRRQQLTEKSDVYSFGVVLFEVLCARPVIDPTLPREMVNLAEWAMKWQKKGQLEQIIDQTLAGKIRPDSLRKFGETAEKCLADYGVDRSSMGDVLWNLEYALQLQEAVVQGDPEENSTNMIGELSPQVNNFNQDASASVTQFAGSSLDDLSGVSMSRVFSQLVKSEGR

SEQ ID NO: 142204 - protein, 195 aa, Glycine max
  Coding DNA Sequence Number=SeqID_25426
  Gene Ontology: Mol. function=transcription regulator activity; Cellular component=nucleus; Biological process=regulation of transcription
  Homolog annotation: Hit_ID=Q8GZ37; Match level="QueryCoverage=83%, HitCoverage=39%, E-value=2e-51, Identity=60%"; Hit description =Putative VIP2 protein
MLYEEEEKEMPNIIIMLKSSLNGSASNLPDGAGRSFATSFSGSIQGLHNIHGNFNVPNMPSTLTSRNSTINSVPTGGGVQQPSASLSSGRFASNNLPVALSQLSHGSSHGHSGVNSRGGISVVGNPGFNSSTNGVAGPIPGILPTSAAIGNRNAVPGLGVSPILGNAGPRITSSMGNMVGGGNIGRISSGGLSVP

SEQ ID NO: 142205 - protein, 91 aa, Glycine max
  Coding DNA Sequence Number=SeqID_25427
MFSYCIIIVFKEKEIVKKQINPITHTSGTEFDKRQKRAIIVGLKKKLNPHRESHGNMRFEGRFQEGKSLAAHPVRNSIQDMIYIKRCGKVT

SEQ ID NO: 142206 - protein, 333 aa, Glycine max
  Coding DNA Sequence Number=SeqID_25428
  Gene Ontology: Mol. function=transcription regulator activity; Cellular component=nucleus; Biological process=regulation of transcription
  Homolog annotation: Hit_ID=Q52JK6; Match level="QueryCoverage=89%, HitCoverage=50%, E-value=1e-101, Identity=62%"; Hit description=VIP2
  Pfam annotation: Domain name=NOT2_3_5; Domain location=180-310; Score= 110.3; E_value=5.6e-30; Accession=PF04153.8; Description=NOT2  NOT3 NOT5 family
  Subcellular localization annotation: CTP_CleavageSite=58; ConfidenceScore=5.30e-01
MDMYQKEQLHDNTVSMMQSQHFSQMGRSAGFSLGGSYPSHRTQQQQQHAPSVSSNGVSFSSVNNQDLLHLHGTDIFPSSHSTYHSQTSGPPGIGLRPLTSPNTVSGMGSYDQLIQQYQQHQNQSQFRLQQMSAANQSFRDQGMKSMQTAQSSPDPFGALGLFSVVHISDPNLKYLAHGIDLTTLGLNLNSSENLYKTFRSPWSDEPAKGDPEFSVLQCYYVKQPPALHQACPKMKHNYTRQMNWWVIAGSYKRGWFYHKEHRLWFIRVPNMEPLVKTNTYERGSYHCFDPNTFETVRKASNGQPSCRIILFFIMKWWKRDRLCLNIEEGKRKP

SEQ ID NO: 142207 - protein, 545 aa, Glycine max
  Coding DNA Sequence Number=SeqID_25429
  Gene Ontology: Mol. function=calcium channel activity; Cellular component=integral to membrane; Biological process=calcium ion transport
  Homolog annotation: Hit_ID=Q1SHR1; Match level="QueryCoverage=99%, HitCoverage=99%, E-value=0.0, Identity=75%"; Hit description=Ankyrin
  Pfam annotation: Domain name=Ank; Domain location=132-164; Score =27.8; E_value=3.7e-05; Accession=PF00023.20; Description=Ankyrin repeat
  Pfam annotation: Domain name=Ank; Domain location=166-198; Score =30.4; E_value=6.5e-06; Accession=PF00023.20; Description=Ankyrin repeat
  Pfam annotation: Domain name=Ank; Domain location=200-233; Score =29.6; E_value=1.1e-05; Accession=PF00023.20; Description=Ankyrin repeat
  Pfam annotation: Domain name=Ank; Domain location=234-266; Score =32.8; E_value=1.2e-06; Accession=PF00023.20; Description=Ankyrin repeat
  Pfam annotation: Domain name=Ank; Domain location=24-58; Score=3.6; E_ value=9.4; Accession=PF00023.20; Description=Ankyrin repeat
  Pfam annotation: Domain name=Ank; Domain location=268-300; Score=2.9; E_value=12; Accession=PF00023.20; Description=Ankyrin repeat
  Pfam annotation: Domain name=Ank; Domain location=63-97; Score=22.3; E_value=0.0017; Accession=PF00023.20; Description=Ankyrin repeat
  Pfam annotation: Domain name=Ank; Domain location=98-130; Score=23.0; E_value=0.0011; Accession=PF00023.20; Description=Ankyrin repeat
  Pfam module annotation: Pfam domain module=Ank::Ank::Ank::Ank::Ank::An k::Ank::Ank; Domain location=132-164::166-198::200-233::234-266::24 -58::268-300::63-97::98-130
MATPAMQAVNTTRKKMTKQLTGKRDDTPLHSAARAGNLAVLKDTILETDEAELHELLAKQNQDGETPLYIAAEYGYVDVVREMIQYYDLADAGIKARNGFDALHIAAKQGDLDVLKILMEGHPELSMTVDPSNTTALHTAAIQGHTEIVKFLLEAGSSLATIARSNGKTALHSAARNGHLVVVKALLEKEPGVATRTDKKGQTALHMAVKGQNIEVVEELIKADPSSINMVDSKGNTALHIATRKGRAQIVKLLLEQKENVTSAVNRCGETAVDTAEKTGNHAVQAILLEHGVESARTIKPPQGTTATTARELKQTVSDIKHEVHHQLEHTRQTRKRVQGIAKRINKMHAEGLNNAINSTTVVAVLIATVAFAAIFTVPGQFVDDPNNIPAGMSLGEANIAPQATFIIFFVFDSIALFISLAVVVVQTSVVVIESKAKKQMMAVINKLMWLACVLISVAFLALSFVVVGKEEKWLAIGVTIIGTTIMATTLGTMCYWVIRHRIETSNLRSIRKSSLQSKSKSFSVSAFSDSELLNSEYYKKMYAI

SEQ ID NO: 142208 - protein, 194 aa, Glycine max
  Coding DNA Sequence Number=SeqID_25430
  Homolog annotation: Hit_ID=Q1SKD7; Match level="QueryCoverage=85%, HitCoverage=45%, E-value=3e-15, Identity=29%"; Hit description =Ankyrin
MVPTKLASKRSRKDKAAEGTSSAPEYDSHRFRSAEHQQCFEAIKGWSFLRDDEYTDFQEEIVRRRWASLVTPMAKFDPDIVLKFYANAWPTEEGVRDMRSWVRGQWIPFDADALSQFLGYPLVLEEGQECEYGQRRNQADGFDEEAIAQLLCIPGQDFARTAAGRRVRIMCTNMTTLTQIWMTFAAQQHPAQRS

SEQ ID NO: 142209 - protein, 140 aa, Glycine max
  Coding DNA Sequence Number=SeqID_25431
MTEGAEDNTLSLTDSERVFIRITTWVTIAEGGVVDKSEAFAPTYPPFMTTLASACQSNLGSPNDEVRITGRCFCLLPDSWVMIAKGGSRLEDADISEKGADDHIGFCVSIGLGTLGSQDNKKCVRVTVGCLRIPPDSWVM

SEQ ID NO: 142210 - protein, 175 aa, Glycine max
  Coding DNA Sequence Number=SeqID_25432
MNQKSAPVARVCGLCSSVDHHTDLCPSLQESGVNEQPEGYAANIYNRPSQQQNQQQQNNYDLSSNRYNPGWRNHPNLRWASPPQQQQPVLPFQNAAGPIKPYVPPPIQQQPQQRQQATEAPPQPSLEELVRQMTVQNMQCQQETRASIQSLTNQMGQMATQLNQAQSQNSDKLPS

SEQ ID NO: 142211 - protein, 321 aa, Glycine max
  Coding DNA Sequence Number=SeqID_25433
  Gene Ontology: Mol. function=binding
  Homolog annotation: Hit_ID=Q0K4M6; Match level="QueryCoverage=98%, HitCoverage=12%, E-value=7e-44, Identity=36%"; Hit description =Filamentous hemagglutinin / adhesin
MDLGVGTLTNREHALIYAAGDLRIGGALDGAGKATGQAALLSNESATIEAERNADIAAASIQNRNLHFTSETVEVSRGPKLYYRLENSTELLDGSKLWLCDSVTTACGRDPVTFLEDDSERRLLLPSDKYPESRYGPPFDYVRGVKGKEGRDAPIPPAYLPDPYVCGPGGDACNYEPGGPRYEAGDGVWRVFGVAEPVVVPALVEQKCNINQVCLVSTPEREQALALNKSRHDELAAKIYAFNADFNRRLVKNFFYYKVNEVVMESRTLSTDPARIVVGGQAKITGTVTNDKSRIVAGGTLTVEGPAINNIGAEGIRSIER

SEQ ID NO: 142212 - protein, 238 aa, Glycine max
  Coding DNA Sequence Number=SeqID_25434
  Gene Ontology: Mol. function=binding; Biological process=electron transport
  Homolog annotation: Hit_ID=Q8XYI3; Match level="QueryCoverage=86%, HitCoverage=23%, E-value=2e-41, Identity=33%"; Hit description =Probable hemagglutinin-related protein
MAGRIAIQVQLRPPTDLDGFASEMQVAILNAGCGDVCVALGFDGGRFVAQQCRLSRRLAGAVQRAADPQVACRIDQRMLAVGQRPHAQVHVATRGDDGVGLVLQQRRLDADAVAINASGVDQVAGGDAGVAAVDQASVGQQAADDQFVVAHGDQFTARAVGERIRRYLQVLARVDLAIVVQVVGHEFQRCSRGQRAARVGQAGESQRGLGIGRHVATRVPRACRWSAPGPVRRPMRPA

SEQ ID NO: 142213 - protein, 173 aa, Glycine max
  Coding DNA Sequence Number=SeqID_25435
LENEVRKLGELLVIDYQGRNGSLVIDYQIVMAAQLIHDRVEMECLEGAWETLEGNARCRFRGTIRFTTTSFVHPDEPVRTFQRTVEWILPTPIPYRLVEPVQVIEVTSSEEDPEEDLEELPLEPAGDALDFLEGDEDPLPEVDSPEEIMSASEADSTEDSGPREMATSGGSSS

SEQ ID NO: 142214 - protein, 619 aa, Glycine max
  Coding DNA Sequence Number=SeqID_25436
  Gene Ontology: Mol. function=transcription factor activity; Cellular component=intracellular; Biological process=regulation of transcription, DNA-dependent
  Homolog annotation: Hit_ID=Q5GQ86; Match level="QueryCoverage=53%, HitCoverage=99%, E-value=1e-142, Identity=75%"; Hit description =Sucrose operon repressor
  Pfam annotation: Domain name=Glyco_hydro_32N; Domain location=1-165; Score=-17.5; E_value=5.9e-12; Accession=PF00251.10; Description =Glycosyl hydrolases family 32 N termi
  Pfam annotation: Domain name=HHH; Domain location=283-312; Score =13.4; E_value=0.065; Accession=PF00633.13; Description=Helix-hairpin- helix motif
  Pfam annotation: Domain name=LacI; Domain location=290-315; Score =43.4; E_value=7.8e-10; Accession=PF00356.11; Description=Bacterial regulatory proteins, lacI f
  Pfam annotation: Domain name=Peripla_BP_1; Domain location=350-612; Score=-9.8; E_value=4.6e-06; Accession=PF00532.11; Description =Periplasmic binding proteins and sugar b
  Pfam module annotation: Pfam domain module=Glyco_hydro_32N::HHH::LacI: :Peripla_BP_1; Domain location=1-165::283-312::290-315::350-612
MVLGAQDQQKQGKVLLLRSADLREWHNLGEIAGSGLNGLAAASYMWECPDMFTLGDSTFLICCPQGIAQEDHRFLNAHPSAWLSGDLDYANARFSHGELHELDAGFEFYAPQTTLTADGRRLLVGWMGVPDGEEMLQPTVANGWIHQMTCVREMGTRDGRLFQRPVTELQALRSAEQHYQGPAADAPVIDAQRLELLLSGQGDITLNFADQLRLEWRADGLRLARRSLANGEWQFRYWRGAPLLPVASGAINPDRTRRSDGALLVVTAVHGRISHCFLNRCTDVRKTKRVTIADIAALAGVSKATASLVLNGRGKELRVAKETRERVLTLAREHHYQASIHARSLRDNRSHTLGLVVPEITNHGFAVFSHALENLCREAGLQLLISCTDENAGQERVVVDNLVARQVDGLIVASSMLSDSDYVKLSDQLPIVLFDRYVNDTQLPLVMTDSVTPTAELVERLARANPDEIYFLGGQPRLSPTKDRLAGFMQGLERAGVTPRPEWIIHGNYHPSSGYEMFAALCARLGRPPKAIFTAACGLLEGVLRYMSQHHLLHSDIRVASFDDHYLYDSLTLPIDTVEQDVPRLAQECFTLLTTMINGDDPISQHTVLPATLRLRFGR

SEQ ID NO: 142215 - protein, 128 aa, Glycine max
  Coding DNA Sequence Number=SeqID_25437
  Gene Ontology: Cellular component=membrane
  Homolog annotation: Hit_ID=Q1I8Z4; Match level="QueryCoverage=96%, HitCoverage=52%, E-value=9e-25, Identity=47%"; Hit description =Putative magnesium transporter, MgtC family
MGLLLEAGIGCVVILCANILLRELAQGINRQSIIIAEDASQYYKVQIICLAADEVQVRSLMLHSLGGSGLRLQSLHSEDLEPSHRMAVNAEVLGKPSLTDQLENLVSRISLEKGVSSVRWQVCEPETD

SEQ ID NO: 142216 - protein, 456 aa, Glycine max
  Coding DNA Sequence Number=SeqID_25438
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=P08470; Match level="QueryCoverage=99%, HitCoverage=100%, E-value=0.0, Identity=84%"; Hit description=PTS system sucrose-specific EIIBC component (EIIBC-Scr) (EII-Scr) [Includes: ...
  Homolog annotation: Hit description=Sucrose-specific phosphotransferas e enzyme IIB component (EC 2.7.1.69) (PTS system sucrose-specific EIIB component); Sucrose permease IIC component (PTS system sucrose -specific EIIC component)]
  Pfam annotation: Domain name=PTS_EIIB; Domain location=7-41; Score =70.5; E_value=5.6e-18; Accession=PF00367.11; Description =phosphotransferase system, EIIB
  Pfam annotation: Domain name=PTS_EIIC; Domain location=110-395; Score= 245.5; E_value=1.1e-70; Accession=PF02378.9; Description =Phosphotransferase system, EIIC
  Pfam module annotation: Pfam domain module=PTS_EIIB::PTS_EIIC; Domain location=7-41::110-395
MDFVTLSRSLLPLLGGRENIASAAHCATRLRLVLVDDAKADTAAIGKLEGVKGCFRNAGQLQVIFGTGVVNKVYAAFIREAGISETSKSKAADIAARKLNPFQRIARLLSNIFVPIIPAIVASGLLMGLLGMVKTYGWVNPDNALYIMLDMCSSAAFIILPILIGFTAAREFGGNPFLGATLGGILTHPALTNAWGVAAGFHTMNFFGIEVAMIGYQGTVFPVLLAVWFMSVLEKQLRRVIPDALDLILTPFLTVIIAGFVALLVIGPAGRMLGDGISFVLSTLIAHAGWLAGLVFGGLYSVIVITGVHHSFHAIEAGLLGNPAIGVNFLLPIWAMANVAQGGACLAVWFKTKDVKIKAISLPSGFSALLGITEAAIFGINLRFMKPFIAGLIGGALGGAWVVSVHVYMTAVGLTGLPGMAIVQASSLLNYAIGMVIAFSSAFVISYLLKYKTDAE

SEQ ID NO: 142217 - protein, 267 aa, Glycine max
  Coding DNA Sequence Number=SeqID_25439
  Gene Ontology: Mol. function=2 iron, 2 sulfur cluster binding; Cellular component=peroxisome; Biological process=purine ribonucleoside salvage
  Homolog annotation: Hit_ID=P77165; Match level="QueryCoverage=68%, HitCoverage=79%, E-value=5e-76, Identity=74%"; Hit description =Putative xanthine dehydrogenase yagT iron-sulfur-binding subunit
  Pfam annotation: Domain name=Fer2; Domain location=103-163; Score =54.1; E_value=4.6e-13; Accession=PF00111.17; Description=2Fe-2S iron- sulfur cluster binding domain
  Pfam annotation: Domain name=Fer2_2; Domain location=171-260; Score =145.1; E_value=1.8e-40; Accession=PF01799.10; Description=[2Fe-2S] binding domain
  Pfam module annotation: Pfam domain module=Fer2::Fer2_2; Domain location=103-163::171-260
MNAGICHREQSDRLQTCPLLGSVSPCRMVVCVLTSMLKVFQNLIKIGVIEISFRHLSGGKGMSNPRDEKTQRYSPQQEETERARLTACAGSAAPAPVTVPVTLQVNGEPQQLNVDTRTTLLDALREHLHLTGTKKGCDHGQCGACTVLVNGRRINACLTLAVMQQDAEVTTIEGVGTPEDLHPLQSAFIRHDGYQCGYCTPGQICSSLAVLQEIAAGIPSHVTGDLTAAPALSDDEIRERMSGNICRCGAYANILAAIEEYAGGQKA

SEQ ID NO: 142218 - protein, 190 aa, Glycine max
  Coding DNA Sequence Number=SeqID_25440
  Gene Ontology: Mol. function=xanthine dehydrogenase activity; Cellular component=membrane; Biological process=purine ribonucleoside salvage
  Homolog annotation: Hit_ID=P77324; Match level="QueryCoverage=98%, HitCoverage=58%, E-value=3e-86, Identity=83%"; Hit description =Putative xanthine dehydrogenase yagS FAD-binding subunit
  Pfam annotation: Domain name=FAD_binding_5; Domain location=1-190; Score=251.2; E_value=2.2e-72; Accession=PF00941.11; Description=FAD binding domain in molybdopterin dehydrogenase
MQHPGARFIAGGTNLLDLMKLEIETPSHLIDVNGLALDSIEPTAGGGLRIGALVRNTDLAADARIRRDYAVLTRALVAGASGQLRNQATTAGNLLQRTRCPYFYDVNQPCNKRQPGTGCAAREGFSRQHAVVGVSEACIATHPSDMAVAMRLLDAVIETVSPDGSQRAIPIAEFYCAPGDTPHIETVLQP

SEQ ID NO: 142219 - protein, 276 aa, Glycine max
  Coding DNA Sequence Number=SeqID_25441
  Gene Ontology: Mol. function=protein binding
  Homolog annotation: Hit_ID=P37348; Match level="QueryCoverage=61%, HitCoverage=62%, E-value=2e-73, Identity=76%"; Hit description =Hypothetical protein yecE
  Pfam annotation: Domain name=DUF72; Domain location=1-162; Score =32.1; E_value=5.7e-09; Accession=PF01904.8; Description=Protein of unknown function DUF72
MSPLANRIGQYWLQLPATFAPRDLPALWQFLNALPRDFTYGVEVRHPQFFAKGEAEKALNRGLLERSVNRVILDSRPVHSAIPHSEAIVDAQRKKPKVPVHAIVTAQNPMVRFIGSDNMQQNQAMFAVWLQTLAKWEQTTTPYLFLHTPDIAQAPELVDALWQALQAAVPTQYRVSYGDGGFSELQSAIRIHGNAVEYIPAGLILLLFMEMNGAETWMVHICGLLLIAGRLMHYYGFHHRLFRWRRSGMSATWCSLLLMVLANLWYMPWELVFSLH

SEQ ID NO: 142220 - protein, 74 aa, Glycine max
  Coding DNA Sequence Number=SeqID_25442
  Gene Ontology: Mol. function=catalytic activity; Biological process =metabolic process
  Homolog annotation: Hit_ID=Q1SI48; Match level="QueryCoverage=80%, HitCoverage=14%, E-value=1e-19, Identity=83%"; Hit description=AMP -dependent synthetase and ligase
MLKSESEPWSWCKMWYLWCQFCRMDYEHAGVGAIEFIICHSEVSIALAEEKKIPELFKTFPNATKYLKRSNSEL

SEQ ID NO: 142221 - protein, 93 aa, Glycine max
  Coding DNA Sequence Number=SeqID_25443
MVGYTPSSFTDLVFASKKIEVDLKRGKFNHPAWMNEKIGANKEGEDEGETHVVTTIPDSPQIPVSYANLLPYLLDNAMVAITPARFPQPPFFR

SEQ ID NO: 142222 - protein, 335 aa, Glycine max
  Coding DNA Sequence Number=SeqID_25444
  Gene Ontology: Mol. function=transporter activity; Cellular component= integral to membrane; Biological process=transport
  Homolog annotation: Hit_ID=UPI00006DBC1B; Match level="QueryCoverage =92%, HitCoverage=77%, E-value=1e-116, Identity=70%"; Hit description= COG0477: Permeases of the major facilitator superfamily
  Pfam annotation: Domain name=MFS_1; Domain location=2-303; Score =25.3; E_value=2.2e-05; Accession=PF07690.6; Description=Major Facilitator Superfamily
FVATVLTRGYAGQLTDRVGGKRSALQGAAVCALAGVLYWLAALPGFSPAVSLALVIAGRLAAGMGESQFVTGCVAWSIASVGPQRAGLSMSWTGIAMFAALSLGAPAGMMLYQHVGLAAAMLACIAAPLLAALIATAASGYRAVGGTRLPFYRVIGRIWREGCGLMLQGVGLAGLTAFASLYFAARHWQLAGWVMTAFGVGFIAVRLVLGHLPDRIGGYRVAAYSLLVEALGQMLLWFAPDETLALTGALITGLGCALIFPALGVEALKRVPPASRGSAMGAFVAFLDIAYGISGPIAGAIASHFSYAAVYLFGAACALLGALLALTSRAASLHA

SEQ ID NO: 142223 - protein, 209 aa, Glycine max
  Coding DNA Sequence Number=SeqID_25445
  Homolog annotation: Hit_ID=UPI0000D9B3B9; Match level="QueryCoverage =98%, HitCoverage=75%, E-value=2e-08, Identity=25%"; Hit description =PREDICTED: similar to splicing factor 3a, subunit 2
  Subcellular localization annotation: CTP_CleavageSite=9; ConfidenceScore=5.31e-01
MNLLPSVVHASSTNESGAPRIDCLALFANSPFSTFIRSPMNSLHSAVHVSYTFESGAPRIDCLALFANSPFSTFFRSPMNSLPSAVHVSSTFESGAPRIDCLALFANSPFSTFIRSPMNSLPSAVHASSTNESGGSRIDCLTLFASSPFSTFILSPMNSLPSAVHASSTIESGGLRIDCLALFPCFPFSTFIRSPMNLLPSAVHASSTN

SEQ ID NO: 142224 - protein, 139 aa, Glycine max
  Coding DNA Sequence Number=SeqID_25446
  Gene Ontology: Mol. function=protein binding; Cellular component =integral to membrane; Biological process=xylan catabolic process
  Homolog annotation: Hit_ID=Q1SWI7; Match level="QueryCoverage=82%, HitCoverage=18%, E-value=7e-43, Identity=70%"; Hit description =Leucine-rich repeat
  Pfam annotation: Domain name=LRR_1; Domain location=27-48; Score=8.6; E_value=7.1; Accession=PF00560.23; Description=Leucine Rich Repeat
  Pfam annotation: Domain name=LRR_1; Domain location=3-25; Score=16.6; E_value=0.091; Accession=PF00560.23; Description=Leucine Rich Repeat
  Pfam module annotation: Pfam domain module=LRR_1::LRR_1; Domain location=27-48::3-25
MGSLQSIDFSRNQLSGEIPPTIANLSFLSMLDLSYNHLKGKIPTGTQLQTFDASSFISNNLCGPPLPINCSSNGKTHSYEGSDGHGVNWFFVSMTIGFIVGFWIVIAPLLICRSWRGRVAERKEGKDRRCGEMELRITK

SEQ ID NO: 142225 - protein, 269 aa, Glycine max
  Coding DNA Sequence Number=SeqID_25447
  Gene Ontology: Mol. function=bile acid:sodium symporter activity; Cellular component=membrane; Biological process=sodium ion transport
  Homolog annotation: Hit_ID=Q8ZKL0; Match level="QueryCoverage=98%, HitCoverage=85%, E-value=1e-115, Identity=79%"; Hit description =Putative Na+-dependent transporter
  Pfam annotation: Domain name=SBF; Domain location=1-177; Score=138.4; E_value=1.9e-38; Accession=PF01758.7; Description=Sodium Bile acid symporter family
MLIMFGMGVTLNIDDFKRVLVRPAPVIAGTFLHYLVMPLAAWALAKLFQMPPDLAAGMILVGSVASGTASNVMIYLAKGDVALSVTISSVSALVGVFATPLLTRFYVDTHIQVDVVGMLLSIVKIVVIPIGLGLIIHHSMNSVVRRVEPYLPAFSMVCILLIISAVVAGSQGFIGSVGLMVIAAVILHNAIGLLGGYWGGKLFGFDESTCRTLALEVGMQNSGLAATLGKLYFSPLAALPGALFSVWHNLSGSLLAGYWSGKTIEKKQK

SEQ ID NO: 142226 - protein, 86 aa, Glycine max
  Coding DNA Sequence Number=SeqID_25448
  Gene Ontology: Cellular component=integral to membrane
  Homolog annotation: Hit_ID=P67143; Match level="QueryCoverage=78%, HitCoverage=34%, E-value=9e-25, Identity=82%"; Hit description =UPF0056 inner membrane protein yhgN
MLIALILMLLFLFADQHQRPARRRRAVPGAAGDPAGRRALTARHPDAAVTSVSQPDDAPGRCPADCLGRHGGDSADVRRVPAPAGG

SEQ ID NO: 142227 - protein, 156 aa, Glycine max
  Coding DNA Sequence Number=SeqID_25449
  Gene Ontology: Mol. function=nucleoside-triphosphatase activity; Cellular component=integral to membrane; Biological process=transport
  Homolog annotation: Hit_ID=Q2PCF1; Match level="QueryCoverage=92%, HitCoverage=9%, E-value=5e-54, Identity=68%"; Hit description =Pleiotropic drug resistance protein 2
  Pfam annotation: Domain name=ABC2_membrane; Domain location=1-155; Score=18.5; E_value=0.00029; Accession=PF01061.14; Description=ABC-2 type transporter
MSVGTVEDGMKFFGAMFFSIMNIMFNGFSEQAMLVSRLPVFYKQRDFMFYPAWAFGLPIWVLRIPISLVESGIWVVFTYYTIGFAPSASRFFKQFLALFGVHQMAISLFRLVGAVGRTYVVANILSGLTFQIVLVLGGFIVSKSETSFISNLLEIF

SEQ ID NO: 142228 - protein, 44 aa, Glycine max
  Coding DNA Sequence Number=SeqID_25450
MVPFDFWHVTELHGLPNDGCQQQAKLEPSDSGVPSSLEISDTIV

SEQ ID NO: 142229 - protein, 85 aa, Glycine max
  Coding DNA Sequence Number=SeqID_25451
  Gene Ontology: Mol. function=oxidoreductase activity; Cellular component=membrane; Biological process=electron transport
  Homolog annotation: Hit_ID=Q2QYH7; Match level="QueryCoverage=97%, HitCoverage=15%, E-value=2e-14, Identity=47%"; Hit description =Cytochrome P450 family protein, expressed
MFIQESLRLYGPGVTTAREVLAEMKLGEHVLLKGIKMWLYLPAILQRDTDNWGPDAREFKLERLAGGVSAACKYPQAYIPFGLGS

SEQ ID NO: 142230 - protein, 84 aa, Glycine max
  Coding DNA Sequence Number=SeqID_25452
  Gene Ontology: Mol. function=serine-type endopeptidase activity; Cellular component=mitochondrion; Biological process=proteolysis
  Homolog annotation: Hit_ID=Q9XKK8; Match level="QueryCoverage=68%, HitCoverage=26%, E-value=2e-20, Identity=84%"; Hit description=LON protease homologue
  Pfam annotation: Domain name=Lon_C; Domain location=1-84; Score= -131.7; E_value=0.00042; Accession=PF05362.3; Description=Lon protease (S16) C-terminal proteolytic domain
PPRFDGREAAEHVATPGVTVGLVWAAFGGEVQFVEATAIVEKGELHLTGQLGDIKESAYPVRDQSGKVSAAELVQAVNEILSAA

SEQ ID NO: 142231 - protein, 1255 aa, Glycine max
  Coding DNA Sequence Number=SeqID_25453
  Gene Ontology: Mol. function=RNA-directed DNA polymerase activity; Cellular component=chromatin; Biological process=chromatin assembly or disassembly
  Pfam annotation: Domain name=Chromo; Domain location=1154-1214; Score= 22.1; E_value=0.002; Accession=PF00385.14; Description='chromo' (CHRromatin Organisation MOdifier
  Pfam annotation: Domain name=RVP; Domain location=340-444; Score= -8.9; E_value=0.029; Accession=PF00077.10; Description=Retroviral aspartyl protease
  Pfam annotation: Domain name=RVP_2; Domain location=325-458; Score= -32.5; E_value=0.00034; Accession=PF08284.2; Description=Retroviral aspartyl protease
  Pfam annotation: Domain name=rve; Domain location=1029-1172; Score =14.9; E_value=0.00034; Accession=PF00665.16; Description=Integrase core domain
  Pfam annotation: Domain name=zf-H2C2; Domain location=970-1011; Score= 5.8; E_value=0.062; Accession=PF09337.1; Description=His(2)-Cys(2) zinc finger
  Pfam module annotation: Pfam domain module=Chromo::RVP::RVP_2::RVT _1::Retrotrans_gag::rve::zf-H2C2; Domain location=1154-1214::340 -444::325-458::533-719::95-185::1029-1172::970-1011
MAEHGTRRTTTDRLEEAIAALSERHSDLANKVEAMCERLSQFTTPTPLATQPSYPSRPPVKLDVPRFDGHDPLGWIFKISQFFEYQGTPEEERITVASFYLDGPALSWFQWMFRNGFIMSWPALLQAIETRFAPSFYDDPRGTLFKLVQRSFVTEYLTEFKKLANQITGLSPSVLLSCFISDLSPEIQREVQAFQPISLPQATSLAQLQEDKINYRRKHYSRPPPSLPPSQTSFPLTHNNQPPKHKPPFIQRTQEDMAYRREKGLCYNCDEKWSSSHRCKGRVLFLIADSEEPLPSGVTLDDLPQTNPPELHPDSLEPKSTFDPSTLQPHVSLHAMAGVPATDTFRLYGFINKKHVTILIDSGSTHNFIQPRVAKFLNLPVKDTLPLMVMVGNGSVMTCSQLCSDTKLLIQDHTFTVTLRILPLSEAEVVLGVEWLQTLGSVITNYASFTMQFSYSGNSINLHADVQSDSNLASANQPSSLPPSRQHDHHINLLPTANPINVRPYRYPHFQKTKIERQVSSLLDVGLIRPSRSSFSSPVLLVKKKDGTWRMCIDYRALNAITVRDRFPLPTIDELLDELGRALWFSKLDLWQGFHQILMAEEDTPKTAFRTHHGHYEYRVMPFGLCNAPSMFQAAMNNLLSPFLRKFATVFFYDILIYSEIFSDHLHHLECVFNSLLQAHYYLKQSNGVRPDPTKIQAIVKWITPRSPKDLCTFLGLVGFYIKFVQGYAAITASLTKLLCKNAFQWSSESQTAFKRLKVVLTAALILALPDFSIPFILETDASSTAMGAVLQEHGHPIAYFSKSFCQRLQHASAYVRELHAIVAAVRKWRQYLLGHKFTIFTDHRSLRELMSQVVQTSEQQFYLAKLLGYDYEIQYKVGSSNIVTDSLSRRDNHPPGQYLILSAPHSEFMVQLKATLLASLEFQKQQEAIRSQPNAYPEFSISDNFIIFKGAIWVDSQNPFIPSLLHEYHATPIGGHFGVKKTMHRLQSNFRWHNMLEDVKTVVRRCAICQQVKHITRKNAGLLQPIPIPTGIWEDISMDFVTHLPASHGFTAVMVVVDHFSKSVHFGALPTQFTAFKVATLFMDTVCKLHGFPRNIISDRDPIFISSFWRELFKMTGTTLHEVVYGKPPPSLSKYLRGSSRNDAVDAILSTCEEIHAILQRKLLKAQEAMKHFADQKRPPTRLVLVQWVGLAPEDSTWEKWTDVCNAHHLEDKVIFPGANNVSSSSERGASSPATHEERPRRNITRPRYLEEYV

SEQ ID NO: 142232 - protein, 84 aa, Glycine max
  Coding DNA Sequence Number=SeqID_25454
MIDVVILGALGFTGKQVLKEALKFFNPNNFTFLAIAAQQVEAYLGLESKKRIVGNFETFESAIMAVKDLKEMELSRVTRVSPKL

SEQ ID NO: 142233 - protein, 140 aa, Glycine max
  Coding DNA Sequence Number=SeqID_25455
  Gene Ontology: Mol. function=galactosylgalactosylxylosylprotein 3 -beta-glucuronosyltransferase activity; Cellular component=membrane
  Homolog annotation: Hit_ID=Q4VZ79; Match level="QueryCoverage=85%, HitCoverage=29%, E-value=1e-21, Identity=47%"; Hit description =Glycosyltransferase
MKTLLFLSPVSIISATEQSPLLSLDSLDYAVHLHHLHGRIQISCHPSTMRLATVVAVQFTAGEAGGEVEEEDEAREAKAENQVDEAADTVDYQPENHCRRLHSAVARRIQLRQSSEAVPLAREVSLLQHRELHFLVQKCA

SEQ ID NO: 142234 - protein, 67 aa, Glycine max
  Coding DNA Sequence Number=SeqID_25456
  Gene Ontology: Mol. function=electron carrier activity; Biological process=electron transport
  Homolog annotation: Hit_ID=Q2HWC7; Match level="QueryCoverage=58%, HitCoverage=21%, E-value=4e-11, Identity=72%"; Hit description=Blue (Type 1) copper domain
MENWRGARMMVVASAVAMGWLSVVAMGSPVLHKVGGSKGWINQDVNYTEWSAQEHIYVGDWLRLSKV

SEQ ID NO: 142235 - protein, 86 aa, Glycine max
  Coding DNA Sequence Number=SeqID_25457
  Gene Ontology: Mol. function=hydrolase activity, acting on ester bonds; Cellular component=anchored to membrane
  Homolog annotation: Hit_ID=Q2R3Y3; Match level="QueryCoverage=68%, HitCoverage=78%, E-value=3e-12, Identity=51%"; Hit description =Expressed protein
MDFNSEDEDIVEREEDERVDENGFAVGLHATELKLLPVPRKGEKQPWLKQHEQNHPDQHWKMQRKGWYGRVWKQEKKGGRRIRTML

SEQ ID NO: 142236 - protein, 437 aa, Glycine max
  Coding DNA Sequence Number=SeqID_25458
MYFVDLGQYISPLSSKPTYGRKRLFNVEAPKHGQVSFGIESGGLDKIWTSVVWAASVKLSGVDILLVLQARSDMSAHAQHSYIRITRGVGMYWRHDVWVSGVALCHHHFEFLSSSSRNLFAFMLASCNSLSSSFAFFDTSRPSSENTDHGASDDKSSSSKRKPIPVIVILPPFVSGEARKSGGDVRDDVMVYKSFFTSAASVTALQRQVKLTNLEDSYKIVIHASESDDFPFLMVTSSNLPFFFMYRFLFEILGLVLELKNFFHLDVVFGSFVQLVHATRIADLNGNVSKPIHEFSDRFIIYLSQAGNPPYQDNVAPLRDAGKTRHMIASSLVYILSWVRKTSKGSSESVVPSYRFRTVHVGETWIILSVNYASRPSQLLLMGLLHLCDEVLELLESINIWHDNCKRIGAFKWGLVSKGAKCTFQNLEFDARQGERG

SEQ ID NO: 142237 - protein, 387 aa, Glycine max
  Coding DNA Sequence Number=SeqID_25459
  Gene Ontology: Mol. function=sequence-specific DNA binding; Cellular component=nucleus; Biological process=regulation of transcription
  Homolog annotation: Hit_ID=Q7XAA5; Match level="QueryCoverage=83%, HitCoverage=36%, E-value=1e-116, Identity=57%"; Hit description =WRKY11
  Subcellular localization annotation: CTP_CleavageSite=55; ConfidenceScore=5.93e-01
MASSSSSSSIQCSVWVPSLLNTNTNTNTIHFLSLKPNSITFSSSFSSSLTRIRIRASSSSPTVEEAAMSIDNLRRFINLNSGKWNGSFYQFDSSGNMLQQLSTKLSASSYGEDELMSLIQTLYIKQPSSSTSISGDDNDAEWAEYKIKETNMFTVDKYQQIGFFPSEKAFALRYQTAGMLETVLRQGVLGEDDTGEESPRNLKLPSRRPSVVCENCLYSLERDMRARAFHILEPRGTVDMLIVFLEERSDGAPPLLESSRDVKSRIIPFLGKWKGHSITKRSGVYGSTITNADTVVLHEMDNNGQLIQDVTSSSTSDGENVTTNVHWTGTVSDHLVTFDGGYQMILLPGGMYMGCPCDVAKSVAESKSFHLEFCWLETPDKRQRLVR

SEQ ID NO: 142238 - protein, 42 aa, Glycine max
  Coding DNA Sequence Number=SeqID_25460
MERNENERWRGYKCERITKPFEFTQFKNHVIGTIFGTSIMML

SEQ ID NO: 142239 - protein, 43 aa, Glycine max
  Coding DNA Sequence Number=SeqID_25461
MALGISEGREMQKWCTVAGGDIFGREIGLTTVRHVGVQGLVCI

SEQ ID NO: 142240 - protein, 81 aa, Glycine max
  Coding DNA Sequence Number=SeqID_25462
MVRTRGLGRALGRVIGRALGRQDDHHVDDVTQRHRPIASTRRQREAAPIVENVLEMTNDVPAPGAEGLAGDGVEGSTADDA

SEQ ID NO: 142241 - protein, 392 aa, Glycine max
  Coding DNA Sequence Number=SeqID_25463
  Gene Ontology: Mol. function=transcription factor activity; Cellular component=nucleus; Biological process=regulation of transcription, DNA-dependent
  Homolog annotation: Hit_ID=Q1T6R1; Match level="QueryCoverage=99%, HitCoverage=100%, E-value=8e-90, Identity=46%"; Hit description =Pathogenesis-related transcriptional factor and ERF
  Pfam annotation: Domain name=AP2; Domain location=40-104; Score =119.6; E_value=8.8e-33; Accession=PF00847.10; Description=AP2 domain
MARKRKVVEVVEEGELCEGTLGWDEMMKQAAALGGVQRARKRFVGVRQRPSGRWVAEIKDTIQKIRVWLGTFDTAEEAARAYDEAACLLHGANMRTNFWPCSQSSTSPALSSKITNLLLQRLKERNNNNNNACSSSSSSSTSLLINHQQMQHHQQVDAYGEGSTQFSIDQFTDFLNDPEDYSTSNNDFINNTAQIDYITSSFESCLTKKDGGTKMDMQLQYKSSNVTPQTSSNDSNSGVVESEEEGNDLGVQSTNLDVHDFRFLDNIVPPSYYSPFEMAEEMEEEPVEPENENYDDEPSMLRALKLESGNMKGRVLADQLTSLQMACSKNKLEKNKEEKEFMATMDRKKEQEHQHASPDMDSSSVDGELLLWNSLDLPPICFVNLLENGSFN

SEQ ID NO: 142242 - protein, 76 aa, Glycine max
  Coding DNA Sequence Number=SeqID_25464
  Subcellular localization annotation: CTP_CleavageSite=37; ConfidenceScore=5.07e-01
MLKCIASVHVATNQDHHPITHHQNKGCTIKVNNRAPSSKQKKTDSTFAPKQQRMNPKLNNNNNNNNNKKSNNREIR

SEQ ID NO: 142243 - protein, 546 aa, Glycine max
  Coding DNA Sequence Number=SeqID_25465
  Gene Ontology: Mol. function=nucleic acid binding; Cellular component= nucleus; Biological process=metabolic process
  Homolog annotation: Hit_ID=Q9FJY9; Match level="QueryCoverage=83%, HitCoverage=92%, E-value=1e-110, Identity=36%"; Hit description =Similarity to selenium-binding protein
  Pfam annotation: Domain name=PPR; Domain location=181-215; Score =30.8; E_value=4.9e-06; Accession=PF01535.11; Description=PPR repeat
  Pfam annotation: Domain name=PPR; Domain location=250-283; Score =11.5; E_value=0.33; Accession=PF01535.11; Description=PPR repeat
  Pfam annotation: Domain name=PPR; Domain location=351-385; Score =43.0; E_value=9.9e-10; Accession=PF01535.11; Description=PPR repeat
  Pfam annotation: Domain name=PPR; Domain location=388-422; Score=9.8; E_value=0.51; Accession=PF01535.11; Description=PPR repeat
  Pfam annotation: Domain name=PPR; Domain location=424-458; Score =13.1; E_value=0.21; Accession=PF01535.11; Description=PPR repeat
  Pfam annotation: Domain name=PPR; Domain location=76-109; Score=3.8; E_value=2.6; Accession=PF01535.11; Description=PPR repeat
  Pfam module annotation: Pfam domain module=PPR::PPR::PPR::PPR::PPR::PP R; Domain location=181-215::250-283::351-385::388-422::424-458::76-109
MVDLSPFACEKDFDDGGNMCHGGLNHASRWTQFGFYLKQKTSKTSNLNYVPYLIDILNHSFTNSSLSHVHFPSDISQTNSLIASYVRRGDPVSALTLFHSLRRRAHSDVVADAYTFTSILRASSLLRVSGQFGTQVHAQMLKTGADSGTVAKTALLDMYSKCGSLDEATKVFDEMRHRDVVAWNALLSCFLRCDLPVEAVGVLREMGRENVELSEFTLCSALKSCALLKALELGRQVHGLVVCMGRDLVVLSTALVDFYTSVGCVDDALKVFYSLKGVGRYDEAFRVMGFVRPNAVALTSALGGVALRIWICGQASRFIVLCNALLDMYAKCGRISQALSVFHGICEKDVISWTCMIDAYGRNGQGREAVEVFREMREVGSKVLPNSVTFLSVLSASGHSGLVEEGKNCFKLLREKYGLQPDPEHYACYIDILGRAGNIEEVWYAYHNMVVQGTRPTAGVWVALLNACSLNQDVERSELAAKHLLQLEPNKASNIVLVSNFYAAIDRWDCVEELRSIMRTKGLAKEAGNSWINVPGFNRHAISLSA

SEQ ID NO: 142244 - protein, 590 aa, Glycine max
  Coding DNA Sequence Number=SeqID_25466
  Gene Ontology: Mol. function=hydrolase activity; Cellular component =extracellular space; Biological process=biological_process
  Homolog annotation: Hit_ID=Q1RZZ0; Match level="QueryCoverage=90%, HitCoverage=84%, E-value=0.0, Identity=82%"; Hit description =Metallophosphoesterase; Purple acid phosphatase, N-terminal
  Pfam annotation: Domain name=Metallophos; Domain location=227-441; Score=61.8; E_value=2.2e-15; Accession=PF00149.18; Description =Calcineurin-like phosphoesterase
MKICTTFCVSLATVLVMMSNIVMAVAETHIPTTLDGPFDPVTRRFDPSLRRGSDDLPMTHPRLRKNVTSNFPEQIALAISSPTSMWVSWVTGDAQIGLNVTPVDPASVGSEVWYGKKSGKYTSVGKGDSVVYSQLYPFEGLWNYTSGIIHHVKLKEHCDVVYWRYKVDLMVGKGSLRVKGEGGERKVAGLEPGTRYYYKCGDSSIPAMSQEHYFETFPKPSPNNYPARIAVIGDLGLTSNSTSTIDHLNYNDPSMILMVGDLTYANQYLTTGGKGASCYSCAFPDAPIRETYQPRWDGWGRFMEPLTSEIPMMVIEGNHEIEPQAGGITFKSYLTRFAVPAEESGSKSNFYYSFDAGGIHFIMLGAYVDYNSTGAQFAWLKKDLQSVDRSVTPWLVAAWHSPWYNSYASHYQEFECMRLEMEELLFRYRVDIVFDGHVHAYERMNRVFNYTLDPCGPVYITVGDGGNIEKVDVDHADDPGKCPSAGDNIPEFGGVCKSNFSTGPAKGNFCWNKQPEWSAFRESSFGHGILEVNLSIQCIILSGACFNIVRMFTQCLVVVCNLIRKSFACCISLVHWYMESIRTIHPVRCK

SEQ ID NO: 142245 - protein, 211 aa, Glycine max
  Coding DNA Sequence Number=SeqID_25467
  Gene Ontology: Mol. function=transferase activity, transferring glycosyl groups; Cellular component=chloroplast; Biological process =biosynthetic process
  Homolog annotation: Hit_ID=Q6DW76; Match level="QueryCoverage=98%, HitCoverage=32%, E-value=1e-103, Identity=77%"; Hit description =Digalactosyldiacylglycerol synthase 1, chloroplast precursor
MVLVLRLSAATQDLPKSVICNVHGVNPEFLKIGEKIAAERELGQKAFTKGAYFLGKMVWGKGYKELIDLLAKHKADLDGFKLDVFGNGEDANEVQSAARRLDLNLNFQKGRDHADDSLHGTSKDFVAKVKEALENEPYPLTPEQRYQLSWEAATQRFMEYSELDRILNMENNGEKESVDKGKLIAKSASMPNLTELVDGGLAFAHYCLIGN

SEQ ID NO: 142246 - protein, 410 aa, Glycine max
  Coding DNA Sequence Number=SeqID_25468
  Subcellular localization annotation: CTP_CleavageSite=40; ConfidenceScore=5.25e-01
MQMQMQQTQQQATATPFSTCTPPPSSGGSASEAPPKQVAQAMDKLGQAERIIADIRIGADRLLEALFVAAAQPHQGNKPLQVFLKEDACMRQYLQDLRSLGKELEESGVLSESVRSRKDFWGLHMPLVCPDGAVVAYAWKRQLAGQAGASAVDRTRLALKAFTDQKRRFFPHLDDGLETSESASKKCCGSEEIAVDPKEGISFLRTLPDVLKSLEKDVPNLKILTFERLDWLKRASTLTSSTNENSLEHNYHGSNKLRLGSVGTVPAEKVAVIELLFPCVFRAVISLHPAGSMDPDAVAFFAPDEEYAATALQYFLGNQSETCLYFLLLPDTVFKTLQVPLALSRTLNFPITCKCSRLLAMDKQSTLLLPPVHRPYWQFSFSKILLNISSKDQNSDTTQAYHIDCLSEET

SEQ ID NO: 142247 - protein, 97 aa, Glycine max
  Coding DNA Sequence Number=SeqID_25469
  Gene Ontology: Mol. function=hydrolase activity
  Homolog annotation: Hit_ID=Q1RZZ0; Match level="QueryCoverage=85%, HitCoverage=13%, E-value=6e-27, Identity=74%"; Hit description =Metallophosphoesterase; Purple acid phosphatase, N-terminal
MLCTNNVVNSTYALWTWHRNQDNYKENAVGDQIYIVRQPELCMKDLKDPHQSLPYNSSTKSSSAINHLSQDVSIIISQILGVLFIYGLLSQEIRIHA

SEQ ID NO: 142248 - protein, 404 aa, Glycine max
  Coding DNA Sequence Number=SeqID_25470
  Gene Ontology: Mol. function=peptidase activity; Cellular component =nucleus; Biological process=regulation of transcription, DNA -dependent
  Homolog annotation: Hit_ID=Q1XTG5; Match level="QueryCoverage=98%, HitCoverage=70%, E-value=1e-125, Identity=49%"; Hit description =Protease with the C-terminal PDZ domain-like precursor
  Pfam annotation: Domain name=Peptidase_M61; Domain location=218-330; Score=29.0; E_value=1.5e-07; Accession=PF05299.2; Description=M61 glycyl aminopeptidase
MEFPKMKSGNVKFHFPKTVPGTYSVDDYGRFIEGFDDELNTEKHKAVFSPSGTDIEAGKVYLINTHGFIGYIDDMQDVPYQLVIQKPADFYGTTALVDQDKSEATDTFTLANYAKVTDSPLMYTKPDYITFNAGGMDLVLGVYSPTGKYKAADFKTNLEKMVVAQKKFLGDMNTNKKYAIMLYLSGGEGPQIKGFGALEHHESTSVVLPEAMPKEAIDQTITDVVSHEFFHTVNPLKTHSEEIHYFNYADPKMSQHLWMYEGGTEYFANLFQIQEGLINKDEFLKRIGEKITNSKNYDDTMPFTVMSKNVLVEPYKDQYRNVYEKGALLAMCMDIELRKLSNGEMGYRDMIRKLSQRFGENKPFKDDKLIDELVTVTGYPQVKDFYNKYIAGNQPTPYADYLNQ

SEQ ID NO: 142249 - protein, 96 aa, Glycine max
  Coding DNA Sequence Number=SeqID_25471
MASSDHTILHDRVHIPTNKSLLEISSQDALLAQNKLLSKQLEALTETLSCTLCGGAHGSGSCIPTEETSHEVNYMGNQPRQNFNVGGFSGFQHGQP

SEQ ID NO: 142250 - protein, 106 aa, Glycine max
  Coding DNA Sequence Number=SeqID_25472
MEVMKDQMTSMMEAMLSMKQMMENNAAAVATTSVAAEVDLTHPSAINQASQPIPDMWYASAQCRGGSITPPTAASALLSRETASGHGRKGEVRSHRGEAKGHLRDW

SEQ ID NO: 142251 - protein, 164 aa, Glycine max
  Coding DNA Sequence Number=SeqID_25473
MGGVAKKKRDKEFRGSNNGPIGGYREWLKAHVQGLDWLPSLSATKRDEDEAPEEDEGVQAFRTELKQAQSFLEPHELRFRSMCPPPSSLEPCVVICLVQLSILNLFRSPMNCVFVHVSSTFEFGAMHSDFLVQFSILNLFRSPMNCVFVHVSSTHEFGACVVIA

SEQ ID NO: 142252 - protein, 278 aa, Glycine max
  Coding DNA Sequence Number=SeqID_25474
  Gene Ontology: Mol. function=protein serine/threonine kinase activity; Biological process=protein amino acid phosphorylation
  Homolog annotation: Hit_ID=Q1RZY7; Match level="QueryCoverage=95%, HitCoverage=43%, E-value=1e-90, Identity=74%"; Hit description =Protein kinase
MFKPQTNYESSLRERCADFPASAVNLLETLLSIDSGNRGTASSALMSEYFSTKPYACNASSLPKYPPSKEMDVKNIEDSSKKKTGGKMREVATSRRQQRRVSKILQDPNNFGKSTSKEDMQNISQNARRDDGKSHLTKGKGGAMHKDYTKPHMDAMSETSQMNVANGNGYSVGSNNTFTWVKRRKQDASSTLSDGSRSKISALDPNFAKGTYDLTTQRVSMDFDPAELMNAQLHVTWRIAEIMDIWWSWIMATEGVLFVNQDLEETTDEAKIAGVVQC

SEQ ID NO: 142253 - protein, 419 aa, Glycine max
  Coding DNA Sequence Number=SeqID_25475
  Gene Ontology: Mol. function=transcription factor activity; Cellular component=nucleus; Biological process=regulation of transcription, DNA-dependent
  Homolog annotation: Hit_ID=Q1T6R1; Match level="QueryCoverage=99%, HitCoverage=100%, E-value=1e-127, Identity=59%"; Hit description =Pathogenesis-related transcriptional factor and ERF
  Pfam annotation: Domain name=AP2; Domain location=40-104; Score =129.8; E_value=7.5e-36; Accession=PF00847.10; Description=AP2 domain
MARKRKVVEVVEEGELCEGTLGWDEMMKQAAALGGVQRARKRFVGVRQRPSGRWVAEIKDTIQKIRVWLGTFDTAEEAARAYDEAACLLRGANTRTNFWPCSQSSTSPALSSKITNLLLQRLKERNNNNNNNACSSSSSSSTSLLINHQQMQHHQQVDAYGEGSTQFSIDQFTDFLNDPEDYSTSNNDFINNTAQIDYITSSFESCLTKKDGGTKMDMQLQYKSSNVTPQTSSNDSNSGVEDSEEEGNDLGVQSTNLDVHDFRFLDNIAPPSYYSPFEMAEEMEEEPVEPENENYDDEPSMLRAVMKRMTYERKFSASLYAFNGIPECLKLKLESGNMKGRGLADQLTSLQMACSKNKLEKNKEEKEFMATMDRKKEQEHQHTSPDMDSSSVDGELLLWNSLDLPPICFVNLLENGSFN

SEQ ID NO: 142254 - protein, 309 aa, Glycine max
  Coding DNA Sequence Number=SeqID_25476
  Gene Ontology: Mol. function=protein serine/threonine kinase activity; Cellular component=nucleus; Biological process=protein amino acid phosphorylation
  Homolog annotation: Hit_ID=Q1RZY7; Match level="QueryCoverage=100%, HitCoverage=51%, E-value=1e-133, Identity=77%"; Hit description =Protein kinase
  Pfam annotation: Domain name=Pkinase; Domain location=103-308; Score =211.8; E_value=1.6e-60; Accession=PF00069.15; Description=Protein kinase domain
  Pfam annotation: Domain name=Pkinase_Tyr; Domain location=103-307; Score=7.8; E_value=6e-13; Accession=PF07714.7; Description=Protein tyrosine kinase
  Pfam module annotation: Pfam domain module=Pkinase::Pkinase_Tyr; Domain location=103-308::103-307
MGCISSKNAVAGACSPSPAVLNIAEGHSGLTVLESKTGSENERNNKKLKKNNSKSSSGGFSFRLGLAPKHVEAEQNAAGWPPWLTATAAEAIQGWIPLKADSFQKLEKIGQGTYSSVFRAREVETGKMFALKKVRFDNFQPESIRFMAREITILRRLDHPNIMKLEGIITSRLSNSIYLVFEYMEHDLAGLVSRPDIVFSESQIKCYMRQLLSGLEHCHMRGIMHRDIKVSNILLNNEGVLKIGDFGLANTINTNGKHHLTSRVVTLWYRPPELLMGSTNYGVSVDLWSVGCVFAELFLGKPILKGRTE

SEQ ID NO: 142255 - protein, 173 aa, Glycine max
  Coding DNA Sequence Number=SeqID_25477
  Gene Ontology: Cellular component=membrane
  Homolog annotation: Hit_ID=Q2QN15; Match level="QueryCoverage=77%, HitCoverage=17%, E-value=5e-26, Identity=43%"; Hit description=Early- responsive to dehydration protein, putative, expressed
MTLELLKVYVPKYETGGEFWPTVHSSTIFSLILMHIIAIGLFGLKKLPLASILILPLPILTLLFNEYCQKRFFPIFKNYSAENADKLVPDVGEYQNNCLIKKDRADQNEHNMSEFYDKLANAYNDPALMRVKYSERIDNVFVTSVETCNISISHCKALFDLLAEVFQVPTSLA

SEQ ID NO: 142256 - protein, 137 aa, Glycine max
  Coding DNA Sequence Number=SeqID_25478
EREIRIGEGTCGGRSGVGGSRKRGKIGRRMVAKVPEEERGRLVWGRDQNDKAGKREISGQRMANDESVYSLRVGTPRDEGRARLNPRIVVKEARGVDDAGLIDMLLLNHYVFLLLLHDVNFMGTLVLINVTLGFLDF

SEQ ID NO: 142257 - protein, 99 aa, Glycine max
  Coding DNA Sequence Number=SeqID_25479
MALITPLSAKFDHFQRAFGSIQNYLPQLDLKVLYRIKGVTSYGVGGNEGDLFYMAVVKREEEAKGLKGCGGVGETGIVAKDLATMGDLDGTRDNNSSSG

SEQ ID NO: 142258 - protein, 155 aa, Glycine max
  Coding DNA Sequence Number=SeqID_25480
  Gene Ontology: Mol. function=protein binding; Cellular component =integral to membrane; Biological process=intracellular protein transport
  Homolog annotation: Hit_ID=Q1T6P9; Match level="QueryCoverage=56%, HitCoverage=39%, E-value=2e-38, Identity=90%"; Hit description =Vesicle transport v-SNARE
  Pfam annotation: Domain name=V-SNARE; Domain location=1-73; Score =3.1; E_value=0.0021; Accession=PF05008.5; Description=Vesicle transport v-SNARE protein
MVSTERLNKTSDRVKDSRRTMLETEELGVSILQDLHSQRQSLLHAHNTLHGVDDNIGKSKKILTNMSRRMNKNKWVIGGIVLVLGAAITNGETSLTADVETVSLMEEARQGEVETVSPMGGARQTDVDGVASACGDTWRRKKILSVLGGHFRFNF

SEQ ID NO: 142259 - protein, 112 aa, Glycine max
  Coding DNA Sequence Number=SeqID_25481
MIEEYVDVENLNYYDELDSVSKLQKQLRASVGRSKLAAKVAKRIKNYGRSGAASGLISSLAFTAVQGIELTNPQARHAHQLGSTHFQRSRGHETMYKYKFLFSPLIILGGYA

SEQ ID NO: 142260 - protein, 71 aa, Glycine max
  Coding DNA Sequence Number=SeqID_25482
MPPFRDSQHEFLRGRNAKTRSTENTFTLIIEGKEIDLKQLTEKTIDAFGSQNAPSFRRKKERDPTTGTARY

SEQ ID NO: 142261 - protein, 630 aa, Glycine max
  Coding DNA Sequence Number=SeqID_25483
  Gene Ontology: Mol. function=transferase activity; Cellular component= nucleus; Biological process=regulation of transcription
  Homolog annotation: Hit_ID=Q1T6P8; Match level="QueryCoverage=100%, HitCoverage=88%, E-value=1e-148, Identity=53%"; Hit description =Pentatricopeptide repeat
  Pfam annotation: Domain name=PPR; Domain location=149-183; Score =12.6; E_value=0.24; Accession=PF01535.11; Description=PPR repeat
  Pfam annotation: Domain name=PPR; Domain location=211-245; Score =19.6; E_value=0.011; Accession=PF01535.11; Description=PPR repeat
  Pfam annotation: Domain name=PPR; Domain location=393-426; Score =23.9; E_value=0.00056; Accession=PF01535.11; Description=PPR repeat
  Pfam annotation: Domain name=PPR; Domain location=427-461; Score =13.4; E_value=0.19; Accession=PF01535.11; Description=PPR repeat
  Pfam annotation: Domain name=PPR; Domain location=463-497; Score=6.1; E_value=1.4; Accession=PF01535.11; Description=PPR repeat
  Pfam module annotation: Pfam domain module=PPR::PPR::PPR::PPR::PPR; Domain location=149-183::211-245::393-426::427-461::463-497
MRWSHTTQQQCALIFRSLLRQCARASAVRPGEQLHAAATVSGLLFSPSSFLLNALLHLYASCPLPSHARKLFDRIPHSHKDSVDYTALIRCSHPLDALRFYLQMRQRALPLDGVALICALGACSKLGDSNLVPQMHVGVVKFGFLRHTKVLNGVMDGYVKCGLVGEARRVFEEIEEPSVVSWTVVLEGVVKCEGVESGKVVFDEMPERNEVAWTVLIKGYVGSGFTKEAFLLLKEMVFGNQQGLSMVERASHLEVCGNPRELGLAEGASLPQHSESRFESSQGEISTFSVRECVEHDCFRRNIPLRNQKENEKVFGCGFGFGLNSITLCSVLSACSQSGDVSVGRWVHCYAVKAVGWDLGVMVGTSLVDMYAKCGRISAALMVFRHMPRRNVVAWNAMLCGLAMHGMGKVVVEMFACMVEEVKPDAVTFMALLSSCSHSGLVEQGWQYFHDLERAYGIRPEIEHYACMVDLLGRAGRLEEAEDLVKKLPIPPNEVVLGSLLGACYAHGKLRLGEKIMRELVQMDPLNTEYHILLSNMYALCGKADKANSLRKVLKNRGIRKVPGMSSIYVDGQLHRFIAGDKSHPRTADIYMKLDDMICKLRLAGYVPNTNCQVLFGCSNGDDCMEAFEE

SEQ ID NO: 142262 - protein, 249 aa, Glycine max
  Coding DNA Sequence Number=SeqID_25484
  Gene Ontology: Mol. function=phospholipase A2 activity; Biological process=lipid catabolic process
MDLGFLGKIPWFNAQLNTDSGSNSVPIDTFTEQPKQELGNDSKLPFLSLFPWVNRAGDKFQRPSTINKELKRQARRRNGVGKDGEVNPLRFRPYVCKVPWHTGVRAFLSQLFPRYGHYCGPNWSSGKDGGSLVWDRRPIDWLDFCCYCHDIGYDTHDQAKLLKADLAFLECLEKHHGSTKGDPHVAPIYKTMCLNGLRNFLIPYRRNIVNLQQFGQPMIQFGWLSNLRWGSWNFQKTHRLSSVGGSTVS

SEQ ID NO: 142263 - protein, 424 aa, Glycine max
  Coding DNA Sequence Number=SeqID_25485
  Homolog annotation: Hit_ID=Q9FFX3; Match level="QueryCoverage=86%, HitCoverage=91%, E-value=1e-125, Identity=57%"; Hit description =Arabidopsis thaliana genomic DNA, chromosome 5, P1 clone:MAC12
  Pfam annotation: Domain name=BRO1; Domain location=19-366; Score= -193.8; E_value=0.051; Accession=PF03097.8; Description=BRO1-like domain
MGCTYSVYRKKKSSFPEVVVFVPSTRIPVQSDLQRVLKGVIPRDLADKLAALRNQIVLIAEDTGGSAVTELQRALNEYLSVLIGLTKKEYGLEGVIDFKWKNIEDGRQFFNMVKSNWQDSSISNTWFEVLSSVHLMSMLTLSEADSLMIPKDPSGSGFRVVSSDSKREAIDLLLKASGYLEFCVRDVLTRIPAETKKTFPHDLQEGVLEAIAIQTLGQGTEIQLGLAVESQKATLSVKRRLACEQLIYFSQAYHCLSGCDINQGLGRKHIRFIKWKFLESKAAAYYYHGLILDKGSEPSSHIGAVSCFLAAEELLAESKKACLSFCLAPPVTRAPPVWGAMKFLHQKIPEVASRKSQMYGYLWEKEKGLQSLPDLPEFQLSLRPDDYELPEIDPAWDSKNWKSLGQPLKEHLRDSDETEENPTD

SEQ ID NO: 142264 - protein, 52 aa, Glycine max
  Coding DNA Sequence Number=SeqID_25486
MDDRLNKKHSARERKKFTFPSEDNDVTYIQDMRRGVEVSWASHIGKNPLKPS

SEQ ID NO: 142265 - protein, 99 aa, Glycine max
  Coding DNA Sequence Number=SeqID_25487
MSNYQRAPQDPYYPPPGYAPPYPPQQGYPPPGYPSAPPQPPPGYSPYPPPPQYEGYQGYFNQGYPPPPPPNYHCHHVQHDNPGFTSFFQGWYIFLLPFF

SEQ ID NO: 142266 - protein, 223 aa, Glycine max
  Coding DNA Sequence Number=SeqID_25488
  Gene Ontology: Cellular component=endoplasmic reticulum
  Homolog annotation: Hit_ID=Q2VCI0; Match level="QueryCoverage=81%, HitCoverage=80%, E-value=2e-57, Identity=61%"; Hit description =Translocon-associated protein beta family protein-like
  Pfam annotation: Domain name=TRAP_beta; Domain location=12-221; Score= 170.4; E_value=4.6e-48; Accession=PF05753.5; Description=Translocon -associated protein beta (TRAPB)
MADPIAKALIAFALLASLLLCSHASSDVPFIVAHKKASLNRLKSGAERVSVTIDIFNQGTSTAYDVSLSDDSWPSDAFDVISGSTSKSWERLDAGGILSHTFELEAKSKGVFAGEPAVIKFRVPTKSALQEAYSTPILPLDVLSDRPPEKKFEWLHESVSIAYVDWHVTFCFHVFYLVGPTSQAKRLLAKYGSLISVISIMVLFVYLVASPSKSSAKGSKKKR

SEQ ID NO: 142267 - protein, 53 aa, Glycine max
  Coding DNA Sequence Number=SeqID_25489
MASPIPGMVKNHINREDQLPFSTTVTVSDGGAGGEGGCRRVTEGVGVSFQMKW

SEQ ID NO: 142268 - protein, 527 aa, Glycine max
  Coding DNA Sequence Number=SeqID_25490
  Gene Ontology: Mol. function=zinc ion binding
  Homolog annotation: Hit_ID=Q69L44; Match level="QueryCoverage=40%, HitCoverage=32%, E-value=6e-33, Identity=31%"; Hit description=SWIM zinc finger family protein-like
  Pfam annotation: Domain name=SWIM; Domain location=116-151; Score =16.1; E_value=0.008; Accession=PF04434.8; Description=SWIM zinc finger
MSLFGEFMEDFVDESKFIDYFKAIWHPRIGAWINALQTLPLVSQESCAAMEFYHNQLKIRLLNEKNIKKDDFARYWKNEWMSGLTSWHKALKIPDTDVLMEDGCAKVTDQDDRDKAFVVWNTGSMLSICNCSWAQDGNLCEHILKVLSICRKRGSILPSVALFQYHQALNNMLHCPPLDSLICDHAMSLAVSVQKQLNTLLDKESVQTVVDSYGKWIVIDIPLENFRVGSANRDQDTVSKKRVINGVLSEDSDGCEDRNDSSDALGCANAMTDIADQVVDRGIARNGKPLSAGEDSLPADMDVDPSSTCVNPPRLHRVDDIVSSDAFPENKERGLATTRYEISTSENGALSNDKIKETILDEGGRDCAVDVDPPTLDTLSSTSEDVKHCETETHQNGVNEVPRVISCTKDADSHLSPPSTVKPAKPLALDMGKNSVRGRAKEIRGWTSDKHKHKLHIIKVYTRKQRAREAITMDHQQQGAQHPRGCKVRRCESRGHDPWEQSQPTIMIRLRGARSGDANQGGMTLGN

SEQ ID NO: 142269 - protein, 315 aa, Glycine max
  Coding DNA Sequence Number=SeqID_25491
  Gene Ontology: Mol. function=zinc ion binding
  Homolog annotation: Hit_ID=Q69L44; Match level="QueryCoverage=97%, HitCoverage=50%, E-value=3e-52, Identity=33%"; Hit description=SWIM zinc finger family protein-like
MARWDAILSLPVQNPPTLEISLAELVWSKVEGWHDKLDRVALIPYARVDDFILIPSQCRYWCSFGPDDHRKGGIVRPSHTTYVPKKKNAGFVMPWYTGQKAAGTRAMFAPYISEDLGLRVLSLLYVGVSVETIMQRLNESVERQGGPCNHDDLLTHRYVQRQERAIRHSTYELDDDDAVSISMWVESHQNQVFFYEDFSDSDPYTLGIQTEWQLLQMIRFGNCGLLASDSRFETKSKLIGNVIQYPIHSLLVFYSDKKAIPVAWIIAPKFSSLDAHRWMRALYNRVHAKDPTSKLACFIVDDPSYDVLAIRLQMI

SEQ ID NO: 142270 - protein, 405 aa, Glycine max
  Coding DNA Sequence Number=SeqID_25492
  Gene Ontology: Mol. function=calcium ion binding
  Homolog annotation: Hit_ID=Q1SVG3; Match level="QueryCoverage=16%, HitCoverage=35%, E-value=1e-23, Identity=75%"; Hit description =Barwin-related endoglucanase
  Pfam annotation: Domain name=F-box; Domain location=14-61; Score =44.0; E_value=5e-10; Accession=PF00646.23; Description=F-box domain
MGGMLTIESKAGQDRISELPDDVVYHILSFLTIKEAIATSLLSTRWRFLWTMLPSLHIDCSKPIMKLYHSVDVFLGLFRTQKISRFHLRCNNDCCLSYAEEWVNAVVSRKVEHGLFPFSIPYDVHLPNLQIFHLHVNALLSFPSINKLISGSPALELFDLKQNWWESQLKILLKHNSQVIQVFHHSSFYGLVIQDDRDYDFISNCMYTHRWPNILKAKVCLTVHHCAKNLYANQIVSNILQGLCNVEFLSLGDFREEMDPSILDLPNFENLVDLRLFLKNADSLFLELPAKCPKLEVLEVNIMDDRYGINQRCRYHITGGATLASGFQSWLNFSSIISNTPVVALSTGWFNNKKRCHHNITIFGNGRRVHAMVVDECDSTRGCDAEHDFQPPCPNNVVDAFKAVL

SEQ ID NO: 142271 - protein, 1002 aa, Glycine max
  Coding DNA Sequence Number=SeqID_25493
  Gene Ontology: Mol. function=transferase activity; Biological process= response to oxidative stress
  Homolog annotation: Hit_ID=Q2HRE0; Match level="QueryCoverage=99%, HitCoverage=99%, E-value=0.0, Identity=64%"; Hit description=C2
  Pfam annotation: Domain name=C2; Domain location=273-347; Score=61.6; E_value=2.6e-15; Accession=PF00168.20; Description=C2 domain
  Pfam annotation: Domain name=C2; Domain location=430-512; Score=55.8; E_value=1.4e-13; Accession=PF00168.20; Description=C2 domain
  Pfam annotation: Domain name=C2; Domain location=596-684; Score=73.0; E_value=9.7e-19; Accession=PF00168.20; Description=C2 domain
  Pfam annotation: Domain name=C2; Domain location=6-91; Score=87.2; E _value=5e-23; Accession=PF00168.20; Description=C2 domain
  Pfam annotation: Domain name=PRT_C; Domain location=847-1002; Score =398.1; E_value=1.3e-116; Accession=PF08372.1; Description=Plant phosphoribosyltransferase C-terminal
  Pfam module annotation: Pfam domain module=C2::C2::C2::C2::PRT_C; Domain location=273-347::430-512::596-684::6-91::847-1002
MSNLKLGVEVVGAHDLMPKDGQGSCSTYVELHFDGWKFRTTTKEKDLNPVWNEKFYFNVTDPSKLPNLTLDACIYHYSKRSNSKIFLGKVHLTEPSFVPYADAVVLHYPLEKKNVFSRIKGELGLKVYVTDDPSVKSSNPIHDVEPSVDTVQHSTPDQSPVSFTNSILNVFSRKKNETKHTFHTLPNSNEEKQHKSSPSAAAKTNKDSGMHESKSGLPPPKVFHAYPGSFSPMDYALKETSPFLGGGQVVGGRVIRGYRPSSSYDLVEPMQYLFVRVVRARLTGSIDPYVEVKVGNFKGITKHYEKTQDPEWNQVFAFARENQQSTLLEVVVKDKNMLLDEIIGTVKFDLHDVPRRVPPNSPLAPEWYRIDKGKDKKKGELMLAVWFGTQADEAFPDAWHSDALSSGDISSSAYAHMRSKVYHSPRLWYVRVKVIEAQDLHVSENSQIHDAYVKLQIGNQILKTRPVQSRTMILRWDQELMFVAAEPFEEPLIVSVENRVGPNKDETIGAVIIPVDQTDKRADDRLIHTRWYHLEESISSVMDGEQGKKEKDKFFSRIHLSVCLDGGYHVFDGSTYYSSDLRPTSKQLWKKPIGLLEIGILSVDGLHPTKTRDGRGTTDTYCVAKYGHKWVRTRTVSDSLSPKYNEQYTWDVYDPATVLTVGVFDNGQLHNSDGNKDLKIGKVRIRISTLEAGRVYTNAYPLPVLHPSGVKKMGELHLAIRFSCSSMVDLMQQYFKPHLPKMHYKRPLNLMEQEKLRHQAVNVVASRLSRAEPPLRKEVVEYMCDTDSHLWSMRRSKANFYRLMTVFSGILSVVRWLGEVSTWKHPITTVLVHILFLMLVCFPELILPTVFLYMFVISMWNWRFRPRCPPHMNTRLSYAEGVTPDELDEEFDTFPSSKSPDILRWRYDRLRTVAGRIQSVVGDLATQGERIQALVNWRDPRASAMFMVFCFVAAIVLYVTPFQLPILLTGFYLMRHPMLRSKVPPAPVNFFRRLPSLTDSML

SEQ ID NO: 142272 - protein, 34 aa, Glycine max
  Coding DNA Sequence Number=SeqID_25494
MAQPNTATTTEQYETDILQSFQVKSQRSKFQLKV

SEQ ID NO: 142273 - protein, 221 aa, Glycine max
  Coding DNA Sequence Number=SeqID_25495
  Gene Ontology: Mol. function=nucleic acid binding; Cellular component= beta-galactosidase complex; Biological process=DNA integration
  Pfam annotation: Domain name=rve; Domain location=3-141; Score=-2.6; E_value=0.0098; Accession=PF00665.16; Description=Integrase core domain
MLYPVRMFQLGIRDKSEAAIVIKMFFQMVKTQFGATIKFDNAKELALTEFLAEQGTLQQFSCVERPQQHSVAERKHQHLLNVAKALFFSPNCQYNFGENSPYQVLFGSKLDYHSLKAFGYLAYATTLPSTRNKFTPWVIPLVFVGYPRGYQRYKLYNLETKQCLVSRDVVFHETNFPFQAVIPTQDISHFVDDMVIPLPVADNSSSDPPASDAMNTNNNHC

SEQ ID NO: 142274 - protein, 128 aa, Glycine max
  Coding DNA Sequence Number=SeqID_25496
  Homolog annotation: Hit_ID=Q9FIZ2; Match level="QueryCoverage=71%, HitCoverage=80%, E-value=7e-25, Identity=58%"; Hit description =Arabidopsis thaliana genomic DNA, chromosome 5, TAC clone:K23L20
  Pfam annotation: Domain name=Mit_rib_S27; Domain location=12-79; Score=63.3; E_value=7.8e-16; Accession=PF08293.2; Description =Mitochondrial ribosomal subunit S27
MASGSLKNMLSEAINKGVVESRARIFGHQLNPTGQQTPHKLLRMKLFGEKVAQWYPHDIKKDDPLVMARQEQDLGIECSGMVWMAIAMLVALHLLTFLYKLAVLLNGGAMAAMVEWCGSFLPSAIGNL

SEQ ID NO: 142275 - protein, 34 aa, Glycine max
  Coding DNA Sequence Number=SeqID_25497
  Homolog annotation: Hit_ID=Q109P9; Match level="QueryCoverage=77%, HitCoverage=13%, E-value=4e-08, Identity=92%"; Hit description =Pectinesterase family protein, expressed
GAGQAVAVRVTADRCAFYNCRFLGWQVELLKRIR

SEQ ID NO: 142276 - protein, 128 aa, Glycine max
  Coding DNA Sequence Number=SeqID_25498
  Gene Ontology: Mol. function=pectinesterase activity; Cellular component=cell wall; Biological process=cell wall modification
  Homolog annotation: Hit_ID=Q9LVQ0; Match level="QueryCoverage=86%, HitCoverage=36%, E-value=7e-24, Identity=59%"; Hit description =Pectin methylesterase-like protein
MVLENITFENSSPQVCRDIFCNNCVTRWNRTVPNGAGSHRCCATRQHSPDGDSGVPRNLPAAKTKNFITLIGLRPEDTLLTWNNTATLIHHHQDAKVIGTGIFGCGTIIVEGGDFIAENITFENSSPQ

SEQ ID NO: 142277 - protein, 137 aa, Glycine max
  Coding DNA Sequence Number=SeqID_25499
MESWKLGRALEGCKEFEGFVHVNLGKQEELGVGEEVFEKLDGGNHCRGDNDYCDGKDEECCGQYNDNDRGNDYYCSGDECCCVSKYGYDNGKLAIRAQHAYKPAGETRKLQNLPHKTHILNGFNSSKLAPTSHGLQV

SEQ ID NO: 142278 - protein, 86 aa, Glycine max
  Coding DNA Sequence Number=SeqID_25500
MPYILGSKKQVPVGSEGDPPSHGKDEILNGMVHNTLVQVENLTNEEAKRTHKETEGKQNHGEKDVTNIFCALRDVKSPTPRRGTQT

SEQ ID NO: 142279 - protein, 87 aa, Glycine max
  Coding DNA Sequence Number=SeqID_25501
  Gene Ontology: Cellular component=integral to membrane; Biological process=transport
  Homolog annotation: Hit_ID=Q1T6P1; Match level="QueryCoverage=65%, HitCoverage=20%, E-value=6e-18, Identity=77%"; Hit description=GOLD
MAATFDLVRSLALLTLAFVCSVANSMRFELQSGNTKCISEDIKTNAMSVGKYSVVNPREGYPLPDSHRIVVKTNAANTTTIAVALWL

SEQ ID NO: 142280 - protein, 63 aa, Glycine max
  Coding DNA Sequence Number=SeqID_25502
MDFKKSRQKLQFCMLALKQAIEGKSNILPYVGYQLQKINYDVLMVSEVGLKCGMQQVRKYLFA

SEQ ID NO: 142281 - protein, 128 aa, Glycine max
  Coding DNA Sequence Number=SeqID_25503
MMVGVPEKEKTGPEEAISGPKQKNPNAKEGEHIRADKKAYRKRELPGPDKSASDGETAASGLHAPEIARDKGSAWKLHWQRDYQGWVALFEANLTLVSPEKMAGDDSGRRRQTADKTRSNANLKTEVS

SEQ ID NO: 142282 - protein, 100 aa, Glycine max
  Coding DNA Sequence Number=SeqID_25504
MKKKIGLGFFVDRAVKVGALKAAEAEAPASPSKEDSERSIENGENPLLLPEKTLLLYFWSLGRFCFIIAIIGVELPRGFCTVGPPPSPFSFERQYISCNL

SEQ ID NO: 142283 - protein, 96 aa, Glycine max
  Coding DNA Sequence Number=SeqID_25505
MPLREGFTLPMGCFVLKPSNSKYCCLLQWHLQDLSSFRKPNYWTCIAHAVTTTSERAGLSASKVSNGNLRKDDLNENPIMKNKTLVSNENSNCNLY

SEQ ID NO: 142284 - protein, 195 aa, Glycine max
  Coding DNA Sequence Number=SeqID_25506
  Gene Ontology: Mol. function=RNA-directed DNA polymerase activity; Biological process=RNA-dependent DNA replication
MVIDNNMKATKSCSHNERDGVVMEIKEPDGEVGYPDQEQVEGDLKDIKRELEFLQGQEDGDPLPRYKSLSEHMVSMLVKEEVYWKQREGEMVEEQARICKLISEEQYAFIVGRFIGDNVLMASKINHHMRNMRRGKTSDMALKMEISKAYDKVDWGYLRAIMERMGFDKHGSTNWIMRALIHKVEGDETLHGIFI

SEQ ID NO: 142285 - protein, 906 aa, Glycine max
  Coding DNA Sequence Number=SeqID_25507
  Gene Ontology: Mol. function=microtubule motor activity; Cellular component=microtubule associated complex; Biological process =microtubule-based movement
  Homolog annotation: Hit_ID=Q0WLK7; Match level="QueryCoverage=96%, HitCoverage=96%, E-value=0.0, Identity=51%"; Hit description=Kinesin like protein
  Pfam annotation: Domain name=Kinesin; Domain location=30-373; Score =414.0; E_value=2e-121; Accession=PF00225.13; Description=Kinesin motor domain
MGAVSGEELVKWEKMGGVGGHEEKILVLVRLRPLSEKEIDVNEAADWECINDTTILYRNTLREGSSFPSAYTFDRVFRGDCSTKQVYEEGAKEIALSVVGGINSCIFAYGQTSSGKTYTMIGITEYAVADIFDYINKFSAIEIYNEIIRDLLITKNTSLRLRDDPERGPIVEKLTEETLRDWVHLKELLSFCEAQRQVGETYLNDKSSRSHQIIRLTIESSAREFMGKSSSTTLAASVNFVDLAGSERASQALSAGSRLKEGCHINRSLLTLGTVIRKLRLSPSFLAYGVYLLYSASNIVSKPTSGLFNSTKQDSKGRQGHINYRDSKLTRILQPSLGGNSRTAIICTLSPARSHVEQTRNTLLFACCAKQVTTKAQVNVVMSDKVLVKQLQKEVARLESELRTPCPPSTNCDCAAMLRKKNLQIQKMEREIRELIEQRHLAQSQVEDLLRMVGNDQKSRKERMDTWEDDDSISESSSTYPSDLRIREFNNPHYNNENSESSPDKHPDECCKEIQSVELEESSRDDLEYADLSVSNNGVLALTLYGEENVISQEIPTPVNEDREEKQNQLTYGVLEQRLDDSQLSNDSPMTMSETVPNCRNFKLLRSWSCREYYTSSSPEKAGVMERTPASSFEKCFPGRPDELQRKFLPLTYGSSTKLSMNGSPSSVGSPSMDELRTNSMRSNANEDVTSLQTFVAGMKEMAKLEYEKQLVDDDQDQQAETTTFRFEKNMKDVGVGSMLEAPESPVEWPLQFKQQQREIVELWQACKVSLFHRTYFFLLFRGDPTDSIYMEVEFRRLSFLKETFASGNQSMNASSAKGVQREREVLVKLMQRRLSEEERKNLFSKWGIELDSKRRRKQLANRIWSSTDMNHIVESAAVVAKLLSFTGLKEMFGLSFSPHTWASLF

SEQ ID NO: 142286 - protein, 204 aa, Glycine max
  Coding DNA Sequence Number=SeqID_25508
  Gene Ontology: Biological process=ubiquitin-dependent protein catabolic process
  Homolog annotation: Hit_ID=Q307X2; Match level="QueryCoverage=50%, HitCoverage=40%, E-value=4e-20, Identity=50%"; Hit description =Ubiquitin fusion-degradation protein-like
MVTYNNKKYYLDVIETKPANAISIIETDCEVDFAPSLDYKVTTASKTLDKGKFNPFFGTGRRLDGNSIPPVYSSRPSDVPNVNSLSFTNSSSPNFARPSQGKLEKDDYLLRLGSADNNSGSGNRNALGRAKEKVEYGCEWCERDAAVQRGCEVCGRGDKKTKKGKRFKGSYGNARPKKEKMIERIKDKVEVPRSTPWPLPFKLI

SEQ ID NO: 142287 - protein, 189 aa, Glycine max
  Coding DNA Sequence Number=SeqID_25509
  Gene Ontology: Mol. function=RNA-directed DNA polymerase activity; Cellular component=chromatin; Biological process=chromatin assembly or disassembly
MKLNIPRFDGTNMTSWIFKILQFFDYHATPDDERLQIASFYLDGAALSWFQWMHRNNQLTTWADFLNALEMRFAPSFYNDPRGALFNLPSPFLLSCFVLGLMPYIHREVQALQPLPLVQVVALAKLQEDKINDAKRPSHPRHPSFPFVAPPITLVPPPPPLLPCHHKPLLKRSLHPKWPTAVERACVTT

SEQ ID NO: 142288 - protein, 104 aa, Glycine max
  Coding DNA Sequence Number=SeqID_25510
  Gene Ontology: Mol. function=RNA-directed DNA polymerase activity; Cellular component=chromatin; Biological process=RNA-dependent DNA replication
MSAKSSFWDVHWRHSNLVKSLGKVQPREPLSIMQIIQEFINSWKRKPVLDCDGVEGFVIHAKTPCAIFLLNKQDQRRVENWVEDESKGYVIVSGVRMWAVGKLA

SEQ ID NO: 142289 - protein, 79 aa, Glycine max
  Coding DNA Sequence Number=SeqID_25511
  Homolog annotation: Hit_ID=Q1SFG1; Match level="QueryCoverage=51%, HitCoverage=5%, E-value=2e-14, Identity=90%"; Hit description=AAA ATPase
MEKSLLEMKKQGVFEERRELLKGVSGVFRPRVLTALMGAIQGVPKIKEGYNPATWMLEVTSAGIEASLKVNFTNVYRNS

SEQ ID NO: 142290 - protein, 220 aa, Glycine max
  Coding DNA Sequence Number=SeqID_25512
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2LAH9; Match level="QueryCoverage=96%, HitCoverage=38%, E-value=8e-78, Identity=66%"; Hit description=Endo -1,4-beta-glucanase precursor
  Pfam annotation: Domain name=Glyco_hydro_9; Domain location=1-220; Score=-40.4; E_value=4.8e-12; Accession=PF00759.9; Description =Glycosyl hydrolase family 9
DQRQTWRANSALGDGWTYKLDLTGGYYDAGDNIKFGFPMAFTTTMLSWSVIEFGDMMPPNEHRNALLAIRWATDYLLKTVSQPNRIFVQNAKFHLFSIWIPNPDEYITDAPRMAVGDPISDHNCWERPEDMDTNRTVYAVDAPNPASDVAGETAAALAAASMAFRSSDPSYSETLLRNAAKAFQFADTYRGAYSDNANVRSGVCPYYCDFDGYQGIAFCF

SEQ ID NO: 142291 - protein, 1098 aa, Glycine max
  Coding DNA Sequence Number=SeqID_25513
  Gene Ontology: Mol. function=nucleic acid binding; Cellular component= nucleus
  Homolog annotation: Hit_ID=Q7XCX5; Match level="QueryCoverage=56%, HitCoverage=38%, E-value=4e-92, Identity=46%"; Hit description=Plus -3 domain containing protein, expressed
  Pfam annotation: Domain name=GYF; Domain location=564-619; Score =50.8; E_value=4.6e-12; Accession=PF02213.6; Description=GYF domain
  Pfam annotation: Domain name=Plus-3; Domain location=251-358; Score =170.9; E_value=3.1e-48; Accession=PF03126.8; Description=Plus-3 domain
  Pfam annotation: Domain name=SWIB; Domain location=112-187; Score =75.5; E_value=1.7e-19; Accession=PF02201.9; Description=SWIBMDM2 domain
  Pfam module annotation: Pfam domain module=GYF::Plus-3::SWIB; Domain location=564-619::251-358::112-187
MNHIIPRRPGPGQIDFDDRNSWEYLFKDYYIDIKEKLSLTFDELTQAKNPWKGSDMLHSKEESPDEIFDATNDRGSDSDSSYENADLSRSKRKKAKKRGKSRSKGDDSSEWASTELLEFVMHMRNGDKSVLSQFDVHTLLLEYIKRNKLRDPRRKSQIICDARLQNLFGKPKVGHFETLKLLESHFLLKDDSQAEDLQGSVVDTEMSHLEGDGNPNSHTKAGKDKRRKNRKKGDERGLQTNVDDYAAIDNHNINLIYLRRNLVEDLLEDTEKFHDKVVGSFVRIRISGSGQKQDLYRLVQVVGTCKAAEPYKVGKRMTEILLEILNLNKTEIVSIDIISNQEFTEDECKRLRQSIKCGLINRLTVGDIQDKALVLQEARVKDLLKTPEERQRRLEEIPEIHVDPNMDPSYESEEDANEVDDKRQENYMRPRGSTAFGRRGRDIVSPRSGSISNDSWSGTRNYSNVNHELGRNLSNKGFSIKGDNASNANEALNDAQLHRGRDRESQLSNSWERQKLSSTLESGAKNTQPLVASESFSSAVSEASAAPSSAGITPPAVKINETEKMWHYQDPSGKVQGPFSMVQLHKWSNTGYFPADLRIWRTTEKQDDSILLTDALAGNFSKEPSIVDKAQSVYDLHYPSSYSRKSPQQGIEVQAGERLSLDQNCGSWNSHSTLGSPGQTTGGSWRSKDNMNSLANRTSPLAVEVPKNPANGWGSDAGVRNEATNLPSPTPQTTPGGTKGLAFENKWSPTPVQLPGSLVGNSFPGSHRVLQASVVVHPEHAVQNAEKGSSSQPGISSASTDNNKLHPQATAVAPVVASGVDIKMTGANMQNQVVSSHNSHAETQGWGSAGVPKPEPLAWGGASSQRIEPNNPATMPAQPASHAPWGDASSVQNTASFNTGNPIASLPTPGFLGMTAPEPWRPPASSSQSNTTAPSPAQPNMPWGMGMPGNQNMNWGGVVPANMNVNWMPAQVPAPGNSNPGWAAPSQGLPPSQGLPPVNAGGWVGPGQGRSHVNANAGWVGPGQGLAPGNANPGWAAPTGNPGMWGSEQSHNGDRFPNQGDRRDSGYGGKSWNRQSSFGSGGRGGSSRPPFGGQRGVC

SEQ ID NO: 142292 - protein, 85 aa, Glycine max
  Coding DNA Sequence Number=SeqID_25514
  Homolog annotation: Hit_ID=Q1S1X7; Match level="QueryCoverage=73%, HitCoverage=4%, E-value=7e-09, Identity=52%"; Hit description =Integrase, catalytic region; Zinc finger, CCHC-type; Peptidase aspartic, catalytic
MSNAKPVSTPLAKHFRLSVDQYLKTDSELEHMSKVLYANSVGCLMYAMAIYKSRDISCCRPSVIQITNQNPYILQMKDHPANYQT

SEQ ID NO: 142293 - protein, 454 aa, Glycine max
  Coding DNA Sequence Number=SeqID_25515
  Gene Ontology: Mol. function=transferase activity, transferring glycosyl groups; Cellular component=cytoplasm; Biological process =metabolic process
  Homolog annotation: Hit_ID=Q5CAZ5; Match level="QueryCoverage=97%, HitCoverage=98%, E-value=1e-134, Identity=50%"; Hit description=UDP -xylose phenolic glycosyltransferase
  Pfam annotation: Domain name=UDPGT; Domain location=12-450; Score= -82.3; E_value=1.8e-06; Accession=PF00201.9; Description=UDP -glucoronosyl and UDP-glucosyl transferase
MEKKSITSRAHCLVLAFPGQGHINPMLQFSKLLERQGVRITLVTTRFYSKNLQNVPPSIALETISDGFDEVGPQEAGSPKAYIDRLCQVGSETFHELLEKLGKSRNHVDCVIYDSFFPWALDVTKRFGILGASYLTQNMTVNNIYYHVHLGTLQAPLKEHEISLPKLPKLQHEDMPSFFFTYEEDPSMLDFFVVQFSNIDKADWILCNTYYELDKEIVDWIMEIWPKFRSIGPNIPSLFLDKRYENDQDYGVTEFKRDECIEWLDDKPKGSVVYVSFGSIATFGDEQMEELACCLKESLGYFLWVVRASEETKLPKGFEKKTKKGLVVTWCSQLKVLAHEAIGCFVTHCGWNSTLETLCLGVPIIAIPFWSDQSTNAKLMADVWKIGIRAPIDDNKVVRREALKHCIREIMENEKGKEMKSNAIRWKTLAVKAVSDDGSSHKNILEFTNNLFHP

SEQ ID NO: 142294 - protein, 249 aa, Glycine max
  Coding DNA Sequence Number=SeqID_25516
  Gene Ontology: Mol. function=oxidoreductase activity, acting on single donors with incorporation of molecular oxygen, incorporation of two atoms of oxygen; Cellular component=integral to membrane; Biological process=...
  Gene Ontology: Biological process=flavonoid biosynthetic process
  Homolog annotation: Hit_ID=O48631; Match level="QueryCoverage=73%, HitCoverage=58%, E-value=3e-53, Identity=52%"; Hit description =Ethylene-forming-enzyme-like dioxygenase
  Pfam annotation: Domain name=2OG-FeII_Oxy; Domain location=117-217; Score=119.4; E_value=1e-32; Accession=PF03171.10; Description=2OG -Fe(II) oxygenase superfamily
MAESGKVEIVGKPVQDLVLNSENQPKNYIYKEGGGGFRDAQDDDIPVIHLHRLSSPSTAQQELAKLHHALNSWGCFQEYCPTVYRKYKAETEVIIKAMTNSLNLEEDCFLNECGERDVMFLRFNYYPPCPMPDHVLGLKPHADGSTITFLLQDKLVQGLQGLKYDQWFKVPIILDALVINVGDQTEILSNGIFRSPIHRAVINSEKERLTVAIFCLADSEKEIKPVKNYSEIYFQYYHQGKRPIEASKI

SEQ ID NO: 142295 - protein, 187 aa, Glycine max
  Coding DNA Sequence Number=SeqID_25517
MDKVKEVPIEKRSKNKITLNYARKTQVQAKLSGRRWTIEGFPNPYSMDVENEEAPLQQHSDSQCHTDLPNLPYASAVDLEEAAATTTEAVAVEPDALAVSDDGAETQVTDVAGDEMIEEKANEGIDVDDVALETDMVEEEPNLAIDAEDDEIEDRNTNEDALMEDEQQQEEEDVEQEGEGEEEEQQQ

SEQ ID NO: 142296 - protein, 158 aa, Glycine max
  Coding DNA Sequence Number=SeqID_25518
MPVNCSIMSELTIDEHREWREMTNMMQNVAASLEAFFQTVHIRDQIFGEVSKVYAVKWNDVLDGSITFKVYLTEQKVTCSSLDVPSSMYYFLKDKGWTHLHLEDVAECRLVFNHFRKTLKIGVGWKHLCETLSLTVDMGIVFEFIDPNVNRVLYWAYL

SEQ ID NO: 142297 - protein, 437 aa, Glycine max
  Coding DNA Sequence Number=SeqID_25519
  Gene Ontology: Mol. function=DNA binding; Cellular component=nucleus; Biological process=regulation of transcription, DNA-dependent
  Homolog annotation: Hit_ID=Q1HAY2; Match level="QueryCoverage=31%, HitCoverage=52%, E-value=4e-50, Identity=64%"; Hit description=R2R3 -MYB transcriptional regulator
  Pfam annotation: Domain name=Myb_DNA-binding; Domain location=62-107; Score=48.0; E_value=3.1e-11; Accession=PF00249.21; Description=Myb -like DNA-binding domain
  Pfam annotation: Domain name=Myb_DNA-binding; Domain location=9-56; Score=47.2; E_value=5.5e-11; Accession=PF00249.21; Description=Myb -like DNA-binding domain
  Pfam module annotation: Pfam domain module=Myb_DNA-binding::Myb_DNA -binding; Domain location=62-107::9-56
MDGSACVRKGLWSEVEDTLLRTCVRQYGEGQWHLVPTRAGLNRCRKSCRLRWLNYLKPNIKRGEFTEDEVDLMQRLHNLLGNRWSLIAGRLPGRTPNDVKNYWNTYIRRKVSSSHKVVINEKQKKTTVKPHVVIKPKARTFSRPSPSGLRGSSVLREEGGESGAKHCSTHHQACAASSEYINNWSTDQWWKTMMHDKGDNLDNNQCLLGYQDEVGKLVKDNNCDENLASLTTQEGEFLIEGQNWISNQNSHQQSTSASHMPSPIVVPTGASGAASPGVAAANPEVGTEGLLTEKRASPLLIDAAPPSNGYILCGTSRGYIYLGLTENKRGYISCGSVLVEDTSTRLSKENKGGYIPYGSLLVKGFLQGVDVGTGDGPRASTEDGDGVDAGGLTRIETEDGDGINDVRLSRGGNSLIMYRLFFAVVPFPLESFDGGRG

SEQ ID NO: 142298 - protein, 326 aa, Glycine max
  Coding DNA Sequence Number=SeqID_25520
  Gene Ontology: Mol. function=nucleic acid binding; Biological process= DNA integration
  Homolog annotation: Hit_ID=Q1ST43; Match level="QueryCoverage=70%, HitCoverage=16%, E-value=8e-32, Identity=35%"; Hit description =Integrase, catalytic region; Peptidase aspartic, catalytic
  Pfam annotation: Domain name=zf-CCHC; Domain location=195-212; Score =9.4; E_value=0.027; Accession=PF00098.13; Description=Zinc knuckle
  Subcellular localization annotation: CTP_CleavageSite=40; ConfidenceScore=5.43e-01
MSDTPPISPKKSSSSPKHDAGSITVTTDPTLNPSSPYFILPSEGPSSVSITPVLDGTNIPELQDEIYGMSQNNCTVFEFYTALKTMWEELDNYRPFPVCTCDAKKYHQQDFIIRLLKGLDDRFFVVRSQILLMDPLPAINRVFSMVVQQERQLRIPSSASLEPNSFVNVAANSFQGKGCGSYGATSTVKGAISSKKCAYCHRAGHTADVCWGKHGYPPGHPHYPGRPSFNNRNSSSSTNNVVVDEVVEGGCSDSGTSSSNPINLTQAQYQSLMALIQPMQLKSTSNSTGPHSPHQANLLHAIPNGPKRVSESTSGSHFVFCTTHYT

SEQ ID NO: 142299 - protein, 481 aa, Glycine max
  Coding DNA Sequence Number=SeqID_25521
  Gene Ontology: Mol. function=zinc ion binding
  Homolog annotation: Hit_ID=Q9FNA6; Match level="QueryCoverage=93%, HitCoverage=96%, E-value=1e-40, Identity=29%"; Hit description =Arabidopsis thaliana genomic DNA, chromosome 5, P1 clone:MSH12
SLQNKGFWMVKGSGHINDRDTVFDNPTKIEPKRPHQWFVDAAEVDFFPNKKQAVEDADEKSSPGFSNVNIPPWENNPNFHSVPNQFIGRLFGSETRPVNFTEKNTYVLADDSNVRSKMVTNQYGDEASFGLSISHSIEDSEACVNFGGIKKVKVNQVKEVDVQALEGHNFGRQSNGDLHQAYNREVETRSASIGQAFDKDRDATLMGLTYSRGDAHVRSFGASFVKGDDSIVSISESYNKEDTNIISFGGFPDERDIISVGRPAAEYDQLYNQSSVHVSTTAHEKELDVSSSDAVASTLQVAKVKSETVSKNKQELKTAKKEAPNSFPSNVRSLISTGILDGVPVKYVSVSREVLNAYEFERHAGCKTKHPNNHIYFENGKTIYQIVQELRSTPESLLFDTIQTVFGAPINQKAFRNWKGNEILLSTAHMNTFTFVWYVTYPIFLSPVNFIQNHFKQQHGSFNAFMERKNLTYKSQPFVKT

SEQ ID NO: 142300 - protein, 107 aa, Glycine max
  Coding DNA Sequence Number=SeqID_25522
MSRSHQISVQLRAQTLVKAVARILNILKATLALTYNGKEACLDFIEEKQVLLTKNRNSIAGAPFPITQDQDKISVLGLSKKITQAAEVESVIMLEMIGAIVIQQQAG

SEQ ID NO: 142301 - protein, 113 aa, Glycine max
  Coding DNA Sequence Number=SeqID_25523
  Gene Ontology: Mol. function=nucleotide binding; Cellular component =membrane; Biological process=small GTPase mediated signal transduction
  Homolog annotation: Hit_ID=P28186; Match level="QueryCoverage=51%, HitCoverage=27%, E-value=5e-23, Identity=89%"; Hit description=Ras -related protein ARA-3
  Pfam annotation: Domain name=Ras; Domain location=2-78; Score=-75.8; E_value=0.0014; Accession=PF00071.12; Description=Ras family
MKHIFVARLGRFERGFSFDLMPSIEVVNIWEPPLSYAVPTSKGQALADEYGIKFFETSAKTNLNVEEVFFSIARDIKQRLADTDSKAEPSTIKINQDQSGGAGQAAQKSACCG

SEQ ID NO: 142302 - protein, 101 aa, Glycine max
  Coding DNA Sequence Number=SeqID_25524
MDTPFPCRVRCLTRVCVSVRHRHDTHTTFYILDIIGVHVSVSVSCPVSVSVLHRICSLHEPEENTDTTQAISCKHVHGIEEDCSKEAIRFLVVATCKDPNT

SEQ ID NO: 142303 - protein, 37 aa, Glycine max
  Coding DNA Sequence Number=SeqID_25525
MEQYITSHSSRSVNMRNLRNEGQKNFLTAAWCERKSS

SEQ ID NO: 142304 - protein, 41 aa, Glycine max
  Coding DNA Sequence Number=SeqID_25526
MADTTSEESELDQEDEVNFNDIESLRKGESKGCDKSGHENT

SEQ ID NO: 142305 - protein, 89 aa, Glycine max
  Coding DNA Sequence Number=SeqID_25527
MSNHKSTESALKNLEVQMGQLVKQIADKSSNSFVANTEQNPKKECKAVTTRSKRFVEAKDEESVVHKEKATKKKGDGVSEVYRWQFSAT

SEQ ID NO: 142306 - protein, 71 aa, Glycine max
  Coding DNA Sequence Number=SeqID_25528
MENWRTALGNDIPGAPDSKVEDGQPFPCVQESFTTRDPRSLNPFSEVKRKEEEISLERDRLYNEDQSQFLI

SEQ ID NO: 142307 - protein, 70 aa, Glycine max
  Coding DNA Sequence Number=SeqID_25529
MPSLYDRTTKLEETLAQFMQKNPKEECKAMITRSRIAIQAEESRADQKMEGFELEEVVEEAEGDKEEETL

SEQ ID NO: 142308 - protein, 68 aa, Glycine max
  Coding DNA Sequence Number=SeqID_25530
MSPSPLGSHNHSQTHLKLSNQLLLQALAIGGLIRARVLSVLMDCLAHISEFWLSACLSCLADELKRCA

SEQ ID NO: 142309 - protein, 76 aa, Glycine max
  Coding DNA Sequence Number=SeqID_25531
MSKIKHVKLKFRKTNTSASLEVKIGDDTIPLVSKKEKKKKPLLQKGGGQLLYTIRVERKLLTLRVELLWALLLKLL

SEQ ID NO: 142310 - protein, 198 aa, Glycine max
  Coding DNA Sequence Number=SeqID_25532
GPRCREEFLQEHPLKVIPAGDGPGSKTTRLFVLQTAKKNVYTDNNSGNSARQHDSNVSMTDLVSAEDDANLHVSTGFSAAIDTAKKNVYTDNHSGISARQRDSNVSMTDLVSAEVDTAKKNVYTDNNSGNSTRQRDSNVSMTDLVSAEDNVNLRVSTGLSAAIDDGRRRRHLVSAEDDVNLRVSTGLSAAIDDRAQKT

SEQ ID NO: 142311 - protein, 152 aa, Glycine max
  Coding DNA Sequence Number=SeqID_25533
  Pfam annotation: Domain name=G-patch; Domain location=42-86; Score =13.2; E_value=0.0046; Accession=PF01585.13; Description=G-patch domain
AFWWTLGDSVGRRGYVGKLPLLGTICRGTGGIIGNSFPILRGALMVAWVMLRHGYEPGMGLSKDSHGNADVIDIRGNPHKYGLGYEPGKPGRRNAPSRLRADRAWPGHEEVAAIREEAPQDPLSFVRPCHPNFQLGNWHVTSQSEVYTADSM

SEQ ID NO: 142312 - protein, 59 aa, Glycine max
  Coding DNA Sequence Number=SeqID_25534
RVSCSTVSDSSFLGDPIVPFSEGKDENSHPGSRFMGVGLASNSGIRGMSHIISMTRMQQ

SEQ ID NO: 142313 - protein, 79 aa, Glycine max
  Coding DNA Sequence Number=SeqID_25535
  Gene Ontology: Mol. function=nucleic acid binding
RRKACNGDDMSESFLVHFILNTLLQEYGPFKISYSAHKDKWLINELMTMCVQEEERLVMEMSESPLLTIACWKNKATKS

SEQ ID NO: 142314 - protein, 120 aa, Glycine max
  Coding DNA Sequence Number=SeqID_25536
MEWFFRISHPFVTRTEETAEPRHPPPPHDEEFVEPPIPEVSVASDLPTDSVISITYVDCQGCQGMAEDLGAIAEDLERVINLRMVTEGTDLYDIMTRCLRRARGDAADGSLRPRQRCRID

SEQ ID NO: 142315 - protein, 746 aa, Glycine max
  Coding DNA Sequence Number=SeqID_25537
  Gene Ontology: Mol. function=transmembrane receptor activity; Cellular component=membrane; Biological process=signal transduction
  Homolog annotation: Hit_ID=Q6D6I9; Match level="QueryCoverage=99%, HitCoverage=92%, E-value=1e-101, Identity=53%"; Hit description =Methyl-accepting chemotaxis protein
  Pfam annotation: Domain name=HAMP; Domain location=34-103; Score =65.5; E_value=1.7e-16; Accession=PF00672.15; Description=HAMP domain
  Pfam annotation: Domain name=HAMP; Domain location=619-688; Score =57.1; E_value=5.6e-14; Accession=PF00672.15; Description=HAMP domain
  Pfam annotation: Domain name=MCPsignal; Domain location=134-356; Score=400.4; E_value=2.7e-117; Accession=PF00015.11; Description =Methyl-accepting chemotaxis protein (MCP) signaling domain
  Pfam annotation: Domain name=TarH; Domain location=467-604; Score =94.9; E_value=2.5e-25; Accession=PF02203.6; Description=Tar ligand binding domain homologue
  Pfam module annotation: Pfam domain module=HAMP::HAMP::MCPsignal::TarH ; Domain location=34-103::619-688::134-356::467-604
MKATYEEWRSAQSALAAEGVAQNQRAFHTMMWLLAIVAVMVIAVIVACWFGLRTVLIQPLHQLLGHIRHIAAGDLTQTITVEGRNEMSQLASSLHEMQQSLVHTVGNVRDGSDAIFTGASEISAGNNDLSARTEQQAASLEQTAASMEQLTATVKQNAENARQASQLALSASETARKGGDVVEGVVRTMHDIAGSSKKIADITSVIDGIAFQTNILALNAAVEAARAGEQGRGFAVVAGEVRNLAQRSAQAAKEIKGLIDDSVSRVNAGSQLVGTAGDTMQDIVGAVTRVTDIMGEIASASDEQSRGIDQVGQAVTEMDRVTQQNASLVEESAAAAASLEEQASRLSQSVAVFRIPRASAAVVVRSPVATTPPAVRKAAAAPRERVAWRALHRFAAGLTPFTSHKDPRLRADNTSDPPINEVFMFSRVRVVSGLLCVLALFALLQLFSGGMFFSTVKADKDNFAYNQRLSTLQRAMGTSWVSLVQARNTLNRAGIRYLLDSQQAGSGATVKDLVALANTELKTADQSFAEFNANLSEKGKSAENVLTLQANYNAFRGALAELIDFLSAGNFKGFVDQPTQGFQDKFEKDYNAWLAYNIVLAKQGIDANESAYQHAIMLVVGTLLVTLLVIALVWSGMRTALIRPLQQSIEHIRHIARGDLTQPVDLSVRNEMGDLLSSLQHMQQELARTVRIVRDGSDAIYTGASEIAMGNNDLSSRTEQQAASLEQTAASMEQLTATVKQNAENA

SEQ ID NO: 142316 - protein, 276 aa, Glycine max
  Coding DNA Sequence Number=SeqID_25538
MEVETLEDRITWELGYNVRTKFLGDDMVLLPGMSDDKAKLLIQSETESDDSLFYSLEKWTPKCRPNNRVVWLQLWGFPIQVWEMKNLRRAVAAIGDVIESDDYTEDRRRLDRARVLVLTPLPPLIRSEVIVRVGELEYRVWIVEETGFEGGSNRKGSSPSDGWSEMITSDDGGEVGDVLDDTNTNFSFSSELPNPEIVSVSYPNGQKEGLMCAVVILDPLGNIQADVTPKEKSKGTVEGMLGSSFGKLNLGDSFAGTEEEAANTKEVTCYNTLQDD

SEQ ID NO: 142317 - protein, 189 aa, Glycine max
  Coding DNA Sequence Number=SeqID_25539
MGHSAPFGHPEAASLMTCRDKLWSFCTLFRHPETIMSDGTQRQIMVILRLFSSRGGEPDDIWRQIMVIPHKFSPSGDDRVRWHAETNYGHSTPFCDPEAVSPMTCRDKLWLFHTPFRHPEMIVSDDTQIQIMVILRLLSSRGGEPNDMRRNHMGQQVEWWAEIPYGHPCLSSTERNEFSSIRMMLVIRC

SEQ ID NO: 142318 - protein, 186 aa, Glycine max
  Coding DNA Sequence Number=SeqID_25540
  Gene Ontology: Mol. function=ATP-dependent helicase activity; Cellular component=cytoplasm; Biological process=regulation of translation
  Homolog annotation: Hit_ID=Q1T3M9; Match level="QueryCoverage=95%, HitCoverage=42%, E-value=2e-83, Identity=83%"; Hit description =Helicase, C-terminal
  Pfam annotation: Domain name=DEAD; Domain location=2-93; Score=-34.5; E_value=0.0046; Accession=PF00270.19; Description=DEADDEAH box helicase
CYTGPNPRIGIVDFSSVQRAWKALENSSYGRILDLAKKGVCILKDCAMLVMDEADKLMSPEFQPSIEQLIHFLPTTRQILMFLATFPVTVKDFKDRYLRKPYVFVEERQKVHCLNTLFSKLQITQSIIFCNSVNRVELLAKKITELGYSCIYIHAKMLQDHRNRVFHDFRNGACRNLVCTGTLLTL

SEQ ID NO: 142319 - protein, 210 aa, Glycine max
  Coding DNA Sequence Number=SeqID_25541
MRGEDIYSIQDDATTSPSSSESEKAKGEESSEEIYPQEEGQPLVVKEKCKEVSVSSKSLAKKETHFTIKTNIKETFPLRKPPHFLFCKKALASIATPLGLEFIPQVKKLLDEGLVRKSLNPCALLVPKIGIIRYQVPKIGGMMNVLSGATLFCKITRTPNIFMVCVHRDPLGSDQGVPMNPKRIKVIPEWPTPPSIRKIWGFHDLTNFYK

SEQ ID NO: 142320 - protein, 103 aa, Glycine max
  Coding DNA Sequence Number=SeqID_25542
MAPRKLASKRSRKDKAAEGTSSAPEYDSHRFRSAEHQQRFEAIKGWSFLRERRVQLRDDEYTDFQEEIVRRRCYQPVPGIPFSAGRESGVRVSPEKEPVRWVQ

SEQ ID NO: 142321 - protein, 85 aa, Glycine max
  Coding DNA Sequence Number=SeqID_25543
MGASWHMSPEFGVVFVIGSAVDRLCGSLGMAFVVNWVVGKEVVCYCLSNVIVGFGGKLGRIGMAVTAWVSPSSSPSLFAPVFSLV

SEQ ID NO: 142322 - protein, 130 aa, Glycine max
  Coding DNA Sequence Number=SeqID_25544
MVVVIPTKIPRPPFFREYNSDPTCAYHEGVPGHSVEHCMTLKRKMQSIDSRSFDDNKDDDKKLKIQDHFMITKMMTFKNEFKIESRTLQRSRGNLISRIKNQYSRFKNNQDQDSRLKDSRIKIRLNQDKY

SEQ ID NO: 142323 - protein, 98 aa, Glycine max
  Coding DNA Sequence Number=SeqID_25545
  Homolog annotation: Hit_ID=Q1RUD8; Match level="QueryCoverage=75%, HitCoverage=14%, E-value=2e-09, Identity=41%"; Hit description=IMP dehydrogenase/GMP reductase
MANQEEWVPFMDVLALLIFGVVLFPNMEGLVDLAAIDAFLAYHHSKESPVVAILVDLFDTFDRRCEKSSARIICCLPALCVWLVLHLFQQDIRHPCPL

SEQ ID NO: 142324 - protein, 188 aa, Glycine max
  Coding DNA Sequence Number=SeqID_25546
MRGAPTEETLSPFLVRDFGAQSFKIIRRVHKAWEGPLRKDKELRGIRNGIISGYHEWLKTSGESVPGYEKKMQLPQEPLEQETKRARKEEHGCDKFRGALWGSNKTNMLAIVSKYQEELNLATAHEHKVADEYAQVYAEKEARGRVINSLHQEAIMWMDRFALTLNGSQELPRLLAKAKAMADTYSTP

SEQ ID NO: 142325 - protein, 74 aa, Glycine max
  Coding DNA Sequence Number=SeqID_25547
MVNTGMMHRRAGYFTPKLFGGPGEREASLGKPGFRKRLKMTLLPSLLDFDDAKRLKQFKVDSSHDQEIKRNDSQ

SEQ ID NO: 142326 - protein, 310 aa, Glycine max
  Coding DNA Sequence Number=SeqID_25548
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=4e-46, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DFRGLQALAFRRLHALAFRGLCVLTFRGLHALPFRGLHVLAFRGLHAFAFRGLHVLAFRGLHVLAFRGLHALPFIGLHVLAFRGLHALPFSGLHVLAFRGLHALAFRGLHVLAFRGLHALPFRGPHVLTLRGLHSLTFSGLHAFPFRGQHVLAIRGLHVLAIRGLHVLTIKGLHALAIKGLHILAIRGLHALAIRGLHVLAIRGLHALTFRGLHVLIFRVLHALAFRGLHVLALKGPHALSFRGLHTLAFRGLLALAFRGLHVLAFRGLYVLTFSGLHIHTLREFKGASCFVLSFPGPPLDPRGGPTVRA

SEQ ID NO: 142327 - protein, 202 aa, Glycine max
  Coding DNA Sequence Number=SeqID_25549
  Gene Ontology: Mol. function=helicase activity; Biological process =protein amino acid phosphorylation
  Homolog annotation: Hit_ID=Q1SN45; Match level="QueryCoverage=99%, HitCoverage=11%, E-value=2e-42, Identity=44%"; Hit description=AAA ATPase
MNKPEQVWAQTRHWMADDIVYNYKKSSTSPALQLDDMTLQNLVLLEIEQLLQANQRSLTDYPSMSYPEDVNFPTYLDNSLILAELNYNNQELRSEFEHLFSHMTDEQASIYNQIVEAVNKDEGGIFFLYGYGGTEKTYIWKKLASSLRTDNKIVIMVASSGITSLLLPGGRTAHSKFKIPVLVFEDSTCNIHQGTQLAKLLN

SEQ ID NO: 142328 - protein, 167 aa, Glycine max
  Coding DNA Sequence Number=SeqID_25550
  Gene Ontology: Mol. function=3'-5' exonuclease activity; Cellular component=intracellular; Biological process=regulation of transcription, DNA-dependent
  Homolog annotation: Hit_ID=Q1SJ16; Match level="QueryCoverage=82%, HitCoverage=26%, E-value=7e-65, Identity=86%"; Hit description=3-5 exonuclease
  Pfam annotation: Domain name=DUF82; Domain location=1-158; Score= -6.7; E_value=2.8e-06; Accession=PF01927.7; Description=Protein of unknown function DUF82
MGFTQVEGLAKHLRCVGIDAAVPYSKKPEPRMLIEQAQKEKRVILTWDAKLLRHDYLTQNQIYRVKSLLKNEQLLEVIEAFQIKINEDKLMSRCTKCNGTFIQKPLTTEEAIEAAKGFQRIPNCLFNKNLEFWQCMDCHQLYWENEFSMRIKNVRFQSYHQDMLVEG

SEQ ID NO: 142329 - protein, 103 aa, Glycine max
  Coding DNA Sequence Number=SeqID_25551
  Gene Ontology: Mol. function=protein kinase activity; Biological process=protein amino acid phosphorylation
  Homolog annotation: Hit_ID=Q2R1R7; Match level="QueryCoverage=66%, HitCoverage=4%, E-value=4e-15, Identity=57%"; Hit description=AT hook motif-containing protein, putative
MPYPEDVNCPAYLDNSLILAELNYNNQELRSEFEHVFSHLTVSVFEDSTCNIHQGTQLAELLNQTSLIIWDEAPMAHKFSFEALDHSLRDIIKHNSKDNKIFG

SEQ ID NO: 142330 - protein, 200 aa, Glycine max
  Coding DNA Sequence Number=SeqID_25552
  Subcellular localization annotation: CTP_CleavageSite=41; ConfidenceScore=5.27e-01
MREFSVTSSLSSLSQFSSQIQNPNSISSESSLFPPCIFLLLASPSSSDHHHSHVHTHEYRAFQFRPASLSFEPRSLDVINIGPAFRGHYGAFAPNSNLPPLDCGPHDSPMISDGGDETMGKMKQAAKDQRELDQCAEGFEVGRLGRMMGSEAKNYTEGLEELYQKMLVKIENLSGLVEKSSAMVIEQGNLVDFYNNCFNS

SEQ ID NO: 142331 - protein, 635 aa, Glycine max
  Coding DNA Sequence Number=SeqID_25553
  Homolog annotation: Hit_ID=Q016Y8; Match level="QueryCoverage=88%, HitCoverage=23%, E-value=1e-22, Identity=26%"; Hit description =Homology to unknown gene
MSGHIGNAISSMGRWRMKLEVRRAEVAEMLPLARLLSRSMDPAVQSRSKVVSLSLFMSWEVPVIRIPPSNDDMSVKKTYACCYTTCVQDFFMQSLQSVGLYTESLQQLLETVRGLHAPSNDVVLEDLSLPGLSELKGHWHGSLDASGGGNGDTLAEFDFHGEDWEWGDYKTQRVLAVGAYSNDDGMYLERIFIQKDNATIHADGTLLGPKTNLHFAVLNFPVSLVPTVVQIIESTAMDVVHSLRQLLAPIKGILHMEGDLRGSLAKPECDVQVRLLDGSVGGVDLGRAEVVASLTSTSRFLFNAKFEPTTQNGHVLIQGSIPVAFVQNNTLQEDVELDKSQVTWVPDWVKEKNRGTVDDASDKKVSRDRNEEGWNTQLAESLKGLNWQILDDGEVRIDADIKDGGMTLVTALSPHVNWLHGNADLKLEVRGTVDQPVLNGHASFHRASISSPVLQKPLTNFGGNVHVQSNRLCITSLESRVSRKGKLLVKGNLPLRTSEAAPDDKIELKCEVLEVRAQKVLSGQVDSQLQITGSILQPNISGNIKISQGEAYLPHDRGGTPASNRFPSNQSVLPTAGVSRMFASRYVSRFLNSESASSREKVSQSSGSDLPQEGGSPNPYFIMIPVDLIPYIVTP

SEQ ID NO: 142332 - protein, 112 aa, Glycine max
  Coding DNA Sequence Number=SeqID_25554
MASIMEAIFSFKVDMSAFICSCTSSWSPIILDLDLKVIASQDLSDNINSLTVPNYMGHQVYRVLTIVEEPVDLLGGRVGVRHSFGLCQQTGKLLTPVQSKSKPIHPHRCFLM

SEQ ID NO: 142333 - protein, 174 aa, Glycine max
  Coding DNA Sequence Number=SeqID_25555
MAIKLQLLVVIRFDIKWTAPTAEGSFNDARGDIIISHDYITVNSASAAFDLYMRVQTSYPDDFHHKREEYNIPRAIPLTIDGVELDLRMRGFEFFSLVSAYAMDSPRPLHLKASGRIKFQGKVLKPNGNISEQNFEMTRQHVQMLEKGIADSLIGEVSISGLKLNQLMLAPQLS

SEQ ID NO: 142334 - protein, 200 aa, Glycine max
  Coding DNA Sequence Number=SeqID_25556
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=96%, HitCoverage=15%, E-value=4e-54, Identity=50%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MLDCNSSQTPVDCGVKLAKEGSDKAIYATYRRDTAYGVGSISRFMDHPRLSHLLAAKRILRYVKGSLDYRLFSNHRRNVIDEVFGYSDSNWYGDKSDRKSTAGYVFMMCGAPISWCFKEEPVVALFSCETEYIAASMGACQALRLKNLMSQLKIKREEPMKKLIDNKSAISLAKHPVVHGRSKHIETRFHFLRDLKGSYS

SEQ ID NO: 142335 - protein, 212 aa, Glycine max
  Coding DNA Sequence Number=SeqID_25557
  Homolog annotation: Hit_ID=Q016Y8; Match level="QueryCoverage=49%, HitCoverage=5%, E-value=3e-09, Identity=34%"; Hit description =Homology to unknown gene
  Subcellular localization annotation: CTP_CleavageSite=71; ConfidenceScore=5.06e-01
MAAPWWMAVAVFQQTTMDYGGGVVGFKIGNTNELAGSVTALFNCQGPLDTPVFVGTGMVSRTFSYLQTESTASVASEALATSKEAGALAAFDRVPFSYVSANFTFNTDNCVADLYGIRACLVDGGEIRGAGNAWICPEIHIGEVSKSTSIEYGYLRQMKGEEDETSIDVNFSGSLAIDNIVLRYIPSSYHQMPLKLGVLNGETKLSGSLLRP

SEQ ID NO: 142336 - protein, 49 aa, Glycine max
  Coding DNA Sequence Number=SeqID_25558
MMPRMHKSGSDPYDVDMEGVIETSGFCISLLLFSLATLLWIMATKVEDD

SEQ ID NO: 142337 - protein, 64 aa, Glycine max
  Coding DNA Sequence Number=SeqID_25559
MVRSRDKLTEEINQGTKGRMQVGDRVTTLTDRCPFPALDKQRMSLHGSPVSFEFTVFITIICFK

SEQ ID NO: 142338 - protein, 178 aa, Glycine max
  Coding DNA Sequence Number=SeqID_25560
  Homolog annotation: Hit_ID=Q1SM20; Match level="QueryCoverage=51%, HitCoverage=23%, E-value=7e-14, Identity=40%"; Hit description =Nucleic acid-binding, OB-fold
MARIPDKIRSIDGSKETLKLVVRITDLWFVGTPNKSEQAEKVFVDSEGDQIHDICKSDHLKSWKVDLKENCTYVMHNFKVVKNDGQFRVCEHNGEILSCTLWENYCIQFLSYLNEHGDDGPMVIILTHARIKDAQGKYDILFTDLDTQPMSFVVAVLGIYRKLSSFSEQFFQGIKTID

SEQ ID NO: 142339 - protein, 263 aa, Glycine max
  Coding DNA Sequence Number=SeqID_25561
  Gene Ontology: Mol. function=metal ion binding; Cellular component =intracellular; Biological process=metabolic process
  Homolog annotation: Hit_ID=Q9FJY9; Match level="QueryCoverage=89%, HitCoverage=70%, E-value=3e-50, Identity=37%"; Hit description =Similarity to selenium-binding protein
  Pfam annotation: Domain name=PPR; Domain location=154-188; Score =32.2; E_value=1.8e-06; Accession=PF01535.11; Description=PPR repeat
  Pfam annotation: Domain name=PPR; Domain location=49-82; Score=3.8; E_ value=2.6; Accession=PF01535.11; Description=PPR repeat
  Pfam module annotation: Pfam domain module=PPR::PPR; Domain location =154-188::49-82
  Subcellular localization annotation: CTP_CleavageSite=83; ConfidenceScore=5.20e-01
MFVRSLTAKLKQKTSKTSNLNHVPFLIDILNHSFTNSSLSHVHFPSDISQTNSLIASYVRRGDPVSALTLFHSLRRRAHSDVVADAYTFTSILRASSLLRVSGQFGTQVHAQMLKTGADSGTVAKTALLDMYSKCGSLDEATKVFDEMRHRDVVAWNALLSCFLRCDRPVEAFGVLREMGRENVELSEFTLCSALKSCASLKALELGRQVHGLVVCMGRDLVVLSTALVDFYTSVGCVDDALKVFYSLKGCWKDDMMYNSMVS

SEQ ID NO: 142340 - protein, 234 aa, Glycine max
  Coding DNA Sequence Number=SeqID_25562
MSRHHTLVNKHVGIDVHAINFCAVMIRCGRDYTSKMRSIIVFKCRSFVTSKLNCDEAKSWLPPMSISESRQWSDDLVGLRSNLVGANGEGESGFDVGGRGEGGAGFFDVLRFQCCKVDGGEHTHQQLPRADGEGGVATDEAVKLKTLKRCSISKIFEMKEDVEEEKSSPEIEMVLKHLSFDADKVSITVTKFQWLSKRLEALRSNGISFDLMKFDEGNLNSTDEEKESEMLCLA

SEQ ID NO: 142341 - protein, 86 aa, Glycine max
  Coding DNA Sequence Number=SeqID_25563
MAPKKLSTKRSRRDAAAEGSNATPEFDSHHFRSAEHQQRFEAIKGWSFHRNRRVQLREDEYTDFQEEIARRHWMSLVTPMAKFDLE

SEQ ID NO: 142342 - protein, 70 aa, Glycine max
  Coding DNA Sequence Number=SeqID_25564
MDLEIPRSCGSTCHRTLGSRISFLNDHLEETLGPSKIGENHSKCFNLTQCVARKSLAHRILLEIKGRGPL

SEQ ID NO: 142343 - protein, 47 aa, Glycine max
  Coding DNA Sequence Number=SeqID_25565
PDEAIRLSQFSFSLAGEAKRWLYLFKGKAAISSFHQFPNESLSEALE

SEQ ID NO: 142344 - protein, 83 aa, Glycine max
  Coding DNA Sequence Number=SeqID_25566
MSGFTCDSPQISASPHQLDLAPYASGPYNAQWNAPGLLHDKHTLRSSRILGEIEVDEPWLGLWLPLNYQVVFVIGSAVGRLCG

SEQ ID NO: 142345 - protein, 261 aa, Glycine max
  Coding DNA Sequence Number=SeqID_25567
MASRKCKSIGARPTAQYDTRRFHSLDAWNRYTDNVLGKNILPERKVEVYHTEFDNFKTKLERRNLHKRLTNLADGTIDLALVKEFYANLYSSEVLEEGESLPTYSRYCRLPTNYREIEAALCIPGRGFILNAEGHPGRILKKDLTTLAQVWSVLLYSNLAPTSHTSDLIVDRARLIFGLISHMEMNIGALISGQMTSIAQSNSSRLGFPTLITALCRARGVVFDSLTFERLSPVINLAYIRKNCWNPDDLTVSIRGARRAR

SEQ ID NO: 142346 - protein, 109 aa, Glycine max
  Coding DNA Sequence Number=SeqID_25568
VTSTGISQPLSGSVDGIIDPPSPVRRHVKWKMARTKKTGEMTIEAAKEIVEKIASHFQLTIRIIFLYFVNAMRHKDPSSPIDVRMFSLLLLDVQSTLDVSVLLEPVSLS

SEQ ID NO: 142347 - protein, 95 aa, Glycine max
  Coding DNA Sequence Number=SeqID_25569
MPMLDQFHPCIHDFIENIVDVKADGMVEDSWSLVHNHLLKELAKWPNEYMNLVCGKDDVHSPLWFLFLQFSTNIFKGNETPESAPSRQVFKIKTE

SEQ ID NO: 142348 - protein, 159 aa, Glycine max
  Coding DNA Sequence Number=SeqID_25570
ALAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQDRATVSKNTGLRKVVSPCMGADACPVPE

SEQ ID NO: 142349 - protein, 70 aa, Glycine max
  Coding DNA Sequence Number=SeqID_25571
MRKMQGSRISKHENKRYAVCRTKDAQKHNTGMHIGHLGLHAWQCLKWHAACLLRAPIWGPIGSISHMAVF

SEQ ID NO: 142350 - protein, 162 aa, Glycine max
  Coding DNA Sequence Number=SeqID_25572
  Gene Ontology: Mol. function=protein binding; Cellular component =integral to membrane; Biological process=defense response to fungus
  Homolog annotation: Hit_ID=Q1SWI6; Match level="QueryCoverage=77%, HitCoverage=57%, E-value=4e-34, Identity=58%"; Hit description =Leucine-rich repeat, plant specific
  Pfam annotation: Domain name=LRR_1; Domain location=120-143; Score =4.2; E_value=48; Accession=PF00560.23; Description=Leucine Rich Repeat
  Pfam annotation: Domain name=LRR_1; Domain location=69-94; Score=8.2; E_value=8.2; Accession=PF00560.23; Description=Leucine Rich Repeat
  Pfam annotation: Domain name=LRR_1; Domain location=96-118; Score =11.2; E_value=2.3; Accession=PF00560.23; Description=Leucine Rich Repeat
  Pfam module annotation: Pfam domain module=LRR_1::LRR_1::LRR_1; Domain location=120-143::69-94::96-118
LWSWNHNNTNCCHWYGVLCHNVTSHLLQLHLNTTFSAAFYDGYYHFDEEAYEKSQFGGEISPCLADLKHLNHLNLSGNYFLGAGMAIPSFLGTMTSLTHLDLSLTGFMGKIPSQIGNLSNLVYLDLGGYSVEPMLAENKFLLLVFPMDSQDLQFRVHDFQAI

SEQ ID NO: 142351 - protein, 380 aa, Glycine max
  Coding DNA Sequence Number=SeqID_25573
SLNNMPLKLFEFHLNIFRHFKDHFFKVLATNVVVDGLPLMFNRDWGAPLPVLVDLLTLVERVNKAILEQLSAMLDAWGILSLPLVDDLYAALDDKVPNLVLFCIMGDFARRPLVKMVLPAGGTIPSSTVVPPAREGGQPVVKDGPVAEVAEVTPSIPSSILAKRKQDGLTPPLVVKVSALVATAIVVPASPPSSVVLVQEVAPAVEVSVPTTLAGPNVAPMSTITAPLVSACVITTSDPEMPPPPSLTPRVPPSAVLALASPSTSSHPHVSLDHIYTSKKFGNYGGEWTATLGGSEQRGILGGGGCQVEGPIEGVRNQLEEFELQAFKEREANKELEEEPLMQAGFFVKDLDLGLFDLFKDGVLLENEDIATEENAIEEE

SEQ ID NO: 142352 - protein, 120 aa, Glycine max [sequence omitted]

SEQ ID NO: 142353 - protein, 204 aa, Glycine max
  Coding DNA Sequence Number=SeqID_25575
  Homolog annotation: Hit_ID=Q9PAI4; Match level="QueryCoverage=20%, HitCoverage=18%, E-value=1e-13, Identity=90%"; Hit description=Two -component system, regulatory protein
IEIQHDRVELVHHGQVQTGNPVSREVHGVAPVLQVVAQTLGLLQLVIALFSLAIPFGHRHATRLWPVGTHNPHARRIREAFRSRSQASQHLAHAAALIGFELRIGLAIIDISLDPLDFCQQGLARPDHRGLIVARPCNGRQSGAGKQARQEQSMKPGAGPHGRWIAIKKTQAVPRLGLKSYPDTDPAERQSCGSLKATPAPIKG

SEQ ID NO: 142354 - protein, 177 aa, Glycine max
  Coding DNA Sequence Number=SeqID_25576
MDMNVGYLISHQISLTAQHDTSRLGFPALITALCKARGVQSDSRSLESLSPAINLDYIMKNCWNLDDPTVTFRGPRKARGNRSEALFTSASSEAPTPSSSTLPPSSSTEIPVIPPSPSQIPLPAPVSAGIFTPQMLHSMLQSIHRGQSIMSYPNFIRGLLLDDMQPLIGRFEILGTL

SEQ ID NO: 142355 - protein, 314 aa, Glycine max
  Coding DNA Sequence Number=SeqID_25577
  Homolog annotation: Hit_ID=Q47522; Match level="QueryCoverage=15%, HitCoverage=59%, E-value=2e-21, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSISQVNFSTREQYRQPKAGTPGSCEVLRLLIPHPCPRAVAWGFSPGDTDNRHNSTHHTGTEAGLSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142356 - protein, 49 aa, Glycine max
  Coding DNA Sequence Number=SeqID_25578
MCTRSWLWSAENTGSMSYKVVAECATIMNEMVSDDEGGMMGAGVTNLEE

SEQ ID NO: 142357 - protein, 138 aa, Glycine max
  Coding DNA Sequence Number=SeqID_25579
MGEVDAVQEWIKADIEALKEQMATMMEAMMSMKKTMEVNVAAVAATSAVVEVDPTPPSGLNQINHPTSDMVGQGGKEWGSTGDSHFVQVQNKHAFPPYSLPPIYTPPNLVHTLDENVNNSNPTLIESQQPQSDHAHVM

SEQ ID NO: 142358 - protein, 77 aa, Glycine max
  Coding DNA Sequence Number=SeqID_25580
  Subcellular localization annotation: CTP_CleavageSite=74; ConfidenceScore=5.30e-01
MSGVERKRQCAIRKVPMFQQKAVPSGGKQPSPPGKFQAKGAFRNASETFFMGRFRGKIFHLFFIVLRSFFVVLQSST

SEQ ID NO: 142359 - protein, 139 aa, Glycine max
  Coding DNA Sequence Number=SeqID_25581
MNLIIVIKRKEHALWHHYRTHARARLMGDVEEVQKQMKVDMEAMKEQMTTMMEAMMSMKKIMEANAVAVAAISAVAKVNPMPPSDLNQMNHPTSAMVGKDLGSTSGQYYVQIQNKHAFPPYGLPPNYTPPNVAYTPSED

SEQ ID NO: 142360 - protein, 103 aa, Glycine max
  Coding DNA Sequence Number=SeqID_25582
  Homolog annotation: Hit_ID=Q2R1R7; Match level="QueryCoverage=89%, HitCoverage=5%, E-value=8e-13, Identity=39%"; Hit description=AT hook motif-containing protein, putative
MMWYDERINKDKQTSKPRMHDMLDEHIIIAIKDMLDHHNQYAQRFRMARDKLHSAAVPDLKMKLISQRQTDGRLYNLPTTTKVAALIVGDEHSTDKRDIIIEK

SEQ ID NO: 142361 - protein, 217 aa, Glycine max
  Coding DNA Sequence Number=SeqID_25583
  Gene Ontology: Mol. function=DNA-directed RNA polymerase activity; Cellular component=chloroplast; Biological process=transcription, DNA-dependent
  Homolog annotation: Hit_ID=Q2PMQ3; Match level="QueryCoverage=99%, HitCoverage=70%, E-value=1e-115, Identity=91%"; Hit description=DNA -directed RNA polymerase alpha chain
  Pfam annotation: Domain name=RNA_pol_A_bac; Domain location=56-159; Score=42.5; E_value=1.5e-09; Accession=PF01000.16; Description=RNA polymerase Rpb3RpoA insert domain
  Pfam annotation: Domain name=RNA_pol_L; Domain location=23-213; Score= 82.9; E_value=9.7e-22; Accession=PF01193.14; Description=RNA polymerases L  13 to 16 kDa subunit
  Pfam module annotation: Pfam domain module=RNA_pol_A_bac::RNA_pol_L; Domain location=56-159::23-213
MVREKIRVSTRTLQWKCVESRIDSKRLYYGRFILSPLMKGQADTIGIAMRRVLLGEIEGTCIEESVHEILMNLKEIVLRSNLYGTRDASICFKGPGYVTAQDIILPPSVEIVDNTQHIANVTEPVNLCIELKIERNRGYRIKTLKNFQDGSYPIDATFMPVRNVNHSIHSYVNGNEKQEILFLEIWTNGSLTPKEALYEASRNLIDLFIPFFTRRRR

SEQ ID NO: 142362 - protein, 48 aa, Glycine max
  Coding DNA Sequence Number=SeqID_25584
MVVTPRIFPPLESAPVSLASLARKRASPTGLSKKGALYPGSWESKDWG

SEQ ID NO: 142363 - protein, 101 aa, Glycine max
  Coding DNA Sequence Number=SeqID_25585
MLYGALTEPVLELEVEEAQEQMKADMEEKMATMMEAMMSIKKINGDMVGKDLGDNDGPMMCKIQNEHAFPPYGLPPDYTPPNVAYTPNKNVNNSTSILIES

SEQ ID NO: 142364 - protein, 233 aa, Glycine max
  Coding DNA Sequence Number=SeqID_25586
  Homolog annotation: Hit_ID=Q5XM22; Match level="QueryCoverage=41%, HitCoverage=67%, E-value=3e-24, Identity=55%"; Hit description =Resistance-like protein HAAS-2
MTDDVPEQSTEALEMRADAQGANSGEGSDGDDAAEGFPGGPRDPSVLTSFAEHVAHACVEWTGPGGCTSLSPLIIVSYTGDPWTYIRICGEFPRSFYGGGQIFAYGVAGSVCRGDQSRDSTHTWSIYVKPGGGLSQLALICCTLSVALFANKSATYVHVVHLDAFRDLAHSGGYAWGVVALVHMYDQLDEACRTTTRQLAGYLTLLQIYEHFLSVHQCVTDDTYQEDVPTCFP

SEQ ID NO: 142365 - protein, 56 aa, Glycine max
  Coding DNA Sequence Number=SeqID_25587
MKHSSKLEGGGYMNNARWGGISPVENDLEWQSEGKRHQKWVFLCRQSLTLLKIYLV

SEQ ID NO: 142366 - protein, 91 aa, Glycine max
  Coding DNA Sequence Number=SeqID_25588
  Subcellular localization annotation: CTP_CleavageSite=38; ConfidenceScore=5.55e-01
MILHEIRRPNSLKTVPSGVANFRNLPFNRRATQGSQVRLPRKKNARSRHYSRKTSEKSERCGLRTLSVKDSGVVFTHGKGISTPSVRHKER

SEQ ID NO: 142367 - protein, 129 aa, Glycine max
  Coding DNA Sequence Number=SeqID_25589
  Subcellular localization annotation: CTP_CleavageSite=35; ConfidenceScore=5.58e-01
MSKVKNTPGLNLKDFGAPNTILRFPYTSTVSFHLRCCYSSSLPSVSFSLGFDRCSLLSALWTCIERDAPPSREKTGRLCSKESRPDGEKTNNSRQRKTQKDYKRGNRFRHTDEVGSRFVHTDQGDPYEV

SEQ ID NO: 142368 - protein, 135 aa, Glycine max
  Coding DNA Sequence Number=SeqID_25590
MDYYDDSINDSVDMVDEINNEENEEIPPEDNFKVSKNALTKFIESIKYVKGPEGKMNAFKACVVKVGGVDTKVGLCLNVPTRWNSTFVMLQRALAHTDARLAPFSRLAQVSEIWLSVILALSAEETILSLNELSV

SEQ ID NO: 142369 - protein, 40 aa, Glycine max
  Coding DNA Sequence Number=SeqID_25591
MEVMATWCSAREERSDCVKVKILVGSASKTHLTHELSGTS

SEQ ID NO: 142370 - protein, 69 aa, Glycine max
  Coding DNA Sequence Number=SeqID_25592
MASGASVKFPKILERKGGELSNLEGASGNFLRKLLARLGERGNNLDPILAINRGRRLLQWILNFLGYAF

SEQ ID NO: 142371 - protein, 106 aa, Glycine max
  Coding DNA Sequence Number=SeqID_25593
MVVVAYNAEVDRGMGCSTQLDHNPGSHCIDGLGEDVHANLGFGVANCAVRCCWPEMSRAHGSDYRGRLRAKWVKVVVVHVGNDWYKGEVKGDGSYWCLGKEQGHRI

SEQ ID NO: 142372 - protein, 525 aa, Glycine max
  Coding DNA Sequence Number=SeqID_25594
MASAQVLPNSTASSRKQEHLEAGKRRPSDLELLVSFLANPWHDGTPMEFPANPPTVELWNIILWSLSVHIGVYPPTVELWNIILWSLSVHIGLEEFRKKKAAERTKKAASSGQVHNSDDSLNKKQSSEVENVRVNESDGVTTSDAVGGSVTDTSTLGMRNDKNLNLFSQSSNQGSLAGSTFLTRNDLNMSSTSLGEAHSNIDEGKRYNASSVTASADFSQNNERNKVNDIYGIHAVGVDGIPYVTTNHQSVPLCSQESQEFDNHATSSLHGVNDNQSNKSNSSLKDYAVTDNFSSYFPSKITPQNSVDTPLQIKPTNSSTFDSGYSHSLLSGGFSDSFSSKFRETVTSSDNNLPSLHGATMPKYDSTGYEARNSSNHTPIHSLPTESSSRRSRPSFLDSLNVTRPSLGSPFHQSEQDSLMSNYLESSSNDISGSAYFHKPSEETKIMPLFSNFTTANVHSSLEPLTTPSVVDNDNQGALITSTRESGMEKKHDYYSSSQNEDFTALEQVISASYGHDITFLMPVI

SEQ ID NO: 142373 - protein, 220 aa, Glycine max
  Coding DNA Sequence Number=SeqID_25595
  Homolog annotation: Hit_ID=Q9LIQ9; Match level="QueryCoverage=82%, HitCoverage=25%, E-value=9e-26, Identity=40%"; Hit description =Arabidopsis thaliana genomic DNA, chromosome 3, BAC clone:F14O13
MLLSKLRKASGIGKSIENQTSKRDVSTSTEDLASEDPASNSSNPEINDNAAEASSLSSVTETRHSSFGVSPVNIPHDQMRMIENINALISELALEKEELIKALTSESSECSRMKEINMELSRKLEVQTQRLELLTAQSMVNENISAKQPDSRAMYENTSYADEGDEGVGMDYEALSWWTFKTENQQTSLIGFTLDLYLLSPKSYSTVRKDHEAVPQYATK

SEQ ID NO: 142374 - protein, 232 aa, Glycine max
  Coding DNA Sequence Number=SeqID_25596
DSDLNVRKPVEHSSDAKLAGESDPLGELMKILFYVYQNPVEVSWEANQFGLHDIGAKFYITHADLAEIISGDKCLNIAILQLWTIFMNECGRSKADQSLYGLLEPQSIQNAKERRQQCQQYIETWVKESQRQLYLGAYLHQAHWQLFVLHPRENTVVWFCSLRKKHDINIKGAINSAMKTTTSSFEGMSNQGAPRWVEPKSNVQSVGFECGYYVMHWMWCIVTAGLKDGWHK

SEQ ID NO: 142375 - protein, 169 aa, Glycine max
  Coding DNA Sequence Number=SeqID_25597
MAEPLKERKGSSSTATAAAHRRHEPSEAPIAPIHPSLSSPRSSTLFSSDDQRLRYLSQFSSRIILDPKYLDVDFFNDETFDCYQAFQNSGLVDFMSLKLPHYPEHVKVFYCNLKIQDDIISSEVHGIPMIIDQSFHDARRMVCNDQTEMIGRLLAGSLTFDNRIMHYII

SEQ ID NO: 142376 - protein, 253 aa, Glycine max
  Coding DNA Sequence Number=SeqID_25598
  Gene Ontology: Mol. function=transporter activity; Cellular component= integral to membrane; Biological process=transport
  Homolog annotation: Hit_ID=Q8ZNM8; Match level="QueryCoverage=65%, HitCoverage=54%, E-value=2e-67, Identity=78%"; Hit description =Putative ABC superfamily transport protein
  Pfam annotation: Domain name=OpuAC; Domain location=2-173; Score= -2.8; E_value=3.2e-05; Accession=PF04069.3; Description=Substrate binding domain of ABC-type glycine betaine transport system
TWTIAVRGDVAQQNNLQSLDDLSAYLKKGGTFKLAASAEFIERSDALPAFEKAYNFKLGQSQLLSLAGGDTAVTIKAAAQQTSGVNAAMAYGTDGPVAALGLQTLSDPKGVQPIYAPAPVIRASVLQQYPQIADWLQPVFSKLDEKTLQQLNAQIAVDGQDASQVAQHGAVTDKPTAPAAGAAGADVADHAGAGSATAAELCGQPAGLRTAADALAGNGRLAAAAAAVMAMAGIVVAATSRRGAGAAAGRGAT

SEQ ID NO: 142377 - protein, 153 aa, Glycine max
  Coding DNA Sequence Number=SeqID_25599
MTFLLSNILPSDRNADLPLRKYQLGSHPQDTQWTRRSPTGPWGFQLWLRASISPTGCPFPQQGITPARHPVDLEKSNRVLGFPALITSLCQFYGVPVTPNKFIRPRINRALTNGKTRIDEFCTLYHSETTSWVVNAQRQILRPLSFKSSNLSG

SEQ ID NO: 142378 - protein, 195 aa, Glycine max
  Coding DNA Sequence Number=SeqID_25600
MRQRPTTFARRQQAIVAIAEDVEHVEHPANKVHEQPQELVTDDERSELKLFSHGRKRGSTRKLVVSIFQLESVGSMSIFLLFLRVLLMRIIMKGNHACRWKYEKALLVSTYRKRMDRLMSDVCATDYIELFYMISHPFMSPKQPEDPLRHPPVVHDETFILPNPPQQPIDAATMPKPHAPTPALANVGMPQHAIV

SEQ ID NO: 142379 - protein, 203 aa, Glycine max
  Coding DNA Sequence Number=SeqID_25601
  Homolog annotation: Hit_ID=Q9AVH2; Match level="QueryCoverage=23%, HitCoverage=16%, E-value=7e-20, Identity=97%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGFVGDLEGRDESKRQGLNLSGSWQQATLPLTYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 142380 - protein, 107 aa, Glycine max
  Coding DNA Sequence Number=SeqID_25602
  Subcellular localization annotation: CTP_CleavageSite=50; ConfidenceScore=5.29e-01
MHTRSFTNPQFLRIGLTHKKSPVESPTVATCPFAVERGKGSRVRFPKEERCAESPPTFICGKRRENRRKPVKMKILSSGVVFTLEEGRQKRGFCSYVPSIKEEIRPT

SEQ ID NO: 142381 - protein, 56 aa, Glycine max
  Coding DNA Sequence Number=SeqID_25603
MPRRHELAGGNGRPVGPTEARNQSWKPQGPVGLLQVHWVSLWGEIGIAVAGQNVAK

SEQ ID NO: 142382 - protein, 43 aa, Glycine max
  Coding DNA Sequence Number=SeqID_25604
MEKEEFKPTFMLKIIKCKPKLQNLDPSSDQINPSFVFRSLLLD

SEQ ID NO: 142383 - protein, 88 aa, Glycine max
  Coding DNA Sequence Number=SeqID_25605
MEPYIPQVPMAPVVAPTYAPSNVEQPRHAVDACHAIAERLEHLLNLRIVTADTVIHEIMKDCIRIVRGVTPDGNVYVRSRRRRCTDQP

SEQ ID NO: 142384 - protein, 146 aa, Glycine max
  Coding DNA Sequence Number=SeqID_25606
MSAKAPRKRKAIASLSQASYDSSRFVSRDAWDCYVDNILDRNILPERNVKLYITEFDEFIREVKRRNWHRELTNFFEGSIDVAVVKKFYANLYYPEDKAPKQVRVQGHLIKFDADSLNTFLKTLVVLEQGESLPSYSRFYRLRPDP

SEQ ID NO: 142385 - protein, 127 aa, Glycine max
  Coding DNA Sequence Number=SeqID_25607
  Gene Ontology: Mol. function=GTP binding; Cellular component =intracellular
  Homolog annotation: Hit_ID=Q84TX8; Match level="QueryCoverage=81%, HitCoverage=18%, E-value=9e-28, Identity=61%"; Hit description =Putative GTP-binding protein
MKGLVIHVPIPIVNEENKDGKVKEYVSTRVGLKRVCLLIDTKWGMKPRDLELIELMERSKTKYQIVLTKTDMVFPIDVARRAMQIEENLFQNKSVVKPVMMVSSNSGAGIRSLRTALANITRFARRL

SEQ ID NO: 142386 - protein, 138 aa, Glycine max
  Coding DNA Sequence Number=SeqID_25608
  Gene Ontology: Mol. function=protein serine/threonine kinase activity; Biological process=protein amino acid phosphorylation
  Homolog annotation: Hit_ID=Q53UK2; Match level="QueryCoverage=57%, HitCoverage=25%, E-value=3e-14, Identity=63%"; Hit description =Ser/Thr protein kinase
DYHATGSGSFFGPKDERVGDAGAAGEGFGGGGGCGGGGGDGGAVEEGVWGGVGRDEWEVWDWGGGLPAHGGARGGGVRGVWEERLKPLLLGGATTSYSSEEEQQQQHQEEEEQQELESQVADGWKLEGIVREEVAAGN

SEQ ID NO: 142387 - protein, 60 aa, Glycine max
  Coding DNA Sequence Number=SeqID_25609
MAGHDVRNPFLDIHWGPLIIEELTNFEDPSYGILTVEAWYLKLHTSVKWHSACNWRKSSK

SEQ ID NO: 142388 - protein, 81 aa, Glycine max
  Coding DNA Sequence Number=SeqID_25610
  Homolog annotation: Hit_ID=Q1PEY6; Match level="QueryCoverage=69%, HitCoverage=36%, E-value=8e-16, Identity=63%"; Hit description =Allergen-like
MKYEGRIEHDMVFEGKTKVSLDWERRFLGGPGSSPPQCTSKCGKCTPCRPVHVTVPPGTPVTAEYYPEAWRCKCGNKLSMP

SEQ ID NO: 142389 - protein, 79 aa, Glycine max
  Coding DNA Sequence Number=SeqID_25611
MKEGRESRLQWEYNPLRKRGNQKGQNRHRSFLHSIAGSESVRRNSKRREERVSQIVAAMPNSDYGVERFSHPHLVTIKG

SEQ ID NO: 142390 - protein, 107 aa, Glycine max
  Coding DNA Sequence Number=SeqID_25612
  Gene Ontology: Mol. function=RNA polymerase II transcription factor activity; Cellular component=nucleus; Biological process =transcription initiation
  Homolog annotation: Hit_ID=Q69MK0; Match level="QueryCoverage=76%, HitCoverage=50%, E-value=3e-22, Identity=65%"; Hit description =Putative TATA box-binding protein associated factor 10
  Pfam annotation: Domain name=TFIID_30kDa; Domain location=20-51; Score=23.0; E_value=1.5e-05; Accession=PF03540.4; Description =Transcription initiation factor TFIID 23-
MPIFLLSLCGKSLPELSFWLLMWWTRLVAVATQKFVAEVAGDALQHCKARQATIPKDKRDKQQKDKRLVLTMEDLSKALREYGVNLKHQEYFADSPSTGMDPATREE

SEQ ID NO: 142391 - protein, 371 aa, Glycine max
  Coding DNA Sequence Number=SeqID_25613
  Homolog annotation: Hit_ID=Q8GSM4; Match level="QueryCoverage=31%, HitCoverage=31%, E-value=1e-14, Identity=38%"; Hit description=Ovate protein
  Pfam annotation: Domain name=DUF623; Domain location=310-369; Score =116.2; E_value=9.1e-32; Accession=PF04844.4; Description=Protein of unknown function, DUF623
  Subcellular localization annotation: CTP_CleavageSite=51; ConfidenceScore=5.29e-01
MGNNRFRLSDMMPNAWFYKLKDMSKSRKRNGPHVMKNKVASPTTSQRSQPRYSHYFSIEPNIADNTFTDSPRRSSKRRAGRKTIYKPSPTVVSSPVIESFGCHSTNNWIKPNQLQSPDYYLSSIEISSSESNLNDEYVSSESECDKFTIPDLLNGVASECSCRVSSSTNDIIIDMKNEPFNGNSENLDGFDTISQLGLAPILTKPVKFDDKVIETTELRRSAKFDELKSHQSLSVIVSKEECSRTKRERKTSPVARVSSANSPGIKLRVNSPKLASKKVQAYARRSVSSRACKASMNSGFPEGFAVVKSSLDPQRDFRESMVEMIVENNIHASKDLENLLACYLSLNSREYHDLIVKAFEQIWYDMAQLRM

SEQ ID NO: 142392 - protein, 583 aa, Glycine max
  Coding DNA Sequence Number=SeqID_25614
  Gene Ontology: Mol. function=protein serine/threonine kinase activity; Cellular component=cytoplasm; Biological process=protein amino acid phosphorylation
  Homolog annotation: Hit_ID=Q6EIX6; Match level="QueryCoverage=93%, HitCoverage=89%, E-value=0.0, Identity=61%"; Hit description=Mitogen- activated protein kinase
  Pfam annotation: Domain name=Pkinase; Domain location=2-258; Score =169.0; E_value=1.2e-47; Accession=PF00069.15; Description=Protein kinase domain
  Pfam annotation: Domain name=Pkinase_Tyr; Domain location=1-256; Score=-3.1; E_value=2.8e-12; Accession=PF07714.7; Description =Protein tyrosine kinase
  Pfam module annotation: Pfam domain module=Pkinase::Pkinase_Tyr; Domain location=2-258::1-256
MVGDILGKGAMKTVYKAIDEVLGIEVAWSQVKLNEALRKPEDLERLYLEVHLLSTLKHQSIMRFYTSWIDVDNKTFNFITEMFTSGTLREYRKKYKHIGLQAIKSWTRLILQGLVYLHEHDPPVIHRDLKCDNIFVNGHLGQVKIGDLGLAAILHGSQPAHSVIGTPEFMAPELYEEEYNELVDVYSFGMCVLEMLTSDYPYSECANPAQIYKKVTSGKLPASFFRIEDTEAQRFIGKCLITAAKRPSAKELLNDPFLLSDDASSMTKIGIQKPFLNYNEMEKLQLDDVSPRTEMSITGKLNPEHDTIFLKVQISDKDGSCRNVYFPFDIYTDTPINVAMEMVKELEITDLKPSDIANMIEGEISVLLPNKRNSNCSVITMTTTTNHHFHSASSRSSSQGSISGSDSRADDLLNGDYWLHGDVLDDASSICSSHGTYSNSNFCSVDEQEENHKASTRKDKHLIIKSHMCTRFSPNEDPITLNQCKVLAGPQAPSTSKNKRMMDNRRLTRNKSLIDTRSQLLHRSLVEEVNKRRLFNTVGAVENIGFVTPYEVTNKKSHPACGAFDVNSSRSSKRENFNREKFF

SEQ ID NO: 142393 - protein, 115 aa, Glycine max
  Coding DNA Sequence Number=SeqID_25615
MEALYPLAIVVKISVGNVDGPNLYEVSLETKFNILLMVVPVSNYSSTSGSGCFPCSWGCMEACRVKDAKNPTGDYGEGIISSPLHLNGNMLLSFQVLRDTTENFNEENILGKCDF

SEQ ID NO: 142394 - protein, 164 aa, Glycine max
  Coding DNA Sequence Number=SeqID_25616
MWLKGVKTPVVLSRNRDERAKRACALSLFIATVKILDFQMNALSRPCRTKRMASKKRKAPSTPTQARFDRSRFTSQEARERYTDIVVPRKLLPERNVVVYYTEFDEFKEELERRHWDEKMTDFSDSSIYIAIVKEFYANLYDPEDKSPKQVRVRGHLVKFDEDT

SEQ ID NO: 142395 - protein, 74 aa, Glycine max
  Coding DNA Sequence Number=SeqID_25617
MTKLGLCLSSGPPPLDDKRVRITIRMTKLGLCLSSGPPPLDDKRVRITIRYLRVSWVQNDQTWSLLVIGPAASG

SEQ ID NO: 142396 - protein, 206 aa, Glycine max
  Coding DNA Sequence Number=SeqID_25618
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=94%, HitCoverage=43%, E-value=2e-79, Identity=74%"; Hit description=ATP synthase subunit alpha
  Pfam annotation: Domain name=ATP-synt_ab; Domain location=1-65; Score= -80.3; E_value=0.021; Accession=PF00006.15; Description=ATP synthase alphabeta family, nucleotide-binding domain
  Pfam annotation: Domain name=ATP-synt_ab_C; Domain location=77-177; Score=127.9; E_value=2.8e-35; Accession=PF00306.17; Description=ATP synthase alphabeta chain, C terminal domain
  Pfam module annotation: Pfam domain module=ATP-synt_ab::ATP-synt_ab _C; Domain location=1-65::77-177
MSLLLRRPPGREAYPGDVFYLHSRLLERAAKLSSQLGEGNGQIFLSADLFNAGIRPAINVGISVSRVGSAAQIKAMKQVAGKLKLELAQFAELEAFAQFASDLDKATQNQLARGQRLRELLKQSQSAPLTVEEQIITIYTGTNGYLDSLEIGQVRKFLVELRAYLNTNKPQFKEIISSTKTFTGEAEVLLKEAIQEQMELFLLQEQ

SEQ ID NO: 142397 - protein, 81 aa, Glycine max
  Coding DNA Sequence Number=SeqID_25619
CYKTYLATGNRLPEIDYILCQLHLHGETKRLLHSFKGNSLKTWEEVVEKFLKKYFPESKPAEGKAAISSFHQFSDESRSEA

SEQ ID NO: 142398 - protein, 70 aa, Glycine max
  Coding DNA Sequence Number=SeqID_25620
MVNDIFTLSRHKENMVQPKASAGLKGKPHQHALTHHAFLYFNKQKLGPPRPKSCFGIYPNSCKLSASKKW

SEQ ID NO: 142399 - protein, 75 aa, Glycine max
  Coding DNA Sequence Number=SeqID_25621
MSGHRVRHRGSCSFTSALDFYLALYSNSSILGQDQLQYSRAGCQDIVSDIVDPATSILHLTFYLALCIVQPDLIP

SEQ ID NO: 142400 - protein, 72 aa, Glycine max
  Coding DNA Sequence Number=SeqID_25622
LEADSSHRDRYSIACFKRYEIARRGLRSTDRDRPANAMRKSSSFLAQDLSWKTPDWIPSSILYPISMRALKS

SEQ ID NO: 142401 - protein, 111 aa, Glycine max
  Coding DNA Sequence Number=SeqID_25623
MIMRGQDIYSSQEETTSCPSSSGSEDEVRDEESSEEVYPHEEGDLLMFRRLLGALLLKQSFYLLLSRETSLSTALPLELEVIPQVKELFDEGLVRKSLNPCALFVPKIGTH

SEQ ID NO: 142402 - protein, 223 aa, Glycine max
  Coding DNA Sequence Number=SeqID_25624
  Subcellular localization annotation: CTP_CleavageSite=59; ConfidenceScore=5.02e-01
MRSDCLVQFSILNPFLVLMNCVFVHASSIFEFGAMRSDCLVQLSILNLFRSPMNCVFVQASSTHDFGAMRSDCLLQFSILNLFRSPMNCVFVHGSSTFEFGAMRSDFLVQFFILSLFRSPMNCVFIHASSTHEFGAMRSDCLVQFSILNPFLEPMNCVFVHASSTFEFGAMRSDCLVQFSILHPFLEPMICVFIHASSTHEFGAMRSDCLVQFSILNLFSDAP

SEQ ID NO: 142403 - protein, 233 aa, Glycine max
  Coding DNA Sequence Number=SeqID_25625
  Homolog annotation: Hit_ID=Q84VI1; Match level="QueryCoverage=96%, HitCoverage=32%, E-value=2e-76, Identity=69%"; Hit description =Envelope-like protein
MATSPKETSASGSPAVPSSPHQEQPEFNIQPIQVIPGQASVPEKLVPRRQQGVKIAENPSLATSPREVDTEMDKKIRSMVSSILKEASVPEADEDVPTSSTPNVSMPDVEKDVPTSSGPNDEVLSSPSKERSTEEDDQAAEETPAPRAPEPAPGDLIDLEEVESDEEPIANRLAPGIAERLQKPKGKNSHQEVWTNQDYGPRRRALQSLLPHPEEARLLSPSKKRKEISSSEI

SEQ ID NO: 142404 - protein, 299 aa, Glycine max
  Coding DNA Sequence Number=SeqID_25626
  Gene Ontology: Mol. function=catalytic activity; Biological process =cellular metabolic process
  Homolog annotation: Hit_ID=Q48IK0; Match level="QueryCoverage=97%, HitCoverage=84%, E-value=8e-41, Identity=34%"; Hit description=Aldo -keto reductase family protein
  Pfam annotation: Domain name=Epimerase; Domain location=8-239; Score=- 0.3; E_value=3.4e-06; Accession=PF01370.11; Description=NAD dependent epimerasedehydratase family
  Pfam annotation: Domain name=NAD_binding_4; Domain location=10-222; Score=-102.6; E_value=0.055; Accession=PF07993.2; Description=Male sterility protein
  Pfam module annotation: Pfam domain module=Epimerase::NAD_binding_4; Domain location=8-239::10-222
MSQQQRVALVAGATGIVGSQLVETLHQHQWQVIGLSRQTTSRNEFPMISVDLLDAQHSAHALAPLNQVTHIFYSAWLNAANWQEMVEPNVTMLRNLVTHIEKVAPLRTVSLMQGYKVYGAHLGSFKTPARESDPGVPGAEFNAEQLRWLSEYQRGKRWHWHALRPGVVGSAVPGNAMNLALTIALYASLCKAQGLPLRFPGSWRTWNSIVDHTDATLLARATLWAAEAPGAQNQAFNVNNGDVWRWSELWPAIAHWFELETAPAVKLTFQQLFQDYRSVWRTLAEQHTLIESDILQLND

SEQ ID NO: 142405 - protein, 325 aa, Glycine max
  Coding DNA Sequence Number=SeqID_25627
  Gene Ontology: Mol. function=transcription factor activity; Biological process=regulation of transcription, DNA-dependent
  Homolog annotation: Hit_ID=Q0KRI7; Match level="QueryCoverage=86%, HitCoverage=94%, E-value=2e-37, Identity=31%"; Hit description =Transcriptional regulator, LysR family
  Pfam annotation: Domain name=HTH_1; Domain location=5-64; Score=74.5; E_value=3.3e-19; Accession=PF00126.17; Description=Bacterial regulatory helix-turn-helix protein, lysR family
  Pfam annotation: Domain name=LysR_substrate; Domain location=88-292; Score=100.1; E_value=6.8e-27; Accession=PF03466.10; Description=LysR substrate binding domain
  Pfam module annotation: Pfam domain module=HTH_1::LysR_substrate; Domain location=5-64::88-292
MNNKLNAINTFIRVAEAGSFSAAARQVGMKQSAVSQQIAALEEDLGVVLLHRTTRAMALTEQGERYLQQMRPMLAAMVEFESQLRPTQQALQGNVHIQLPSGLGQLFLPHLLRLQQHNPEMHLNISLDDRIAELVSERVDIALRLSETPPELFPARLLARIQTPLFAAPERVHQQPITSPEELAFNPHVRFSAIAHDAPLKLISDDATLAIKVNTVFRANNSEGLLQALQANIGIGGMQLPLVTEAIKAGTLVRILPEYRLPDRFLYAVFPDARFIPLRVRRIVELIEQLFQPAAGKVALTVTAKAGATFGFPASRVVEPYVAKR

SEQ ID NO: 142406 - protein, 465 aa, Glycine max
  Coding DNA Sequence Number=SeqID_25628
  Homolog annotation: Hit_ID=P18005; Match level="QueryCoverage=32%, HitCoverage=58%, E-value=9e-35, Identity=63%"; Hit description =UPF0380 protein yubP
  Pfam annotation: Domain name=DUF932; Domain location=1-149; Score =81.7; E_value=2.3e-21; Accession=PF06067.2; Description=Domain of unknown function (DUF932)
  Pfam annotation: Domain name=Tra_M; Domain location=330-450; Score =12.7; E_value=2.8e-05; Accession=PF05261.2; Description=TraM protein
  Pfam module annotation: Pfam domain module=DUF932::Tra_M; Domain location=1-149::330-450
MIPGIFRQVCSNGLVCWKSFGEISVPHKGDIVSQVIEGAYEVLGVFDKVENNIDIMKGIQVNNEERRLLGQLALEYKYDGKEPPVTAERIIQPRAWYDKGTDLWTAFNIVQENLIKGGVTGRTAKGKRTTTRPVTGAVENGGRVRKTEVIMFNPGCRGYFDAVLTSALRKLRTGAGVIHPDAVPVPAVLPEVARLDPRAGVNADARILKQPFPRNIKSFQLIKVRAVNLHITDVARINAEILTSFGETHFRRGLHAEYSGKPESCKPFHSYCLTYMRIKRQAGNDDTMVSQATIVYRRVTLYDMMVSVTTTCINQNSRAKCTLSAGEKIMGRMGIYVKDKIEKEIRDIYLLDIQNGASPAEVSLSSTCNELLRLGLIMHKAKNKEDTFNQKEFNRELIRKVSGSKEGIMILLTMMTELYVSATGGGGTERIDTLLSQYLAEIDSSENDADNRHFVRHEESGHADA

SEQ ID NO: 142407 - protein, 83 aa, Glycine max
  Coding DNA Sequence Number=SeqID_25629
MLGFISDSPQISASPHQLDFAPYASGPYNAQWNAPGFLHDMHLLRSSRILKKMEVEEPWLGLWLPLNYRVDMGASQHRTPEWG

SEQ ID NO: 142408 - protein, 124 aa, Glycine max
  Coding DNA Sequence Number=SeqID_25630
MEERGIHKENHSEGDTSTSKTREKRGEESVVELKDEDWEKRNRQGKRYGFVRFAGEKSSTLLEKELGSICIGNRKIHVNIPRFNRRDDPSHRVALPEEEKIGTKSKKKKDFVVVRKQVIWRKKQ

SEQ ID NO: 142409 - protein, 51 aa, Glycine max
  Coding DNA Sequence Number=SeqID_25631
MVRWRTYNFKRLVTMLECDEDDARVRRTRCSDADRDDFARRRLEEEESTKA

SEQ ID NO: 142410 - protein, 208 aa, Glycine max
  Coding DNA Sequence Number=SeqID_25632
MWHWEGVTLDDEWKFDFSVFDACRMVCTNQADMIGRLLVGSLAFECCIMHYLIVCILLPSSSNLAQVSEEDLIIMWVFLTGRQIDWAHLVRYHMHKALQSNAPLPYPHLITLFLQHFNVPLNSKPFVKVKRSFSISANVVSSFGYRKERDDSWVKKDAPVLAVEDRSPSLHSQRDDSSSLMHNILDRFDGLQTYVGERFDSLERQVDS

SEQ ID NO: 142411 - protein, 75 aa, Glycine max
  Coding DNA Sequence Number=SeqID_25633
MEGKGNLKQARRFLCEGLDDLEVPTGYSLSLHVFHSKFGETLVASNPMVLLGWLTSKTQKSSFKQCTNFLFQSLL

SEQ ID NO: 142412 - protein, 53 aa, Glycine max
  Coding DNA Sequence Number=SeqID_25634
MASIIAAICSFMASMSASIYSCTSSALPINLALAQKWVYDPNMVGSWYPNTCN

SEQ ID NO: 142413 - protein, 223 aa, Glycine max
  Coding DNA Sequence Number=SeqID_25635
GLALPLEPEVGPSAAHVSTKGSCVDPSAINPNTGRVYEGSTTVHNILLLHDQVKVGVEQVKDADAPVPVPTDEEVVSLAKPADRPNSEVMWDASLFGLFNSNFPLYIKHEDLSKIAHGGQCLSISVIQLWIFAQWQMVVILPKENLVVWFCSLHHRPDNYLKGIINMSVFFFNTFALPLVSNINILMCLVFNSALKEVDATPQPKSKVVVGARWIVVKLTLNI

SEQ ID NO: 142414 - protein, 192 aa, Glycine max
  Coding DNA Sequence Number=SeqID_25636
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=72%, HitCoverage=8%, E-value=1e-44, Identity=57%"; Hit description=Chromo
MVDNTRMKELTGDVKRILEMMENRNKEYAARFETLETTLEMTLKDKLEILGVRNVKIDFPILDGSDVLQWIFKAEQFFNYHKTPGEQRLIIASIHLDKEVVPCYQMMTRENSFKTWIAFTRALETEFGPSPYECPRSQLFKLAQIGSVQSYYVQFTALANRVQGITQEALLDCFVGGLKPDIRRDVIAQSPT

SEQ ID NO: 142415 - protein, 288 aa, Glycine max
  Coding DNA Sequence Number=SeqID_25637
  Homolog annotation: Hit_ID=Q8GFU1; Match level="QueryCoverage=29%, HitCoverage=58%, E-value=3e-10, Identity=40%"; Hit description=KlcA
  Pfam annotation: Domain name=Antirestrict; Domain location=28-131; Score=57.2; E_value=5.5e-14; Accession=PF03230.4; Description =Antirestriction protein
  Pfam annotation: Domain name=DUF1380; Domain location=115-244; Score=- 29.1; E_value=0.007; Accession=PF07128.2; Description=Protein of unknown function (DUF1380)
  Pfam module annotation: Pfam domain module=Antirestrict::DUF1380; Domain location=28-131::115-244
PERLSTLTTEVSDEHSTARAPAGANPGRDYDGGVWEFAQLPGGGGFMKPEGEARWHFSNPGNYSELDVSAEAAGIIITALVLNHRSWMYDRHDEEELCAHYCERHRQLMNYADMMHGTVKEISTRLTELFDEENPLSVLIWTMDDVMNAAECMDITEREAGWVLSFIADEGDHRRYGIGREAVRDMLNNLREEEREEMREVSVPAGALAAVLSVAEDFMRLKDAQAGPGAGARHWPVENEAMKTSTATATATARATFGFPASPMSLSGKAAKRHRTPAGFGRERFRAD

SEQ ID NO: 142416 - protein, 143 aa, Glycine max
  Coding DNA Sequence Number=SeqID_25638
  Gene Ontology: Mol. function=RNA-directed DNA polymerase activity; Biological process=RNA-dependent DNA replication
  Homolog annotation: Hit_ID=Q1T5Q8; Match level="QueryCoverage=96%, HitCoverage=25%, E-value=5e-26, Identity=37%"; Hit description=RNA -directed DNA polymerase
MGENLYKGFQVGSNKVEISILQYADDTIFFGEASMMNVKTIKAMLRIFELVSRLKINFVKSSFGAFGTTDQWKINAASYLNCSLLSIPFIYLGILIGANPRAWQMWDPILKKVPKRVADKLASLQRQFLWGGDADHNKIAWVK

SEQ ID NO: 142417 - protein, 59 aa, Glycine max
  Coding DNA Sequence Number=SeqID_25639
MVVESILEHRATMGQGIGVQDIEGKLIQPQSRDDWVWKADPSGQYSVKSAYNMMKREAA

SEQ ID NO: 142418 - protein, 141 aa, Glycine max
  Coding DNA Sequence Number=SeqID_25640
MEPPMLGGEEECHSNESGWTMYIGSPRDEDAQHCDDDDHHHHSFLEEDYDYESAAAAAQHCDVESDDSMASDASSGPSKSKEQVNKKDNKYYCSEKKVEKKNEIMAFNSKEKAPAAVHQNDSKVKDLLWNAVEITDNRLIA

SEQ ID NO: 142419 - protein, 111 aa, Glycine max
  Coding DNA Sequence Number=SeqID_25641
  Gene Ontology: Mol. function=methyltransferase activity; Cellular component=nucleus; Biological process=fatty acid biosynthetic process
  Homolog annotation: Hit_ID=Q2HRW2; Match level="QueryCoverage=56%, HitCoverage=17%, E-value=5e-15, Identity=64%"; Hit description=SAM dependent carboxyl methyltransferase
  Pfam annotation: Domain name=Methyltransf_7; Domain location=2-109; Score=-172.6; E_value=0.00011; Accession=PF03492.6; Description=SAM dependent carboxyl methyltransferase
MKLYHDSSPNCMKVADLGCSVGPHALLVISNITNIVDTTCTILNCEPPTFQFYLIDLFGNDFNTIFKSLPDFYTRLVEVGEGLSGEEKREVKSEILRIMKEASHSLKQSLP

SEQ ID NO: 142420 - protein, 71 aa, Glycine max
  Coding DNA Sequence Number=SeqID_25642
MLIVRMLSILLQVFWYPEMMICGGLDQLLMKTDRFEELKRSLLVDGLSMVYLKDCCPLPPLALLWSGDCHP

SEQ ID NO: 142421 - protein, 347 aa, Glycine max
  Coding DNA Sequence Number=SeqID_25643
  Gene Ontology: Mol. function=nucleic acid binding
  Homolog annotation: Hit_ID=Q1SN43; Match level="QueryCoverage=90%, HitCoverage=61%, E-value=8e-17, Identity=23%"; Hit description =Nucleic acid-binding, OB-fold, subgroup
  Pfam annotation: Domain name=DUF223; Domain location=39-135; Score= -1.5; E_value=0.004; Accession=PF02721.5; Description=Domain of unknown function DUF223
MSRKENLISELHTRKGTWKIVVRITDLWQARKQNSKQTIEMVLMDQTGSKIGATLWQELFTELRDKLQCGSSYLIQNLRIVDNQSEYRVSPAPYLVYFLKTTSVKEIHCPEIPSNIYLITPFTDIIFGLAQRHTLVDIVGVVADLIDVKTVNPPYRMTVRLRDNSNCDILITVWEDYAIQLHDAIDKNLLLQEPLVVMLTLGKIKDATEIHEFCQSLPVPFYSSGMINDKDDSQSQSSQSNVVEKFLQNAQVVSIGEINNLRQGCYCLTVGTVDEIIIDAPWSYDSCPNCKTTFDPSKGGSACRSCHTSVVDTVPRMKHNGDKGNSFSRMQHVSSCLVKLLENVEMS

SEQ ID NO: 142422 - protein, 202 aa, Glycine max
  Coding DNA Sequence Number=SeqID_25644
  Gene Ontology: Mol. function=transition metal ion binding; Cellular component=nucleus; Biological process=protein amino acid phosphorylation
  Pfam annotation: Domain name=Transposase_21; Domain location=1-102; Score=-5.2; E_value=3.7e-14; Accession=PF02992.5; Description =Transposase family tnp2
MKRKYMMLSMMISSPRQPRNDIDVYLSQLIEDLTKLWDNGVLVFDVFCKETFQMRAMLFCTINDFPAYGNLSGYSVKGHHKNVCDSVIGTLLNIQGKTKYGLDTRQDLADMGIQSQLHPSKVVDPVKFDDLENEAAIILCQLEIYCPSAFFDIMIHLIVHLVREIKCCGPVYLRWMYPIEQYMKILKGYTKNLHRPEASIVE

SEQ ID NO: 142423 - protein, 955 aa, Glycine max
  Coding DNA Sequence Number=SeqID_25645
  Gene Ontology: Mol. function=hydrolase activity; Cellular component =intracellular; Biological process=metabolic process
  Homolog annotation: Hit_ID=Q5FAL7; Match level="QueryCoverage=92%, HitCoverage=95%, E-value=0.0, Identity=51%"; Hit description =Putative Putative Pentatricopeptide (PPR) repeat-containing protein
  Pfam annotation: Domain name=PPR; Domain location=160-194; Score =16.5; E_value=0.082; Accession=PF01535.11; Description=PPR repeat
  Pfam annotation: Domain name=PPR; Domain location=231-265; Score =16.7; E_value=0.077; Accession=PF01535.11; Description=PPR repeat
  Pfam annotation: Domain name=PPR; Domain location=366-399; Score =32.7; E_value=1.2e-06; Accession=PF01535.11; Description=PPR repeat
  Pfam annotation: Domain name=PPR; Domain location=468-502; Score =33.8; E_value=6.2e-07; Accession=PF01535.11; Description=PPR repeat
  Pfam annotation: Domain name=PPR; Domain location=503-537; Score =12.2; E_value=0.26; Accession=PF01535.11; Description=PPR repeat
  Pfam annotation: Domain name=PPR; Domain location=569-603; Score =37.5; E_value=4.7e-08; Accession=PF01535.11; Description=PPR repeat
  Pfam annotation: Domain name=PPR; Domain location=670-704; Score =38.5; E_value=2.3e-08; Accession=PF01535.11; Description=PPR repeat
  Pfam annotation: Domain name=PPR; Domain location=705-739; Score=1.2; E_value=5.3; Accession=PF01535.11; Description=PPR repeat
  Pfam annotation: Domain name=PPR; Domain location=741-775; Score=9.5; E_value=0.56; Accession=PF01535.11; Description=PPR repeat
  Pfam annotation: Domain name=PPR; Domain location=807-841; Score =16.8; E_value=0.077; Accession=PF01535.11; Description=PPR repeat
  Pfam module annotation: Pfam domain module=PPR::PPR::PPR::PPR::PPR::PP R::PPR::PPR::PPR::PPR; Domain location=160-194::231-265::366-399::468- 502::503-537::569-603::670-704::705-739::741-775::807-841
  Subcellular localization annotation: CTP_CleavageSite=10; ConfidenceScore=5.54e-01
MASVAAPPVSCQHYHKLTFHNRNTWTRNHNNSNNLFPPFTVPKSSLTSHTKTHSPILQRLHNLCDSGNLNDALNLLHSHAQNGTVSSSDISKEAIGILLRACGHHKNIHVGRKVHALVSASHKLRNDVVLSTRIIAMYSACGSPSDSRGVFDAAKEKDLFLYNALLSGYSRNALFRDAISLFLELLSATDLAPDNFTLPCVAKACAGVADVELGEAVHALALKAGGFSDAFVGNALIAMYGKCGFVESAVKVFETMRNRNLVSWNSVMYACSENGGFGECCGVFKRLLISEEEGLVPDVATMVTVIPACAAVGEVRMGMVVHGLAFKLGITEEVTVNNSLVDMYSKCGYLGEARALFDMNGGKNVVSWNTIIWGYSKEGDFRGVFELLQEMQREEKVRVNEVTVLNVLPACSGEHQLLSLKEIHGYAFRHGFLKDELVANAFVAAYAKCSSLDCAERVFCGMEGKTVSSWNALIGAHAQNGFPGKSLDLFLVMMDSGMDPDRFTIGSLLLACARLKFLRCGKEIHGFMLRNGLELDEFIGISLMSLYIQCSSMLLGKLIFDKMENKSLVCWNVMITGFSQNELPCEALDTFRQMLSGGIKPQEIAVTGVLGACSQVSALRLGKEVHSFALKAHLSEDAFVTCALIDMYAKCGCMEQSQNIFDRVNEKDEAVWNVIIAGYGIHGHGLKAIELFELMQNKGGRPDSFTFLGVLIACNHAGLVTEGLKYLGQMQNLYGVKPKLEHYACVVDMLGRAGQLTEALKLVNEMPDEPDSGIWSSLLSSCRNYGDLEIGEEVSKKLLELEPNKAENYVLLSNLYAGLGKWDEVRKVRQRMKENGLHKDAGCSWIEIGGMVYRFLVSDGSLSESKKIQQTWIKLEKKISKIGYKPDTSCVLHELEEEGKIKILKSHSEKLAISFGLLNTAKGTTSAFIISKTDCVPVEISGSWGTMLVFNDYFQ

SEQ ID NO: 142424 - protein, 121 aa, Glycine max
  Coding DNA Sequence Number=SeqID_25646
  Gene Ontology: Mol. function=signal peptidase activity; Cellular component=integral to membrane; Biological process=signal peptide processing
  Homolog annotation: Hit_ID=Q9SEL8; Match level="QueryCoverage=89%, HitCoverage=16%, E-value=2e-32, Identity=65%"; Hit description =Putative protease SppA
MEEFAQGRVWTGNDAASRGLVDAIGGLSRAIAIAKMKADIPQDRQVTLVEMSRANPSLPEILLGVGSSLVVADRTVKELLQGLTFSYGVQARMDGILFQTLEEYPFGNPILSIIKDIISSL

SEQ ID NO: 142425 - protein, 132 aa, Glycine max
  Coding DNA Sequence Number=SeqID_25647
MEEKRERLPDMWSDAHSQAPKDPKPRLQPMKACSCDRCSPMNKAHLETEGCNSNVTLVGDASRVVYVNFSYRKRALRGVVVATDKRVTHWLPNKPNSGHGYSSPTKKVAHRHVFVGDIGEHHSGKWILKESR

SEQ ID NO: 142426 - protein, 321 aa, Glycine max
  Coding DNA Sequence Number=SeqID_25648
  Gene Ontology: Mol. function=signal peptidase activity; Cellular component=integral to membrane; Biological process=signal peptide processing
  Homolog annotation: Hit_ID=Q9SEL8; Match level="QueryCoverage=87%, HitCoverage=40%, E-value=1e-92, Identity=61%"; Hit description =Putative protease SppA
  Pfam annotation: Domain name=Peptidase_S49; Domain location=197-321; Score=-0.3; E_value=3.2e-06; Accession=PF01343.9; Description =Peptidase family S49
  Subcellular localization annotation: CTP_CleavageSite=34; ConfidenceScore=5.76e-01
MSNLLFLPSPPLTPSSIHPSHTSSSASALQFQCRFSLLSRPRRHSPTLTPFHRRRDLSLLVFGSDSPSDAKTEEQVKENEDGVDDPSGSVIEDEDYPSGEFDFEPITGWRSFLVKLKMLVAFPWERVRKGSVLTMKLHGQVSDQVKSRFSPGLSLPQICENFLKAAYDPRISGIYLHIDSLNCGWGKVEEIRRHILDFKKSGKFVLAYVPLCQEKEYYLASACEEIYAPPSAYFSLFGLTVQASFLRGILENIGIEPQVERIGKYKSAGDQLARRTMSEENCEMLTTLLDNIYTNWLDKVSSAKGKTREDIENFINEGVYQ

SEQ ID NO: 142427 - protein, 134 aa, Glycine max
  Coding DNA Sequence Number=SeqID_25649
MGCLAEARPGTNKVTDLMNSSPQQQHQLNTDHIGRGPTQKESHAQPCGSKAQIANHEADSANIQRVEATALWDVAKEMGVTCGSAQRDFVEKLMELEERDKKEAERLRNRRKVVEVPWVGRKFTWFRLNGSARS

SEQ ID NO: 142428 - protein, 132 aa, Glycine max
  Coding DNA Sequence Number=SeqID_25650
  Gene Ontology: Mol. function=DNA binding; Cellular component=nucleus; Biological process=regulation of transcription, DNA-dependent
  Homolog annotation: Hit_ID=Q2LAJ4; Match level="QueryCoverage=62%, HitCoverage=14%, E-value=6e-21, Identity=51%"; Hit description=Auxin response factor 3
MKLDIEDATEDMGGDVGRGRERKIVKVLLQVSLREVHDNTPFLGQGNQWTRAGVPELEAHGGGGARRRHFIVFGCVVEIDETSHEEKNEKEEGRRERSKEERVVRLLFFMPPAAAAAAFSESVTNFGIAKRS

SEQ ID NO: 142429 - protein, 216 aa, Glycine max
  Coding DNA Sequence Number=SeqID_25651
  Gene Ontology: Mol. function=translation elongation factor activity; Cellular component=mitochondrion; Biological process=translational elongation
  Homolog annotation: Hit_ID=Q1RWS0; Match level="QueryCoverage=95%, HitCoverage=36%, E-value=3e-89, Identity=81%"; Hit description =Translation factor; Elongation factor G, III and V
  Pfam annotation: Domain name=EFG_C; Domain location=100-205; Score =104.7; E_value=2.8e-28; Accession=PF00679.14; Description=Elongation factor G C-terminus
  Pfam annotation: Domain name=EFG_IV; Domain location=1-98; Score =69.7; E_value=9.5e-18; Accession=PF03764.8; Description=Elongation factor G, domain IV
  Pfam module annotation: Pfam domain module=EFG_C::EFG_IV; Domain location=100-205::1-98
MELFTLLPIEYIEPLPAGSSTKFAFENLLVGQAIPSNFIPAIEKGFKEAANSGALIGHPVENLRVVLTDGAAHAVDSSELAFKLASIYAFRQCYAASRPVILEPVMLVELKVPTEFQGAVAGDINKRKGVIVGNDQEGDDSVITAHLVMVDLWRNNSSLIPLDEVPLNNMFGYSTALRSMTQGKGEFTMEYKEHLPVSHDVQTQLINTYKGNKEGE

SEQ ID NO: 142430 - protein, 445 aa, Glycine max
  Coding DNA Sequence Number=SeqID_25652
  Homolog annotation: Hit_ID=Q1SRP4; Match level="QueryCoverage=16%, HitCoverage=16%, E-value=5e-17, Identity=60%"; Hit description =Integrase, catalytic region
  Subcellular localization annotation: CTP_CleavageSite=54; ConfidenceScore=5.19e-01
MVDREEVVVETIPVHIAFMSYGKRFGHTKDQRRTKANQQAKTVTVVRNSNMVSRACTVSSVTFSGVNKLSQLLSLIVFNDSSSIRKVGQDFSLKKIMKLALRIMSMKSLEQQDQVLLTWLQSTLSTSILSQVLGSAHSYELRTQLQSTRLAEKSMHEHLSQIKAIVDSLASVEALLLDHESHLNKFKQSLVDSPSVNNTHTQPVPNKQEPERFFSFRGRSSLGGCFGSGFNCNGGRQGGANSGASNSGRGRESFANYQCQVTNEVLLQGKVGPDGLCSFSNIQFQSPVSASSGFACISSSDKSSATSCISSTKSNLPSSSESVYTSLELVYSDLWGPSHVTSTNGLLYHITFVDAFSRFTWIYLLKSKAESLTVFQKFKTIAELQFNSKIVFKLIEEQKSSSIIYNSVLEVLRRTAYDYNGKTMPNPTTLEQNTQQLKKKDNNNP

SEQ ID NO: 142431 - protein, 317 aa, Glycine max
  Coding DNA Sequence Number=SeqID_25653
  Gene Ontology: Mol. function=nucleic acid binding; Cellular component= nuclear pore; Biological process=DNA integration
MTEAQSISSPMASSCKLTKIGSDLFSDPTLYRSVIGAFQYLIITRPELSYSVNKVCQFMANLLESHWVAVKRILRYLKGTVLHGLHLRPAILGQSYFIRVLCDADWESHVDDRRLTSVAAVYLGPHLISWWSCKQQVVARSSTEAEYRSLAQITAKISWTQTLLTELKVPFSTPIVSCDNQSAVAIAHNLVFHAKTKHMELDLFFVRAKVLTKQLIVQHVQALDQRADALTKPLSPTRSAFLRTKLMLRLLQSLNHLEFEGGSINTRLYYTVKWLNIIFHSLLILSFLSKYLSYDSVRIIIAGQSLGKGKEKMGNGS

SEQ ID NO: 142432 - protein, 144 aa, Glycine max
  Coding DNA Sequence Number=SeqID_25654
  Subcellular localization annotation: CTP_CleavageSite=28; ConfidenceScore=5.37e-01
MEFSMSPGIFNESKFPYVDMFENSTPVSQSTSSSIPFQFPSIPIVQSPNLSQPTSTPSQPTQTHISSTSVHSHSSDADHSPSVSAQSSPIHQPAQSKIEIPTSNPTQLSEHNTTDQSPPITDVSVPEKKPIFLNSCPTETIFEI

SEQ ID NO: 142433 - protein, 147 aa, Glycine max
  Coding DNA Sequence Number=SeqID_25655
  Gene Ontology: Mol. function=translation elongation factor activity; Cellular component=mitochondrion; Biological process=translational elongation
  Homolog annotation: Hit_ID=Q9C641; Match level="QueryCoverage=75%, HitCoverage=15%, E-value=7e-49, Identity=84%"; Hit description =Probable elongation factor G, mitochondrial precursor
  Pfam annotation: Domain name=GTP_EFTU; Domain location=60-147; Score=- 50.4; E_value=0.0014; Accession=PF00009.17; Description=Elongation factor Tu GTP binding domain
  Subcellular localization annotation: CTP_CleavageSite=17; ConfidenceScore=5.12e-01
MARVSRSSPPRLLYSLCCTTASRSPASSLIGGAFHLRHFSAGNAARTKPDKEPWWKESMERLRNIGISAHIDSGKTTLTERVLYYTGRIHEIHEVRGRDGVGAKMDSMDLEREKGITIQSAATYCTWKDYKFNKHALRHGGNEVLKK

SEQ ID NO: 142434 - protein, 273 aa, Glycine max
  Coding DNA Sequence Number=SeqID_25656
  Homolog annotation: Hit_ID=Q10RZ3; Match level="QueryCoverage=33%, HitCoverage=56%, E-value=7e-38, Identity=84%"; Hit description=60S ribosomal protein L21, putative, expressed
MASNSDSILIVDFCCSLACTVDFGFKVGNRIIRKRIHVRVEHVMPSRCTEEFRLRKIKNDQLKAEVKAKGEKISTKRQPQGPKPGFMVEGATLETVTPIPYDVVNDLKGEGKLKGGINQEGVKYYNSLINELIANAAEPIAGYALGLLLLLLGFMLPPSDGIGVVVDASVFHESFLDGGIGGHCKEVRAHKVLKVVNFSPLGDDTYLSVSNVTLGFDVDKYTSLAFGFSKSSLKNVQDAQGTMVIKGNLVVRGLGETQQDYSYTSDGYFYSRK

SEQ ID NO: 142435 - protein, 487 aa, Glycine max
  Coding DNA Sequence Number=SeqID_25657
  Gene Ontology: Mol. function=hydrolase activity, acting on glycosyl bonds; Cellular component=cellular_component; Biological process =carbohydrate metabolic process
  Homolog annotation: Hit_ID=O82019; Match level="QueryCoverage=71%, HitCoverage=88%, E-value=1e-144, Identity=69%"; Hit description =Polygalacturonase precursor
  Pfam annotation: Domain name=Glyco_hydro_28; Domain location=148-487; Score=505.9; E_value=4.7e-149; Accession=PF00295.8; Description =Glycosyl hydrolases family 28
MLQMFRDCNVHDSLREMHARVLTDGSTLFIVFTTTTLDLVVAREFLQLHMLEFQCGGCRATLEEVGSAPSFPFCFRSCSLTVEDFCFAQTAPMFGKVGGMASGMADPGASRWKNLLRACCHVGRATVSVFHDSLDMEMACLSAWTQACASTTAVKIVIPAGTYQMGAVDVKGPCKAPIEVQVDGTIQAPTNVVNLKGADQWLKVQHVNSFTLSGKGVFDGQGPTAWKQNDCTTNKNCKMLCMNFGFNFLNNSIVRDLTSKDSKNFHVNVLGCNNMTFDGFKISAPAESPNTDGIHIGRSTDVKVLNTNIATGDDCISLGDGNKNITVQNVNCGPGHGISVGSLGRYDNEEAVEGLLVKNCTLNNTDNGLRIKTWPSTPLTITVTDMHFEDITMENVSNPVIIDQEYCPWNQCSKKNPSKIKISKVSFKNIKGTSGTKEGVIFICSSVAPCEGVEMTDVDLTFNGAATTAKCANVKPVITGKAPTCAA

SEQ ID NO: 142436 - protein, 45 aa, Glycine max
  Coding DNA Sequence Number=SeqID_25658
  Homolog annotation: Hit_ID=P38417; Match level="QueryCoverage=87%, HitCoverage=4%, E-value=4e-14, Identity=85%"; Hit description =Lipoxygenase-4
GGIETNADGIIEKPFLWGRYALEMSVVVYKDWVFTDQAFPNDLVK

SEQ ID NO: 142437 - protein, 43 aa, Glycine max
  Coding DNA Sequence Number=SeqID_25659
VDGGGEEIDVDLLKQPDLVELDEDGCILGVNEIESDFDDTNTS

SEQ ID NO: 142438 - protein, 44 aa, Glycine max
  Coding DNA Sequence Number=SeqID_25660
MRSCFEDLDWFEDLVDFVDIGESCQVYVVFVFMGALRVNSTPDT

SEQ ID NO: 142439 - protein, 99 aa, Glycine max
  Coding DNA Sequence Number=SeqID_25661
  Gene Ontology: Mol. function=nucleic acid binding; Biological process= RNA-dependent DNA replication
KSLPFKNKDPGSFTIPCSIGNLSVGKALSDWRASISLIPLLMLSKVGYVEIKPTRMTHQLANRLIKVPYGVVEDVLVKVDKFVSWIKNLEGWEINSSTF

SEQ ID NO: 142440 - protein, 128 aa, Glycine max
  Coding DNA Sequence Number=SeqID_25662
MDSSSSSGTGYWAAEALPPPEGEGWTPGQATWLMNLSILMIGCRPELYRLCSMASKVLELNAEGPEETRAEAGAGKDETRADGAVVEVEEAEVGRAEDGGALDLLPLAFWGPRKVTEGSSRFQQFFFT

SEQ ID NO: 142441 - protein, 296 aa, Glycine max
  Coding DNA Sequence Number=SeqID_25663
  Gene Ontology: Mol. function=transposase activity; Cellular component= membrane; Biological process=transposition, DNA-mediated
  Homolog annotation: Hit_ID=Q1SUE7; Match level="QueryCoverage=74%, HitCoverage=65%, E-value=2e-57, Identity=48%"; Hit description =Transposase, IS4
MVDMSLNSSDDSSSSIDSELDDYDDLMNLVLVMTIMECEQSFIDKTPCRTSMLTGKVYTREFLVGHETRCYENFRMKKDVFMKFCESLKEVGNLCDGKKVSIEEAVAMFLIRICHNLRHWVVTERFQHSLHTVNKWFWIILKAVCKLGTGIIHQINQTSTHPHIRGNPKYYLYFKDCIGAIDGTHVSSWARASKQTAFHGRKVLVTQNVLTVCDFDMLFTFVYSGWEGTTNDSKVFLDALSPENNFPKPNGDQFYLVDSGFPNMPSYLAPFRRNKYHLRDFREGCGRPRGKEELFN

SEQ ID NO: 142442 - protein, 63 aa, Glycine max
  Coding DNA Sequence Number=SeqID_25664
MKKILGLQAPMELTSQAVKGSQQVLDYFIKQASAKHNTHWLSARKNLEEDELYRFAERTASSY

SEQ ID NO: 142443 - protein, 285 aa, Glycine max
  Coding DNA Sequence Number=SeqID_25665
  Homolog annotation: Hit_ID=Q1SE34; Match level="QueryCoverage=96%, HitCoverage=40%, E-value=4e-21, Identity=27%"; Hit description =Cyclin-like F-box; tRNA-binding arm
MGGKNEKGEVMEWSVVNTKTFIEKFYERVKNGQLQGSIFKTTTWEEINKDLFEMIQTNYGVDKLKSKFNRLRQMHRDFSTLLARTRVTWEMESNEGNAPDEVWDELIKKGIHYKNFKKHGFEYDYDILEPPNSDEERAMEVDFLTNGIHINVSDDEKDDIKGLRHKMKEIFSSGERHRKEGKTSNKEMLDKIVSIWSDSMSQRTTTSRAREERYKGKTSQASQATNPISDPYSAKACVELLYNMQDVPTSAYFKLMEKFTSQHWRQMFIVMDAKRRKQLIESLTK

SEQ ID NO: 142444 - protein, 177 aa, Glycine max
  Coding DNA Sequence Number=SeqID_25666
  Homolog annotation: Hit_ID=Q1T0Y0; Match level="QueryCoverage=82%, HitCoverage=16%, E-value=3e-14, Identity=33%"; Hit description =Ovarian tumour, otubain
MDKGQWMYDSIMSKEVDMDDENEHESSVNEEQHVDCLDAFNTSQVFTTRDDVLPWADENRFVAVIMRSNTHWVHGKPMVRGQGWMLKLMCESHNHELTKLLVGHPYVGRLTKDEKKIIADMTKSMMKPRNILLTLKEHNANSCTTIKQIYNARNAYRSSIRRSDSEMPHLMKFLERD

SEQ ID NO: 142445 - protein, 444 aa, Glycine max
  Coding DNA Sequence Number=SeqID_25667
  Gene Ontology: Mol. function=ATP binding; Cellular component =phagocytic vesicle; Biological process=response to heat
  Homolog annotation: Hit_ID=Q1SF16; Match level="QueryCoverage=70%, HitCoverage=60%, E-value=1e-102, Identity=55%"; Hit description=Heat shock protein Hsp70
  Pfam annotation: Domain name=HSP70; Domain location=69-444; Score =154.7; E_value=2.4e-43; Accession=PF00012.10; Description=Hsp70 protein
MRASRGAAVKLCLGDLLVMSSNPETASLHMQGQGCVQYPSPIPSHSEEPLGNGYSFTSNSMAKEGHRIAIGINLGTTYSCVAVWREHHRRVEIIHNDQGNTRSEATVGQAVMAFKVVAGTNDKPMIILNYKEAFLEKHAKNEVVTVPAYFNDSQYKATIDAGKIAGLNILRIINEPVAAAIMHGLDMRTNNCVGERNIFIFDLGGGTFDASLLTLKGKIFKVKATAGNGHLGGEDIDNRMLDHFVKEIKRKKKVDISGNLKVLRRLKTTCERAKRTLSHAVTTNIEVDALSDAIDFCSSITRAKFEEINMELFKECMETVDKCLTDSKMNKSSVHDVILVVVLQGFPKCKSYCRTFPTERICERASTLMKLLSREEINRMIQEAEEYQAEDKKFLRKATAMNKLNDYVNKMNNGLENENLSSKLCSEDKEKISSAITKATKLID

SEQ ID NO: 142446 - protein, 147 aa, Glycine max
  Coding DNA Sequence Number=SeqID_25668
  Gene Ontology: Mol. function=hydrolase activity; Cellular component =cytoplasm; Biological process=negative regulation of progression through cell cycle
  Homolog annotation: Hit_ID=Q5YJN3; Match level="QueryCoverage=98%, HitCoverage=78%, E-value=1e-47, Identity=64%"; Hit description =Diadenosine tetraphosphate hydrolase
  Pfam annotation: Domain name=HIT; Domain location=14-98; Score=60.3; E_value=6.5e-15; Accession=PF01230.13; Description=HIT domain
MAAEDYTFGPYKIHHTEVFYSTNLSYAMVNLRPLLPVKRFVDLTADETSDLWLTAQKVGKQLESYHKASSLTLAIQDGPQAGQMVPHVHIHLIPRKSGDFEKNDEIYDAIDEKEKELKQKLDLDKERKDRSLEDMSQEADEYRKLFL

SEQ ID NO: 142447 - protein, 41 aa, Glycine max
  Coding DNA Sequence Number=SeqID_25669
MENWRKALAKDIRGAPDSKRYARTSRGSRLEGGGHMNSARQ

SEQ ID NO: 142448 - protein, 61 aa, Glycine max
  Coding DNA Sequence Number=SeqID_25670
MNEEVQVHYAISKIDLKWDPHGASQHRVKVILATDKFHILLSSTYESANTWLSAKEQFVWP

SEQ ID NO: 142449 - protein, 55 aa, Glycine max
  Coding DNA Sequence Number=SeqID_25671
MSTYVRLVDQTISLNVLVESRSARRPVVSDLVLESSVSARSQLASLSGWPFYLTK

SEQ ID NO: 142450 - protein, 308 aa, Glycine max
  Coding DNA Sequence Number=SeqID_25672
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=96%, HitCoverage=25%, E-value=4e-93, Identity=50%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MGYVRCISEHGVYVKSGGGDIVILCLYVDDLLVTGNNETKKKYVSDVLKRFNMQHCNGAATPAEAGLWLDKNVDEPEVDATEFRQVVGALRYLCNTRPDIAFSVGLISRVMDRPRTSHLAAAKRILRYVKDTMAYGILLPSKCRENEKGLYGFTDADWGGDKTDRKSTAGSVFLLGSGPISWSSKKESVVALSSCEAEYIAASMGGCQAIWLDNLMQELMIKKESVVELFVDNKSAISLAKHPVAHGRSKHIETRYHFLRDQVTKGRLKLSYCRTDMQVADIFTKAVKRETFKKLRNILNVVDCNEFV

SEQ ID NO: 142451 - protein, 111 aa, Glycine max
  Coding DNA Sequence Number=SeqID_25673
ASTFNFERLDILQDSIRHPRKKLLSFELAQRGSTFNFERLDMLRIKLIDTVDLEGGPVGKPVVPAALMNRPTRGERRFAYWALAECILAYYVGTDEGVSEVLHVAGEKRLH

SEQ ID NO: 142452 - protein, 62 aa, Glycine max
  Coding DNA Sequence Number=SeqID_25674
  Gene Ontology: Mol. function=protein binding; Cellular component=cis -Golgi network; Biological process=ER to Golgi vesicle-mediated transport
  Homolog annotation: Hit_ID=Q84NS9; Match level="QueryCoverage=79%, HitCoverage=34%, E-value=8e-18, Identity=84%"; Hit description =Synbindin-like protein
  Pfam annotation: Domain name=Sybindin; Domain location=1-62; Score= -29.0; E_value=5.1e-06; Accession=PF04099.3; Description=Sybindin -like family
MDTNDSLRVASLWHSMHAISQQLSPVSGCLGIELLQADTFDLHCFQSLTGSSRMTRFQLNMV

SEQ ID NO: 142453 - protein, 678 aa, Glycine max
  Coding DNA Sequence Number=SeqID_25675
  Gene Ontology: Mol. function=ubiquitin-protein ligase activity; Cellular component=ubiquitin ligase complex; Biological process =protein ubiquitination
  Homolog annotation: Hit_ID=Q84TU4; Match level="QueryCoverage=78%, HitCoverage=58%, E-value=3e-99, Identity=44%"; Hit description=Arm repeat-containing protein
  Pfam annotation: Domain name=U-box; Domain location=396-470; Score =97.1; E_value=5.4e-26; Accession=PF04564.6; Description=U-box domain
MADETRKRLGFLLGEKGVGPAPKLAHSYEHQQNHRTGEKKRSNRPKNYNEAMREKMGGRLVEEEKCWIIQSNKLARGSDHKSLHSKEEGGICLTFPTSYYSGSWYPCALGFPLDKTHIHEPFLLSFTDVMYKKSKLPPGVMEISLLKMIVNGMSSFLHLSFSGNMNSEPVSKYYQKAEEIHKLLKPIIDAIVNPELASDEVLNKILEEIGFAVNELKEHVENWHLLSSKVYFLSGFTFGKPKVQDPNDSEDMMVMQVEPLISRIRTSGLNIFQQLKDSQHCLPDELSSEYLQLCSQKLKLLGHEEISPVIKEAITEHLENVGPSSELLTKIADSLGLRSNQEVLIEAVALERLKENAEQTEKTAEAEFIDQMIAVVTRMHERLVMLKQAQSSSPVSIPADFCCPLSLELMTDPVIVASGQTYERAFIKNWIDLGLTVCPKTRQTLVHTHLIPNYTVKALIANWCESNNVQLVDPTKSTNLNQASVLHGYMESGTTRESPVFAHSRSNQPSSPESARSCSFSSPANNLTSGGTQREGTSPLHPRSTSEGSFRGMVNGQYMDLARISPEGLDDRSASSDESSVDSASHPSMSPSRRESSSAFSSEQSQTHIRAVSDSSALSNANFPQETQDDDNNAPQLSTSAGHSREASGELNPGTETGGTTAVPSVHREPEFPLRLET

SEQ ID NO: 142454 - protein, 67 aa, Glycine max
  Coding DNA Sequence Number=SeqID_25676
MSSKVGLVLMSLPSIKLELNVTSTKYDVPNQFYVIDLCSGQIDKNQQIENIKLKKYINIFTFIDKLI

SEQ ID NO: 142455 - protein, 113 aa, Glycine max
  Coding DNA Sequence Number=SeqID_25677
  Gene Ontology: Mol. function=nuclease activity; Cellular component =intracellular; Biological process=DNA repair
  Homolog annotation: Hit_ID=Q8BX32; Match level="QueryCoverage=90%, HitCoverage=35%, E-value=5e-15, Identity=49%"; Hit description=ES cells cDNA, RIKEN full-length enriched library, clone:C330006M04 product:inferred: ...
  Homolog annotation: Hit description=Unknown (protein for MGC:2532) (Homo sapiens), full insert sequence
MFPCKQFQIHSESEAPDQATQWGDWVWSLENEEEEALGDGFVYLWLPNKCLCSSGLNLILLSFEWAWQHPVESLAVRKAAVEFKSLSGIANKIKLAYTMLTLPSWQRYGLYLY

SEQ ID NO: 142456 - protein, 123 aa, Glycine max
  Coding DNA Sequence Number=SeqID_25678
GSQYLLYAFPSDFPERGRIANGRTVGWACLYDSPKRKSTITDRLKGMDRTIDVRPRPSQYHVHHPDRTEAIVITSPKTTIDWQDTAREQKESGGEAYASMPTAPTLYYWWLIGPFAYPVFWLA

SEQ ID NO: 142457 - protein, 156 aa, Glycine max
  Coding DNA Sequence Number=SeqID_25679
  Homolog annotation: Hit_ID=Q1SWX1; Match level="QueryCoverage=57%, HitCoverage=17%, E-value=1e-11, Identity=37%"; Hit description=IMP dehydrogenase/GMP reductase
MGTNQTGKRFYQVKVKGLDTTSIKELGRLMEPLQMQAFRKTYGKILELTIAEVSVEAIASLTQYYDQPLRCFTFGDFQLVPTIEEFEEILGCPLEGRKPYLSSGCLPSLSRIATVVKDSARGAKRVAHGSSVAYPPSVFGWFHTCSNKTQDIHVRS

SEQ ID NO: 142458 - protein, 149 aa, Glycine max
  Coding DNA Sequence Number=SeqID_25680
  Homolog annotation: Hit_ID=Q1T493; Match level="QueryCoverage=91%, HitCoverage=25%, E-value=9e-17, Identity=35%"; Hit description =Nucleic acid-binding, OB-fold, subgroup
VTVVRECVLGDIPFRKYRFVGFADVVVGQFEHGLLVDVIGLVEEVVFRQVSGKGRRVVFKLKDLSQQLLSCTLRDDYCLQFVNFLDDYEGDGPITVLLSHCRIKEAQGSYPASINNSLKASKLIINQPVMDIQEFNERYFLLAELGIEA

SEQ ID NO: 142459 - protein, 128 aa, Glycine max
  Coding DNA Sequence Number=SeqID_25681
MPPTRHPLDPDKSNRALGFSVLITGLCQLFRVPVTPSRRRVMHIGPHQGQVQIHECLYRFSLSQQGQGFAPFACPTPEQFGAEVTWPGDWPEAQAGEEPAGSPGEAEEARMDEDMTDLLGFLGGSGAT

SEQ ID NO: 142460 - protein, 155 aa, Glycine max
  Coding DNA Sequence Number=SeqID_25682
  Homolog annotation: Hit_ID=Q6CQF3; Match level="QueryCoverage=41%, HitCoverage=68%, E-value=7e-09, Identity=66%"; Hit description =Kluyveromyces lactis strain NRRL Y-1140 chromosome D of strain NRRL Y- 1140 of Kluyveromyces lactis
LSGAKPEETLVEARSDTDVQIVRLTWDGAAALLRPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHR

SEQ ID NO: 142461 - protein, 162 aa, Glycine max
  Coding DNA Sequence Number=SeqID_25683
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=10%, E-value=1e-58, Identity=68%"; Hit description=Chromo
MDQEKVQAVLNWPYPINLKQLRGFLGLTGYYRKFIKGYVSIATPLSNLLKKENFHWNDHTSMAFDNLKAAITKAPVLALPDFSKAFTLETDASGIGIRAVLSQEQHPIAFFSKNLTPRMQRQSAYIRESYAIIEAVAKFRHYLLGHRFVIKTDQRSLKSLTE

SEQ ID NO: 142462 - protein, 272 aa, Glycine max
  Coding DNA Sequence Number=SeqID_25684
  Gene Ontology: Mol. function=hydrolase activity
  Homolog annotation: Hit_ID=Q2K8D0; Match level="QueryCoverage=54%, HitCoverage=84%, E-value=2e-44, Identity=58%"; Hit description =Putative hydrolase protein, MutT/nudix family
CADGPCGGWRSHQFHAADPDRGATFPKAAGLKRPARHQSGRAMGRRYRLPIIPNRACRYLSNRIVAGPARSKAMAIIGHAEGRNARQMRLPSLTALTLLFPLRAKIDKKRLQFDITNAPGRLIRAHPFQQAFTAFLETGFRLRHLYLEYIDHAGNDIAIVEHLEIGIAANHILFHPAAHARLLPRLDCRRLVRLLAFHRPAARNDPASAGAGRDKEDFDILAIAGITEAKRGILLPESACEELFRNRSKLLEQCQCTSRAGFPAFLGGFHIR

SEQ ID NO: 142463 - protein, 215 aa, Glycine max
  Coding DNA Sequence Number=SeqID_25685
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=5e-28, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTTRPRLEWAACPRLQRAARLYRQRTIHPNLQRTAYRHPQRATCPHLQRTTRPRLKRAARPLLQMATRPHHQRTIRTHLQRTTRPRLQRTTRPHLQRASRPRLQRVTCPRRQRTICPRIYRTTRLRLQRTTRPHHHRATYPSLQRTTRPHLQRATHPRHQRTARPPLRRATRPHPLEDYTSSPSEDLPSSPSKNYTSSPLEDYRSSPSEVYTSLP

SEQ ID NO: 142464 - protein, 99 aa, Glycine max
  Coding DNA Sequence Number=SeqID_25686
  Gene Ontology: Mol. function=aspartate-tRNA ligase activity; Cellular component=cytoplasm; Biological process=tRNA aminoacylation for protein translation
  Homolog annotation: Hit_ID=UPI000068BFB0; Match level="QueryCoverage =97%, HitCoverage=16%, E-value=6e-35, Identity=71%"; Hit description =aspartyl-tRNA synthetase
  Pfam annotation: Domain name=tRNA_anti; Domain location=19-98; Score =57.8; E_value=3.6e-14; Accession=PF01336.15; Description=OB-fold nucleic acid binding domain
MFRSHTNGELSLKNLNEEVTLSGWVQTIRDKGFMIWIDLRDRYGITQLVLDQDRSSAQLMEEAKKLGREFVIQVTGKVIERVSKNPNIPTGEIEILVEN

SEQ ID NO: 142465 - protein, 77 aa, Glycine max
  Coding DNA Sequence Number=SeqID_25687
TNRAFIKKFCVSRQAQGETPQQPGDGRQRATDAPPSPLEFTSAHPQKGLSIAYTTWPTNRRPSPKPKVEIYLRCACM

SEQ ID NO: 142466 - protein, 118 aa, Glycine max
  Coding DNA Sequence Number=SeqID_25688
MTKPGLCVPSDTTVSEWQRGADNRKVSPRIIMTKLGLCVPSDTTVSEWQRGADNRKVSPRIIMTKLGLCVPSDTTVSEWQRGADNRKVSPRIIMTKLGLCVPSDTTVSERQRGADNRK

SEQ ID NO: 142467 - protein, 57 aa, Glycine max
  Coding DNA Sequence Number=SeqID_25689
MENWRTALHNNFAGLQTPLGNDIHGAPQKGEDGELHKAITTHSSKLVCGGHMNNARQ

SEQ ID NO: 142468 - protein, 264 aa, Glycine max
  Coding DNA Sequence Number=SeqID_25690
  Gene Ontology: Mol. function=nucleoside-triphosphatase activity; Cellular component=membrane; Biological process=cobalt ion transport
  Homolog annotation: Hit_ID=UPI00006BCB3C; Match level="QueryCoverage =98%, HitCoverage=98%, E-value=5e-92, Identity=61%"; Hit description =ABC transporter ATP-binding protein
  Pfam annotation: Domain name=ABC_tran; Domain location=29-184; Score =97.0; E_value=5.6e-26; Accession=PF00005.17; Description=ABC transporter
  Pfam annotation: Domain name=SMC_N; Domain location=5-187; Score= -132.7; E_value=0.068; Accession=PF02463.9; Description=RecFRecNSMC N terminal domain
  Pfam module annotation: Pfam domain module=ABC_tran::SMC_N; Domain location=29-184::5-187
MNTLSINHLSLTYKNGFQAIKDISLEIGNGMFGLLGPNGAGKSSLMKTIVGLQKPSSGNIIFNGIDISREPDFIRQNLGFLPQDFGVYPKVSAYDLLHHIAILKGIKDDTFRKRQISGLLEKALLGNPKIIIVDEPTAGLDPEERNRFNSLLNDISKDVIVILSTHLVEDVRNLCSEMAIINKGKLIRKGKPGDLISELEHKIWSKRINRNEWEDYQATHEIISQQLIERELYITTFAAHQPKDFNAVPPLLEHVYFYSLTQKP

SEQ ID NO: 142469 - protein, 188 aa, Glycine max
  Coding DNA Sequence Number=SeqID_25691
MLTRLASPCAKRVIRNCQQIRQLPQAGYDGSRFVSQEAWDRYSNNVLARNILRERNVKLHINEFDDFRRQLIRRKWHKQLTNLTEGSIEVAIVKEFYANLYVPEDKFPKQVRVRWHLIKFDADSFNTFLETLVVMEQGESLPSYSRFARLRHDPQELAARLCILGRGFVLNAEGLSWKLLMKDLTTLA

SEQ ID NO: 142470 - protein, 74 aa, Glycine max
  Coding DNA Sequence Number=SeqID_25692
MVETSQINTKRGVKDKAPNTLPMKGLFVTKLESNEALKVVGPLLLDSNSSRDGTNPPSNSLYGNPQTRKQRDKQ

SEQ ID NO: 142471 - protein, 307 aa, Glycine max
  Coding DNA Sequence Number=SeqID_25693
  Homolog annotation: Hit_ID=Q1S0F5; Match level="QueryCoverage=41%, HitCoverage=26%, E-value=8e-12, Identity=34%"; Hit description=IMP dehydrogenase/GMP reductase
FYPSLARISKIVQISAQELDHGKQVRNGVVGIPRKCSEAKARTLAGRGEWAPFIDILALLIFGGVLFPNVDGLVDLATINAFLAYHDHKESPVVAMLADLYDTFDQRCEKSSTRIVCCTPTLYAWLVSHLFRQEERLSTGSLDGKKEEPGGAPLEEELAPVISRGFNKTNVETLQKVHKAWRWCKRRTKNSGAVTMGPSVATEGGESPRARLDWLPSLRTAKREEVEAPENAELRDINIATTKALEQETKRARREEHGRNKFRGALCGNNSELKLWREERDQSRVHSMVLKEELTACSRSKKSLAQH

SEQ ID NO: 142472 - protein, 71 aa, Glycine max
  Coding DNA Sequence Number=SeqID_25694
MVGAFSQNIVTLTGLPMILLSESDLTNPLCGVSCYVLLSVPGWFFTDMMNRWMTMKNLMLEDTGTPRSDRM

SEQ ID NO: 142473 - protein, 78 aa, Glycine max
  Coding DNA Sequence Number=SeqID_25695
MALCSVFLNLHLLLSVCLTIEALGVAKPSVASYLSQEILAEQKADRVHRLPAQPPVKFHNMVVISLVYETPGRALLYW

SEQ ID NO: 142474 - protein, 70 aa, Glycine max
  Coding DNA Sequence Number=SeqID_25696
IDCPFERGDNSCNLILSFCKSLRELPQSEGTYWVRTSNLPLGSLEVHARCPSLPQCKALRYQSLSFVMTL

SEQ ID NO: 142475 - protein, 97 aa, Glycine max
  Coding DNA Sequence Number=SeqID_25697
MVKEECKEVSVSSKRLAMKESHFTIKTNIKETSPLRKPLHFLLGKKTLVSIAIALRLEVLPQVKELLDEGFIRKSLNAFALLVSKIVIKGFPQTLRE

SEQ ID NO: 142476 - protein, 64 aa, Glycine max
  Coding DNA Sequence Number=SeqID_25698
SRLFRFFRRFPRINVGGDSARIPFVEHASRESRVALPPKGRLRQGAREIVSFLDTTSWGTTVPD

SEQ ID NO: 142477 - protein, 86 aa, Glycine max
  Coding DNA Sequence Number=SeqID_25699
  Gene Ontology: Mol. function=catalytic activity; Biological process =metabolic process
  Homolog annotation: Hit_ID=Q4V0R5; Match level="QueryCoverage=75%, HitCoverage=13%, E-value=1e-11, Identity=54%"; Hit description =Cardiolipin synthetase
VVDEEAQVRQQRQRQDPAQRRHRLALLQHDPAGQREQVQQIGHRQDGTEVGNAVQPVAQGVEEGEHPPIIAAHATRWDPTSTRVPG

SEQ ID NO: 142478 - protein, 137 aa, Glycine max
  Coding DNA Sequence Number=SeqID_25700
  Gene Ontology: Mol. function=transporter activity; Cellular component= integral to membrane; Biological process=protein transport
  Homolog annotation: Hit_ID=O34258; Match level="QueryCoverage=98%, HitCoverage=100%, E-value=1e-52, Identity=77%"; Hit description =Biopolymer transport exbD2 protein
  Pfam annotation: Domain name=ExbD; Domain location=8-137; Score=15.5; E_value=3.1e-05; Accession=PF02472.7; Description=Biopolymer transport protein ExbDTolR
MAFSSGGGKGPMADINVTPLVDVMLVLLIIFIVTAPIMTYPIAVDLPQRVLNPPPQLVEPPPPIELKIDASNQVSWNNSPINTSELQQRMEQEVQRDPTNQPELRIDASPDSEYDVMAKVLAAAKNAQMKKIGFVQQ

SEQ ID NO: 142479 - protein, 98 aa, Glycine max
  Coding DNA Sequence Number=SeqID_25701
  Subcellular localization annotation: CTP_CleavageSite=20; ConfidenceScore=5.26e-01
MTLLLSNIPSGNHNADLSLRNNQLGSRPQGTQWTRRSPIGPWGFQLWLQAFVSPTGGRAHKTLSGPGEVQQGPGVSSFGYGPLSFLQGARPPNKVMPS

SEQ ID NO: 142480 - protein, 157 aa, Glycine max
  Coding DNA Sequence Number=SeqID_25702
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=6e-17, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MNPGVLVPTPSEGYTPSPLEDYTSSPSEDYTSSPSEGCTPSPSEDYTSSPLEDYTSSQSEDCMSSPSEGCKPSPLEDYTSSSSEGWTPSPSEDCTSLPSEGCKPSPSEDYTSSSSEGWTPSPSEDCTSSPSEGCTPSPLEDFVSSLSVALYPHLKRI

SEQ ID NO: 142481 - protein, 103 aa, Glycine max
  Coding DNA Sequence Number=SeqID_25703
MVVGETEGPPKCLAWVYHQLLALQWHIRGKARSQLDCGGEFHVPPPWVERHFNEYGSGAIDILIGNDMGLNQFRFFNMVHDILVKVKLEVTRTSTVLNVFGSK

SEQ ID NO: 142482 - protein, 167 aa, Glycine max
  Coding DNA Sequence Number=SeqID_25704
  Homolog annotation: Hit_ID=UPI00006A1D2C; Match level="QueryCoverage =93%, HitCoverage=49%, E-value=3e-08, Identity=33%"; Hit description =UPI00006A1D2C related cluster
MIRGDTLRLSAPFYHPEAAGPMTSREKIGSFCTLVSSRGGGPDDTRRYLTVIRTLLSSRGGGPDDTQRYLTVICTLVSSRGDGPDDTRKYLTVIRTLLSSKGGGPDDKQRQNLAAGPMTSRDKIWSFCTLVSSRGGGPDDTRRYLTVIRTLVSSTGGGPDDTRKYPS

SEQ ID NO: 142483 - protein, 62 aa, Glycine max
  Coding DNA Sequence Number=SeqID_25705
MEEARGEALAAQQLWFRGYLETRMSCNRLQGLVIDYRSNKPSGCLFLCNRLHWMVIDYQSIN

SEQ ID NO: 142484 - protein, 189 aa, Glycine max
  Coding DNA Sequence Number=SeqID_25706
  Gene Ontology: Mol. function=hydrolase activity, hydrolyzing O -glycosyl compounds; Biological process=carbohydrate metabolic process
  Homolog annotation: Hit_ID=P16551; Match level="QueryCoverage=99%, HitCoverage=29%, E-value=5e-67, Identity=65%"; Hit description=Alpha- galactosidase
MAELGHGLFGSPGIEGHRQGLDGSPVFTTTDVQQQGQTLTITAEDEHAGLRLTSEMALDASGVLAVRHGLTNLKSQAWQVDRFAVTLPVAERAREVLAFHGRWIREFQPHRVMLEHDSFVIENRRVKCTATSGVCIWAGAATTACARKRKPMVAVIFRPKRSTCRVRWRLKRATRSGRRACMPATPRRD

SEQ ID NO: 142485 - protein, 119 aa, Glycine max
  Coding DNA Sequence Number=SeqID_25707
  Gene Ontology: Mol. function=protein serine/threonine kinase activity; Cellular component=membrane; Biological process=protein amino acid phosphorylation
  Homolog annotation: Hit_ID=Q94KF3; Match level="QueryCoverage=64%, HitCoverage=25%, E-value=4e-35, Identity=91%"; Hit description=Pto -like kinase SG5-3f
SGPLDTQPYVSTGVKGTFGYLDPEYFRSQQLTEKSDVYSFGVVLLKVLCARAPINPLLPRDQINLAEWGMLCKNKGILLMTAEWRRKKDDWRRHFKEKMSQEEVHHHRKPWIRVCGRRR

SEQ ID NO: 142486 - protein, 96 aa, Glycine max
  Coding DNA Sequence Number=SeqID_25708
  Subcellular localization annotation: CTP_CleavageSite=48; ConfidenceScore=5.11e-01
MPIFPCGSISWDHAHKTPSGPGEVQQGPGVSRSGYGPLSVLLGARPPRIAPARPPVDLKNSNRVLGFPALITGLCQFYGVPIAPARLSGLLLIDLS

SEQ ID NO: 142487 - protein, 140 aa, Glycine max
  Coding DNA Sequence Number=SeqID_25709
MIRGDTLRLSAPLCHSDTVVSVGTQRPSLVILHTCYAEIPYGYPHPFAIQTQSCPMARRDQVWSFCTHDTRRYLTGLTQSSAPFVPPGTTKSFTCGNFMVARDSRQPRGAKLVSYTDFRGPLLDDMRPFFGPCGVLGTHH

SEQ ID NO: 142488 - protein, 109 aa, Glycine max
  Coding DNA Sequence Number=SeqID_25710
DHARKTPSGPEEFQQGPRVSSSDYGPLSMLRSARRPQQGIMPARHPVDPKKFNKVLGFPALIMGLCQFYGVPVAPSKFIRPPINRAFIKKYCAPRHAQGETPQQHWDGR

SEQ ID NO: 142489 - protein, 55 aa, Glycine max
  Coding DNA Sequence Number=SeqID_25711
MKDLFVTKFESNEDVQKIQLKIRSDQFPVIYTSSYVQAASTSDFNLEIKSSVYVA

SEQ ID NO: 142490 - protein, 193 aa, Glycine max
  Coding DNA Sequence Number=SeqID_25712
  Gene Ontology: Mol. function=inorganic phosphate transporter activity; Cellular component=membrane; Biological process=phosphate transport
  Homolog annotation: Hit_ID=Q2P1J8; Match level="QueryCoverage=76%, HitCoverage=40%, E-value=5e-70, Identity=86%"; Hit description =Transport protein
  Subcellular localization annotation: CTP_CleavageSite=35; ConfidenceScore=5.29e-01
AFRAGLFVRTPDGERPHSRKSPAFDRSPRTVGTASCTALVGVDLDQVQPNSSNSFRIRYAQPPAAGMVRIQAQTMRSITPNFSERGFLAKPTPMIAVEMLCVVETGMPKWAARVRMVAELVSAAKPWIGCSLTILWPRVLMIFQPPEAVPAAITTAQVSTIHIAMPSPAWASGCMKASQDGRSFSAPVASAPI

SEQ ID NO: 142491 - protein, 142 aa, Glycine max
  Coding DNA Sequence Number=SeqID_25713
  Gene Ontology: Mol. function=RNA-directed DNA polymerase activity; Biological process=RNA-dependent DNA replication
  Homolog annotation: Hit_ID=Q8H6Q8; Match level="QueryCoverage=93%, HitCoverage=50%, E-value=1e-21, Identity=50%"; Hit description=CTV.20
MALFDTGADSNCILEGLIPTKFFEKTTEKLSTANGSKLKFNFKLSNAIIENQGFRINTNFLLIQLGKPQVKEKIQSLLNHIESTVCSDLSHAFWDRKKHIVDLPYEKGFREKQIPTKARPIQMNEELFNTAKRKSTICLIKA

SEQ ID NO: 142492 - protein, 338 aa, Glycine max
  Coding DNA Sequence Number=SeqID_25714
  Gene Ontology: Mol. function=unspecific monooxygenase activity; Cellular component=integral to membrane; Biological process=electron transport
  Homolog annotation: Hit_ID=Q6D1R6; Match level="QueryCoverage=86%, HitCoverage=89%, E-value=1e-127, Identity=76%"; Hit description =Pyoverdine biosynthesis protein
MARRAADLHQFAVQALRVFTLHQHELAVHVGRHAVPRRQPVVFGRHHVDAHFQAVGRLRVNRQADRRREMLRQQVAPGPAALDHAAGALFGIFLQRGVGTAVARQLAVFIQEARDGAVQQEALFVLHQLLLDRLFRFGIALHQQPAQQIVIIGMLRQAFDVAEVEHAQVRRAHFMQQAFNLTLIVVDRFIADADQIAEHVAVGADNDMRPRRVIELNALAQRVEEDQRQPLRHVRHRADHLVGVGRLGGKGRQHEFDTLLVFNECPNARQLHLSDPPFFFGNRGIVAGEAAAHGGKRIGHDDFRRQPAYSPVGRTSGHSITAALDALIESDRSRIVLL

SEQ ID NO: 142493 - protein, 483 aa, Glycine max
  Coding DNA Sequence Number=SeqID_25715
  Gene Ontology: Mol. function=oxidoreductase activity; Biological process=electron transport
  Homolog annotation: Hit_ID=Q6D1R7; Match level="QueryCoverage=52%, HitCoverage=81%, E-value=1e-110, Identity=73%"; Hit description =Pyoverdine biosynthesis protein
  Pfam annotation: Domain name=TauD; Domain location=9-288; Score =169.4; E_value=9.1e-48; Accession=PF02668.6; Description=Taurine catabolism dioxygenase TauD, TfdA family
MNNQPLNCHIQPNTPFGAILTPQHPGQKIGELPVAALRALAQEHHLLVLRGFDSGFSEAEVLTRYAEQWGEIMMWPFGAVLDVKEHPDAKDHIFDSSYVPLHWDGMYKPTIPEFQLFHCVAAPSPDEGGCTTFVDTTRLLANADEALLDQWLSVSITYRIKQVVHYGGEVCSPLVVQHPNGRGLIMRYNEPPTEGKKFLNQHALEYHGVPEHQQEQFHHTLQQHLYDPRHYYAHQWQQGDVVVADNFSLLHGREGFTAQQPGVCQSGAEAGQRRSVKEHYGKDTDGGGRHSGARLPDVSHRSPPDCPRASGAGDDRRAVSRTRRGGGRELRAVRRAGGFRLPPPGRALPRARRAAAGQCADGAGAEGFLRRADPVAGSAAACGHRRRKDRSADGGELLLRRAAAAAVRRAAAGLRYRRYAAVALTREQLVDEETRVLIDDVQQSFDAALLQAGGRALDRPFTDALIGGCERFLQLATTALEYE

SEQ ID NO: 142494 - protein, 229 aa, Glycine max
  Coding DNA Sequence Number=SeqID_25716
  Gene Ontology: Mol. function=2-C-methyl-D-erythritol 4-phosphate cytidylyltransferase activity; Cellular component=chloroplast; Biological process=isoprenoid biosynthetic process
  Homolog annotation: Hit_ID=Q2P1L0; Match level="QueryCoverage=76%, HitCoverage=64%, E-value=1e-76, Identity=82%"; Hit description=2-C -methyl-D-erythritol 4-phosphate cytidylyltransferase
MRTGGKGAVLMDATPAAGPRGQSAGAAGKYEFEPVQIGRGGDLEVVLTAFHQQRALALALHGHGLVGDFNTGGSSVGQRAAELVATEQLRGQCAPQALARLGAVDATVVACTLERVVHRGGQDRANRVGTADFKQAAEIGQGQVRSRRIVDQHELIGAHRLRQRLQPGQHRGGTGRTPDTGQHRLARPLVPARSVGVVRGRSPTIAPATAGCASRASRVWASRICPPAC

SEQ ID NO: 142495 - protein, 67 aa, Glycine max
  Coding DNA Sequence Number=SeqID_25717
MWVQAIGLFAQATCALEFGLPRPFNQRLLVLHVGGERSELSRIGCWTNGLSYLKKGGLIKIRRLFPN

SEQ ID NO: 142496 - protein, 117 aa, Glycine max
  Coding DNA Sequence Number=SeqID_25718
  Subcellular localization annotation: CTP_CleavageSite=56; ConfidenceScore=5.64e-01
MAINVFPTNVSEKPPTFNTSVWTASLSSAFGMPVQAFATSVQQEYKALRTTLLRILCNAKTTMCTFRPTLMSLRCSHAHRNRPISSFVMSKKETVSFWACEWRKLRASLKFPELQRL

SEQ ID NO: 142497 - protein, 80 aa, Glycine max
  Coding DNA Sequence Number=SeqID_25719
MKNKKVEAASVSLSEAYALSEQHPLSEALSLLSELGESKRESVKLARAQCAISSPSESIVSYGAKCTWLAKPKSTNSHLA

SEQ ID NO: 142498 - protein, 246 aa, Glycine max
  Coding DNA Sequence Number=SeqID_25720
  Gene Ontology: Mol. function=transcription regulator activity; Cellular component=nucleus; Biological process=regulation of transcription
  Homolog annotation: Hit_ID=Q8S3F4; Match level="QueryCoverage=99%, HitCoverage=47%, E-value=6e-35, Identity=44%"; Hit description =Putative bHLH transcription factor
MSQCVPSWDVEDNPPPSRVSLRSNSNSTAPDVPMLDYEVAELTWENGQLSMHGLGLPRVPVKPPTAVTNKYTWEKPRASGTLESIVNQVTSFPHRGKPTPLNGGGGGGVYGNFRVPWFDPHATATTTNTVTMDALVPCSNREQSKQGMESVPGGTCMVGCSTRVGSCCGGKGAKGHEATGRDQSVSGSATFGRDSKHVTLDTCDREFGVGFTSTSINSLENTSSAKHCTKTTTVDDHDSVSHSKPV

SEQ ID NO: 142499 - protein, 190 aa, Glycine max
  Coding DNA Sequence Number=SeqID_25721
  Gene Ontology: Mol. function=transcription regulator activity; Cellular component=nucleus; Biological process=regulation of transcription
  Homolog annotation: Hit_ID=Q8S3F4; Match level="QueryCoverage=79%, HitCoverage=38%, E-value=1e-15, Identity=36%"; Hit description =Putative bHLH transcription factor
YRVHIKSNYLLSYSDRRLFGEEAPNCSHRKSFPVSDKASMLDEVIEYLKQLQAQLQMINRINMSSMMLPLTMQQQLQMSMMSPMGMGLGMGMGMGMGMGMDMNSMNRAHIPGIPPVLHPSAFMPMAASWDAAAAAGGGDRLQGTPANVMPDPLSTFFGCQSQPMTIDAYSRLAAMYQQLHQPPPASGSKN

SEQ ID NO: 142500 - protein, 62 aa, Glycine max
  Coding DNA Sequence Number=SeqID_25722
MASCNLGGRIGLGDEKGKEKWGVDGVVEIASVGNIEGTLGKDRVREGLMLGGLPYGYEVTRV

SEQ ID NO: 142501 - protein, 247 aa, Glycine max
  Coding DNA Sequence Number=SeqID_25723
MVDNNQFIDKEAFLTRPPGFIREDYLYWKGKMEMLEALGHIFTKAQVNLKILDNIPKVCGSHVQKVQADDDKERKVLAFLQKKNTRFKKKYKEENNKIIYSECRKHEHMEVECPQLKKRRYSGDKKKKSLMVTYDNSDSENSTSSNNEQANIYLMADIDENFVVENCSRSDTSSYASSNNEKDMPMMFFFKTHMFGLGLEKGTSSSKSQSDSNKCDFCGKSGNSKFICILKKKKMSKDTNSTEPKKI

SEQ ID NO: 142502 - protein, 74 aa, Glycine max
  Coding DNA Sequence Number=SeqID_25724
MLYVLLQLSSGPCRRPYPLDEQCEEVRLKPKNSKFKIDLAIDLESDNIDKEFANKYNTTKQRRFQGSLPLKLAI

SEQ ID NO: 142503 - protein, 96 aa, Glycine max
  Coding DNA Sequence Number=SeqID_25725
  Gene Ontology: Mol. function=transcription initiation factor activity; Cellular component=nucleus; Biological process =transcription initiation from RNA polymerase II promoter
  Homolog annotation: Hit_ID=Q2HS28; Match level="QueryCoverage=55%, HitCoverage=16%, E-value=2e-16, Identity=75%"; Hit description =Transcription factor IIA, helical
MNQRSPLDVNVAYVEGRDEADKGTSNTQDFFTRPSGKRTRNDLTSQYNAGGYIPQQDGAGQDGAGDAAHGVFEIEVLYTLISDTVTHLILFVKVLS

SEQ ID NO: 142504 - protein, 117 aa, Glycine max
  Coding DNA Sequence Number=SeqID_25726
MKKKECTEETSCSKQKMKNLSKWKTQQEIKAKTGNEAGRRKKENEGSILKLVRRSRKQRICSLPHSITCILYSPFIFYHSCREFIAIRTPSRQPETIANDTSSSASSSRSLCEDVGR

SEQ ID NO: 142505 - protein, 44 aa, Glycine max
  Coding DNA Sequence Number=SeqID_25727
MKGTPIEQECNNCCQVRQTIYGQKHRDPISGQLVEEFNKQQHFD

SEQ ID NO: 142506 - protein, 144 aa, Glycine max
  Coding DNA Sequence Number=SeqID_25728
MEPSFTMNVGFIFKVIVQCPCEYQTYAIFQLSKAEYTIAFNKTTIKLWMKFITGDQWKIQLLCTVGRTTDAILNLLERPSIPTHDAVLYYNGRWNMPCQNNFVGYAFTGINPKKIDIPKGCSIDQLKDLIKQVTPKGNPPHGIL

SEQ ID NO: 142507 - protein, 164 aa, Glycine max
  Coding DNA Sequence Number=SeqID_25729
  Gene Ontology: Mol. function=nucleoside-triphosphatase activity; Cellular component=membrane; Biological process=iron ion transport
  Homolog annotation: Hit_ID=Q5PE95; Match level="QueryCoverage=99%, HitCoverage=69%, E-value=1e-69, Identity=73%"; Hit description=Iron transport protein, ATP-binding component
MADKRPLIVGNNALFRAGKRDVTQHAAEGQLQVVGGEGGLRRAAGQHAFVAQFSQQGDDPRLGLHIDAGKRLIEQDHFAFLSNGAGEEHALFLPAGELANLSFAVFAHPYAGQRGIDNLPVAGLRPPQPAHMTIAAHHHYIFHQHRKRPVHLFRLRYVGNKILP

SEQ ID NO: 142508 - protein, 72 aa, Glycine max
  Coding DNA Sequence Number=SeqID_25730
MKAQVEKDEGLETYQGNPYGVYSNLSSFTRSGVIQNSVAYIKRSAPSQVHISGPLRNDLYSLKVHGNPLITI

SEQ ID NO: 142509 - protein, 188 aa, Glycine max
  Coding DNA Sequence Number=SeqID_25731
  Gene Ontology: Mol. function=nucleic acid binding; Biological process= DNA integration
  Homolog annotation: Hit_ID=Q8RUQ2; Match level="QueryCoverage=43%, HitCoverage=8%, E-value=3e-11, Identity=40%"; Hit description =Putative retroelement
GNFGNRVRATLEEDTLMQQPKGFEVEGKENYVCRLKRSLYGLKKSPSKVEDGSHIYLLLYADDMLAASQNLLVIQKMKSLLNSEFEMKGVSSLQTQVDVPSTCTTKDVPSNVLRQRSQAVKPSILCEWGYKRILRREKGDTKEFRRLVLCSFGKGRRETQKEFMRLVLSEFFLAKGEENEKMNNTSFQ

SEQ ID NO: 142510 - protein, 105 aa, Glycine max
  Coding DNA Sequence Number=SeqID_25732
  Homolog annotation: Hit_ID=Q1SFS3; Match level="QueryCoverage=98%, HitCoverage=20%, E-value=3e-08, Identity=32%"; Hit description =Lambda repressor-like, DNA-binding
MVPTIEEFEEILGCPLGGRKPYLFSGFLPSLSKIAAVVGDSAKKLDRMKQTRNDVVGLPRKYLEGKARDMASQEKWGPFADILALLIFGVVLFPNVDGLVYLAAH

SEQ ID NO: 142511 - protein, 143 aa, Glycine max
  Coding DNA Sequence Number=SeqID_25733
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=98%, HitCoverage=69%, E-value=2e-38, Identity=47%"; Hit description =Protein ULTRAPETALA2
NVTLEAFEKHALRDGSGRWKRNIWVHCEDEDKIPLWKTPLIKDEFLRCTRCGKERRFHLKSRPDIKKYHDALNNKCWTCSLWPYQKITCDDDEERSSLKARRGCSRSSTCQGCSTCYYEGCIKCRFEDCNCQECRDFMLYAKP

SEQ ID NO: 142512 - protein, 71 aa, Glycine max
  Coding DNA Sequence Number=SeqID_25734
  Subcellular localization annotation: CTP_CleavageSite=26; ConfidenceScore=5.26e-01
MVNSLKKVPGGVANCCNLPFGGRATRDSRKRRGLRTLSERFGSCIYARGSRQGYFPCSYVFLNRDKEIKPM

SEQ ID NO: 142513 - protein, 58 aa, Glycine max
  Coding DNA Sequence Number=SeqID_25735
  Homolog annotation: Hit_ID=Q69AX6; Match level="QueryCoverage=71%, HitCoverage=3%, E-value=1e-08, Identity=66%"; Hit description=P1B -type heavy metal transporting ATPase
MVTRDSQSAAMQAQDQLGHSMELVHVELLQEDKMKIISEFKKEGPTAMIRDGLNDALA

SEQ ID NO: 142514 - protein, 77 aa, Glycine max
  Coding DNA Sequence Number=SeqID_25736
MSAQRLLTRISLPAPCCCHSAPTKNVRDHHRMMHAPDSTLRCNVGTMQCSSRPPGCACNCPPPIGDQPGSPKEFPTK

SEQ ID NO: 142515 - protein, 120 aa, Glycine max
  Coding DNA Sequence Number=SeqID_25737
LYHLVLVATNFGFLMLPKGERNGVELNCHHKKGGDCRSKDFAFDVLMMPYDHDVLMPYENALFKFNSRQKSKNNGYNNKKISSVLGREFQIETAKGLAKKFKQKCLFQEIYSLVIDYQRM

SEQ ID NO: 142516 - protein, 351 aa, Glycine max
  Coding DNA Sequence Number=SeqID_25738
  Gene Ontology: Mol. function=L-seryl-tRNASec selenium transferase activity; Cellular component=cytoplasm; Biological process =selenocysteine incorporation
  Homolog annotation: Hit_ID=Q2KUA4; Match level="QueryCoverage=90%, HitCoverage=68%, E-value=1e-135, Identity=78%"; Hit description =Selenocysteinyl-tRNA(SeC) synthase
ARQRSHQWWSCHGRYGRRCRRSCPRLRGLRREVGELLGEGGLVARLQAAQVEPQRVIGEAADHRHGQAAQAGFQPVQMAPGTALAPIAHRQPVAGQLVHRQRAAADLAEHRHRLDLVVRARRVRQHAAQALGQRLDLALRPGQQAQRGQALRQEFRRAVQLQHRLQGRQRQLAHAQGALERVLLDLADQVGAPHQQAGLRTAQQLVTAEGHQVGAGGDGLAHRVLARQAELGQVHQRAAAQVHRGRQAARVRQRRHLGHADALGEAGDGVVAAMHLHQHRGARADGVLVVGGVGAVGGADLDQPGAGALHDVRDAEGAADLDQLAARHHHLAAVGQRVQHQQHGARVVVDH

SEQ ID NO: 142517 - protein, 217 aa, Glycine max
  Coding DNA Sequence Number=SeqID_25739
  Homolog annotation: Hit_ID=Q1SP02; Match level="QueryCoverage=51%, HitCoverage=25%, E-value=3e-13, Identity=37%"; Hit description=IMP dehydrogenase/GMP reductase
ERLDRLRILDVCWIPYGEHREVRDFHVRSCYSGLLRWGPVAVYYRPERVVRQFGYTQTIPTPPVDSWVSYDDIHDRWMHYKDHIVPAGEVCVVPGACSSDYIDWFFRISHPFMTPGHAVDPLPHGHAPQPRVVPQAPQTDIPHVSEPGASSTSTEEPRHEVCDDIAERLEHHLSLGVLTPGSSTHEVIEECLRLARSVTQDHLVYVRCRRRRRTDQA

SEQ ID NO: 142518 - protein, 99 aa, Glycine max
  Coding DNA Sequence Number=SeqID_25740
IEEAKEHHLDEDALIPHDLAPCGAGRPWIFFINGVLCFLKMNGSGMEKAEDWRCHFKEKMSQEEAHHHEKPWIRARRKEKMSRGRKGARNLVPQMRSEL

SEQ ID NO: 142519 - protein, 88 aa, Glycine max
  Coding DNA Sequence Number=SeqID_25741
MKSADKREYHMVIRTFHQPGANEPVDTQRLTSSSAPSVILTHEVRFTLVVRRYSSPTTHEILLCWAVTIKFDSAWKRRGYPILSLSRH

SEQ ID NO: 142520 - protein, 46 aa, Glycine max
  Coding DNA Sequence Number=SeqID_25742
MPRAHNSTTATVPISGKEPWKQQRGAACALKPSLGLVLHEGSTGEA

SEQ ID NO: 142521 - protein, 648 aa, Glycine max
  Coding DNA Sequence Number=SeqID_25743
  Gene Ontology: Mol. function=transmembrane receptor activity; Cellular component=integral to membrane; Biological process=defense response to bacterium
  Homolog annotation: Hit_ID=Q1SI21; Match level="QueryCoverage=92%, HitCoverage=94%, E-value=0.0, Identity=85%"; Hit description =Nonaspanin
  Pfam annotation: Domain name=Cytochrom_B_C; Domain location=483-589; Score=-16.9; E_value=0.047; Accession=PF00032.8; Description =Cytochrome b(C-terminal)b6petD
  Pfam annotation: Domain name=EMP70; Domain location=65-606; Score =1135.7; E_value=0; Accession=PF02990.7; Description=Endomembrane protein 70
  Pfam module annotation: Pfam domain module=Cytochrom_B_C::EMP70; Domain location=483-589::65-606
MTLINDGKIYLTTVVHPLLKNCLCLSFCPACKLDKMRNILNSLWIYFGDQLQVKVNKLTSTKTQLPYSYYSLPYCAPSKIQDSAENLGEVLRGDRIENSLYVFKMREPQMCNILCNLKLDAKTAKEFKEKISDEYRVNMILDNLPLVFPLKRTDQDSTVYQLGFLVGLKGQYSGSKEEKYFIYNHLAFTVKYHKDMLTESARIVGFEVTPFSVKHEYEGKFDVRTTRLTTCDPHAKHTVVNSNSPQEVEEGKEIIFTYDVEFQESDVKWASRWDAYLLMNDDQIHWFSIVNSLMIVLFLSGMVAMIMLRTLYRDIAKYNELETQEEAQEETGWKLVHGDVFRPPNNSDLLCVYVGTGVQFFGMILVTMIFAVLGFLSPSNRGGLMTAMLLLWVFMGIFAGYSSTRLYKMFKGSEWKRVALRTATMFPAVVSAIFFVLNALIWGQKSSGAVPFGTMFALIFLWFGISVPLVFVGSYVGFKKPAIENPVKTNKIPRQIPEQAWYMNPVFSVLIGGILPFGAVFIELFFILTSIWLNQFYYIFGFLFLVFIILIVTCAEITVVLCYFQLCSEDYLWWWRSYLTSGSSALYLFLYATFYFFTKLEITKLVSAIFYFGYMLIASYAFFVVTGTIGFYACFWFTRLIYSSVKID

SEQ ID NO: 142522 - protein, 201 aa, Glycine max
  Coding DNA Sequence Number=SeqID_25744
  Gene Ontology: Mol. function=electron carrier activity; Cellular component=anchored to membrane; Biological process=electron transport
  Homolog annotation: Hit_ID=Q1SI16; Match level="QueryCoverage=76%, HitCoverage=89%, E-value=9e-49, Identity=59%"; Hit description=Blue (Type 1) copper domain
  Pfam annotation: Domain name=Cu_bind_like; Domain location=33-118; Score=138.3; E_value=2.2e-38; Accession=PF02298.8; Description =Plastocyanin-like domain
MAACSRTSLLLLFFLFGFSAAKELLVGGKIDAWKIPSSESDSLNQWAERSRFRVGDHLVWKYENGKDSVLEVTREDYANCSTSKPIKEYNDGNTKVKLEHAGPFYFISGAKGHCEKGQKLIVVVMSPRHIISPAPSPTEFHFEGPAVAPTSSATTFQVGLLTALGVLAMYVVFLNLNRAVDGARNMTGREKAEWDQTCSDS

SEQ ID NO: 142523 - protein, 1113 aa, Glycine max
  Coding DNA Sequence Number=SeqID_25745
  Gene Ontology: Mol. function=binding; Cellular component =mitochondrion; Biological process=translation
  Homolog annotation: Hit_ID=Q338A4; Match level="QueryCoverage=91%, HitCoverage=94%, E-value=0.0, Identity=41%"; Hit description =Pentatricopeptide, putative, expressed
  Pfam annotation: Domain name=PPR; Domain location=1034-1068; Score =34.2; E_value=4.5e-07; Accession=PF01535.11; Description=PPR repeat
  Pfam annotation: Domain name=PPR; Domain location=1069-1103; Score =43.7; E_value=6.4e-10; Accession=PF01535.11; Description=PPR repeat
  Pfam annotation: Domain name=PPR; Domain location=123-157; Score=9.5; E_value=0.56; Accession=PF01535.11; Description=PPR repeat
  Pfam annotation: Domain name=PPR; Domain location=158-192; Score=9.8; E_value=0.51; Accession=PF01535.11; Description=PPR repeat
  Pfam annotation: Domain name=PPR; Domain location=193-227; Score =25.9; E_value=0.00014; Accession=PF01535.11; Description=PPR repeat
  Pfam annotation: Domain name=PPR; Domain location=228-262; Score =26.6; E_value=8.7e-05; Accession=PF01535.11; Description=PPR repeat
  Pfam annotation: Domain name=PPR; Domain location=263-297; Score =37.9; E_value=3.5e-08; Accession=PF01535.11; Description=PPR repeat
  Pfam annotation: Domain name=PPR; Domain location=298-332; Score =47.2; E_value=5.4e-11; Accession=PF01535.11; Description=PPR repeat
  Pfam annotation: Domain name=PPR; Domain location=333-367; Score =28.6; E_value=2.2e-05; Accession=PF01535.11; Description=PPR repeat
  Pfam annotation: Domain name=PPR; Domain location=368-402; Score =46.8; E_value=7.5e-11; Accession=PF01535.11; Description=PPR repeat
  Pfam annotation: Domain name=PPR; Domain location=403-437; Score =42.6; E_value=1.3e-09; Accession=PF01535.11; Description=PPR repeat
  Pfam annotation: Domain name=PPR; Domain location=438-472; Score =38.0; E_value=3.4e-08; Accession=PF01535.11; Description=PPR repeat
  Pfam annotation: Domain name=PPR; Domain location=473-507; Score =19.4; E_value=0.013; Accession=PF01535.11; Description=PPR repeat
  Pfam annotation: Domain name=PPR; Domain location=508-542; Score =53.2; E_value=9e-13; Accession=PF01535.11; Description=PPR repeat
  Pfam annotation: Domain name=PPR; Domain location=543-577; Score =27.8; E_value=3.9e-05; Accession=PF01535.11; Description=PPR repeat
  Pfam annotation: Domain name=PPR; Domain location=578-612; Score =53.3; E_value=8.2e-13; Accession=PF01535.11; Description=PPR repeat
  Pfam annotation: Domain name=PPR; Domain location=613-647; Score =40.0; E_value=8e-09; Accession=PF01535.11; Description=PPR repeat
  Pfam annotation: Domain name=PPR; Domain location=648-681; Score =21.9; E_value=0.0024; Accession=PF01535.11; Description=PPR repeat
  Pfam annotation: Domain name=PPR; Domain location=789-823; Score =33.8; E_value=6.1e-07; Accession=PF01535.11; Description=PPR repeat
  Pfam annotation: Domain name=PPR; Domain location=824-858; Score =43.8; E_value=6e-10; Accession=PF01535.11; Description=PPR repeat
  Pfam annotation: Domain name=PPR; Domain location=859-893; Score =27.7; E_value=4.1e-05; Accession=PF01535.11; Description=PPR repeat
  Pfam annotation: Domain name=PPR; Domain location=894-928; Score =40.9; E_value=4.3e-09; Accession=PF01535.11; Description=PPR repeat
  Pfam annotation: Domain name=PPR; Domain location=929-963; Score =47.1; E_value=6e-11; Accession=PF01535.11; Description=PPR repeat
  Pfam annotation: Domain name=PPR; Domain location=964-998; Score =26.4; E_value=9.8e-05; Accession=PF01535.11; Description=PPR repeat
  Pfam annotation: Domain name=PPR; Domain location=999-1033; Score =51.9; E_value=2.1e-12; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR::PPR::PP R::PPR::PPR::PPR::PPR::PPR; Domain location=1034-1068::1069-1103::123- 157::...
  Pfam module annotation: Domain location=158-192::193-227::228 -262::263-297::298-332::333-367::368-402::403-437::438-472::473 -507::508-542::543-577::578-612::613-647::648-681::789-823::824 -858::859-893::894-928::929-963::964-998::999-1033
  Subcellular localization annotation: CTP_CleavageSite=71; ConfidenceScore=5.46e-01
MAVLVLCSSTICSSSLSSCCAFSGTNVYVMSNNGFFGETPFFKMKSFPNGSSVIWKKHGKRQLGLRVFETRCAHEVVVVNGKSKSSVSSEEVIGALKSISDPNSALSYFKMVSQLPNIVHTPETCNYMLEFLRVHGRVEDMAFVFDLMQKQVINRNPNTYLTIFKALSIKGGIRQAPFALGKMRQAGFVLNAYSYNGLIYFLLQPGFCKEALKVYKRMISEGLKPSMKTYSALMVALGRRRDTGTIMDLLEEMETLGLRPNIYTYTICIRVLGRAGRIDDAYGILKTMEDEGCGPDVVTYTVLIDALCAAGKLDKAKELYTKMRASSHKPDLVTYITLMSKFGNYGDLETVKRFWSEMEADGYAPDVVTYTILVEALCKSGKVDQAFDMLDVMRVRGIVPNLHTYNTLISGLLNLRRLDEALELFNNMESLGVAPTAYSYVLFIDYYGKLGDPEKALDTFEKMKKRGIMPSIAACNASLYSLAEMGRIREAKDIFNDIHNCGLSPDSVTYNMMMKCYSKAGQIDKATKLLTEMLSEGCEPDIIVVNSLIDTLYKAGRVDEAWQMFGRLKDLKLAPTVVTYNILITGLGKEGKLLKALDLFGSMKESGCPPNTVTFNALLDCLCKNDAVDLALKMFCRMTIMNCSPDVLTYNTIIYGLIKEGRAGYAFWFYHQMKKFLSPDHVTLYTLLPGVVKDGRVEDAIKIVMEFVHQSGLQTSNQVWGELMECILIEAEIEEAISFAEGLVCNSICQDDNLILPLIRVLCKQKKALDAKKLFDKFTKSLGTHPTPESYNCLMDGLLGCNITEAALKLFVEMKNAGCCPNIFTYNLLLDAHGKSKRIDELFELYNEMLCRGCKPNIITHNIIISALVKSNSINKALDLYYEIISGDFSPTPCTYGPLIGGLLKAGRSEEAMKIFEEMPDYQCKPNCAIYNILINGFGKAGNVNIACDLFKRMIKEGIRPDLKSYTILVECLFMTGRVDDAVHYFEELKLTGLDPDTVSYNLMINGLGKSRRLEEALSLFSEMKNRGISPELYTYNALILHFGNAGMVDQAGKMFEELQFMGLEPNVFTYNALIRGHSKSGNKDRAFSVFKKMMIVGCSPNAGTFAQLPNKC

SEQ ID NO: 142524 - protein, 761 aa, Glycine max
  Coding DNA Sequence Number=SeqID_25746
  Gene Ontology: Mol. function=DNA binding
  Homolog annotation: Hit_ID=Q9FFJ8; Match level="QueryCoverage=67%, HitCoverage=65%, E-value=5e-14, Identity=22%"; Hit description =Arabidopsis thaliana genomic DNA, chromosome 5, P1 clone:MJJ3
MTDMLTSFNADFGSQYDKDVLKTRYTNLWKQFNDVKSLLSHFGFSWDASRQMVVAAADDDSVCDAYLKSHPDARCYRTKPVLNFDDLCVIYGHTVADGRYSLSSHDVNLDDQVQGQHLGDGMGSIAVPSSERARTDWTASMEQFFIELLLDQLGRGNQVDNGFNKNAWTDMLAIFNAKFGCQHGRRVLKNRFKKRLKHYCDITNLIKQGFLWDEQQLMLLADDDVWNAYVKAHLHAGTYRSKTLPNYRDLELIFRNMAENEISNLQQEKNHEDVISETKAGEAKGSRNPSGTDRTRTYWTPPMDRCLIDLLLEQGGFSWDDTIEMIDAEDHVWDAYTKAHPEAPPLRVKTLPDYWKWSVIFAAESSDTRYVHLAHNEDHSSELPMYITGEQKNGICSNVYDAGSTIEWTESMECYFVDIMIEQVNRGNRIENLYNEEAWMHMVQAFNARWGLQSDKQVLMDQYFCLMKKHDDISNILSHSEFAWNETLQTINAEDDVWDAYIKDHPDAISYKNNCLYRFCDLCKIFGNKLMEVPDVRVSDLEQLHLMEANDFTIEMDMDEANENLLNISSVDISDQNPGRTREMDTDGSFANLGVTSSSATSGNLDVTSSNATSNQNTERPREMDMDMTSGNLDVTGDAQILSQDEQSHDEMVTNGTCGNLELSGNTKMTQHFRKRPNMMSQDSRPPKKKLGMKEALSEMASAVKALMNDKENNDTSFDDALSALRAMPDVDDELVMDACDLLEDERKANIFLALDISLRK

SEQ ID NO: 142525 - protein, 55 aa, Glycine max
  Coding DNA Sequence Number=SeqID_25747
MSDISGNVENVRKLLSHSTFDLRNLMLLNWFICLVITQFDQQQTEALQRLSGSLQ

SEQ ID NO: 142526 - protein, 282 aa, Glycine max
  Coding DNA Sequence Number=SeqID_25748
  Gene Ontology: Mol. function=hydrolase activity, acting on ester bonds; Cellular component=nucleus; Biological process=multicellular organismal development
  Homolog annotation: Hit_ID=Q94K01; Match level="QueryCoverage=88%, HitCoverage=68%, E-value=6e-80, Identity=54%"; Hit description =Lariat debranching enzyme
  Pfam annotation: Domain name=DBR1; Domain location=146-265; Score =58.4; E_value=2.4e-14; Accession=PF05011.3; Description=Lariat debranching enzyme, C-terminal domain
MCTEPFNSWRNSKTRKSTSSSAEAISKPYYGGWAAPNIYILRAAGVVRFGNFRIGGLSGIYKSFDYKLGHFERPPYDHNTIKSVYHVCEYDVRKLMQVKELIDVFLSHDWPIEEKRLGSKPAAELLEKLKPHYWFSAHLHCKFATLVQHGEGGPLTKFLVLDKCIAGCDFLQIVEIESDAGPYEIQCDEEWLAITRKFNHIFPLTYKGADFRGINLEMEDCLEWVRSRLQERGCKPFEFVRSAPLNPQNPQTESFLRLLELPYLLDRNPEAKDLSPYPSPSI

SEQ ID NO: 142527 - protein, 165 aa, Glycine max
  Coding DNA Sequence Number=SeqID_25749
  Homolog annotation: Hit_ID=Q9ZPJ0; Match level="QueryCoverage=74%, HitCoverage=62%, E-value=5e-38, Identity=59%"; Hit description=Tsi1 -interacting protein TSIP1
  Subcellular localization annotation: CTP_CleavageSite=42; ConfidenceScore=5.27e-01
MSRCVSCGSGSALIHNKNLLISPIHNALKVRGNNRSCGLRVQVSMVDSSSADFTRRIERAWSISKKIGYQGVYNNSFAPGQPAELDLLCVKQPRPIVCSSCDSKGHIECKWCAGTGFFILGDNMLCEVPSRNTTCIICTGKGSMCCSDCQGTGFRAKWLGEPPSS

SEQ ID NO: 142528 - protein, 540 aa, Glycine max
  Coding DNA Sequence Number=SeqID_25750
  Gene Ontology: Mol. function=oxidoreductase activity; Cellular component=chloroplast; Biological process=electron transport
  Homolog annotation: Hit_ID=O49931; Match level="QueryCoverage=99%, HitCoverage=99%, E-value=0.0, Identity=78%"; Hit description=Rieske iron-sulfur protein Tic55 precursor
  Pfam annotation: Domain name=PaO; Domain location=294-384; Score =133.9; E_value=4.6e-37; Accession=PF08417.2; Description =Pheophorbide a oxygenase
  Pfam annotation: Domain name=Rieske; Domain location=89-191; Score =98.0; E_value=2.8e-26; Accession=PF00355.16; Description=Rieske [2Fe- 2S] domain
  Pfam module annotation: Pfam domain module=PaO::Rieske; Domain location=294-384::89-191
  Subcellular localization annotation: CTP_CleavageSite=57; ConfidenceScore=5.31e-01
MALVNPFLSPPRTPLSLRVSAPPNQALLRWTLCSQYSFKPSSLRSKHAMCGATADIKAAPLADGEADHAVLVGPASEDERKGDYDWTQEWYPLYLTLNVPEDAPLGLRVFDKQLVLFKDGNGQFRCYEDRCPHRLAKLSEGQLIDGRLECLYHGWQFEGEGKCVKIPQLPADAKIPQAACVKTYEVRDSQGVIWVWMSLKTPPNVSKLPWFENFARPEFQDISTIHELPYDHSILLENLMDPAHIPISHDRTDWTAKREDAQPLCFEVTERTHRGFAGWWGREKDGSMPNFLRFEAPCVLQNNREIVDKNGEINYFSGLFLCRPTGQGKSMLIVRFGGTKRSPLAKVFPKWYLHQNASKVFEQDMGFLSSQNEILLKEKVSTKELYLNLKSSDTWVAEYRKWMDKAGHGMPYHFGHSTISLPKEPAVVEHAPAGLVAGQSASSPTKGGIGTMHAPNFANRYFRHVIHCKGCRTVVKAFEAWKNALSAVAVALVALAILVSGRQWKALLLASAALCSVGVYACSIAIAMNTTNFIRTHRRL

SEQ ID NO: 142529 - protein, 190 aa, Glycine max
  Coding DNA Sequence Number=SeqID_25751
  Homolog annotation: Hit_ID=Q47522; Match level="QueryCoverage=32%, HitCoverage=82%, E-value=8e-22, Identity=76%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGNARVFPVTTLEALRQAVMTDNSNELSGAVLASKGLKLQSNWWTIKLIDTVDLEGGPVGKPVVPAALMNRPTRGERRFAYWALAECILAYYVGTDEGVSEVLHVAGEKRLH

SEQ ID NO: 142530 - protein, 332 aa, Glycine max
  Coding DNA Sequence Number=SeqID_25752
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q8S8Z0; Match level="QueryCoverage=95%, HitCoverage=94%, E-value=1e-135, Identity=78%"; Hit description =Protein phosphatase 2C
  Pfam annotation: Domain name=PP2C; Domain location=48-291; Score =241.7; E_value=1.5e-69; Accession=PF00481.12; Description=Protein phosphatase 2C
MGYLNSVLSSSSEVHAAGDAIASGGGLSHNRKFSYGYASSPGKRSSMEDFYETRIDGVDGEVVGLFGVFDVCLAVVLFSAHHEGNLFEGHGGARAAEYVKKNLFSNLISHPKFISDTKSAITDAYNHTDSELLKSENSHNRDAGSTASTAILVGDRLLVANVGDSRAVICRGGNAIAVSRDHKPDQTDERQRIEEAGGFVMWAGTWRVGGVLAVSRAFGDRLLKQYVVADPEIQEEKIDSSLEFLILASDGLWDVVTNEEAVAMIKSIEDAEEAAKRLMQEAYQRGSADNITCVVVRFLMNQGGSKDKEVVAPPHNSSSASRNPSVEGLCDR

SEQ ID NO: 142531 - protein, 410 aa, Glycine max
  Coding DNA Sequence Number=SeqID_25753
  Gene Ontology: Mol. function=zinc ion binding; Cellular component =intracellular; Biological process=regulation of transcription, DNA -dependent
  Homolog annotation: Hit_ID=Q9ZTK7; Match level="QueryCoverage=75%, HitCoverage=99%, E-value=1e-84, Identity=53%"; Hit description =CONSTANS-like protein 2
  Pfam annotation: Domain name=CCT; Domain location=359-397; Score =79.7; E_value=9e-21; Accession=PF06203.4; Description=CCT motif
  Pfam annotation: Domain name=zf-B_box; Domain location=101-148; Score= 59.4; E_value=1.2e-14; Accession=PF00643.14; Description=B-box zinc finger
  Pfam annotation: Domain name=zf-B_box; Domain location=149-191; Score= 44.6; E_value=3.3e-10; Accession=PF00643.14; Description=B-box zinc finger
  Pfam module annotation: Pfam domain module=CCT::zf-B_box::zf-B_box; Domain location=359-397::101-148::149-191
  Subcellular localization annotation: CTP_CleavageSite=28; ConfidenceScore=5.28e-01
MPKSCEGGGTISVSAPATGHKVGSTLTRTMRGRRWNMAWAPHGRKSKPKKAPLLPLGLLGVGLYSAKPHPRATLPLVPLQISLAPLDRLGLTPLDMEPPTMASKLCDSCKSATATLYCRPDAAFLCGACDSKVHAANKLASRHPRVVLCEVCEQAPAHVTCKADAAALCLACDRDIHSANPLASRHERIPVTPFFESVHSVKASSPINFHHRFFSDADADADVSTEEAEAASWLLPNPKTDLNSSQYLFSETEPVPYIDLDYAAMDPKTEQKSSATADGVVPVQSNFEPFTYGYKYNTTLSQSQSHMSQSVSSPSSMEVGVVPDGNTMSEISNCSYSKVAPVTVTAQFSAADREARVLRYREKRKNRKFEKTIRYASRKAYAETRPRIKGRFAKRTDADPLAGYGVVPSC

SEQ ID NO: 142532 - protein, 110 aa, Glycine max
  Coding DNA Sequence Number=SeqID_25754
MGLMSTCENLDDTLSDENGEEANIWQIQLLMNLNQIRKVRDEIVGNVKHPEVVESAEIDLEKCFSHKVDELMQRNGGISLNIPFQSTIDNDEAREMRELEDRQPRLALAT

SEQ ID NO: 142533 - protein, 78 aa, Glycine max
  Coding DNA Sequence Number=SeqID_25755
MVLVLCIDFASPFTGGIVWGSGRDDVELGVTSEVHRAKVVGGAVDGSKECGEELAEEGGWGGQTKRGTGEGHGNERRR

SEQ ID NO: 142534 - protein, 370 aa, Glycine max
  Coding DNA Sequence Number=SeqID_25756
MKQKHAFFKSPNLNFCPFSHSHSVHRRLRVADIPLSDEDHDGDAVRETPSTKCFSPRRLVASLLAPLRPTKGLRLQQRRQNETGDLEAPSPSSPTNELKGSDESTGQLHESDTSFKLGVGCGLLYLIAASKNELSKMIELQKEMEMLLQNAKGELQSKDSLLKPLKQSDTLALSITDIQEVSSSSSHLSIHSNIQYVQPESKSDTVPNRFLEYNTSEQDECAEEINELRAEFEIELQRLQLYLDGEAGFDDAQQEGVKVTLEDSSSKSHSSSFGEIIMEPQGATYDVSFGVPPIELERRLHELLEARLEERISELESALECKTQKLIKKEIEVTWWKDTAQLISQHVPETSRFTFPLDPDISLKLSQLVG

SEQ ID NO: 142535 - protein, 292 aa, Glycine max
  Coding DNA Sequence Number=SeqID_25757
  Gene Ontology: Mol. function=DNA-directed RNA polymerase activity; Cellular component=DNA-directed RNA polymerase II, core complex; Biological process=transcription
  Homolog annotation: Hit_ID=Q1L6V6; Match level="QueryCoverage=85%, HitCoverage=22%, E-value=3e-71, Identity=51%"; Hit description=RNA polymerase IV second largest subunit
  Pfam annotation: Domain name=RNA_pol_Rpb2_1; Domain location=67-274; Score=62.7; E_value=1.2e-15; Accession=PF04563.6; Description=RNA polymerase beta subunit
MGHVGSSKDGTEAGPSAAAMGIDDDEDIDLGDVDLDPTNAEILEELGEDIVKYWCKKASMLFFNEYGLISHQINSFNHFIHTGLQKTFESFGDLVVTPGFDPSKKGENEHFRYASVKFGNVKLDKPMFWGGEGNAQEFKMLPRHARIQRMTYASKVKIQVKVQVYVPKKVRSDKFKTGKAEFLDREVMKEDEREIIIGRLPVMVKSDLCWMKEAEKEDDEFDHGGYFIVKGAEKTFIAQEQLYLKRLWVMNSPGWMIAYKSQMTRNRMVIKLVGNSRGEEVENGDMSLAVYL

SEQ ID NO: 142536 - protein, 135 aa, Glycine max
  Coding DNA Sequence Number=SeqID_25758
  Gene Ontology: Mol. function=chorismate mutase activity; Cellular component=chloroplast; Biological process=aromatic amino acid family biosynthetic process
  Homolog annotation: Hit_ID=Q1SZ86; Match level="QueryCoverage=98%, HitCoverage=45%, E-value=1e-41, Identity=65%"; Hit description =Chorismate mutase
DELLPIFVASGDDGNYAQTAATDLSLLQAISRRIHYGKFIAEAKFRESPKGYEPLIRAKDKEALMKLLTIESVEEMVVKRVKKKAMVLGQEVSLDRNVKGIKYKVDPSVVSFLYQKWLIPLTKNVEVEYLLSRLD

SEQ ID NO: 142537 - protein, 231 aa, Glycine max
  Coding DNA Sequence Number=SeqID_25759
MTNKAKGKGKEVAGKGFAGKRKGAFDDDKTDGGRKRNNPVPMRVPNLCDFSTLKSRIHNSLQQNNNQVVDEIHYRRPVEDTDAILNLLERPSIPTHDAVLYYNGRWNMPCQNNFVGYAFTGINPKKIDIPKGCSIDQLKDLIKQVTPKGNPPHGIHESQVLRCLFYRKPSHLEYSEKVLEFEIIELKCDDDVLKVLVESNYWKQFVPIEILALFSKVVMENEDDVVTSLRD

SEQ ID NO: 142538 - protein, 404 aa, Glycine max
  Coding DNA Sequence Number=SeqID_25760
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=4e-53, Identity=30%"; Hit description= UPI00006A17C9 related cluster
MDFSVKLKDDPIALVEFLSKYCQWVVLTLGANGCIAKHGTKSVDAESNPLKVRTCSPIKARASNPLKARVCDPLKARACSSLKARTCSPLKERACSPLKVRACSPLKARTCSPLKARASNPLKARASSPLKARACSPLKARTCSPQKVRACSPLKVRACSPLNARTCSPLKARTCSPLKARTRSPLKPRACGPLKVRACSPMKARMCDPLKVRACNPLKARVCSRLMVRTCSSLKVRACSPLTARTCSPLKERTCSPLKVRASNPLKARACSPMKARACSPQKVRTCSPLKVRACSPLKARTCSPLKARMYSPLKQRACGPLKVRACSPMKARMCDPLKARACSPLKAWACSRLMVRTCSSLKARACNPLMVRTCSPLKARTCSPSKARTCSLFSSCKCTGSHK

SEQ ID NO: 142539 - protein, 60 aa, Glycine max
  Coding DNA Sequence Number=SeqID_25761
MYPVEEVWQVLPREGLKACRRRFHRFFCENKMEPAEEGVLPRAPAEERFTMPTILTCNVS

SEQ ID NO: 142540 - protein, 836 aa, Glycine max
  Coding DNA Sequence Number=SeqID_25762
  Gene Ontology: Mol. function=DNA-directed RNA polymerase activity; Cellular component=nucleus; Biological process=transcription
  Homolog annotation: Hit_ID=Q1L6W5; Match level="QueryCoverage=99%, HitCoverage=81%, E-value=0.0, Identity=79%"; Hit description=RNA polymerase IV second largest subunit
  Pfam annotation: Domain name=RNA_pol_Rpb2_3; Domain location=125-192; Score=48.3; E_value=2.5e-11; Accession=PF04565.7; Description=RNA polymerase Rpb2, domain 3
  Pfam annotation: Domain name=RNA_pol_Rpb2_4; Domain location=228-290; Score=85.4; E_value=1.8e-22; Accession=PF04566.3; Description=RNA polymerase Rpb2, domain 4
  Pfam annotation: Domain name=RNA_pol_Rpb2_5; Domain location=304-351; Score=40.3; E_value=6.4e-09; Accession=PF04567.7; Description=RNA polymerase Rpb2, domain 5
  Pfam annotation: Domain name=RNA_pol_Rpb2_6; Domain location=356-733; Score=347.2; E_value=2.7e-101; Accession=PF00562.18; Description=RNA polymerase Rpb2, domain 6
  Pfam annotation: Domain name=RNA_pol_Rpb2_7; Domain location=735-834; Score=129.2; E_value=1.1e-35; Accession=PF04560.10; Description=RNA polymerase Rpb2, domain 7
  Pfam module annotation: Pfam domain module=RNA_pol_Rpb2_3::RNA_pol _Rpb2_4::RNA_pol_Rpb2_5::RNA_pol_Rpb2_6::RNA_pol_Rpb2_7; Domain location=125-192::228-290::304-351::356-733::735-834
MQECLEMYVFPGISGLNRKARFLAYMVKGLLLAYTGRRKCDNRDDFRNKRLELASELLDRELKVHIAHARKRMAKALQRDLYGDRDVRPIEHYLDASIITNGLQRAFSTGAWSHPYKRMERISGVVANVGRTNPLQTMAELRRARQQVQYTGKVGDARYPHPSHWGKVCFLSTPDGENCGLVKNLAVTGLVSTDVSAVSEYILPKLLDCGMEELVDDTSTHLGNKDKVLLNGDWVGVCPDSSSFVAELRSRRRRNELPHQVEIKRDQSQHEVRIYSDAGRILRPLLVVGNLLKIKGFKSDCNSFQSLLDKGVIELIGPEEEEDCCTAWGVEYLFGKEGKRSVKYTHCELDMSFLLGLSCSLVPFANHDHARRVLYQSQKHSSQAIGFSTTNPNIRVDTLSHQLHYPQKPLFRTMASDCLGKPDNSLGQNKISKIPPKAEFYNGQNAIVAVNVHLGYNQEDSLVMNRASLQRGMFRSEHIRSYKSEIDNKESSDKKRKPEDIVNFAKLQSKIGRVDSLDDDGFPYVGANLQSGDIIIGKGAESGADNSVKLKHTERGYVQKVVLSSNDEGKNFAVVSLRQVRSPVLGDKFSSMHGQKGVLGFLESQENFPFTRQGIVPDIVINPHAFPSRQTPGQLLEAALGKGIACGGILRQATPFSTPSVDAITEQLHRAGFSRWGNERVYNGRTGEMVRSLIFMGPTFYQRLHHMSEDKVKFRNTGPVHPLTRQPVADRKRFGGIKFGEMERDCLIAHGASANLYERLFTLSDSSQIHICSKCKNVANVILRPVSGGRKIRGPYCRHCESADDIVVAHVPYGAKLLCQELFSMGINLKFETQLC

SEQ ID NO: 142541 - protein, 82 aa, Glycine max
  Coding DNA Sequence Number=SeqID_25763
MRRKCLKSLIQQLIPPPSLHTSVVKPHPSVGKEDPPRKVIPKDPGWNKKKGDSITIQALGYGVDDYTRGSIQKGKITLFKGG

SEQ ID NO: 142542 - protein, 320 aa, Glycine max
  Coding DNA Sequence Number=SeqID_25764
  Gene Ontology: Mol. function=catalytic activity; Cellular component =membrane; Biological process=metabolic process
  Homolog annotation: Hit_ID=Q67UR5; Match level="QueryCoverage=87%, HitCoverage=54%, E-value=1e-110, Identity=63%"; Hit description =Putative phospholipase D
  Pfam annotation: Domain name=PLDc; Domain location=166-193; Score =25.4; E_value=0.0002; Accession=PF00614.12; Description =Phospholipase D. Active site motif
MRHTPKIGVHGVFVCYNILVLLLSSFHESTSSSSHCKAWLVQSIPTDMPHLSHVPGTLSTGDVLRWLAANSTTRLHIIAQYWQLLPSPNDPRSGDYGYTQHQMHEFGADQGVSLYQALDAAADRNVSIRLLSHSGVYPTFASEPSKLAFGRPNVENVTLLLEDWWGSGIVHAKVWISDSRDVYIGSANNDWKSLTQVKELGIYFADCPEIAKRVEVYFDNLWTLASLNSSAYTKTVFDQDWQVERKVPCWSHFINHRERCKSPLPQYLETPHIAGYPILSEPYMFKVPFQTPGSNYSTKHPQGSYLSFAPPEVTFTLTRP

SEQ ID NO: 142543 - protein, 316 aa, Glycine max
  Coding DNA Sequence Number=SeqID_25765
HGSTLFHSLEKWNPNMRTGHRLVWAHCWGIPLVAWEMVQIRKIVAAIGDLVEVDDDVEELRRLDRTRVLIRTPWSPTLLHTVNIHIGGEIYKVHIVEENGNGNGNCSCQPQSTLGSSEEIDSGDSNTGTSISKLLGAPGTDYAPRRTTDNSTGGVVTKGNLLLSNGPSADEVPVGNNLGRLALCTNHKTSMLGMGAGNGTKPVAQPRLETVAKAMARRVPKIGNVDLVRRQQLEDDECLNGSQLARSTEARDTGVVDSGHTNIVGALLVTPLLKQHTSNEAHNSVNVSLMGANTDKNNLKQPNVDSEKDTTTNKGS

SEQ ID NO: 142544 - protein, 750 aa, Glycine max
  Coding DNA Sequence Number=SeqID_25766
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=96%, HitCoverage=60%, E-value=1e-150, Identity=36%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=445-597; Score =71.1; E_value=3.5e-18; Accession=PF00665.16; Description=Integrase core domain
  Pfam annotation: Domain name=zf-CCHC; Domain location=256-273; Score =10.4; E_value=0.019; Accession=PF00098.13; Description=Zinc knuckle
  Pfam module annotation: Pfam domain module=rve::zf-CCHC; Domain location=445-597::256-273
MTMLKNNDQIPAKLPIFDGTNYESTDVTPLEMNPTEAHRVTHREQIKKDDKAIFLIHQCVDSNVLEKIIDHETANEAWDVLATTYASDKQTKKVRLMALRRQLGLLQMESNETVAQFINRLVILANQMKSCGEVVTDSMKVAKVLTGLTPNFDHIISAIEQSKDLKTLKLEQLLDSLEAHELKMKNREGIKKEEKDFEKALFAKNQKKGGGDSWKNKKGKGKWKYNKQENKGSTSENQEKEGENNGKRKKKSKEHIQYYNYQKYGHYADECNNPKVPRKRGEEAQLARDSNDEEAMMLMATVNSETGNEEWWYLDTGCSNHMTGHKDWFCEIDETVKRSIKFGDGRSVMAKGIGKVAIRRVDGSKVIISDVLYVPNMESNLLSLGQLLEKGFSMHMEGEHMEVADSNGNVGVSTIEQKCLTAQSNDSMWKLHRRLGHLNFNNLNKLQKKNMVVGLPSIEVPRQVCGRCCEGKQPSKAYNAAVPTRAKEKLAVIHSDQSGCSIKMLRTDGGGEYTSLEFENFSKEEGIIHEVMAPYTPQHNGTAERRNRTVLNMVRCMLREKHLPHDLRAEAVSTTAHILNRCPTKRLDSLTPEEAWSELKPSVKHFKVFSSLCYRHVPKQNRRKLDSRAQTMILVGYHSTGAYKLFDPLSKTIVISNDVIVDETKEWNWNIGMERQTNETLEVELGGEEIQDEVQIDNEQYYDVFPDAAININGELMNLVLLAEAKLVSLEEALASPHWRKTMEEELRSI

SEQ ID NO: 142545 - protein, 205 aa, Glycine max
  Coding DNA Sequence Number=SeqID_25767
MKDEEDHFEPQNEVATTNEGDQSAQNEDGPNVETIVDGLAKLRIANSCFEKEEDEKEEEPFEKVEKFEAIVVIAQNEPKVANGEKILIGSVKDSFFNTENMKKFFNSPLFDTSVKNSCGLAPLYGEPSAISIIFPSFPYETTTTKLSKVGEEVPRVYTPSLPPTNEHFARSIESKLKSMEKQVKKISFVQNLFFSNVDQLRKTLN

SEQ ID NO: 142546 - protein, 228 aa, Glycine max
  Coding DNA Sequence Number=SeqID_25768
MPINTPHFPTCEKCGIVHGHENARQGQDFGKNQNQGMYRPPPMQNQWPRQEERQPTFQEIMLQQSGNRLAQFELNPKNEDDDTSLKAINDILIEEDQAPKKDKTPTDGNQVHDKEEDKKKEILMSPKVEKFIFPTNFVILDMEADEDVPTILGRTFLSTGLDAFPSLGMPDPPETVLTDEDQDRELNLDMEETVTLLQTHPSPRTSYFERLEYGNGPKEKPSIEEPPE

SEQ ID NO: 142547 - protein, 84 aa, Glycine max
  Coding DNA Sequence Number=SeqID_25769
MAVVDFYNWGLCQQLCVANTFSQFEMSHNVTTSDNGRGQPRGPSSITRVVINHEGPRHFKHLKLQHQDSDNNSGGYHHGHNKLN

SEQ ID NO: 142548 - protein, 217 aa, Glycine max
  Coding DNA Sequence Number=SeqID_25770
  Homolog annotation: Hit_ID=Q1SKD7; Match level="QueryCoverage=71%, HitCoverage=40%, E-value=3e-14, Identity=29%"; Hit description =Ankyrin
MAFAHMFVNIAYRLGLFMYDCHFWRCGQLTGEIAPKKLSTKRSRRDATEEGSSAASEFDSHRFRSAEHQQRFEAIRGWSFHRERRVQLREDEYTDFQEEIARRRWTPLVTPMAKFDPEIVLEFYANAWPTEEGVRDMRSWVRGQWIPFDADALSQFLGDPLILEEGQQCEFSQRRSRADDFDEEAIAQLLEAGVDHAHQHDHFDPDMDDIAAQQCLA

SEQ ID NO: 142549 - protein, 187 aa, Glycine max
  Coding DNA Sequence Number=SeqID_25771
MERQLEGIPGEATPAPSLDSTSMLLTQTGGRDQTSQLSTSRGSQKMQCNEEGPLGPVQKVGGCTEDLHLQTKKQRGEELDNLIVGGLKLYVNIPKYERENERHVEHRTKLKIQWGDDNHGTIAARQKQSQHKVPSMSYAKVVATNTMTSGQWQNPEKASFRHDGSQSSVHLEIPTGDKQWYTDAWVG

SEQ ID NO: 142550 - protein, 58 aa, Glycine max
  Coding DNA Sequence Number=SeqID_25772
SVLKKTAIERESLRMVKKEEFLRENGDNENRSVSRSDFPPNFIFGVATSAYQVPANPH

SEQ ID NO: 142551 - protein, 197 aa, Glycine max
  Coding DNA Sequence Number=SeqID_25773
  Gene Ontology: Mol. function=small conjugating protein ligase activity; Cellular component=membrane; Biological process=protein modification process
  Homolog annotation: Hit_ID=Q9LUQ5; Match level="QueryCoverage=88%, HitCoverage=28%, E-value=4e-72, Identity=71%"; Hit description =Similarity to ubiquitin-conjugating enzyme
  Pfam annotation: Domain name=UQ_con; Domain location=11-160; Score =78.1; E_value=2.7e-20; Accession=PF00179.16; Description=Ubiquitin -conjugating enzyme
MLQKPKNWAKKIQEEWKILEENLPETIFVRVCESRMELLRAVIIGPQGTPYHDGLFFFDCLFPSTYPAGPPKVHYHSGGLRLNPNLYQCGKVCLSLLGTWHGRNSENWIPEKSTMLQVLVSIQALILNEKPFFNEPGYPSTYPGSEGQRRSKEYNESTFILSLKTMMYTLRKPPKFRYLSGCLKLRTPLPRGSSLCE

SEQ ID NO: 142552 - protein, 191 aa, Glycine max
  Coding DNA Sequence Number=SeqID_25774
MEASLCIPGKGFILSIEGQPWKLLRKDLTTLAQTWSIFSYSNLAPTSRTSDLNTDRARLVYGLITRMDMNIGSLISGQMTMMAQSNSSRLGFPALITALCRLRGVGSDALTSYENLRPVIDLAYIIRNCWNANEPKVNFLEAKKTKLRAADVPYSFAPIAGIPASSTSTPLPALADLSAQSSQTSDAQLQS

SEQ ID NO: 142553 - protein, 136 aa, Glycine max
  Coding DNA Sequence Number=SeqID_25775
  Homolog annotation: Hit_ID=Q1STZ2; Match level="QueryCoverage=66%, HitCoverage=19%, E-value=6e-08, Identity=32%"; Hit description=IMP dehydrogenase/GMP reductase
MGSSQKPSLKKRFYPVKVKSLGITSLRELGQLMGQLQQQAFRKAYGKIWDLAMVEVSTEAIASLAQYYDQPLRCFIFGDFQLSPMVEEFEEILGCPLGGRKPYLFSGFYPSLARISKIVQISAQELDRQKQVENGV

SEQ ID NO: 142554 - protein, 309 aa, Glycine max
  Coding DNA Sequence Number=SeqID_25776
  Homolog annotation: Hit_ID=Q1T4D0; Match level="QueryCoverage=26%, HitCoverage=17%, E-value=2e-22, Identity=71%"; Hit description =SPla/RYanodine receptor SPRY
MSQYPSHFLSLPPPPAIPRHHLLWPPCHPAAPVPLPLPGAHRRRAPLPQRKIPPPRRRRPRHHPQPPLQQQQHFQLDQGNKNNNKGNYNYFVFRDGGVSGKRSLFNWGDHPSMAADAVENGWSRFAFTGYKSYMPSPLKKSALLGVCAAHGGGSDFGRELEAEISWEVACGSAEFMQKEEGGVAVEEAAGDGGVDVFEVEGSCVEVTEPGDDALRGGGRVLRGGGGGEVGDAEDGKNRGIGIATENPYYGTFQGVANHYPPQHQQPPVPYANYYQRQGYHVVPVYAVAEGRPVRERRLPCCGLSLGWFL

SEQ ID NO: 142555 - protein, 161 aa, Glycine max
  Coding DNA Sequence Number=SeqID_25777
  Gene Ontology: Mol. function=structural constituent of ribosome; Cellular component=ribonucleoprotein complex; Biological process =translation
  Homolog annotation: Hit_ID=O22584; Match level="QueryCoverage=92%, HitCoverage=92%, E-value=2e-57, Identity=80%"; Hit description=40S ribosomal protein S14
  Pfam annotation: Domain name=Ribosomal_S11; Domain location=28-157; Score=220.3; E_value=4.5e-63; Accession=PF00411.9; Description =Ribosomal protein S11
MSRRKVREPKEENVTLGPAVRDGEHVFGVARIFASFNDTFIHVTDLSGRETLVRITGMSYSLLIARPSGMKVKADRDESSPYAAMLAAQDVAARCKELGITALHIRLRATGGNKTKTPGPGAQSALRALARSGMKIGRIEDVTPIPSDSTRRKSGRRGRRL

SEQ ID NO: 142556 - protein, 43 aa, Glycine max
  Coding DNA Sequence Number=SeqID_25778
FTLVVLKHSSPATCKILLCWAATIECNGEGKCRGCPTLLLSRH

SEQ ID NO: 142557 - protein, 86 aa, Glycine max
  Coding DNA Sequence Number=SeqID_25779
MCCNLPSGGGAKRSLGWAKGASSIEGKHMESPPTFILGNRRKNQRMEKVEGLRILKMRVWELFTHGEGCFPRSYVFFNCDEEIRPM

SEQ ID NO: 142558 - protein, 212 aa, Glycine max
  Coding DNA Sequence Number=SeqID_25780
  Gene Ontology: Mol. function=RNA-directed DNA polymerase activity; Cellular component=chromatin; Biological process=chromatin assembly or disassembly
AKTLLQTYLDDQEWDLTAFVDLIEDDDDEGLFALVTALNLYRYRPTEELRWYVCSVLKLNLGIIWHSASVYSSPIILMKKEDSIWQMCIDYCALNQVKEKLNLGIIWHSASVYSSPIILMKKEDSIWQMCIDYCALNQVKEKLNLGIIWHSASVYSSPVILMKKEDSIWQMCIDYCVLNRVTIKFPIPMVDELLDELYRACFFSMLDFMSCT

SEQ ID NO: 142559 - protein, 66 aa, Glycine max
  Coding DNA Sequence Number=SeqID_25781
MILGKILKTTFPLSILVRMHSGWRRGKEKGGWQRRGRGYEGGWGRKRRVAADDGDDSKNVEGLLNL

SEQ ID NO: 142560 - protein, 313 aa, Glycine max
  Coding DNA Sequence Number=SeqID_25782
  Gene Ontology: Mol. function=sequence-specific DNA binding; Cellular component=nucleus; Biological process=regulation of transcription, DNA-dependent
  Homolog annotation: Hit_ID=Q1SC43; Match level="QueryCoverage=99%, HitCoverage=100%, E-value=2e-50, Identity=40%"; Hit description =Transcription factor, MADS-box
  Pfam annotation: Domain name=SRF-TF; Domain location=9-61; Score =54.7; E_value=3.2e-13; Accession=PF00319.9; Description=SRF-type transcription factor (DNA-binding and dimerisation domain)
MGRGRIPMELIQKEKARKKTFDKRKKGLLKKAYEISTLCAVDVGIVIYAPKFLNEPETWPQDQDSREVKRIIQKYQNTTSDRYSKMYNVQEYFNDRMKKIEGEISKVHKEKIKLMYPTWDDSYNTLGEEQLRMFVSILDVKLDACNQRMNMLKRDSKGKRITKSDKTQTLTPCMTSNFMSQTQQLFPSSDNNQVAFYPCQLSQSSQPSMFHFGQSCMQFMEKNAMVDWANQVGVGACDPKMGVLKEDGSDKNQNSSPCYNGNMQTLPSQLQYDATFQTLPNQLEQPSGVELNGFYDSNMLQLSQFFNYMHGRK

SEQ ID NO: 142561 - protein, 156 aa, Glycine max
  Coding DNA Sequence Number=SeqID_25783
MSEVWHLLKKSLRCKPHALEVHDPKAYSSTQRKPQGKISTQRHSLEDHVSHEIFLDRSSGEIMLCPCCPCSHEGSEDGKGVQEEPHPPRSTKRIIPSSKTHYVDCDECNFFSKKKVPLKKDSNDDLPISTRHHECDEKLKSTDTVEEHDHNIPEHS

SEQ ID NO: 142562 - protein, 382 aa, Glycine max
  Coding DNA Sequence Number=SeqID_25784
  Homolog annotation: Hit_ID=Q1SKD7; Match level="QueryCoverage=58%, HitCoverage=57%, E-value=2e-17, Identity=26%"; Hit description =Ankyrin
MAMKKLVAKRARKVTAREGSSTTPQVEIEFAGHRFRSEEHQGRFEVIKDWSFLKERRVHLAKGEYVEFQVEVARRRWTQLTEPMAKYDPEVVMEFYANTCPIKEGVMDRRSRVRGQWIPYDRDAINQFLGHPLVLEERQRCEYAERRSQFSGFDEEVIGQLLCSLGHDFARSVVGRQVRIIRTSMTTLTQIRMLLLLSNILPNDHNFDLSLPKCQLIYSIMTQISVHVAQLISDAIHQFIGIAPPRHLVDPEKSNTTLGFLALFRGLCQFYRAGTAAGARPVATVGRRCITIASTSATISRVHLSSHAEDGAPDACHFQDPNPYPWPTPEYFRATVTWPGGRPNFQEEVGPTDAQGVAQGSEGGAKDDGDMADLLDFFIGGD

SEQ ID NO: 142563 - protein, 85 aa, Glycine max
  Coding DNA Sequence Number=SeqID_25785
  Gene Ontology: Mol. function=ribonuclease H activity; Biological process=DNA integration
MLPFTLHGYRTSVRRSIGATPFSLVYGMEAILPFEKDHQGKWTPNYEGPFILKKAFLGGALLLMNMNDEELPSPMNSDVVKRYYA

SEQ ID NO: 142564 - protein, 57 aa, Glycine max
  Coding DNA Sequence Number=SeqID_25786
MTSTQEPMLESARSKVIRSALEHVPTGAKAMFGFAHDQREELGTMRWRSLDYNHTSS

SEQ ID NO: 142565 - protein, 174 aa, Glycine max
  Coding DNA Sequence Number=SeqID_25787
  Gene Ontology: Mol. function=N-acetyltransferase activity; Cellular component=cytoplasm; Biological process=metabolic process
  Homolog annotation: Hit_ID=Q9FKI4; Match level="QueryCoverage=100%, HitCoverage=62%, E-value=2e-45, Identity=58%"; Hit description =Similarity to N-acetyltransferase
MNLVAKGLRVQIEGRAVALAHVEGHVLGTKHLRSHMQNFLGLAAVMHRERERDPMSWRTPTISDAGQKERVETKGKERGIGGMACLFHGVLGCGHELGGEAELAVGAEDGEGGDVAVAVGGFFLHLGEDVADDAAVVVFGDVEELGPGEDVIEVVLHLVVLREAEQVARLHRQK

SEQ ID NO: 142566 - protein, 112 aa, Glycine max
  Coding DNA Sequence Number=SeqID_25788
  Gene Ontology: Mol. function=N-acetyltransferase activity; Biological process=metabolic process
  Homolog annotation: Hit_ID=Q9FKI4; Match level="QueryCoverage=76%, HitCoverage=41%, E-value=2e-25, Identity=68%"; Hit description =Similarity to N-acetyltransferase
MTAASPRKFCMLCESNGNRIEHVFGAEYVSLHVRKSNRAAFNLYTETLGYKIHDVEAKYYADGEDAYDMRKQLKGKQHHHHHHNHHHHHHHHHEHSGGCCSGEAKGNPAKAT

SEQ ID NO: 142567 - protein, 47 aa, Glycine max
  Coding DNA Sequence Number=SeqID_25789
MAKESAGESSRSMGSIAGTSACLRGGEGNQMAEEPRKDSYKLEQHPP

SEQ ID NO: 142568 - protein, 170 aa, Glycine max
  Coding DNA Sequence Number=SeqID_25790
  Subcellular localization annotation: CTP_CleavageSite=48; ConfidenceScore=5.69e-01
MSFTFNLHVPKALPPLPSSSRGTTSLFFSSKHKSYHNNTSPSQSLRITCSSQKSNHDDDGSLKYTSLALQIGVLLALAEQPVLAVTGENNRPELLWVLTQWGVVLFGYFLVVPCKSSEFRVILWAPFLNFRKFPRDPSLQYPWSVPEDPSKIRSSYAKYPYAEPEDYDNL

SEQ ID NO: 142569 - protein, 102 aa, Glycine max
  Coding DNA Sequence Number=SeqID_25791
  Subcellular localization annotation: CTP_CleavageSite=48; ConfidenceScore=5.16e-01
MGMGCKYTLPSISGAGMGREMGSQGRGWGKQNPTPTRPVAMPNLYTVKGSSLQSAGSVQSERHSKDSAHVTVYAINAILILLRKCLFHVNTILNSGKWTRVQ

SEQ ID NO: 142570 - protein, 172 aa, Glycine max
  Coding DNA Sequence Number=SeqID_25792
  Homolog annotation: Hit_ID=Q53MM4; Match level="QueryCoverage=68%, HitCoverage=29%, E-value=4e-11, Identity=31%"; Hit description=F-box domain, putative
  Pfam annotation: Domain name=F-box; Domain location=35-82; Score =44.4; E_value=4e-10; Accession=PF00646.23; Description=F-box domain
  Subcellular localization annotation: CTP_CleavageSite=22; ConfidenceScore=5.26e-01
MSKQQQSFAATAAAKRGPSPPSSDQIKKKRRETPTTILSLDPDIVTTIFAFLDMFDLVRCSLVCKLWNAIVESRSLREFCERKMHKSFAEFTKKPLRVILGEVAMEQHSLALQCGGFYVDQWKAHSTTVAQCRMKMGMLVTGVGHKNRSEDFGYNIYNLKLHWAVLLSRVGP

SEQ ID NO: 142571 - protein, 80 aa, Glycine max
  Coding DNA Sequence Number=SeqID_25793
MVRTRGLDRALGKVIGKALGRGVNRDSDKAPQRRRPTTSAHRKWGIAPVAEDVQHVDHAADRVHEQPEEPAADDVVPNAK

SEQ ID NO: 142572 - protein, 61 aa, Glycine max
  Coding DNA Sequence Number=SeqID_25794
MDRVLGEVERSGEHLGCRNPKLQWLPCFNMIPNHDQMIYAKKENVFLAMGSKATPESAWCK

SEQ ID NO: 142573 - protein, 53 aa, Glycine max
  Coding DNA Sequence Number=SeqID_25795
MPFPLLLLLLPLSVQLLIPLTYSNVARCCLAEEQSLSRKKANKSGKGGDRKGA

SEQ ID NO: 142574 - protein, 62 aa, Glycine max
  Coding DNA Sequence Number=SeqID_25796
  Subcellular localization annotation: CTP_CleavageSite=24; ConfidenceScore=5.12e-01
MATTNANGGGSVTGTRKRRRGNTTMSYGKEGEVFVLGAPSNTPGRSTTPKNRDFNLDSMKQV

SEQ ID NO: 142575 - protein, 143 aa, Glycine max
  Coding DNA Sequence Number=SeqID_25797
  Homolog annotation: Hit_ID=Q1SL15; Match level="QueryCoverage=79%, HitCoverage=13%, E-value=4e-09, Identity=29%"; Hit description =Ovarian tumour, otubain
MGQNTPNKIDDDGSNSHEGKPKNNDDTSVRNHLLKELAKWFDEYINVLGGISRFEELKWSLLVDGLSMVTMDEWMNITNIGYMIASRYNVILVSLSLQQSMTFFPLRSQPPTDWFVHHVFLRDRCPLPPLTLLWSTHYHSQAK

SEQ ID NO: 142576 - protein, 2183 aa, Glycine max
  Coding DNA Sequence Number=SeqID_25798
  Gene Ontology: Mol. function=nucleoside-triphosphatase activity; Cellular component=membrane; Biological process=cis assembly of U2 -type pre-catalytic spliceosome
  Homolog annotation: Hit_ID=O48534; Match level="QueryCoverage=99%, HitCoverage=99%, E-value=0.0, Identity=72%"; Hit description =Putative ATP-dependent RNA helicase
  Pfam annotation: Domain name=DEAD; Domain location=1364-1537; Score =142.5; E_value=1.2e-39; Accession=PF00270.19; Description=DEADDEAH box helicase
  Pfam annotation: Domain name=DEAD; Domain location=517-697; Score =157.4; E_value=3.7e-44; Accession=PF00270.19; Description=DEADDEAH box helicase
  Pfam annotation: Domain name=Helicase_C; Domain location=810-896; Score=50.6; E_value=5.4e-12; Accession=PF00271.21; Description =Helicase conserved C-terminal domain
  Pfam annotation: Domain name=ResIII; Domain location=1360-1507; Score= 7.0; E_value=1.2e-05; Accession=PF04851.6; Description=Type III restriction enzyme, res subunit
  Pfam annotation: Domain name=ResIII; Domain location=513-693; Score =2.3; E_value=3e-05; Accession=PF04851.6; Description=Type III restriction enzyme, res subunit
  Pfam annotation: Domain name=Sec63; Domain location=1017-1322; Score =595.0; E_value=6.7e-176; Accession=PF02889.7; Description=Sec63 domain
  Pfam annotation: Domain name=Sec63; Domain location=1850-2169; Score =529.5; E_value=3.6e-156; Accession=PF02889.7; Description=Sec63 domain
  Pfam annotation: Domain name=Utp21; Domain location=1841-2053; Score=- 103.4; E_value=0.069; Accession=PF04192.3; Description=Utp21 specific WD40 associated putative domain
  Pfam module annotation: Pfam domain module=DEAD::DEAD::Helicase _C::ResIII::ResIII::Sec63::Sec63::Utp21; Domain location=1364 -1537::517-697::810-896::1360-1507::513-693::1017-1322::1850 -2169::1841-2053
MAHLGGGAEAHARFKQYEYRANSSLVLTTDSRPRDTHEPTGEPESLWGKIDPKSFGDRAYRGRPPELDEKLEKAKNKKKKKDRDAAADDAAAVPSKRRRVQHDSVLSASDDGVYQPKTKETRAAYEAMLSVIQNQLGGQPLSIVSAAADEILAVLKNDVVKNPDKKKDIEKLLNPIPGHVFDQLVSIGKLITDFQEAVDVPNGSSAMDGEEGLDDDVGVAVEFEENEDDDEESDLDIVQDEEEEDEDVTEPNSSGAMQMGGIDDEDMEEGNEGMGLNVQDIDAYWLQRKISQAFEQQIDPQHCQKLAEEVLKILAEGDDREVENKLLFHLEFDKFSLIKFLLRNRLKIVWCTRLARAQDQEERERIEEEMKGTELQPILEQLHATRASAKERQKNLEKSIREEARRLKDDTGGDGDKESRDRSRRVVADRDGESGWLKGQRQMLDLDSIAFAQGGFFMAKKKCDLPDGSYRHLSKGYEEIHVPALKAKPLDPNEKLVKISSMPDWAQPAFKGMTQLNRVQSKVYETALFQPDNLLLCAPTGAGKTNVAVLTILQQIARHRNPKDGSIDHSAYKIVYVAPMKALVAEVVGNLSNRLQDYDVKVRELSGDQSLTRQQIEETQIIVTTPEKWDIITRKSGDRTYTQLVKLLIIDEIHLLHDNRGPVLESIVARTVRQIETTKDYIRLVGLSATLPNYEDVALFLRVDLKKGLFYFDNSYRPVPLSQQYVGITVKKPLQRFQLMNDICYEKVMAVAGKHQVLIFVHSRKETAKTARAIRDTALANDTLGRFLKEDSASREILHTHTDLVKSNDLKDLLPYGFAIHHAGMTRTDRQLVEDLFADGHVQVLVSTATLAWGVNLPAHTVIIKGTQIYNPEKGAWTELSPLDVMQMLGRAGRPQYDSYGEGIIVTGHSELQYYLSLMNQQLPIESQFVSKLADQLNAEIVLGTVQNAREACNWIGYTYLYVRMLRNPSLYGIAPDVLTRDITLEERRADLIHTAATILDRNNLVKYDRKSGYFQVTDLGRIASYYYITHGSISTYNEHLKPTMGDIELCRLFSLSEEFKYVTVRQDEKMELAKLLDRVPIPIKESLEEPSAKINVLLQAYISQLKLEGLSLTSDMVFITQSAGRLLRALFEIVLKRGWAQLAEKALNLCKMVTKRMWSVQTPLRQFNGIPSDLLTKLEKKDLAWERYYDLSSQEIGELIRAPKMGRTLHKFIHQFPKLNLAAHVQPITRTVLRVELTITPDFAWDDRIHGYVEPFWVIVEDNDGEYILHHEYFMLKKQYIDEDHTLNFTVPIYEPLPPQYFIRVVSDRWLGSQTVLPVSFRHLILPEKYPPPTELLDLQPLPVTALRNPSYESLYKDFKHFNPVQTQVFTVLYNSDDNVLVAAPTGSGKTICAEFAILRNHQKWPDSVMRVVYVAPIESLAKERYRDWEKKFGGGLKLRVVELTGETATDLKLLEKGQIIISTPEKWDALSRRWKQRKHVQQVSLFIIDELHLIGGQGGPILEVVVSRMRYIASQVENKIRVVALSTSLANAKDLGEWIGATSHGLFNFPPGVRPVPLEIHIQGIDIANFEARMQAMTKPTYTAIVQHAKNGKPALVFVPTRKHVRLTAVDLITYSGADSGEKPFLLRSAEELEPFLDKITDEMLKVTLREGVGYLHEGLNSLDRDIVTQLFEAGWIQVCVLNSSMCWGVTLSAHLVVVMGTQYYDGRENAQTDYPVTDLLQMMGHASRPLVDNSGKCVILCHAPRKEYYKKFLYEAFPVESHLHHFLHDNLNAEIVAGIIENKQDAVDYLTWTFMYRRLTQNPNYYNLQGVSHRHLSDHLSEMVENTLSDLEAGKCITIEDDMELAPLNLGMIASYYYISYTTIERFSSSVTSKTKMKGLLEILSSASEYAQLPIRPGEEEVVRKLINHQRFSFENPKVTDPHVKTNALLQAHFSRQFVGGNLALDQKEVLLSANRLLQAMVDVISSNGWLGLALLAMEVSQMVTQGMWERDSMLLQLPHFTKDLAKKCQENPGKSIETVFDLLEMEDNERQELLGMSDSQLLDIARFCNRFPNIDLSYEVLDSDNVRAGEVVTVLVTLERDLEGRTEVGPVDAPRYPKAKEEGWWLIVGDTKTNLLLAIKRVSLQRRLKAKLEFDAPADAGRKSYSLYFMCDSYLGCDQEYGFTIDVNADGGDQDSGRE

SEQ ID NO: 142577 - protein, 166 aa, Glycine max
  Coding DNA Sequence Number=SeqID_25799
MPGAQSNNHCPTYPTRLEHEVHRSSLKQVRPGIQDDFRQQCILHTEQKPLFLSCLFNVATIECLNLPIPNLPPSFIASPSHPPSSAPLAALALPPLPSSLRRTLIVSLPLSTTPTSVLIVAPSTIIGLSYPSFATFPSNRQAQLVNVYIGGADEVRKLYDSDNCLS

SEQ ID NO: 142578 - protein, 123 aa, Glycine max
  Coding DNA Sequence Number=SeqID_25800
  Gene Ontology: Mol. function=phospho-N-acetylmuramoyl-pentapeptide -transferase activity; Cellular component=integral to membrane; Biological process=peptidoglycan biosynthetic process
  Homolog annotation: Hit_ID=UPI000004897B; Match level="QueryCoverage =86%, HitCoverage=33%, E-value=3e-21, Identity=49%"; Hit description =ATTRANS11; catalytic
MAGSCVGFLLHNRYKASVFMGNIGSLALGGALAAMAACTGMFFPLLISSGIFIVESLSVIIQVLYFKMTKGFQGAWWWRFLRIPPFHYGLQLRGFREPNIVLGAYIISSVLALLGGYVGLVSA

SEQ ID NO: 142579 - protein, 175 aa, Glycine max
  Coding DNA Sequence Number=SeqID_25801
  Gene Ontology: Mol. function=nucleic acid binding; Cellular component= ribonucleoprotein complex; Biological process=RNA processing
  Homolog annotation: Hit_ID=Q5JM05; Match level="QueryCoverage=86%, HitCoverage=40%, E-value=6e-25, Identity=43%"; Hit description =Putative RNA-binding protein homolog
MGSLQTDETSNFCFAFSWLHALVEYETIEAAEKAVAMLNNEQDWRNGMRVKLLKGMGTYGHKKQAWKGSHSEKNSSRHVSEQTGDEENHGSNEHREDAHEEEDGDHLSKDKGGQRYRNQGRSRKHKYRAGNGMGHGSTPSTHAAEASKPPPGPRMPDGTRGFAIGRGRFPVPASN

SEQ ID NO: 142580 - protein, 188 aa, Glycine max
  Coding DNA Sequence Number=SeqID_25802
  Gene Ontology: Mol. function=phospho-N-acetylmuramoyl-pentapeptide -transferase activity; Cellular component=integral to membrane; Biological process=peptidoglycan biosynthetic process
  Homolog annotation: Hit_ID=O49730; Match level="QueryCoverage=59%, HitCoverage=34%, E-value=2e-14, Identity=39%"; Hit description =Phospho-N-acetylmuramoyl-pentapeptide-transferase homolog
MAPTPSHTSIPRDMKRDTAAFLVIYYLNPYILSFHFCGALVTQFRIVRLPLSPFYLTRPFLISAILASFAGYVCVPIFRHFKIIHVIKKQGPARHHMKKTAPTLGGLLFIPIGVVVAHVFAGSSSIEVSGAAGATIAFAAVGLLSDILSLTKNHWRALPALTEVLLEGLIGREERKEVRNWVDGNREG

SEQ ID NO: 142581 - protein, 142 aa, Glycine max
  Coding DNA Sequence Number=SeqID_25803
MELDMCYMSVNVQHVLNTCTQLQHVVSVLHRNRRQIKIIHWSKKNFAITVFPVTGRELICRRTIISIPIIKHCEIKSREYLETSAIEAGTGRVDEGRGWREREAFAAREVERERAMAVVEDARMRRHGCDAEKVDLRREWRK

SEQ ID NO: 142582 - protein, 161 aa, Glycine max
  Coding DNA Sequence Number=SeqID_25804
  Pfam annotation: Domain name=La; Domain location=129-161; Score=3.1; E_value=0.003; Accession=PF05383.7; Description=La domain
AAAGYPNVSPPPLADPVGASDLAAAASDDVVAEPEIHALISDEEHDHDHDHEHEHEHDHDLEHDHEHEHDHHEDRDDHAAVAAVSLEDLKLKIIKQATPLLPFNYSQFNNCFVPAEFAFCDADLWNWRVEYYFSDENLPTDKYLLGFVKRNKEGFADPKGS

SEQ ID NO: 142583 - protein, 181 aa, Glycine max
  Coding DNA Sequence Number=SeqID_25805
  Gene Ontology: Mol. function=nutrient reservoir activity; Cellular component=anchored to membrane
  Homolog annotation: Hit_ID=Q43557; Match level="QueryCoverage=90%, HitCoverage=44%, E-value=3e-44, Identity=50%"; Hit description =Unidentified precursor
  Pfam annotation: Domain name=CBM_4_9; Domain location=15-174; Score= -14.0; E_value=0.044; Accession=PF02018.8; Description=Carbohydrate binding domain
  Pfam annotation: Domain name=DUF642; Domain location=32-181; Score =68.1; E_value=2.9e-17; Accession=PF04862.3; Description=Protein of unknown function, DUF642
  Pfam module annotation: Pfam domain module=CBM_4_9::DUF642; Domain location=15-174::32-181
MKTQNYNNDNNCLLPGLVANGDFEVSPSSGFPNEAIVEGPSEVPNWKSNGNVELVESGQKQGGMILIVPQGRHAVRLGNDAEISQELPVEKGSIYSLTFCAARTCAQLESINVSVAPASQTVDLQTLYNVQGWNPYAVSFNADEDTFRLVFKNPGMEDDPTCGPIIDNIAIKKLFTPDKPK

SEQ ID NO: 142584 - protein, 208 aa, Glycine max
  Coding DNA Sequence Number=SeqID_25806
  Gene Ontology: Mol. function=RNA-directed DNA polymerase activity; Biological process=RNA-dependent DNA replication
MATKSIVQGDNNINYGGIDDFSVNNKESNKDMEYSMGVYKNPKLIVPKLVTQSFKTQPINHFEVTITEDDPIIALNVANKKISQTGLYKVSKRLSQIVTFMMIQWKATNTLGLEEKASQMVLRKQLIALQQILNGLISSQTFASLMPFPPSLTTRNGCLNKTFRKRFHFENSDLSTLIEHGWNAPPNSDLISKIRSCTKEMHQWGKDL

SEQ ID NO: 142585 - protein, 110 aa, Glycine max
  Coding DNA Sequence Number=SeqID_25807
MGMVFANTTGGTYAGWCLDTWHGHGDAANMHMLLQWCYAVGVGDMHATQAVCFVSGDGETHLAHMIFFADMNSGVTLMGMAISRDFFYKTDPLRNMFKKGPLLGISYQRM

SEQ ID NO: 142586 - protein, 53 aa, Glycine max
  Coding DNA Sequence Number=SeqID_25808
MKKKKKRFLVTVSETKKKKKVILISGPTDFGKSRLALELAKRLNDKIVSADSV

SEQ ID NO: 142587 - protein, 98 aa, Glycine max
  Coding DNA Sequence Number=SeqID_25809
  Gene Ontology: Mol. function=RNA-directed DNA polymerase activity; Biological process=RNA-dependent DNA replication
  Homolog annotation: Hit_ID=Q1STT2; Match level="QueryCoverage=69%, HitCoverage=15%, E-value=2e-10, Identity=57%"; Hit description =Lipocalin
MKKILGLQAPMELASQRLSSLLGVTKQLGKGKLKRDQLNESGQNDNEEGIWWNGFLRPPWFQPCNAREVRWKLSTDHDVMVTKIFEAKYFPQGGFLEA

SEQ ID NO: 142588 - protein, 90 aa, Glycine max
  Coding DNA Sequence Number=SeqID_25810
MGRVEQTGWGPWAIHKIHSPHEKVTLVLVVQLRDPMRRYDAVGGPMMVLIHATSAYTKGKEEEKRFKNFSHNGEETIANHKYIQQQQKIK

SEQ ID NO: 142589 - protein, 136 aa, Glycine max
  Coding DNA Sequence Number=SeqID_25811
  Homolog annotation: Hit_ID=O52175; Match level="QueryCoverage=28%, HitCoverage=44%, E-value=6e-14, Identity=94%"; Hit description =Salmonella berta plasmid pBERT, complete plasmid sequence
MGIKIKVATYMSMGLRTSIFLKGGYGDEYYRMLPIVIPKRGLPSPSGDILFSQVFSLVIKGNKSTQSVSSLNGGVFKVTSYVFRILEGHHPFGPSNKAFPPGGSLVRSPVPAFRFTGVIPLLWPRLSHSTPDTQFP

SEQ ID NO: 142590 - protein, 104 aa, Glycine max
  Coding DNA Sequence Number=SeqID_25812
  Subcellular localization annotation: CTP_CleavageSite=65; ConfidenceScore=5.10e-01
MPKGQIKLDEWSNWQLGNDWLSQGVHRSSSVYRVIAITSSLGVLRPSSVYQVISLLNLFSWESIMSNNLGVSSVLHNGCFDSRELGFPSLFDHFKLQVPSSFNL

SEQ ID NO: 142591 - protein, 52 aa, Glycine max
  Coding DNA Sequence Number=SeqID_25813
MNTKRGVKDKAPNTLPMKRPFGYKLESNEMLLSPIALKVVGPLLLDSNSSKG

SEQ ID NO: 142592 - protein, 112 aa, Glycine max
  Coding DNA Sequence Number=SeqID_25814
MAAEWRRKRERRRHFKEKMDLKEAHHHRRPRIKAWRKKEMNEGRGREEHGILCYKKALKSKIIGPNLGSWVQKSTLRFMRTLRSSSAALAQSSWSLSLMALVIGLFLGRIGP

SEQ ID NO: 142593 - protein, 118 aa, Glycine max
  Coding DNA Sequence Number=SeqID_25815
MVEEQMEWREVRRREMRRRSFSKHQSTWRQSNKVVGRWMGHKDEDGEYLKLYKRGVEVDDREFSTNHGKRDEENKWVIYQYSEKAGHRGAHAHLGISYTNSTRKIIPKFDTHGRRGGR

SEQ ID NO: 142594 - protein, 102 aa, Glycine max
  Coding DNA Sequence Number=SeqID_25816
MFRTTTSHKPKRKKDCNFPKDIGETKHTTNPRSKGTQKTIKKKERKKERNMNETNLRSQKVDEETSEETKQRWFFIEEVAEKTQLRKRGDGVELCGCVGFIS

SEQ ID NO: 142595 - protein, 106 aa, Glycine max
  Coding DNA Sequence Number=SeqID_25817
MYGEFLYVEEPIESRECLNFARFFNRMNMKDLVNTMIRVHITKDIFEIKLVEEEVEDCANRLLCRKCAVSLVMNVDTNDMEDDFDESFINGDIQRCCASYIIDKST

SEQ ID NO: 142596 - protein, 137 aa, Glycine max
  Coding DNA Sequence Number=SeqID_25818
  Gene Ontology: Mol. function=sequence-specific DNA binding; Cellular component=nucleus; Biological process=regulation of transcription, DNA-dependent
  Homolog annotation: Hit_ID=Q67BK3; Match level="QueryCoverage=99%, HitCoverage=61%, E-value=6e-48, Identity=72%"; Hit description=AGL15
  Pfam annotation: Domain name=K-box; Domain location=2-77; Score=12.0; E_value=4.3e-05; Accession=PF01486.8; Description=K-box region
MVEILREEIEKLETKQLQLVGKDLTGLGLKELQNLEQQLNEGLLSVKARKEELLMEQLEQSRVQIEELRCLFPQSESMVPFQYQHTERKNTFVNTGARCLNLANNCGNEKGSSDTAFHLGLPAGVQEEGPQERNLFK

SEQ ID NO: 142597 - protein, 481 aa, Glycine max
  Coding DNA Sequence Number=SeqID_25819
  Gene Ontology: Mol. function=RNA-directed DNA polymerase activity; Cellular component=chromatin; Biological process=RNA-dependent DNA replication
  Pfam annotation: Domain name=rve; Domain location=333-479; Score =60.7; E_value=4.9e-15; Accession=PF00665.16; Description=Integrase core domain
MKEEVRKEVLKLLEAGLIYFISDSAWAVIGWRTCIDYRKLNKATRKDHFPLSYMDQMMERLAGQSFYCFLDGIPFGLCNVPATFQRCMLAIFANMVEKCIECLFMVQEGIVLGHKILAQGIEVDKAKMDFIEKLPPPTLKAKLVSTPIMVAPNWSKEFKLMCDASDYAIGAVLGQQRDKIFHAIYYASKVLNDEQLNYVTTEKEMMAIVYALKKFRSYLVDKISPVDSRVRHHIKGKKGSENVEVTQEEQEVKDEFSDESLLFVATRSWFTDIANYKATGVIQQDLYWNQFKAYCGTVTAHLMETIIVEIGQLPEYFRLDFSSPPFSRMPMTTYFALGGLILWGPQPSSHGKAYILVYVDYVSKWVEAIATPQNDARIMIKFLKKNIFSRFGIPRVLISDGGTHFCNAQLQKVLRHYNARHKVVSPYHPQTNDQVKVSNREMKRISEKTVTSSRKDWAAKLDDALWAYRTAFKTSIGLSPF

SEQ ID NO: 142598 - protein, 152 aa, Glycine max
  Coding DNA Sequence Number=SeqID_25820
MREDCDDFKKKLSTLSKPSRAKLAQGTNGLSPGIPLSTTTTDWREDQGTRVHQMLSAPYTLSVNTINAAVIVRLRAKCHTHAKRVPRLARSLVLSPSKWLLGNAKPDPAKHMKGIPPGTPLGSSQRQHGTDIKTKLPEKEIDVALVKDFYSN

SEQ ID NO: 142599 - protein, 94 aa, Glycine max
  Coding DNA Sequence Number=SeqID_25821
MHGVVFTLTAKRPDFATPAKQLEQSNQVNKHAVKDIVRQCFIIDNYYHWTKRTSRAKALSSKANMVQDNAIQKRLWFMNSRFVVLNIEDNNLKY

SEQ ID NO: 142600 - protein, 465 aa, Glycine max
  Coding DNA Sequence Number=SeqID_25822
MEKNTNMRLRDLSETKDEEVPQLQRKRKKDEDKGNKRKLGILEKNWNPPSPSHESTQRLIKNNSRVQDKNQEEFKTQEESLETRIKIQGYILCGTSRGYIYLGLTENKRGYISCGSVLVEGTSTRFKENKVGYIPCGSLLVNGFLQVNPVDLVLSLVENSMIGGILAEVYAFNQAIAYSPGLHINRTTDIKIEPDHCYPRLPPRDEGKEKGFKLYYNEEMLNKQKNVETFWNQIVWNDMIKALSFDYDNNDNVDHEDSIQDSEDDTIISRLIELPIIFNDIVYDLMKMDERDFKDHVMKIHEVQKPKRKELEKAYKVVIEAKKVVEENAKAEIEKRTKAIQQVLDDAAKVTKVFIDLTIEEVRDAIVVFSSNFDVALINLSASSSLTKDHIQAMLDQALTRQNEETQMLVTHVMAQQREETRKELQAYVEQQILKSEQYKHSIQFTIATQFTSLSKMLLHNLQQA

SEQ ID NO: 142601 - protein, 427 aa, Glycine max
  Coding DNA Sequence Number=SeqID_25823
  Gene Ontology: Mol. function=cystathionine beta-lyase activity; Cellular component=chloroplast; Biological process=amino acid metabolic process
  Homolog annotation: Hit_ID=Q5P1T6; Match level="QueryCoverage=78%, HitCoverage=87%, E-value=1e-86, Identity=51%"; Hit description =Cystathionine beta-lyase, putative (EC 4.4.1.8), gene: metC
  Pfam annotation: Domain name=Aminotran_1_2; Domain location=40-327; Score=-88.9; E_value=0.0064; Accession=PF00155.11; Description =Aminotransferase class I and II
  Pfam annotation: Domain name=Aminotran_5; Domain location=42-324; Score=-174.1; E_value=0.0016; Accession=PF00266.9; Description =Aminotransferase class-V
  Pfam annotation: Domain name=Beta_elim_lyase; Domain location=34-308; Score=-52.3; E_value=3.1e-07; Accession=PF01212.11; Description=Beta -eliminating lyase
  Pfam annotation: Domain name=Cys_Met_Meta_PP; Domain location=8-360; Score=325.4; E_value=9.8e-95; Accession=PF01053.10; Description =CysMet metabolism PLP-dependent enzyme
  Pfam annotation: Domain name=DegT_DnrJ_EryC1; Domain location=37-405; Score=-182.9; E_value=0.0031; Accession=PF01041.8; Description =DegTDnrJEryC1StrS aminotransferase family
  Pfam module annotation: Pfam domain module=Aminotran_1_2::Aminotran _5::Beta_elim_lyase::Cys_Met_Meta_PP::DegT_DnrJ_EryC1; Domain location=40-327::42-324::34-308::8-360::37-405
MSPYSDSYTRLAQAAVSPPESSYPVAPPLYQTASFATDEASVFLDMATRPLHSGFYTRYGNPTTRAFESAVADLEGGECALATASGMGAITAALFAFAARGDHVVAQRVLYGGTTGLLQNIAPQLGIDVTFVDQADVAGFAAAVRPNTRLFMLESPSNPMLRLTDLARLAEIARARGITTLVDNTIASPINQRPLEFGIDLVMHSATKYLCGHGDVSAGVLVGDERRIKAVWEKAYLLGATLDPFAAWLVLRGLRTLPMRVARQNETALKVARHLEAHASVCAVHYPGLESHPQRALAQTQMSGRASRGRACAGPSFGKLRVVLDAGGASGGDVGRHDDTGTVGGLRAAARSDPAGSGFREPCRNHRRSGYRARGSRLTPPLRPRAQLARGYAEASLEQAAEMGRMRKPDLIGQLGDTAMPMARIQQ

SEQ ID NO: 142602 - protein, 125 aa, Glycine max
  Coding DNA Sequence Number=SeqID_25824
MRILWWSGTTKFAWRRLHLGVVGVFVEPHGHAQHQPLPLRVLFEEKFKSVIPLLFPSSFTTRPILSLPSFSPTFIKQPQYATCRESPPLVGGMFSRTLEYGLVLLGCTMNHDPDENTPCKKFQGC

SEQ ID NO: 142603 - protein, 95 aa, Glycine max
  Coding DNA Sequence Number=SeqID_25825
MENSSSSQSSKVTVLMNINDILCRCAQLADIKELQDKVEKMKDDLNEASRKVELGNEMLVVVRNKSDENGVECRKIRFFVCIMLLLLVARLMYSS

SEQ ID NO: 142604 - protein, 111 aa, Glycine max
  Coding DNA Sequence Number=SeqID_25826
MAEFEERLFAKVDSEVDIIYNKANEGESDNDEDDVAEGEDTEGDAASLPSTKLTHHLTQGIFLEVGEQDRMKFTLYLVLDSHNIIKEKIIQHATANRKHLEDKQRRIVVPN

SEQ ID NO: 142605 - protein, 102 aa, Glycine max
  Coding DNA Sequence Number=SeqID_25827
  Gene Ontology: Mol. function=protein disulfide oxidoreductase activity; Cellular component=chloroplast; Biological process=cell redox homeostasis
  Homolog annotation: Hit_ID=Q9LIF1; Match level="QueryCoverage=99%, HitCoverage=100%, E-value=4e-40, Identity=76%"; Hit description =Glutaredoxin-like protein
  Pfam annotation: Domain name=Glutaredoxin; Domain location=13-75; Score=72.4; E_value=1.4e-18; Accession=PF00462.14; Description =Glutaredoxin
MERITKLASQKAVVIFSKSSCGMSHAIKRLFYEQGVGPAIYELDEDTRGKEMEWALLRLGCNPSVPAVFVGGKFVGSANTVMTLHLNGSLKKMLRDAGALWL

SEQ ID NO: 142606 - protein, 272 aa, Glycine max
  Coding DNA Sequence Number=SeqID_25828
  Gene Ontology: Mol. function=translation elongation factor activity; Cellular component=intracellular; Biological process=translational initiation
  Homolog annotation: Hit_ID=Q67UH6; Match level="QueryCoverage=43%, HitCoverage=25%, E-value=4e-11, Identity=34%"; Hit description =Mitochondrial transcription termination factor-like
  Subcellular localization annotation: CTP_CleavageSite=7; ConfidenceScore=5.84e-01
MASPTPKSAASSKHTLTSSPTTPAKPSSPNSPSSSPKAPPPPTSFASSPKTLESSTSISTTPSPRATTSSKNSCFPMIPPSAPSNHAPASSFRTPPSSTFNFSSTTMSRNPRLLCCFATGPARSLPMPPRFRMRFGRKSLWERKVEVYRKWGWSEEILLSTFLRNPWCMLVSEKKIEAMMEFFITHLGLDSLCFAKHPVLIALSLEKRVVPRASVLQFLLAKGLLKDVNWASAFIVTDKIFLQKFVVSYEKEADQLLKLYEEKRDVPREERC

SEQ ID NO: 142607 - protein, 396 aa, Glycine max
  Coding DNA Sequence Number=SeqID_25829
  Gene Ontology: Mol. function=structural constituent of ribosome; Cellular component=intracellular; Biological process=translation
  Homolog annotation: Hit_ID=Q0WWX4; Match level="QueryCoverage=99%, HitCoverage=60%, E-value=9e-87, Identity=46%"; Hit description =RanGAP1 interacting protein
MVSIHHQELVAVVFYVALNGHGETLVYDVVKSEWSVAITSPPSSITTNKGFSVALVQHKDKDFLVAFGGSKKEPSNQVEVLITEKIESVLGRRPTSTKDPRSILLEKHSLSAGLASQLKNDSSQHLINSVARQNLASVIEHSSERKSLSESLLVQDSNSLPTNISLRRQFDHDEECNADVRIDKHSEDESSFPRNSLQAADHKTNQNDPRNHMSRSGAKTNMEEQVSVSRSSNQKNLGFGNPVLESDDVSFPENSKSGSLSAASDIHHYYETKVASLMRKFGILEGQLAVALASREASEKSLASAFKSRQEMERKLADTLKEMELLREKLVSAELVQEEANNLSNMVHADNVRLEHDVAFLKAVLDDTQKVEVFHLKQRLQSMEKRAPTPRKPFQV

SEQ ID NO: 142608 - protein, 537 aa, Glycine max
  Coding DNA Sequence Number=SeqID_25830
  Gene Ontology: Mol. function=binding; Cellular component=thylakoid; Biological process=photosynthesis
  Homolog annotation: Hit_ID=O82028; Match level="QueryCoverage=27%, HitCoverage=74%, E-value=4e-63, Identity=83%"; Hit description=IVR -like protein
  Pfam annotation: Domain name=TPR_1; Domain location=20-53; Score =13.4; E_value=0.13; Accession=PF00515.18; Description=Tetratricopepti de repeat
  Pfam annotation: Domain name=TPR_1; Domain location=225-258; Score =9.6; E_value=0.38; Accession=PF00515.18; Description=Tetratricopeptid e repeat
  Pfam annotation: Domain name=TPR_1; Domain location=326-359; Score =20.3; E_value=0.0069; Accession=PF00515.18; Description =Tetratricopeptide repeat
  Pfam annotation: Domain name=TPR_1; Domain location=393-427; Score =6.3; E_value=0.95; Accession=PF00515.18; Description=Tetratricopeptid e repeat
  Pfam annotation: Domain name=TPR_1; Domain location=461-494; Score =24.9; E_value=0.00028; Accession=PF00515.18; Description =Tetratricopeptide repeat
  Pfam annotation: Domain name=TPR_2; Domain location=117-150; Score =2.3; E_value=18; Accession=PF07719.7; Description=Tetratricopeptide repeat
  Pfam annotation: Domain name=TPR_2; Domain location=191-224; Score =15.7; E_value=0.17; Accession=PF07719.7; Description=Tetratricopeptid e repeat
  Pfam annotation: Domain name=TPR_2; Domain location=20-53; Score =17.7; E_value=0.042; Accession=PF07719.7; Description=Tetratricopepti de repeat
  Pfam annotation: Domain name=TPR_2; Domain location=225-258; Score =9.1; E_value=2.9; Accession=PF07719.7; Description=Tetratricopeptide repeat
  Pfam annotation: Domain name=TPR_2; Domain location=293-325; Score =10.1; E_value=2.2; Accession=PF07719.7; Description=Tetratricopeptide repeat
  Pfam annotation: Domain name=TPR_2; Domain location=326-359; Score =15.7; E_value=0.17; Accession=PF07719.7; Description=Tetratricopeptid e repeat
  Pfam annotation: Domain name=TPR_2; Domain location=393-427; Score =8.8; E_value=3.2; Accession=PF07719.7; Description=Tetratricopeptide repeat
  Pfam annotation: Domain name=TPR_2; Domain location=461-494; Score =28.0; E_value=3.3e-05; Accession=PF07719.7; Description =Tetratricopeptide repeat
  Pfam module annotation: Pfam domain module=TPR_1::TPR_1::TPR_1::TPR _1::TPR_1::TPR_2::TPR_2::TPR_2::TPR_2::TPR_2::TPR_2::TPR_2::TPR_2; Domain location=20-53::225-258::326-359::393-427::461-494::117 -150::191-224::20-53::...
  Pfam module annotation: Domain location=225-258::293-325::326 -359::393-427::461-494
MEVPKDQIATLLEHGLYNSAQMLVLLGDSFFREREYRRAIHTYKQALQCYKMIPKQNMTSSRSSLSSNRSSSPNSCNGSVINENEVKFKIASCHCFLNENKAALVEMEGIPSKARNLPMNLLLGKLYRISRHSRAAVAIYKECLRHCPFVLEAITALAELGSTAKDIITLIPQTPNRSGRASFDHTDSSRWLQRYVEAQCCMASNDYKGGLELFADLLQRFPNNIHLLLEMAKVEAIIGKNEEAIMNFEKARSIDPYIITYMDEYAMLLKLKSDYPKLNKLVHDLLNIDPARPEVFVALSVLWERKDEKKALQYAEQSIRIDERHIPGYIMKGNLLLTMKRAEAAVPAFRAAQELRPDIRSYQGLVHTYLALSKIKEALYASREAMKAMPQSAKALKLVGDVHASNSSGREKAKKFYESALRLEPGYLGAALALAELHVIEGRNGDAVSLLERYLKDWADDSLHVKLAQVFAATNMLQEALSHYQAALRLNPQNEAAKRGLERLEKQMKGVDPDAPEEDEDNDVEDADGDQDETELL

SEQ ID NO: 142609 - protein, 479 aa, Glycine max
  Coding DNA Sequence Number=SeqID_25831
  Gene Ontology: Mol. function=GTP binding; Cellular component =intracellular; Biological process=small GTPase mediated signal transduction
  Homolog annotation: Hit_ID=Q8L7L0; Match level="QueryCoverage=82%, HitCoverage=64%, E-value=1e-113, Identity=51%"; Hit description=GTP -binding protein obg-like
  Pfam annotation: Domain name=ATP_bind_1; Domain location=265-447; Score=-72.2; E_value=0.09; Accession=PF03029.7; Description =Conserved hypothetical ATP binding prot
  Pfam annotation: Domain name=GTP1_OBG; Domain location=122-259; Score= 173.8; E_value=4.2e-49; Accession=PF01018.12; Description=GTP1OBG family
  Pfam annotation: Domain name=MMR_HSR1; Domain location=261-399; Score= 118.5; E_value=1.9e-32; Accession=PF01926.13; Description=GTPase of unknown function
  Pfam module annotation: Pfam domain module=ATP_bind_1::GTP1_OBG::MMR _HSR1; Domain location=265-447::122-259::261-399
  Subcellular localization annotation: CTP_CleavageSite=74; ConfidenceScore=5.38e-01
MGMRLIDVESATSSISAFARRNGNRSSKIPNPKFQKPVLPVPGGESTTYTRLLLPPLSPLPKSSSPKRRHRSPASSAIENDPTEPESDGEYEFSGDENVVKGEEETPSVKEKSVPAVMRSFDRAKIYVKAGDEGNGVVAFRREKYVAVGGPSGGDGGRGGDVYVEVDGAMNSLLPFRNSVHFRAERGGHGHGSMQSGAKGEDVVVKVPPGTVVRMSGKNNVLLVYPGHKGLLLPGGRGGRGNASFKSGTIRWLELELKLVVDVGIVGAPNAGKSTLLSVVCAAKPAVANYPFTTLLPNLGVVSFDYDSTMVVADLPGLLEGAHRGFGLGHEFLRHTERCASLLCLILELPAYHTAPRVHVVDVSSPLPDLEFDAVCLELKLFNPKLAEKPYVVAFNKMDLPEAYENWKSFKEKLQSHGITPFCMSAVKREDGGDMVNLNHVAVAVKKLRNASISDFEICHDSDSNIWHVVGSGLQDLYR

SEQ ID NO: 142610 - protein, 475 aa, Glycine max
  Coding DNA Sequence Number=SeqID_25832
  Gene Ontology: Mol. function=ATP binding; Cellular component =chloroplast; Biological process=response to heat
  Homolog annotation: Hit_ID=Q1SEZ3; Match level="QueryCoverage=96%, HitCoverage=91%, E-value=5e-98, Identity=57%"; Hit description=Heat shock protein Hsp70
  Pfam annotation: Domain name=HSP70; Domain location=9-475; Score =392.9; E_value=4.8e-115; Accession=PF00012.10; Description=Hsp70 protein
MAKEDQKFVIGIDLDNQRLIGDAAKNQAVTNPENTVFDAKRLIGRKYSDPIIQKEKTLWSFKVVAGINDKPMIVVKYKDAGDFRGLFGNTSEECCCYRTKDAGAIAGLNVMSIINEPTATDIAYGLNKRTNCVGERNIFIFDLGGGTLDAALLTIKDVYEVKATAGKRKFEEIDMELFEECMETVDKCLTDSKMGKGSVRDVVLVGGSSRISKVQELLQDLFDGKDLCKSINPDEAVPYGASVQAAMLSEGIKNVPDLVLLGVTPLSLGILTKGDVMSVVIPRNTRIPVRKTQVCCNLDNQKRVPFSVYEGERARANDNNLLGSFVLSGLPPSPRGHPLDVSFAIDVNGILSVSTEEKTSGNKNEITIINDKDRLSTEEIGRLIQEAEKYRAEDKKFLRKANAMNSLGYYVYKMRNVLKKDISSLCSKEREKIDYAITKATNLLDDSKYQYEVEVFEDHHKELASFFESIASKIG

SEQ ID NO: 142611 - protein, 294 aa, Glycine max
  Coding DNA Sequence Number=SeqID_25833
  Gene Ontology: Mol. function=transcription factor activity; Cellular component=nucleus; Biological process=regulation of transcription, DNA-dependent
  Homolog annotation: Hit_ID=Q6J9Q2; Match level="QueryCoverage=38%, HitCoverage=35%, E-value=5e-33, Identity=63%"; Hit description =Putative AP2/EREBP transcription factor
  Pfam annotation: Domain name=AP2; Domain location=45-109; Score =105.3; E_value=1.8e-28; Accession=PF00847.10; Description=AP2 domain
  Subcellular localization annotation: CTP_CleavageSite=33; ConfidenceScore=5.12e-01
MSTSRTSDASLKGYESNQTQMNLSLLQRNMSPSGERRGRGKQAEPGRFLGVRRRPWGRYAAEIRNPLTKERHWLGTFDTAQEAALAYDRAALSMKGCQARTNFIYSKDTNTNIFHNALTPMNAQPLLPPSYNTHNPQPINQSGLSHLGNISSHIENPSGMSSSGSPQDDNFFFSSDSNSGYLECIVQDNCSRKSNASASSHDLKLGHVNTSSMHVQPHFDTTHEVLNMQTTVASNSADFSYPSKGLWDCSSNELAAMFKNPSRAEEGCMNALYPFTDSSSYGFMTQAEPVSSTT

SEQ ID NO: 142612 - protein, 448 aa, Glycine max
  Coding DNA Sequence Number=SeqID_25834
  Gene Ontology: Mol. function=nucleic acid binding; Cellular component= nucleus
  Homolog annotation: Hit_ID=Q6NPN3; Match level="QueryCoverage=86%, HitCoverage=84%, E-value=3e-94, Identity=44%"; Hit description=Zinc finger CCCH domain-containing protein ZFN-like 3
  Pfam annotation: Domain name=zf-CCCH; Domain location=104-130; Score =39.7; E_value=1e-08; Accession=PF00642.15; Description=Zinc finger C- x8-C-x5-C-x3-H type (and similar)
  Pfam annotation: Domain name=zf-CCCH; Domain location=151-177; Score =43.5; E_value=7.4e-10; Accession=PF00642.15; Description=Zinc finger C-x8-C-x5-C-x3-H type (and similar)
  Pfam annotation: Domain name=zf-CCCH; Domain location=59-85; Score =44.9; E_value=2.7e-10; Accession=PF00642.15; Description=Zinc finger C-x8-C-x5-C-x3-H type (and similar)
  Pfam module annotation: Pfam domain module=zf-CCCH::zf-CCCH::zf-CCCH; Domain location=104-130::151-177::59-85
MEQYGRSSEGSRSDPSPEWAGPEAQTGLEAGSILIVENAEPMWQLGMGGAGEESYPQRPDEVDCTYYLRTGFCGFGSRCRFNHPRDRAAVAGAERTTGEYPERVGQPVCQYYMRTRTCKFGSSCKYHHPRQAGGTAATPMSLSYYGYPLRPGEKECSYYVKTGQCKFGATCKFHHPVPAGVQIPAPSPVAPSPLPVPVPSPLYSTMQPPPGPSSQQIGVLVARPPMLPGSLVQSPYGPVVLSPAMVPISGWGPYQVGQAFLFDCSVKLHVHSLKPLTIEFLVQASATGAVHPSGTPSNVGSPQLYGITQLPSPVAAYPGPYQPSGSPVGPSSSSQKEQAFPERSNQPEYQYYPKTGEVKFGPSYRYNPPPDMSAPKANVILSPAGLPLRPVMDASQLCCNIWRLLLSCELHMHDPSPLFHIVGKGFAVVDPSSLQQSSIASRDQTSYL

SEQ ID NO: 142613 - protein, 87 aa, Glycine max
  Coding DNA Sequence Number=SeqID_25835
  Gene Ontology: Mol. function=nucleic acid binding; Cellular component= nucleus
  Homolog annotation: Hit_ID=Q6NPN3; Match level="QueryCoverage=57%, HitCoverage=11%, E-value=1e-08, Identity=54%"; Hit description=Zinc finger CCCH domain-containing protein ZFN-like 3
MGPPVDKVKPIDPVNVDEDILDGTDSLLDPEDRVQLACQPGKKQMDYNSVIPYDDRICMQNQTYTLHVVHNECKLVPPPDYQTQTLD

SEQ ID NO: 142614 - protein, 126 aa, Glycine max
  Coding DNA Sequence Number=SeqID_25836
  Subcellular localization annotation: CTP_CleavageSite=40; ConfidenceScore=5.42e-01
MLLQKFQQAQQSMLIAIINPSVQPQPTLPPTSTPSILPTPAQVEPTPPSKKEKSLALSIHRTKKPSSSITPSSKASSKALSVGNCYDDESKDKEINEDDELPFISRKIRKMWRDNSGSKRFFKEKK

SEQ ID NO: 142615 - protein, 123 aa, Glycine max
  Coding DNA Sequence Number=SeqID_25837
  Homolog annotation: Hit_ID=Q9SPJ6; Match level="QueryCoverage=78%, HitCoverage=52%, E-value=2e-28, Identity=68%"; Hit description =Maturation protein pPM32
MEKKLVAIQYLCMLRENRSSVDFTYDTKEKTKDAKENIEDVVGSMKDRVENAAEKTFDYSYDTKESAKDTTRMVADKSREGAERMKEKMEEVAVLAGETLKSLAKKAKQGVQGAWEMAVNLQD

SEQ ID NO: 142616 - protein, 183 aa, Glycine max
  Coding DNA Sequence Number=SeqID_25838
  Homolog annotation: Hit_ID=UPI0000D9B3B9; Match level="QueryCoverage =95%, HitCoverage=52%, E-value=1e-07, Identity=25%"; Hit description =PREDICTED: similar to splicing factor 3a, subunit 2
  Subcellular localization annotation: CTP_CleavageSite=45; ConfidenceScore=5.49e-01
MNSLPSVVHASSTFESGAPRIDCLALFANSPFSTFIRSPMNILPSAVHASSTFESGAPRIDCLALFASSPFSTFIRSPMNLLPSAVHVSSTFESGAPAVHVSSTFESGAPRIDCLALFANSPFSTFIRSPMNSLPSAFHAYSTNESGAARIDCLALFANSPFSTFMRSPMNSLPSAFHASSTN

SEQ ID NO: 142617 - protein, 75 aa, Glycine max
  Coding DNA Sequence Number=SeqID_25839
  Homolog annotation: Hit_ID=Q2QWU6; Match level="QueryCoverage=97%, HitCoverage=7%, E-value=4e-12, Identity=50%"; Hit description =Leucine Rich Repeat family protein, expressed
MARDWSSFGVILLEPLTGKTAVTKRMELVKWVLSNPTDQDYILDFNVSKTSQVIRNHMLDILEIALVCVSTSPEV

SEQ ID NO: 142618 - protein, 66 aa, Glycine max
  Coding DNA Sequence Number=SeqID_25840
MALAYYLLKYKFKVKSYKPEPLGIGLKCGVKFTYVVAHGRRCCGDARNWSMLAEMTRRARTTTVKL

SEQ ID NO: 142619 - protein, 333 aa, Glycine max
  Coding DNA Sequence Number=SeqID_25841
  Gene Ontology: Mol. function=chromatin binding; Cellular component =chromatin; Biological process=chromatin assembly or disassembly
  Homolog annotation: Hit_ID=Q1SAV4; Match level="QueryCoverage=58%, HitCoverage=61%, E-value=3e-38, Identity=39%"; Hit description =Integrase, catalytic region
  Pfam annotation: Domain name=rve; Domain location=129-285; Score=8.1; E_value=0.0013; Accession=PF00665.16; Description=Integrase core domain
MDSWGYQGSVDGSLEDAIGTTPILLLPNFNLPFVLETYASGVGMGVVLFQHGHPIAFFSKPFSPKLIHASTYVRKLFAIIAATLEQQMYLARLIGYDYTIQYRSSKSNVVVDALSRVSEIPSSTFLSLSDVERFVATCVDCQHTKYETRKAARLLGHNTILVVVDRFPKGIHLSMLPLHHTSLTVVLLFMEIMGKLHGMPKSLILDRDSLFISRFWQELFRISGTKLCMSSAYHPQFDGQTALSNNTFVPSITRDPLHGESSDLSPYELTFGKKPFTISQYDAGTSNEEVVDDFLSSREAVFAELRKKPLEAQENMKRYVDSNRRDVDSDKED

SEQ ID NO: 142620 - protein, 101 aa, Glycine max
  Coding DNA Sequence Number=SeqID_25842
MKKLARKFHNEEDENLPLPIHDGDSRPLDPQDLDFDAQSKKSWFVLLKGVKLNRVAYGGPYLQLYSSVTSCFFCTPSSSRLHLCGNWFTSLVRISASHFML

SEQ ID NO: 142621 - protein, 213 aa, Glycine max
  Coding DNA Sequence Number=SeqID_25843
  Gene Ontology: Mol. function=enzyme inhibitor activity; Cellular component=cell wall; Biological process=cell wall modification
  Homolog annotation: Hit_ID=P93674; Match level="QueryCoverage=74%, HitCoverage=85%, E-value=5e-69, Identity=79%"; Hit description =Putative 21kD protein precursor
  Pfam annotation: Domain name=PMEI; Domain location=49-205; Score =174.9; E_value=2e-49; Accession=PF04043.6; Description=Plant invertasepectin methylesterase inhibitor
IHYVVDGKDEVSPQLEEEEDGHGGDGRGKDEDALPCSNNEPQRRRWGGGDSGNRSRGTTQYPALCIQSLSVYASTIQQDPHELVQTALSLSLNHTEATKTFVAKCNKFRGLKPREYAALKDCAEEISDSVDRLSRSLKELKLCKVKGEDFTWHISNVETWVSSALTDESTCGDGFAGKALNGKIKEAIRARMVNVAQVTSNALSLINQYAAQH

SEQ ID NO: 142622 - protein, 85 aa, Glycine max
  Coding DNA Sequence Number=SeqID_25844
MGKGNEYLSGTGEHVEGILRFFDDKDVVEADVMVEDAVAEGVMKVEDEGLEVDTGEDFEDGDKGGVGVVEVGLAVDPVEEHDALY

SEQ ID NO: 142623 - protein, 55 aa, Glycine max
  Coding DNA Sequence Number=SeqID_25845
MKRLASPNRNHGIESTGQGKLTLNFGELEFWLGEKFCFNNITNGTHAKIKYDELL

SEQ ID NO: 142624 - protein, 165 aa, Glycine max
  Coding DNA Sequence Number=SeqID_25846
MGTLIDLKPKTQLWSPRHQIINNFLISSSEEKNEGLKRNKEIWLRKTIKPIIRVCFPDSVAFASSIIMDLGISKTLPDNLMLWVPDGYWNKVREGLLIEGSQRLKEREKRRTSWKFCEYRVNGKDDGFKKNIVIFDPSIYDIATASNSTTIPHNCLRFDVVEVVF

SEQ ID NO: 142625 - protein, 768 aa, Glycine max
  Coding DNA Sequence Number=SeqID_25847
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=67%, E-value=0.0, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=116-292; Score =71.6; E_value=2.5e-18; Accession=PF00665.16; Description=Integrase core domain
  Pfam module annotation: Pfam domain module=RVT_2::rve; Domain location=457-654::116-292
MTGHKDWFVSLDELVNHKVRFADDSTIRVEGHGKVVIKRRDGTVSYIEDVLYVPNMRCNLLSLGQLLEKKYRMVMEDKEMKIYDKDRRLIIKAPLNRNRTFKVGIQVMKHNCLQAETCREEWLWHYRFGHLNFKDLSQLHRMAQGIPQLRQMTENCRECLECKQPRNAFQKFVPVKSTQKLEVIFSDVCGPLQVESIGGNRTDGGGEYTSKEFAEFCDEAGITHEFTPPYTPQHNGAAERRNGTILNMVRSMLKTKKLPHFLWSEAAAIAVYILNKCPTKRLKGVTPEEAWTSTKPKVNQLRIFGSLCYKHVPEQLRQKLDDKGEQMILIGYHATGGYKLLDPRSKQVSVSRDVIFDELKEYEWKEDPINNTTKILADSIILEELSDTTDELPTRNTEGGTRRSQRVMQPSQMLKDYEVMKDSQITDEGDIVHFSLYADAEPVSFEEALKNDKWVNAMKEELKSIETNHTWQLMELPKLKRPIVVKWVSKVKRNPAGEKEGVDYGEIFAPVARIETLDVKSAFLNGPLEEEVFVKQPPGFEVVGHEGKVYKLRKALYGLKQAPRAWNKKIDNVLIHIGFSKCISEHRIEIDKIKQLLKNQFEMTDLGFLLYFLGIEFKETEAGIVMHRSKYATYLLKKFRMTNCNAAATPAETGLALSLRDEGEPVDETQLMQAPKTPHMMTAKRIIRYIRGTINYGILLPNTITSSNMELVGYTDSYWRRDNDDKKSTARYIFLLGDALVSWSSKKQDPVALSTCEAEYITASICSC

SEQ ID NO: 142626 - protein, 429 aa, Glycine max
  Coding DNA Sequence Number=SeqID_25848
  Gene Ontology: Mol. function=hydrolase activity; Biological process =aromatic compound metabolic process
  Homolog annotation: Hit_ID=Q9FFZ1; Match level="QueryCoverage=76%, HitCoverage=75%, E-value=1e-124, Identity=59%"; Hit description =Arabidopsis thaliana genomic DNA, chromosome 5, P1 clone:MAC12
  Pfam annotation: Domain name=Abhydrolase_1; Domain location=180-412; Score=32.1; E_value=1.9e-06; Accession=PF00561.10; Description =alphabeta hydrolase fold
  Subcellular localization annotation: CTP_CleavageSite=67; ConfidenceScore=5.05e-01
AEQFLGMETLSYGSAPCCQVVNSKWKLVEKSLSSRQSRVSSIGKLGVYYTGTISACAPVRFYEMGTRVQLRSSKRFNFKVCSGSYDDGYVIGEEEARDISGLEEPVTTKVLIPGLPDDSKGESGAPISSCFWGWKPKLNVHYEKAGCENVNDLPRVLFLPGFGVGSFHYEKQLKDLGRDYRVWALDFLGQGMSLPFEDPAPLSNEEAASNGSVSSWGFGDETKPWATKLVYSVDLWQDQVRCFIEEVIGEPVYLVGNSLGGLVALYFAANNPHLVKGVALLNATPFWGWEKISDPKSIAEVLSQVYADHSTNVDNVFSRIVETTRHPAAAASFASIMFAPQGELSFNETLSRCRANNVPICLMYGKEDPWVGPIWGLQVKRQVPEAPYYQISPAGHCPHDEVPEDCTVFDLSVLKVISSMFFPFHIEKC

SEQ ID NO: 142627 - protein, 174 aa, Glycine max
  Coding DNA Sequence Number=SeqID_25849
  Homolog annotation: Hit_ID=Q1T2D5; Match level="QueryCoverage=43%, HitCoverage=4%, E-value=8e-14, Identity=44%"; Hit description=Chromo
  Pfam annotation: Domain name=Chromo; Domain location=14-68; Score =44.8; E_value=3e-10; Accession=PF00385.14; Description='chromo' (CHRromatin Organisation MOdifier
MPLPLTMTDIGPIVLPAKVLAARVIQQGELKIPQVLIQWTNMPPDESTWEGLEDMKANYPSFNLEDKVVLNGDGIVIRQIKEKEIDVAESSIQVCKGPHGMQEDNSVMHDPELQGMRKSTRARKANNQLKDFVLGWGCSYYGKGINVRFHSDLERKGVQGKGKDTFVHLSFLWD

SEQ ID NO: 142628 - protein, 112 aa, Glycine max
  Coding DNA Sequence Number=SeqID_25850
MVVSIVTANFMVSKVLIDQGSSTDILYWKTFQRLKASPDTIQPHYGSLLGFAGERVETRGYVDLMTTFGQGQLSRRIIVRKTLNELGAIVSTPHLKRNFPTLIGEIVTVKED

SEQ ID NO: 142629 - protein, 485 aa, Glycine max
  Coding DNA Sequence Number=SeqID_25851
MVEGGSLNMFKGCRFVKTPQPGQVLSRLLCMGYSCLLFYRKIQCALKRDILFLFVASGFAWTFLVKHVGLPGDDVPPSTVEPLVGKMGQLATRFGPDDDEAVEHDDGVGVSEPKKSSVEAMPSKVILMMPKNQELSKFQRFKNLVSRIKIQDSRIKVHLLGDCYTENKRGYISYGSVQVEGTSTWLFKENKGGYITCGSLACKGFYKATIAALTPSTPSSLPTQEVSVSLSTMVAALVPLAAPIMAPPSITVTPLLSVGVVTMSTLVVPPPSSSTSPVSTSFVLSLVLPSFSSCPASGRVSSLETKVAEWRATTRTIWRVKHPKVVNVTVTLDEATRHYKDLLREKNDLTDKVESTIVEKEELVVESIKVITGLRAQLKESESKQEEFELKASKGRKASKELKEELLEFKKEAMEPHKKGFYKAVRQEEIIIMEEDVGVEKDVGANQGSPRPDLGFDEPLEKLDSPRGDLGFDEPMDNPPGMHQS

SEQ ID NO: 142630 - protein, 594 aa, Glycine max
  Coding DNA Sequence Number=SeqID_25852
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=45%, E-value=1e-164, Identity=66%"; Hit description =Chromo
  Pfam annotation: Domain name=RnaseH; Domain location=253-373; Score= -23.1; E_value=0.0082; Accession=PF00075.14; Description=RNase H
  Pfam annotation: Domain name=rve; Domain location=405-559; Score =69.5; E_value=1.1e-17; Accession=PF00665.16; Description=Integrase core domain
  Pfam module annotation: Pfam domain module=RVT_1::RnaseH::rve; Domain location=16-351::253-373::405-559
MVKEMLDQGIIQPSNSPFSSPIVLVKKKDGSWRFCTDYRALNAITVKDSFPMPTVDELLDELCGAKYFSKLDLRSGYHQILIQPEDRHKTAFRTHHGHYEWLVMPFGLTNAPATFQCLMNQIFQHALRKYVLYHLEGPPHTFGSSFTGVRTKYPEIEYLGHVVSGKGVAIEATKIEAVLKWPTPTNLKQLRGFLGLTGYYRRFIKSYAKIAAPLTDLLGKDSFCWNETTQEAFQGLQQAITSAPVLALPNFQQTFILETDASGIGVGAVLHQNGHPIAFFSKKLAPRNQKKSSYFREMLAIAEAIAKFRHYLLGSKFIIRTDQKSLRSLMDQSLQTPEQQEWLHKFLGYDFVIEYNPGKENIAADSLSRMFMISWSEPKTRFMQQLLDEVKSNDKMQELITQCKDHPQLKPHYTTKEGLLYWKGSKQNLLIVYQLGCSNHCPFHLSDYSSKTVAEAFMNYIVKLHGIPKSIVSDRDKVFTSDFWKRLFEIQGTTLAMSSAYHPQSDGQSEILNKCLEMFLRCFTFENPKAWYKALTWAEYWYNTAHHTSIGMTPFKALYGRDPPALTRYRPQPNDPITVQEQLGERDRTLQQLK

SEQ ID NO: 142631 - protein, 163 aa, Glycine max
  Coding DNA Sequence Number=SeqID_25853
  Gene Ontology: Mol. function=DNA binding; Biological process=DNA integration
  Homolog annotation: Hit_ID=Q1T192; Match level="QueryCoverage=73%, HitCoverage=19%, E-value=8e-12, Identity=35%"; Hit description =Polynucleotidyl transferase, Ribonuclease H fold
MSLGDGIEMPDLFSVGQFGEQVYSSVVLPWYVEQLKAIKVINEGFCNMIVLEPWLDICLQLALKQACSKVTLSSPSRMMLVPTSLYVGCSIHVEVPPVWGGLVIASKLYYEVLYELGFHGTLRAELKAFSTTERIARKLHPTRMTRFFGVACRMDLPSPRVSG

SEQ ID NO: 142632 - protein, 93 aa, Glycine max
  Coding DNA Sequence Number=SeqID_25854
MHPSRQPPQPELPLAFHHVGDGHIGTIVKSPRSGQPQPKYDTDAMTPCRKLGNHQQEGCFSQAQQNEENMKVELEMKDGVQKMARINEEATKL

SEQ ID NO: 142633 - protein, 205 aa, Glycine max
  Coding DNA Sequence Number=SeqID_25855
MDGVKITLLGFIGQPSIGKSGHNGVDCPSDLLDGLIFLLLLRLTFASLLVMPLSPSIFYFIPPSIDIMIFVLVVLVPSGLFANLPVVEGATWSVVPLQDSVETFDKGVKAIDGLWGESSVPCQCCHFEGRWKNSTQDCVVVRVKISLGMSTSHPSFMAVYVRKVGIILCVDVSLSVMVVGERLELSRGVSRLRSDHMLTIGEKKP

SEQ ID NO: 142634 - protein, 63 aa, Glycine max
  Coding DNA Sequence Number=SeqID_25856
MVSGNCILIFLIVLERLVCKNIAKRRERERMVAGGEERANLNEEDEQVEGTLQDFLTLLHWDC

SEQ ID NO: 142635 - protein, 152 aa, Glycine max
  Coding DNA Sequence Number=SeqID_25857
MRTWESEKETLAAANKLERSIECCVCYGFGGGASERCCVVESAIENGKRRGNFVGWASTRATPESVPSYWGHPPTQHSSISIPFCLQTSLSDPHPFYPTRLQISVSLRANVGLGPAGRAKNAGARLPDSTHLLPNRTMGQRIDSPHIKCKYY

SEQ ID NO: 142636 - protein, 592 aa, Glycine max
  Coding DNA Sequence Number=SeqID_25858
  Homolog annotation: Hit_ID=Q53J12; Match level="QueryCoverage=25%, HitCoverage=9%, E-value=4e-10, Identity=29%"; Hit description=BAH domain-containing protein, putative
MTLEDFFTLTEMKDGLTAPSRVQELVSVMQKEKDSEVKNAADATRQWASVASTIAATENKDCLDLFIQLDGLCFINRWLKDAQNFGVDANDSFVEESITAMLRAVEKLHIDSEKSMSSGIRITVSNLLDHHSARVQDRARTLFDSWKGVGNGDTESHEVELAKVDNASDKIVREERQPSALNEDGNDNDPASGLIGCEKSLLRSSDDLLVHSSDNVPQLSASVECIDIKEGSANHVAGVPSSAQEVAPTHEGLPICTTGETTSAGTCNFSVSNQSSFEGQSDVVQLSDLAKMEKQEQNVNDAPEKFGAPEICSVSSNKPEPEPEPVSMVACEAKAPESVKEPALEQNVEHSEDDVCHKLTTSASMRTPASDRSGEDDTTSIIQVFKAAENDNDCCSNALQGTSVSDSNLGKTEVLDMSVSGTEYVTASKEDKGHEEDTSIGSDCSKPGIDFRSSNIIDKRGSDNELDCAIVDALEFARQVAQEVNREVSSSSEKISEDRIRQPGSPNSVRKEDQLTPVPPKEVSSRQSHATEAYSMERHASILDNNEAEPKCRPDMVSLEVTETAQDSAGNSEKRLCGFDLTKLVLMIWMFL

SEQ ID NO: 142637 - protein, 261 aa, Glycine max
  Coding DNA Sequence Number=SeqID_25859
MEGQLFLGRNGYWSQSRASSSSSMQPSVRNIDLNDRPCLQTDLVDQGPNAPVISLLGAKVEVGKNECVPQMSSLQNGKAIEPAIDLRMSRAGSVLGMTPTVPFNHSPVFGYNGVASASVAPAMSFSSAMYGSGGTIPYMVDSRGAPVVPQVGGSSSTVLSSYSQPPIFMNMTGTQLGLNGFGPSRPNLDLNSGFMIEGGNRDTLAARQFFFPGQGRAVEEQVRSMPQPSSSGVSGKRKEPDSGLEPYPFIYKHPQPPGSSF

SEQ ID NO: 142638 - protein, 163 aa, Glycine max
  Coding DNA Sequence Number=SeqID_25860
  Homolog annotation: Hit_ID=Q9ZQY8; Match level="QueryCoverage=40%, HitCoverage=46%, E-value=2e-11, Identity=51%"; Hit description=Small hydrophobic protein
  Subcellular localization annotation: CTP_CleavageSite=51; ConfidenceScore=5.02e-01
MAISDAVARNFSTIFVGLMACFEAYGFASGRRFSGGYVVIVSTAAVILFLVATLTWDVSRKATCAFHRDHADSQEDVCKGGICWHGVAPRSPASQGLVDWLTLPVVDKNNTINHYGICKVKVELNCEYGVWTTKSTVSASCQARITDMASLLSQFAARLFSFS

SEQ ID NO: 142639 - protein, 61 aa, Glycine max
  Coding DNA Sequence Number=SeqID_25861
MAEWSKAPDSSSGPQISSGPNRLGLFELLMGWALLCAPGKLLVHPALFHFSKIIPDKFTDP

SEQ ID NO: 142640 - protein, 106 aa, Glycine max
  Coding DNA Sequence Number=SeqID_25862
  Gene Ontology: Mol. function=DNA binding; Biological process =regulation of transcription
  Homolog annotation: Hit_ID=Q1SMM7; Match level="QueryCoverage=94%, HitCoverage=29%, E-value=8e-13, Identity=44%"; Hit description =Homeodomain-related
MSEEYERSEEHADDDSSMGSSQKCSSFDLNEEASSEDNNDNDEGYDEEAKDEGTSTNKSSSITKEGSNERRGGVRQYVRSKMPRLRWTPELHLSFVHAVERPWWSR

SEQ ID NO: 142641 - protein, 337 aa, Glycine max
  Coding DNA Sequence Number=SeqID_25863
  Gene Ontology: Mol. function=protein serine/threonine kinase activity; Cellular component=anchored to membrane; Biological process=protein amino acid phosphorylation
  Homolog annotation: Hit_ID=Q1S6A8; Match level="QueryCoverage=71%, HitCoverage=80%, E-value=3e-97, Identity=70%"; Hit description =Thaumatin, pathogenesis-related
  Pfam annotation: Domain name=Thaumatin; Domain location=31-248; Score= 280.6; E_value=3e-81; Accession=PF00314.8; Description=Thaumatin family
MDHLTLAFPFLLTLHLLASGVLATTTFTLVNKCDYTVWPGILSNAGIATLPTTGFVLQTAESKTVTAPTSWGGRFWGRTLCTQDSAGKFSCITGDCGSGKLECAGSGATPPATLAEFTLDGAGGLDFFDVSLVDGYNVAMLVAPQGGSGDNCTSTGCAGDLNGACPSELRVTSEDGKQSVACKSACEAFGSPQYCCSGAYGSPNTCKPSPYSQIFKNACPRAYSYAYDDKTSTFTCASAAAYTITFCPSPNSNPSQKSWQGQNPKSDSSGSASSSSGSPQINNGTIVYIGSMDPSELWSAGMRVILNTSSIDGTPPPYNATQVFCFCPGTPKSTIPC

SEQ ID NO: 142642 - protein, 228 aa, Glycine max
  Coding DNA Sequence Number=SeqID_25864
  Gene Ontology: Mol. function=DNA binding; Biological process =regulation of transcription
  Homolog annotation: Hit_ID=Q1SMM7; Match level="QueryCoverage=99%, HitCoverage=52%, E-value=6e-63, Identity=57%"; Hit description =Homeodomain-related
MGNGGIILASDYNDRSYFHGLMHPSSLSPSQSKAIDSRHQQWYFNSHQPYRRPSYFSNEVVSSTTLQTQGRSMSSNQINLMDATSIAPMKPSQFLEEKKWPPLDIMNNHHWKKRLPANISSNSGSQPVVHQFGTTSPSLRPSELNFGNNTRISWEHLSNSDEHRNYSNSLKLELEPLFRIKSNQEKLQKEKQWAPDLRLSLSQRDGNNDGKTDHCRETQEINTKLSLS

SEQ ID NO: 142643 - protein, 140 aa, Glycine max
  Coding DNA Sequence Number=SeqID_25865
  Homolog annotation: Hit_ID=Q9FJ51; Match level="QueryCoverage=53%, HitCoverage=18%, E-value=3e-09, Identity=45%"; Hit description =Arabidopsis thaliana genomic DNA, chromosome 5, TAC clone:K15I22
MAKEDKAERLAADQEINQESMSLQLVPSSFDKDAEINNQQIVVVDDSGKVDNEYVLHPLAPPLPKSPSESWLCRALPLVSSKNSFPHSNQGTHSQAKRQGFSRASNFTKWETIVKSSNLNHDHVTYSKELVVYKSQHMKS

SEQ ID NO: 142644 - protein, 306 aa, Glycine max
  Coding DNA Sequence Number=SeqID_25866
MTIQPPQYASFRKQQPVLAEQPREFIKLVPEQKKSFVNRHITDIVPYTGQCQEEEEEEEESDDETNDYANNSAKGCGLFPRLCVRNSLCLLNPVPGTKMGNQFPLYSAYEVVKPDKSSHIRSHRPAPAIKKAWDAINKSKLSSSSRAASPDKKDVRKKWTSESSRYNYSGELKQLGRLSPFRRSRAASAGVSPFRSKPQPPFPGAKLLGDSEQADNNHSGKLKFPNRGHASIQEVLSQGAKKSYSFGSLSVEKTLYIDTASTVKSSCSSSRSLGSTIVVGKDRNSLVDSFRDMKHLEALEENLDSQ

SEQ ID NO: 142645 - protein, 166 aa, Glycine max
  Coding DNA Sequence Number=SeqID_25867
  Homolog annotation: Hit_ID=Q1SZI6; Match level="QueryCoverage=56%, HitCoverage=8%, E-value=1e-29, Identity=69%"; Hit description =Tetratricopeptide-like helical
  Pfam annotation: Domain name=DUF177; Domain location=1-162; Score =7.4; E_value=0.00016; Accession=PF02620.7; Description =Uncharacterized ACR, COG1399
MTELSNIFVDNYFKVSSFYEVANSANIAVSVTCCAPSAESIFSEFSLLLTDEPIEEPETIDMGVIFGEDKLTTSGNSGEDDDDDALIDMDDQLYFPPQQRQIDISKNIRDRVHLEITMNSVCGPGCKGMCLKCGQNFNTGNCNCSKEEVQEKSFGPLGNLKEKMQL

SEQ ID NO: 142646 - protein, 143 aa, Glycine max
  Coding DNA Sequence Number=SeqID_25868
  Gene Ontology: Mol. function=chromatin binding; Cellular component =chromatin; Biological process=chromatin assembly or disassembly
  Homolog annotation: Hit_ID=Q1SAV4; Match level="QueryCoverage=78%, HitCoverage=29%, E-value=2e-28, Identity=54%"; Hit description =Integrase, catalytic region
  Pfam annotation: Domain name=Chromo; Domain location=61-110; Score =17.1; E_value=0.0094; Accession=PF00385.14; Description='chromo' (CHRromatin Organisation MOdifier
MGKRYYGPYQITKIIGSVAYKVALPESAKIHPVFHSSLLKPYHDPSQSEQPLPPTAIEGKPTIQQITILDHKWDSSDSPKRLVLVQWLGLQPEDSSWEDWTELQANYHLEDKVFLEGGEGVYDDDGVGARDCQVVVRYYCRLV

SEQ ID NO: 142647 - protein, 539 aa, Glycine max
  Coding DNA Sequence Number=SeqID_25869
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=35%, E-value=1e-154, Identity=49%"; Hit description =Chromo
MADNTRMKELATDVKKNADDIKKLYDEVQIQFERFGAVTDARFQTMEDLQSSTDGKLDKINEALSMLLRNSSQTSSHGVTNSNKAPFQVRNVKLDFPRFDGKNVMEWIFRAEQFFDYYETPDKDRLTITSVHLDQDVVPWFQMIQRTHPFNSWAEFTRALELDFGPSIYDCPRATLFKLSQTGTVSDYYRQFTALANRVYGLSTDALVDCFISGLNPDIRRDVMIHTPINIVKAVSLAKVYEEKYTSNTKPQKYQNPNTQYQNRAHFNSNKPEINQKPTNTPLLPTPPTRPMDINQKNPNIKRITPAEMQLRKDKGLCYWCDEKFSFSHKCPNKHLMLLQSDHEPENAAEEETEPPDQPQNIINQTHTEHHLSLNAMKGANSLGTMRFMGKIGKLQVQILIDGGSSDNFVQPRIAHFLKLPVEPAPCFKVLVGNGQTMTAEGVVTQLPVVIQEHEMLIPVYLLPVAGADLILGTAWLATLGPHVADYSALTLKFFHKGKFITLQGDTSMGPGQAQLHQLKRMCNTRSIDEVFTGRESTS

SEQ ID NO: 142648 - protein, 62 aa, Glycine max
  Coding DNA Sequence Number=SeqID_25870
MSLEVEACRQRHHHAPSCVASIKVHQKEGDKQKASSGTMGRQKSDGGQKCHRKKKKGSSKDR

SEQ ID NO: 142649 - protein, 381 aa, Glycine max
  Coding DNA Sequence Number=SeqID_25871
  Pfam annotation: Domain name=AT_hook; Domain location=275-287; Score =14.9; E_value=0.061; Accession=PF02178.9; Description=AT hook motif
MVKVEIEDSRTGPVNITFIMVQIDHGGQVRITCHHVVELNCGNGVMIVTKPKATWIGHAGVGRQWGCGSGWAEGVRFRLSGDIMVAAGGLDGVWQQQEHRRRVAAAAAMKEGREVGDDLVGRVYDTTLHLFVAVLRNKTLSFRLMMRIMKLAKYRLKVQVEKDEAQVEKDKAPEWRRMKAQVEKDEGPEAETLSRQLISQHETKVGVAEMRMLRWMCGKTRQDKIRNGAIRERVGVTPIVEKMVENRLRWFGHVERRPVDSVVRRIDQMERRQTIRGRGRPKKTIREVIKKDLELNDLDRSMTYQGNHCSVYPDLSSFTGSGVYPDLSSFTGSGVYPDLSSFTRSSVIQTSIASIKRSAPTQVHIRLCRNTVLTSKQFQWC

SEQ ID NO: 142650 - protein, 36 aa, Glycine max
  Coding DNA Sequence Number=SeqID_25872
MVDMAFIEQVWEWETMIGSCWLARILRCCINNDIRM

SEQ ID NO: 142651 - protein, 165 aa, Glycine max
  Coding DNA Sequence Number=SeqID_25873
  Homolog annotation: Hit_ID=Q1SN61; Match level="QueryCoverage=24%, HitCoverage=14%, E-value=1e-13, Identity=90%"; Hit description=Beta -Ig-H3/fasciclin
  Subcellular localization annotation: CTP_CleavageSite=62; ConfidenceScore=5.47e-01
MHQVPTANTNPTNCIPLLMMKNQSILLFSPASAPLKPTQPAPTTPAAAPQQPLVPSLPQPPTDSTRQGSVNISTGEVNTTITGIIYTDKHLAIYKVGKVLLPMDFFTVAKAPAKAPSLAPEAPKEDKEKSLSPDSSESSEINSTNDNSGTVKSICMESGRPLFLD

SEQ ID NO: 142652 - protein, 407 aa, Glycine max
  Coding DNA Sequence Number=SeqID_25874
  Gene Ontology: Mol. function=GPI anchor binding; Cellular component =membrane; Biological process=cell adhesion
  Homolog annotation: Hit_ID=Q1RVI6; Match level="QueryCoverage=50%, HitCoverage=72%, E-value=1e-72, Identity=68%"; Hit description =Fasciclin domain, putative
  Pfam annotation: Domain name=Fasciclin; Domain location=81-216; Score= 97.6; E_value=3.8e-26; Accession=PF02469.12; Description=Fasciclin domain
  Pfam annotation: Domain name=Glyco_hydro_35; Domain location=272-407; Score=-115.1; E_value=8.2e-08; Accession=PF01301.10; Description =Glycosyl hydrolases family 35
  Pfam module annotation: Pfam domain module=Fasciclin::Glyco_hydro_35; Domain location=81-216::272-407
  Subcellular localization annotation: CTP_CleavageSite=62; ConfidenceScore=5.29e-01
MMMQHSLIFCASLVLVMITTSAQHSPAASPTIPKLPQSPLASPQGMNTVPLVPVSPIGAPTPATSKAPTIDIAQILSKAKRFSVLIRLLKTTQLINQLNSQLLTSGSGGLTIFSPPDSAFSKLKAGFLNSLNDRQKVELLQFHTLSSFLSISNFDTLTNPVQTQAGDDSKRLQLNVTTYGGSQVSMTTGAVNATITGTVYTDNKLAVYEVDKVLVPLDVVLPKPKAPAPSPSKGESPKTKSSADESGDSNKNSDDDGAVPVDASAGSMNFNSVHVTRMSFVVGGDLVKFVKAVAATGLYVHLWIGPYACAEWNYGLQTEMKQFTAKIMDMIKQENLYASQGGPIILCQIENEYRDIYAAYGPAAKSYMKWAASMETSLDTRVPWVLWQQADADAADPIVSFLVLCFC

SEQ ID NO: 142653 - protein, 316 aa, Glycine max
  Coding DNA Sequence Number=SeqID_25875
  Gene Ontology: Mol. function=GPI anchor binding; Cellular component =anchored to membrane; Biological process=cell adhesion
  Homolog annotation: Hit_ID=Q1RVI6; Match level="QueryCoverage=73%, HitCoverage=72%, E-value=8e-63, Identity=61%"; Hit description =Fasciclin domain, putative
  Pfam annotation: Domain name=Fasciclin; Domain location=107-242; Score=100.3; E_value=5.8e-27; Accession=PF02469.12; Description =Fasciclin domain
  Subcellular localization annotation: CTP_CleavageSite=57; ConfidenceScore=5.14e-01
MMMQQHFLFFRASFVLVMVTTSAQHSPAISPTIPKLPQSPLASPPGMNMIAILIEITAQQASYHYLRHITYQNTVPLVPVSPNGAPTPATAKAPTIDIAQILSKAKRFSVLIRLLKTTQLINQLNSQLLTSGSGGLTIFSPPDSAFSKLKAGFLNSLNDKQKVELLQFHTLSSFVSISNFDTLTNPVQTQAGDDAQRLQLNVTTYGGNQVSMATGVVNATITSTVYLDNKLAIYEVDKVLLPLDVVLPKPKAPAPSPFKGESPKTKSYTEESGDGNKNSDDDGAVTVNASAGSVNLINNVNLMFVVGLVLMGGAML

SEQ ID NO: 142654 - protein, 290 aa, Glycine max
  Coding DNA Sequence Number=SeqID_25876
  Gene Ontology: Mol. function=GPI anchor binding; Cellular component =membrane; Biological process=cell adhesion
  Homolog annotation: Hit_ID=Q1SGD7; Match level="QueryCoverage=77%, HitCoverage=76%, E-value=2e-80, Identity=71%"; Hit description=Beta -Ig-H3/fasciclin
  Pfam annotation: Domain name=Fasciclin; Domain location=81-215; Score= 86.5; E_value=8.2e-23; Accession=PF02469.12; Description=Fasciclin domain
  Subcellular localization annotation: CTP_CleavageSite=87; ConfidenceScore=5.15e-01
MKMISLLSFSLALLVSLLYSTTTLAQLSPAAAPLKPPQPTPTPPAAAPQQPLVPSLPQSPSDATPDTAAVDIVGILRKAKSFNILIRLMKTTQLINQLNAQLLTTKSGGITILSPDDSAFSELKVGFLNSLSDGQKLELLQFHVLSDYVSSSNFDTLTNPVRTLAGAKPGKVELNVISYGGSVNISTGEVNTTITGIIYTDKHLAIYKVGKVLLPMDFFAVAKAPAKAPSLAPEPSSDAAKAPKADKDESSSSDASQVNPTEQNSGIEKISVYGMWVSLVFGLVLLIAFS

SEQ ID NO: 142655 - protein, 196 aa, Glycine max
  Coding DNA Sequence Number=SeqID_25877
  Gene Ontology: Mol. function=beta-galactosidase activity; Cellular component=beta-galactosidase complex; Biological process =carbohydrate metabolic process
  Homolog annotation: Hit_ID=Q1SN78; Match level="QueryCoverage=93%, HitCoverage=29%, E-value=1e-50, Identity=78%"; Hit description =Rhodopsin-like GPCR superfamily; D-galactoside/L-rhamnose binding SUEL lectin; Galactose-binding like
  Pfam annotation: Domain name=Gal_Lectin; Domain location=145-195; Score=10.5; E_value=0.00036; Accession=PF02140.8; Description =Galactose binding lectin domain
MELFFDTWGAGITGPVILKGLKNGSTLDLSSRKWTCKVGLKGEDLGLSSGTSGQWNSQSTLPTNQPLIWYKTNFVAPSGSNPVAIDFTGMGRGEAWVNGQSIGRYWPTYMSLQKVALLTHAIVEEVKAILLDTESEGKVVPLVSLECPYPNQVISSIKFASFGMPYGTCGNFKHGHCRSNEALSIVQKELYIKLPF

SEQ ID NO: 142656 - protein, 73 aa, Glycine max
  Coding DNA Sequence Number=SeqID_25878
  Subcellular localization annotation: CTP_CleavageSite=27; ConfidenceScore=5.01e-01
MAKNPRHITPFTIYKYPARVKYSQAKRTSLVKSTVLRLYKLKLALETVKRQYENLLATRREFISLSNHVKENK

SEQ ID NO: 142657 - protein, 568 aa, Glycine max
  Coding DNA Sequence Number=SeqID_25879
  Gene Ontology: Mol. function=nucleic acid binding; Cellular component= intracellular; Biological process=regulation of transcription
  Homolog annotation: Hit_ID=Q1SN59; Match level="QueryCoverage=91%, HitCoverage=99%, E-value=1e-115, Identity=49%"; Hit description=Zinc finger, C2H2-type
  Pfam annotation: Domain name=RS4NT; Domain location=132-169; Score =15.5; E_value=0.028; Accession=PF08071.2; Description=RS4NT (NUC023) domain
  Pfam annotation: Domain name=zf-C2H2; Domain location=147-169; Score =19.5; E_value=0.012; Accession=PF00096.16; Description=Zinc finger, C2H2 type
  Pfam annotation: Domain name=zf-C2H2; Domain location=174-195; Score =16.3; E_value=0.11; Accession=PF00096.16; Description=Zinc finger, C2H2 type
  Pfam annotation: Domain name=zf-C2H2; Domain location=70-92; Score =22.6; E_value=0.0014; Accession=PF00096.16; Description=Zinc finger, C2H2 type
  Pfam module annotation: Pfam domain module=RS4NT::zf-C2H2::zf -C2H2::zf-C2H2; Domain location=132-169::147-169::174-195::70-92
  Subcellular localization annotation: CTP_CleavageSite=57; ConfidenceScore=5.23e-01
MMSEETFSVPPPNSTIRATSLVHHHAHVQPPSPSPNPNPNPNSNPAKRRRNPDAEVVALSPKSLMATNRFLCEICNKGFQRDQNLQLHRRGHNLPWKLKQRANKDQVRKKVYVCPEKSCVHHDPSRALGDLTGIKKHYSRKHGEKKWKCDKCSKKYAVQSDWKAHSKICGTREYKCDCGTLFSRKDSFITHRAFCDALAEESARVTTVPAALSNLRNDHHHHLTNAQASRIPQINFSGFHSSDQLFGGGSSEALLANHHHHQQQKLRLPLWLDHHQVNNNPQVLHHHTLNNFSTKPNGFTTNSGSGPNSVTDLVQTMDMFGSQTEFVNYRYPEASFGGGNANVSVLPPHELKQEQEENKEHLSHSGASYNNLYLSSSDIQNPPPHHHHYMSATTLLHKAVQMGSSRLMNDNVFGSILGTTTTNSNNNNVVVEVQKLNELVSVEAAGCTNNNLGGGYLLNDSNNSNSFVVVNGTNKGGGLEHMVMPVDEETQQASIMGKQLHSSLSSNNKNQQLGLTRDFLGVGDHNNSIDSIRRPFLQQDLVEFNAMGSASASASVMNLQSQYGGHYC

SEQ ID NO: 142658 - protein, 71 aa, Glycine max
  Coding DNA Sequence Number=SeqID_25880
MMDEDEKNWNEMVKTMMKINIKSYEIFNTIHIKDQPYGEVSRTFAIRWKDQLEHTWYLLDNNDNIHSITYN

SEQ ID NO: 142659 - protein, 91 aa, Glycine max
  Coding DNA Sequence Number=SeqID_25881
MSILTLGSKKKRRKISNQRKREGKFPIKGKKEARKFPIKEREKEKRKERKFPTKEWEKVKKKKAPGQRNQKKCAERSLDQTISEQYRIVTK

SEQ ID NO: 142660 - protein, 87 aa, Glycine max
  Coding DNA Sequence Number=SeqID_25882
  Gene Ontology: Mol. function=zinc ion binding; Cellular component =cytoplasm; Biological process=apoptosis
  Homolog annotation: Hit_ID=O04261; Match level="QueryCoverage=96%, HitCoverage=19%, E-value=3e-15, Identity=42%"; Hit description =Putative zinc finger protein
MSEENTLANSLISRNRTHDTMNSLLDSFEGDDDKKSWASFRECIAKVPEQVLRGTNAKPIWPVSSGRPSNADIPRYSYCTGVQTYVL

SEQ ID NO: 142661 - protein, 695 aa, Glycine max
  Coding DNA Sequence Number=SeqID_25883
  Gene Ontology: Mol. function=protein-tyrosine kinase activity; Cellular component=large ribosomal subunit; Biological process =protein amino acid phosphorylation
  Homolog annotation: Hit_ID=Q6QNV0; Match level="QueryCoverage=92%, HitCoverage=97%, E-value=1e-175, Identity=50%"; Hit description =Receptor-like kinase
  Pfam annotation: Domain name=LRR_1; Domain location=133-153; Score =7.7; E_value=10; Accession=PF00560.23; Description=Leucine Rich Repeat
  Pfam annotation: Domain name=LRR_1; Domain location=155-176; Score =22.2; E_value=0.0018; Accession=PF00560.23; Description=Leucine Rich Repeat
  Pfam annotation: Domain name=LRR_1; Domain location=178-199; Score =10.5; E_value=3.1; Accession=PF00560.23; Description=Leucine Rich Repeat
  Pfam annotation: Domain name=LRR_1; Domain location=201-223; Score =16.5; E_value=0.099; Accession=PF00560.23; Description=Leucine Rich Repeat
  Pfam annotation: Domain name=LRR_1; Domain location=225-248; Score =12.2; E_value=1.5; Accession=PF00560.23; Description=Leucine Rich Repeat
  Pfam annotation: Domain name=LRR_1; Domain location=82-104; Score =17.3; E_value=0.054; Accession=PF00560.23; Description=Leucine Rich Repeat
  Pfam annotation: Domain name=Pkinase; Domain location=389-652; Score=- 10.6; E_value=6.2e-08; Accession=PF00069.15; Description=Protein kinase domain
  Pfam annotation: Domain name=Pkinase_Tyr; Domain location=389-653; Score=-6.2; E_value=4.3e-12; Accession=PF07714.7; Description =Protein tyrosine kinase
  Pfam module annotation: Pfam domain module=LRR_1::LRR_1::LRR_1::LRR _1::LRR_1::LRR_1::Pkinase::Pkinase_Tyr; Domain location=133-153::155 -176::178-199::201-223::225-248::82-104::389-652::389-653
MKPFCRFLILVSLFSLVESSCNSSEEHDLVSKAFKSVSGFNAFSSSFPTNNCSQTHIITSIVLPSQNLSGTISWNYLRNISNLQILDLSGNFLQGHVPSWFWSSSSLLAINLSRNRFGGSILQPTSENTSFSSIQSLNLSYNRFTNSIQLSGFKNLKILDLSHNNLVTLPSGFQNLSNLQHIDLSSCNLQSNVKPISALHSLHYLDLSNNTFTGNFPYDFPPLTTLKFLNISFNNFTSAISVNKFSRFFGKSAFVHAGSNFTYTNDSNKNTKQEAIIEKKQKKRKSKTLIGAASSAASAIVLILLGIWAVRIVIQKRKQRAKKNKWAISMPVPQGMMMMMKSGPFEFETESGSTWVADLKEASSAAVVMFEKPLMNLSFKDLIVATSHFGKESLLAEGRCGPVYRAVLPGDLHVAIKVLEEARDVDPDDSVATFVDLSRLKHPNLLPLSGYCIAGKEKLVLYEYMANGDLGRWLHELPTGDTNVEDWTGDTWEIQNGVVDDGSPEKMGWLTRHRIAVGIARGLAYLHHARSKPVVHGHLVTSNILLADDFEPRIADFGLRPDPDPNFGTETDVYCFGAALVELLTGKGSTAEAVAAARKAMREGHGVRVLDERLRLGGDSVVLSQMVETLRVAFLCTAECPSKRPTMQQTHFLGGKEKVEKDKKMGMMKAQRERVVYSFFLGRGIGPENPTQEFP

SEQ ID NO: 142662 - protein, 153 aa, Glycine max
  Coding DNA Sequence Number=SeqID_25884
  Homolog annotation: Hit_ID=Q10P22; Match level="QueryCoverage=24%, HitCoverage=11%, E-value=1e-11, Identity=76%"; Hit description=Rap8, putative, expressed
MASEDSKPVVKKEVDSNNKSSVSKKVTKFKKEEPEAVKKGPKVKKEENDDDIPIWRSTSNSKEVKKKRITIKKEEENKNNKKKKEKKVYDLPGQKRDPPEEKDPLRIFYETLFKQVPSSEMSQIWFVLLLFCVFFVEYNLAEMLIMAPQHEHY

SEQ ID NO: 142663 - protein, 38 aa, Glycine max
  Coding DNA Sequence Number=SeqID_25885
MVWPLKERGSKLGVPTEAGSSAVGGLALGFGLLPLRFQ

SEQ ID NO: 142664 - protein, 276 aa, Glycine max
  Coding DNA Sequence Number=SeqID_25886
  Gene Ontology: Mol. function=ER retention sequence binding; Cellular component=integral to membrane; Biological process=protein retention in ER
  Homolog annotation: Hit_ID=Q1SSF8; Match level="QueryCoverage=98%, HitCoverage=62%, E-value=1e-131, Identity=88%"; Hit description=ER lumen protein retaining receptor
  Pfam annotation: Domain name=ER_lumen_recept; Domain location=48-258; Score=81.3; E_value=3.1e-21; Accession=PF00810.9; Description=ER lumen protein retaining receptor
MKGSKRPIHAVTTWVRRQPPKMKAFLAVLSGLAALLFLRIFVHDHDSLFVAAELVHALGISVLIYKLTREKTCAGLSLKSQELTAMFLGVRLYCSFVMEYDIHTLLDMATLVTTLWVIYMIRFKLKSSYMDDKDNLAMYYVVIPCAVLSLLIHPTTRHHPLNRILWAFCVYLEAVSVLPQLRVMQNAKIVEPFTAHYVFALGVARFLSCAHWVLQVLDTRGHLLTALGYGLWPFMVLLSEIVQTFILADFCYYYVKRWISCWGTTCSSTSFRSGVT

SEQ ID NO: 142665 - protein, 52 aa, Glycine max
  Coding DNA Sequence Number=SeqID_25887
MAISKLLVASLLVSFVLFHLVDADDQSAHAQTQGSLVQHIGIPSASVRAIFY

SEQ ID NO: 142666 - protein, 122 aa, Glycine max
  Coding DNA Sequence Number=SeqID_25888
MATVQHLLIANRKKRPIICRIKPDLNRTPKETTKMSVINQKKIEASIKNLEVQVVQLATQLSEHGSGSFSTNTHVNPKEQRNSITTKRGTMNKEGVENEKEKNEEVVTSEKVEENVISEEKK

SEQ ID NO: 142667 - protein, 592 aa, Glycine max
  Coding DNA Sequence Number=SeqID_25889
MDISEGGEAMTKRHTNKQQQSQSASSGGRNLIPAACGLNASLGDLEFSEKSKKEKVRSLSAVAKALSMGCRVSHSQKPTKKFKLPIKFLKDCNGVDHASVPRKIRSAVKKRGRESFFGDSEKVNHRMNGMESPQKDGIKKSKKQRTPGWSTRQVSPGPITKDEEEVVETLYALAGMFPSDKASNVVKSELDSESLPENSTVLQDQEESQSANVTLEASGATQDAGEKSPTGCKKASSLNETIGQEQTDFPESANFLVATDNTAPKTNPQAVPMMVKTENGGNVALHDSQLLSLEMGLNVPTQPQISHIGRQSDVGFQTVGTVGYKQEHLIKYQNETGSALWPGLSPIASAGITRASYLQFSSAAKAQDWMKTAMGVSKQDLMETCSSGGKFFIPVNALHSKSSVSMQISEIITHKKSWKRCAAHVHISHLIRSLEVSKRQAGKEHELFPQTIVHQGSKCGVLTKAHNLNWMRSGNSHATQTVYSATTSNSRETKNGILQHDLYHEAPPTPGVYDPQKQCFNFLSLSTGVSDQLKANEIFNKGESKLEPYSKQQLPYFQSLQLQQQRQHGLMPVQSSPYASTFLDQLPVAGPQ

SEQ ID NO: 142668 - protein, 189 aa, Glycine max
  Coding DNA Sequence Number=SeqID_25890
  Homolog annotation: Hit_ID=O48822; Match level="QueryCoverage=86%, HitCoverage=91%, E-value=4e-17, Identity=36%"; Hit description =Expressed protein
  Pfam annotation: Domain name=DUF827; Domain location=18-149; Score= -34.9; E_value=7e-08; Accession=PF05701.2; Description=Plant protein of unknown function (DUF827)
MNMEDGVMLVRKAEIDTRAPFRSVKEAVSLFGEKVLAGEVYASANKLKKIQSGANENGVEFSRIESVEAELDETRENLQRAKEESMEELERTKQELRQLKQRETQKHPEESEIEDVKFVENLTTFGVKSSRFDEDKMEFQKKRCVTFANPQHGVEKLERHPSLRKKNKKSLIPFIGAIFSRKKGTQEIP

SEQ ID NO: 142669 - protein, 134 aa, Glycine max
  Coding DNA Sequence Number=SeqID_25891
MVVGGGEEGVRVWVGVQRGGKGENHVFHVEERIYNLQISLSELVLLSRSLLFALSATIRTEHNSLCTNSHSTVENCLRNLQPKFEDDPPVNISSDVAPCGALEWRWKKHDWRHRFKEKMSQEEAHHHRKPWIRA

SEQ ID NO: 142670 - protein, 123 aa, Glycine max
  Coding DNA Sequence Number=SeqID_25892
MYNKHNNPHKSRTEGFVVIQIRTEEEASFEQIPQPCPKLNLSAMKLFQRFRKIFMRLVFSVPNSRRSKDSKHKVNDRFEPPKTSCSSYYSSYSHYNEAIADCIEFFNKSAQDGVLDGRKSDVV

SEQ ID NO: 142671 - protein, 335 aa, Glycine max
  Coding DNA Sequence Number=SeqID_25893
  Gene Ontology: Mol. function=transcription factor activity; Cellular component=transcription factor complex; Biological process =regulation of progression through cell cycle
  Homolog annotation: Hit_ID=Q1SSF0; Match level="QueryCoverage=99%, HitCoverage=91%, E-value=1e-114, Identity=64%"; Hit description =Transcription factor E2F/dimerisation partner
  Pfam annotation: Domain name=E2F_TDP; Domain location=70-135; Score =130.8; E_value=3.8e-36; Accession=PF02319.11; Description =Transcription factor E2Fdimerisation partner (TDP)
MSQRYDNNVFKSHINNIQLAPGITETLHLPPPLQTEPTIRGKQNGKSKGPRNAKSANADSPNSTAVNNCRYDSSLGLLTKKFVSLIQDAKDGTLDLNRTAEILEVQKRRIYDITNVLEGVGLIEKTSKNHIQWKGCDGLGPQELEDQVNSLKAEVDSLYAEESELDDCIRFATNIEKAGASKKPGGKRKLSKEDILSLPCFQNQEIIAIKAPKASCIEVPDPDEELGFRQRQYKMIVRSAIGPINLYLLSKDDSKFEDDSAKRMKLMDPSWNSDPIRKRGVGLLESQHDEKNPSEHFSLQGSQAFGIQEITPTDFEMEDDYWFQSDPGVSQTELW

SEQ ID NO: 142672 - protein, 260 aa, Glycine max
  Coding DNA Sequence Number=SeqID_25894
  Gene Ontology: Mol. function=protein serine/threonine kinase activity
MPSVDHFSGLVELLSLGNSPSLGSSKKDSLWIKWINCYYMKNGNVMSMGIKDSCSWILKGILKQIQKIQSLTNWSTLLQKDRFVLKIMYNELQDVSSRVPWRKLFFSNLARPCAKFVFWTVCHDRLATKVRMMKFGLLSDTKCNFCDHLETIDHLLFEYAEMKDVWIQILEWQKINHQPKKWIEELSWAMAQGKGKGHRATLLKTALTETVYELWKYRNEVSFGGIVNNTHIGKKIMDSIVYRSWTHKKMREYIARLLIS

SEQ ID NO: 142673 - protein, 71 aa, Glycine max
  Coding DNA Sequence Number=SeqID_25895
MWYHLQGNSLSVSTRHSHLGKLGNNSPYGDQPESQGSSKLSGMPPSTSIPLHEKLQVLNDKVYTISMSYEV

SEQ ID NO: 142674 - protein, 315 aa, Glycine max
  Coding DNA Sequence Number=SeqID_25896
  Homolog annotation: Hit_ID=Q8LE10; Match level="QueryCoverage=43%, HitCoverage=48%, E-value=4e-60, Identity=77%"; Hit description=HVA22- like protein i
  Pfam annotation: Domain name=TB2_DP1_HVA22; Domain location=1-82; Score=14.3; E_value=1.5e-06; Accession=PF03134.9; Description=TB2DP1, HVA22 family
MAGWFLVMPSQPMNAIKQLKRIGQKLNNFAFGASTVCERIADAFISWVPMYSEAKLAFVIYLWYPKTKGTTYVYDSFFRPYVAKHETEIDRNLLELRTRAGDIAVLYWQKAASYGQTRIFEILQYVAAQSTPSPRPAQQQPAVRVRQPASSNSQPAAATEPQAENPSSPTSSSSSQHQKEVAEKLGSSQVPKAPYTVAGLSSQKSNPIPAEDEPMQIEAAPPSSSSANENENPPLEDTIMEESIRPLRRTILMIPADIGSGGVIRDSVGNWLAGFYAYDGTEIMGFRQGLQSWVLGLRNIICEYDNLPLVNPIYW

SEQ ID NO: 142675 - protein, 87 aa, Glycine max
  Coding DNA Sequence Number=SeqID_25897
MPVEIVEISTSSSSSSNEPKEDFNDYECTLTTPYFPIFGCQWMVSPLVVELGDYEIENDPKMLKEDSKTKEDLKMLEKDPKEEGKVG

SEQ ID NO: 142676 - protein, 69 aa, Glycine max
  Coding DNA Sequence Number=SeqID_25898
  Subcellular localization annotation: CTP_CleavageSite=37; ConfidenceScore=5.71e-01
MSSPSHGDSATVRERHTSSPRPTPTPIASTSGRLRPRASVSGSNISSASESKCVERRSYNTAEEVRALG

SEQ ID NO: 142677 - protein, 95 aa, Glycine max
  Coding DNA Sequence Number=SeqID_25899
  Gene Ontology: Mol. function=calmodulin binding; Cellular component =integral to membrane; Biological process=cell death
  Homolog annotation: Hit_ID=Q5BMD0; Match level="QueryCoverage=97%, HitCoverage=15%, E-value=9e-30, Identity=66%"; Hit description=MLO1
  Pfam annotation: Domain name=Mlo; Domain location=1-94; Score=-372.3; E_value=0.079; Accession=PF03094.6; Description=Mlo family
MIILLVGTKLQVIITEMGLRIQQRGEVLKGVPLVQPGDHLFWFNRPGLILYLINFVLFQNAFQLAFFAWSALQFGIKSCFHSHTEDVVIRITMGY

SEQ ID NO: 142678 - protein, 250 aa, Glycine max
  Coding DNA Sequence Number=SeqID_25900
  Gene Ontology: Mol. function=calmodulin binding; Cellular component =integral to membrane; Biological process=cell death
  Homolog annotation: Hit_ID=Q2HSW1; Match level="QueryCoverage=99%, HitCoverage=34%, E-value=6e-70, Identity=58%"; Hit description=Mlo -related protein
  Pfam annotation: Domain name=Mlo; Domain location=5-250; Score=-83.8; E_value=1.4e-14; Accession=PF03094.6; Description=Mlo family
MAGGSGGRNLEETPTWAVSAVCFVLILISIIIEHIIHLIGKWLKKKHKTALYESLEKIKSELMLLGFISLLLTVGQGPISRICISEKVAGTWHPCDDSSSIHESDTEESENVNGTNSRRLLAAFYGSDDVNPRRVLAGGGTDKCRELMSIKLCQGSLIALEKSRFYIKIYYSDTYYMTAYFFYGCATLSKGKVPFVSSDGIHQLHIFIFVLAVFHVLYCILTMALGRAKMKRWKRWEEETKTPEYQFSHG

SEQ ID NO: 142679 - protein, 504 aa, Glycine max
  Coding DNA Sequence Number=SeqID_25901
  Homolog annotation: Hit_ID=Q9FQZ2; Match level="QueryCoverage=78%, HitCoverage=96%, E-value=2e-64, Identity=38%"; Hit description =Avr9/Cf-9 rapidly elicited protein 137
  Pfam annotation: Domain name=DUF668; Domain location=326-422; Score =55.7; E_value=1.5e-13; Accession=PF05003.3; Description=Protein of unknown function (DUF668)
MARCPGAAANLCCLFVHHNQSPPPETLGILAFDAVKTMCRLISLYNSLHHQEILHLRRHIIRSKSVSNLNSRDECFLLTLACAERLEDLNLSAATVYHLATRCSNRNLTRCFEAIDARKLQFGTKDVETKIENMEKLVLATRSLHKAMESLTEMEASERKMQKWRTIRENHGLKVKVECFNDKIMFYRRQVVYFKQVSLWNQTFDKVVALMARIICIVYNRICSVFGTFVTGNVKRRNQNKNNKNGVVRRRIFENSYCRVEHRELYRMNLCMFDQTEEVLKKRAWGCCNVKRGAPTGVFRFHHAPSGEGGEVAMNNRVMRLAPANTVGGAGLSLRYANVILLAERCMHAPDATIGNDARVTLYDMLPGRLKMKLRAKLKGEWLEWKKLEGGEEEHSEAATRRHVVAAEVMEILVPVAHDMVRWQAERNLEKQKFETKPTVLLLQTLHYSDLEKVEEAIVEVLIGLSYMHWSSLRGDLLQYLDQCTRLNRDYKGRVGGTWAPMTL

SEQ ID NO: 142680 - protein, 77 aa, Glycine max
  Coding DNA Sequence Number=SeqID_25902
  Subcellular localization annotation: CTP_CleavageSite=21; ConfidenceScore=5.41e-01
MGFMIPQRRGGGGSRKGHRRRQQMRRNSRRRRSRGRRGTCSLESEGVEAALALWRLKEREEENATAPLSTPVPKQPS

SEQ ID NO: 142681 - protein, 643 aa, Glycine max
  Coding DNA Sequence Number=SeqID_25903
  Gene Ontology: Mol. function=protein serine/threonine kinase activity; Cellular component=cell surface; Biological process =protein amino acid phosphorylation
  Homolog annotation: Hit_ID=Q6UY58; Match level="QueryCoverage=97%, HitCoverage=93%, E-value=0.0, Identity=72%"; Hit description=Lectin -like receptor kinase 7;3
  Pfam annotation: Domain name=Lectin_legB; Domain location=21-252; Score=380.9; E_value=1.9e-111; Accession=PF00139.10; Description =Legume lectin domain
  Pfam annotation: Domain name=Pkinase; Domain location=334-604; Score =157.9; E_value=2.6e-44; Accession=PF00069.15; Description=Protein kinase domain
  Pfam annotation: Domain name=Pkinase_Tyr; Domain location=334-604; Score=108.4; E_value=2.1e-29; Accession=PF07714.7; Description =Protein tyrosine kinase
  Pfam module annotation: Pfam domain module=Lectin_legB::Pkinase::Pkina se_Tyr; Domain location=21-252::334-604::334-604
MATLLKILSLLVLLLIPVSCQVDQVLYSGFKDVGASNLTMNGVTTIERNGILKLTNESSRSIGHAFYPSPFQLKNSTSGKALSFSSSFAFAIVPEYPKLGGHGLAFTIATSKDLKALPNQYLGLLNSSDNGNFSNHIFAVEFDTVQDFEFGDINDNHVGIDINSMQSNTSANVSLVGLTLKSGKPILAWVDYDSRLNLISVALSPNSSKPKTPLLTFNVDLSPVFHDTMYVGFSASTGLLASSHYILGWSFKINGPAPPLDLSSLPQLPKPKKKQTSLIIGVSVSVVVIVLLAISIGIYFYRKIKNADVIEAWELEIGPHRYSYQELKKATRGFKDKELLGQGGFGRVYKGTLPNSKIQVAVKRVSHESKQGLREFVSEIASIGRLRHRNLVQLLGWCRRQGDLLLVYDFMANGSLDKYLFDEPKIILNWEHRFKIIKGVASALMYLHEGYEQVVIHRDVKASNVLLDFELNGRLGDFGLARLYEHGANPSTTRVVGTLGYLAPELPRTGKATTSSDVFAFGALLLEVVCGRRPIEPKALPEEMVLVDWVWEKYKQGRILDVVDPKLNGHFDEKEVMVVLKLGLMCSNDVPAARPSMRQVVRYLDGEVEVPEDLKKPGAVSHHEGFEEFLHSLASSSFDKMSS

SEQ ID NO: 142682 - protein, 138 aa, Glycine max
  Coding DNA Sequence Number=SeqID_25904
MENCWWEKELQPYNQYEEEIISNLDNLLMQLMETSKATQHAIKILEIPFEHDSREKDEEKNEERTQQQWKECSQVEMQQESILQVNIPPHQLIVKEDRHGEHDKSLSVILSLITSTSLAMIWKTFPGYMSFMESLAKR

SEQ ID NO: 142683 - protein, 226 aa, Glycine max
  Coding DNA Sequence Number=SeqID_25905
  Homolog annotation: Hit_ID=Q10MZ1; Match level="QueryCoverage=45%, HitCoverage=21%, E-value=7e-16, Identity=42%"; Hit description =Expressed protein
  Subcellular localization annotation: CTP_CleavageSite=66; ConfidenceScore=5.22e-01
MVPGKANDSKPKINQKTNQATKIGTGEAHQSFSFRQNRVFGTTRSTNIIQGRPVWDKSITKTKIVVAQRKPKSISTTQAPIDTHDKTSTENVNLGLKKSVAFPQQLAEKTTKNSSQEKVSASVPKTPVASSFRVRSKSSTPFYSALNCSKCHFDRLETSSYWVGQIKMAESVGKHFVASEFFRLALESHAEPIRNLGIELKRYLLRHGYLSEQKEWREVAARYGLH

SEQ ID NO: 142684 - protein, 50 aa, Glycine max
  Coding DNA Sequence Number=SeqID_25906
MRRGRFSFFTKPGEKEVMGEVVFFLYDVLPWERGDEKLLSDAGAFCEKEL

SEQ ID NO: 142685 - protein, 1022 aa, Glycine max
  Coding DNA Sequence Number=SeqID_25907
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q93YX7; Match level="QueryCoverage=99%, HitCoverage=99%, E-value=0.0, Identity=69%"; Hit description=Type IIB calcium ATPase
  Pfam annotation: Domain name=Cation_ATPase_C; Domain location=863 -1007; Score=-16.2; E_value=0.0015; Accession=PF00689.11; Description= Cation transporting ATPase, C-terminus
  Pfam annotation: Domain name=Cation_ATPase_N; Domain location=165 -241; Score=49.1; E_value=1.5e-11; Accession=PF00690.16; Description =Cation transporterATPase, N-terminus
  Pfam annotation: Domain name=E1-E2_ATPase; Domain location=255-496; Score=236.8; E_value=4.6e-68; Accession=PF00122.10; Description=E1 -E2 ATPase
  Pfam annotation: Domain name=Hydrolase; Domain location=500-828; Score=60.1; E_value=7e-15; Accession=PF00702.16; Description =haloacid dehalogenase-like hydrolase
  Pfam module annotation: Pfam domain module=Cation_ATPase_C::Cation _ATPase_N::E1-E2_ATPase::Hydrolase; Domain location=863-1007::165 -241::255-496::500-828
MESFLNPEEFKLSHRDRSIETLEKWRSAAWLVKNPRRRFRWAADLVKRKHAEDKRRKIQHDILERLLMQTDKMVAHWLPNRPNSEREAKSKEISVSMKGEATMVVGGRPQKDSTIRTALTVRRAADQFISVLPPAEYKVSEKTREAGFSIEPDDIASVVRGHDYNYYKKIGQVEGIIEKLSASADDGVGQDSIDTRQDIYGVNRYTEKPSKSFLMFVWEALHDLTLMILMVCAIVSIAIGLPTEGWPKGVYDGLGIILSIFLVVIVTAISDYQQSLQFRDLDKEKKKIFVQVTRDRKRQKVSIYDLVVGDIVHLSTGDQVPADGIYISGYSLVIDESSLTGESEPVNIDEERPFLLSGTKVQDGQGKMIVTTVGMRTEWGKLMETLSEGGEDETPLQVKLNGVATVIGKIGLTFSVLTFVVLTIRFVVEKAVRGEFASWSSNDALKLLDYFAIAVTIIVVAIPEGLPLAVTLSLAFAMKKLMKDKALVRHLSACETMGSATCICTDKTGTLTTNHMVVNKIWICGKINEIKGNESIDKLKTEISEEVLSILLRSIFQNTSSEVVKDKDGKTTILGTPTESALLEFGLLAGGDFEAQRGTYKILKVVPFNSVRKKMSVLVGLPDGGVQAFCKGASEIVLKLCNKVIDPNGTAVDLSDEQAKKVSDIINGFANEALRTLCLALKDVNGTQGESSIPEDSYTLIAIVGIKDPVRPGVREAVKTCLAAGITVRMVTGDNINTARAIARECGILTEDGVAIEGPHFRDLSTEQMKSIIPRIQVMARSLPLDKHTLVTRLRNMFGEVVAVTGDGTNDAPALHESDIGLAMGIAGTEVAKENADVIIMDDNFTTIVNVARWGRAIYINIQKFVQFQLTVNIVALIINFVSACITGSAPLTAVQLLWVNLIMDTLGALALATEPPNDGLMLRPPVFNEINSREIEKINIFKGMFESWIFFTVIFSTVVFQVLIVEFLGTFASTVPLSWQFWVLSVVIGAFSMPISVILKCIPVERGGITTHHDGYEALPS

SEQ ID NO: 142686 - protein, 130 aa, Glycine max
  Coding DNA Sequence Number=SeqID_25908
MFGSRLDILLRTTTNDHCCLSLHGYRDFFGLRFCKEIYQCPSHKFILCATFFVGEQYHAHCWACLAASAPPSCRFASTTFQECHAVHVHSQLNTPPQQPHARPFFQQEKFTHTMRDTSQMSVTLESSPFV

SEQ ID NO: 142687 - protein, 132 aa, Glycine max
  Coding DNA Sequence Number=SeqID_25909
MEACLWGFYGGWIFELQWGPLMVIFHHGDAAEDKGKDDCINHCHQVFVVRNQLQNQPHEVRNLTRFTTFSTAENLTLLSVSECEREERERESEKGKSTVTNSHVCGSSGKLLLSALHKIHPLPSPWMLLNMG

SEQ ID NO: 142688 - protein, 1080 aa, Glycine max
  Coding DNA Sequence Number=SeqID_25910
  Gene Ontology: Mol. function=structural constituent of muscle; Cellular component=striated muscle thick filament; Biological process=smooth muscle fiber development
  Homolog annotation: Hit_ID=Q9C698; Match level="QueryCoverage=99%, HitCoverage=99%, E-value=0.0, Identity=46%"; Hit description=Mysoin -like protein; 11013-7318
  Pfam annotation: Domain name=DUF869; Domain location=90-966; Score =1153.9; E_value=0; Accession=PF05911.2; Description=Plant protein of unknown function (DUF869)
  Pfam annotation: Domain name=Tropomyosin; Domain location=50-263; Score=-120.3; E_value=0.098; Accession=PF00261.10; Description =Tropomyosin
  Pfam module annotation: Pfam domain module=DUF869::Tropomyosin; Domain location=90-966::50-263
MDRRWPWKKKSSEKSVIEKATTALDSSDASNNQDNNKKPNYVQISVESYSHLSDLEDQVKTYEEKVQTLEDEIKEMNEKMSAANSEINTKESMVKQHAKVAEEAVSGWEKAEAEALALKNHLESVTLLKLTAEDRATHLDGALKECMRQIRNLKEEHEHKIQEVALSKTMQLDKIKGELEAKIVNFEQELLRSAAENGTLSRSLQERSNMLIKLSEEKGHAEGEIELLKGNIEACEREINSLKYELHVVSKELEIRNEEKNMSMRSAEAANKQHMEGVKKITKLEAECQRLRGLVRKKLPGPAALAQMKLEVESLGRDFGESRLRKSPVKPATPNLSPLPDFSLENVQKFQKDNEFLTERLLAMEEETKMLKEALAKRNSELQASRSMCAKTLSKLQSLEAQSQNQLKGSPKSIVQLTHERIYNQNSSSAPSLISMSEDGNDDAESCAESWATAIVSGLSQFPREKCNEESNKSEVTNKLELMDDFLEVEKLARLSNDSNVDATISVSSNNKTTDFVADDLSEVCTGKEGLSEKNGDSDQLPNEVSSDALMSAPDSQTDVSGLLLTELRSRILLVFESLAKDADIGKIVDDIKHVLEDSHDTTIHHSVDAHPSDTTCDRKDNPEDAGLNLEKEVISSQQPKEYVQITTDLEAAVSQIHDFVLFLGKEAMTSFHDVSSDGNEMRQKIEEFSVTFNKVLCNNASLLQFVLDLSYVLDKASEFRFNVLGYKGTEAESNSPDCIDKIALPENKLVQDNSSGERYQNGCSHILNPCSNPEVPDDGNLVSGYKADAASQKLSIEEFEELKLEKEKVVIDLSNCTENLEMTKSQLLEAEQLLAEVKSQLASANKSNSLAETQLRCMAESYNSLETRAQDLETELNHLQIKIESLENELQEEKRAHEAAMARSKELEEQLKRIECLAADDDHKTPHERNLTAAAEKLAECQETILLLGKQLNSLRPQTEANDSPYSKINPKDEGFTEDEHTTNGQKFQELGQLEMDSSTSAFVPRLSSESPLHFSNSLFSPSDSESTIPARSPVQHSKSKPKHRPTKSASSSVSSATTPEKHARGFSRFFSPKGKSGH

SEQ ID NO: 142689 - protein, 107 aa, Glycine max
  Coding DNA Sequence Number=SeqID_25911
  Gene Ontology: Mol. function=catalytic activity; Biological process =auxin mediated signaling pathway
  Homolog annotation: Hit_ID=Q1S393; Match level="QueryCoverage=98%, HitCoverage=80%, E-value=4e-28, Identity=55%"; Hit description=Auxin responsive SAUR protein
  Pfam annotation: Domain name=Auxin_inducible; Domain location=1-84; Score=109.7; E_value=8.3e-30; Accession=PF02519.5; Description=Auxin responsive protein
  Subcellular localization annotation: CTP_CleavageSite=39; ConfidenceScore=5.03e-01
MLRRWRSKARMSAHRIPSDVPAGHVAVCVGTNSRRFVVRATYLNHPVFKKLLVEAEEEYGFSNHGLLAIPCDEALFEQLLRFISRSDCHLALRNNLHFYLQSLPLLH

SEQ ID NO: 142690 - protein, 64 aa, Glycine max
  Coding DNA Sequence Number=SeqID_25912
MHLMQGPNDHYHQMKTSEESNHWKTAREPHFKRNLKESWASSSKGNNTRKSSLPWIQTENANET

SEQ ID NO: 142691 - protein, 84 aa, Glycine max
  Coding DNA Sequence Number=SeqID_25913
MGIFLFSRPEPEWTDVDLAIMDLNTKARYTLTCIENVRLRKATTLTRHYESFAIKDGESVDNMFGRLLLLLNIMETLGQKYPEA

SEQ ID NO: 142692 - protein, 73 aa, Glycine max
  Coding DNA Sequence Number=SeqID_25914
FNSAFKGLDDTPQPKSKVGARWILLKQKGSTECGYYVMHWMSTIILGSFRNNWETYFNDGRPLESERLKALRI

SEQ ID NO: 142693 - protein, 139 aa, Glycine max
  Coding DNA Sequence Number=SeqID_25915
MGEVEEVQEQMKADTEALKKQMATMMGAMMSIKEIMEVNVAAIAVISTIVEHAFPPYGLPPNYTPPNVAYTPSEDVNNSAPILIESRQPQTNHAHVSQTMGETHEIPHHNLSDFEPCLGYATEGQAVGGIPLQNTLEGS

SEQ ID NO: 142694 - protein, 391 aa, Glycine max
  Coding DNA Sequence Number=SeqID_25916
  Homolog annotation: Hit_ID=Q10MZ2; Match level="QueryCoverage=97%, HitCoverage=53%, E-value=1e-52, Identity=36%"; Hit description =Expressed protein
  Subcellular localization annotation: CTP_CleavageSite=43; ConfidenceScore=5.81e-01
MASPSPPKSKFSVYQNPSFSAVLTSNSLQPSNSTILSILSFFSASAFVFLAAFFRENGFVHILCFGTLSPVTAYWLAKTLQAIVGFIFIGTVSALFNVVFLRRARYAGGGAAVAAKSLSDSNSVHRNEILLTKHQLGLLGVKPKVDLVQPDSAKKPPKSKPQLPSSGLLVPLHQPIPSPTRGSSSRIDADGSNSNRGGAARSIGTPSRSPGLASLYLSPGVVSPPRSLAGVDSVVSSPWSNRRVSSANKITSEEKLERFLAEVDERINESAGKMSTPPPTVPGFGIVSPSTVTGSANTSGTARRTPLRPVRMSPGSQKFNTPPKKGEGEFPAPMSMEEFVQAFEHLGIYPQIERWHDRLRQWFASVLLNPLLNKIETSHIQIMAGNTTAKG

SEQ ID NO: 142695 - protein, 62 aa, Glycine max
  Coding DNA Sequence Number=SeqID_25917
MYPEELSPSEDAPKNLCLSFVEEQGGGESSRVRPRFASENSRKNGPCGVDPMHGGSNEDGHN

SEQ ID NO: 142696 - protein, 304 aa, Glycine max
  Coding DNA Sequence Number=SeqID_25918
  Homolog annotation: Hit_ID=Q10MZ2; Match level="QueryCoverage=99%, HitCoverage=44%, E-value=1e-110, Identity=63%"; Hit description =Expressed protein
MQAAAKLGISITISQVGSDMLSTGIPSALPTIDKNQEWQPALSLNEDGLLHQLHSTLVQAIDSSKSKLLVSNMQQSPQQTSLVSIMQDCVDAITEHQRLQALVKGEWVKGLLPQSSVRADYTVQRIRELAEGTCLKNYEYLGSGEVYDKTNKKWTLELPSDSHLLLYLFCAFLEHPKWMLHVDAMSYAGAQSGKNPLFLGVLPPKERFPEKYIAVVSAVPSVLHPGACILAVGKQGPPIFALYWDKKLQFSLQLWICQGRTALWDSILLLCHKIKIGYGGVIRGMHLGASALSILPVMEAEYED

SEQ ID NO: 142697 - protein, 72 aa, Glycine max
  Coding DNA Sequence Number=SeqID_25919
MQTNKESQGVRIRTALRALVDGNFHMASFKWNYEQSNKASSGTRCYPATYSAELSQHLDNKTAHFLSSLLIR

SEQ ID NO: 142698 - protein, 388 aa, Glycine max
  Coding DNA Sequence Number=SeqID_25920
  Gene Ontology: Cellular component=cytosol
  Homolog annotation: Hit_ID=Q9CXP9; Match level="QueryCoverage=71%, HitCoverage=75%, E-value=5e-28, Identity=30%"; Hit description=13 days embryo head cDNA, RIKEN full-length enriched library, clone:3110037I16 product:...
  Homolog annotation: Hit description=hypothetical protein, full insert sequence
MAETSSTEEDHNHIPIEIISDDEMALIEAAFAFASTRTFSSLRSSSSSKLPLCTNALSITPLSKRKLSSDIEDLPTCKKKHTLSDSFLHRFRNKRGLSVTDLTSTEWCPKQMEFSLLLGGRKVNEAMRAGIARHAKLEQEVIQRVEVKVKSQEDYWALKFLNFIAGANQLLFEGLTRELPVIGFAEDIWMVGVIDEIRMPLTENDHNPILIDTKTRSRDTLPAEPQRRNGRLQLMCYKYLWDNLVADDFPSEKFFTYFGLNPQNNLCEDLKVIGADSGFSASTLDDAVRYYRNTCRMLAPAHDQLLLRYEYQKDHSLLGEVKFAYDRDWLKNQLRSCLEFWLGEQEATYTPEEERWKCQYCQFARVCPAYTNSKGTESPKRNYSNIKG

SEQ ID NO: 142699 - protein, 103 aa, Glycine max
  Coding DNA Sequence Number=SeqID_25921
MQSMLNLRATHGVPLCLSGITHPLTLPKEMADHDRRRKAMKRQRLRARRGGGMHANQQKGIHRYNFESDFLEIKVEEYDYGDLDDLILHDLFHTYLDLTAKAA

SEQ ID NO: 142700 - protein, 131 aa, Glycine max
  Coding DNA Sequence Number=SeqID_25922
  Gene Ontology: Mol. function=translation elongation factor activity
  Homolog annotation: Hit_ID=Q1RW61; Match level="QueryCoverage=97%, HitCoverage=38%, E-value=6e-55, Identity=79%"; Hit description =Putative translation elongation factor
MQLAQSNPKINEFLKDKRLENVNRAHLTLAHKRSHGIKAVADYGIYHNKKVPVELTALLFTDKMAAFEACTGSVEGEKIVSKNSWPHITLWTAEGVAAKDANMLPQLLAEGKANRIDFNPPINISGTLDFY

SEQ ID NO: 142701 - protein, 721 aa, Glycine max
  Coding DNA Sequence Number=SeqID_25923
  Gene Ontology: Mol. function=nucleic acid binding; Cellular component= nucleus; Biological process=ubiquitin cycle
  Homolog annotation: Hit_ID=Q1RWA4; Match level="QueryCoverage=99%, HitCoverage=88%, E-value=0.0, Identity=70%"; Hit description=DNA -binding SAP; Zinc finger, MIZ-type; Zinc finger, FYVE/PHD- type
  Pfam annotation: Domain name=PHD; Domain location=62-116; Score=38.3; E_value=2.6e-08; Accession=PF00628.19; Description=PHD-finger
  Pfam annotation: Domain name=zf-MIZ; Domain location=247-296; Score =87.0; E_value=6e-23; Accession=PF02891.10; Description=MIZ zinc finger
  Pfam module annotation: Pfam domain module=PHD::zf-MIZ; Domain location=62-116::247-296
MWAKKNAGGKEQVAKLVDDTYRKMQISGATDLASKGQGASDSSSVKVKSEFDDAFQRDVKIRCLCGSRLETEDLVKCDDPRCHVWQHISCVIIPEKPTEGIPPVPDKFYCELCRLTRADPNNPVQSVERTFQLTRADMDLVSKPEFDVEVGLVYAPERQGSIQDAMATVYRPAGVPVRATNRPGSQLLGANGRDDGPIILNSIPKESDGEKFEEALARVCRCVGGGNAADDADSDSDLEVVSDTFTINLRCPMSGSRMKIAGRFKPCIHMGCFDLEVFVEMNQRSRKWQCPICLKNYALENIIIDPYFNRITSMMMNCGEEIAEIEVKPDGSWRVKVKSESERLELGNLAQWRLPDGTLCVSTDGDVKRVDTLKQVKQEGVSDSPAGLKLGIKKNCNGVWEVSKPEGTNTSSGNNLKRVFGNPEQVVIPMSSSATGSGRDGDDPSVNQGGGGHIDYSTTNGIEMDSLCLNNVDLAYEYTAPNTSAQVGGAEVIVLSDSEEDNDLLASPAIAYKNNRNDATDGYSVPPPVIVDSYTEDHNLGGNSCLGLFPNDDDFGMSSLWPLPSGSQAGPGFQLFGSDADVSDALVHLQHDPMNCSSSLNGYALAPDTALGSGGILQESSAGRSVADLNGGLVDNPLAFGGDDPSFQIFLPTRPADSSMHNELRDQANVANGVCTEEDWISLRLGGGAGGNNGDAPTQNGLNSRHQIPTREGAKNTLDDT

SEQ ID NO: 142702 - protein, 485 aa, Glycine max
  Coding DNA Sequence Number=SeqID_25924
  Gene Ontology: Mol. function=hydrolase activity; Cellular component =cellulose and pectin-containing cell wall; Biological process =aromatic compound metabolic process
  Homolog annotation: Hit_ID=Q1S193; Match level="QueryCoverage=99%, HitCoverage=99%, E-value=0.0, Identity=76%"; Hit description =Alpha/beta hydrolase fold
  Pfam annotation: Domain name=Abhydrolase_1; Domain location=177-446; Score=44.6; E_value=3.3e-10; Accession=PF00561.10; Description =alphabeta hydrolase fold
MEWVKMKGYAREFMVGVAEMTVEFGKGCRDIVKQSLVNDDSYIVKNFGRDSYIGKTVTEPFANLFQKLSFFNEYLPEDKDPLHAWSVIFFVSILAFLALYANFERDAYAAAPVKHVFVHPPSATCVVLPDGRYMAYKEQGVSSHRARFSVIAPHSFLSSRLAGIPGVKDSLLQEFGIRLLTYDLPGFGESDPHPNRNLESSATDMAFLANALGVDKFWVVGYSSGSMHAWAALRYIPDRLAGAAMFAPMVNPYDPIMTKEERRRTWNKWTRRRKFMYFLARRFPRLLAFFYQRSFLSGKHGQIDRWLSLSLGNRDKALMEDPMYEEFWQRDVEESIRQRNVKPFMEEAALQVANWGFSLSDLKLQKRKRSSNLLSWLKSMFTETEEYMGFLGPIHIWQGMDDKVVPPSMTDFVHRVLPGAAVHKLPYEGHFTYIYFCHECHRQIFTTLFGTPQGPLSISIEVDQANLEETNIEQQVVNDGDYATN

SEQ ID NO: 142703 - protein, 257 aa, Glycine max
  Coding DNA Sequence Number=SeqID_25925
  Gene Ontology: Mol. function=translation elongation factor activity
  Homolog annotation: Hit_ID=Q1RW60; Match level="QueryCoverage=86%, HitCoverage=95%, E-value=4e-83, Identity=73%"; Hit description =Expressed protein-related
MACQFWFKEGPGAYKAYYLRQMKIWGTSAAKQRELSNMLDEWAVYIRRKCGNKPLSSSTYLSEAEPFLEQFAKRSPQNQALIGSAGNLVRTEDFLAIVEGGQDEEGDLVAEREIALPGPNISVKDTVPKYEGLIVFFPGIPGCAKSALCKELLNDQGGLGDDRPVHSLMGDLIKEVLNMIQIHFMYPTAPVLLYIKVVSSTCITNTEYHGVSTGKYWQKVAEERRKKPNSIMLADKNAPNEEVWRLVSVLTNFIMAY

SEQ ID NO: 142704 - protein, 323 aa, Glycine max
  Coding DNA Sequence Number=SeqID_25926
  Gene Ontology: Mol. function=RNA-directed DNA polymerase activity; Biological process=RNA-dependent DNA replication
MDYTNLNKVFPKDACLFPSIDRLVDGVARHHLLNFLDAYSGYNRILMHPRDEEKYAFTTESTNYCYQDTFQGLKIILVTPPLLAKPYIQEKLIIYLSISDDSSNQNGCRAGVLLEAPNQMTLEQSLRFGFKASNNQAEYETLLVELRLAKEYFHAFMKLNDEFEEVQVEHIDRNYNEREDELTKIVSDKRPTQLRTLIHETLLEPSIHSDECMNISSDSKEWMVDIMDYLAKGNLPGNALKAKQAKYAIRELHKGICGVHSGSQTMATGVLRSTTNEIPFRLTYGTKALILVGIGEPLFQQMHYDNTGNVEALKDELDLIDEL

SEQ ID NO: 142705 - protein, 960 aa, Glycine max
  Coding DNA Sequence Number=SeqID_25927
  Gene Ontology: Mol. function=helicase activity; Biological process =viral genome replication
  Homolog annotation: Hit_ID=Q1SN45; Match level="QueryCoverage=85%, HitCoverage=60%, E-value=1e-156, Identity=47%"; Hit description=AAA ATPase
  Pfam annotation: Domain name=DUF889; Domain location=676-876; Score =260.0; E_value=4.8e-75; Accession=PF05970.5; Description=Eukaryotic protein of unknown function (DUF889)
MATDQTFFISIIRIAMLQRGTKLSCVSIFVTGCNQGIMKHEQYFIQEDCFTNGLLMGRSPTLFEVSLVMWFPGSFPFTSYPNFVNINQCTLRVRLIASEPNLRSCLMDEGLTVRPRSTGCNQGIMKHEQYFIQEDCFTNGLLMGIRYMEQLYFDGMEICAHVGFPDLFLTLTCNPAWPEIQQQVAKSNLTAHDFPDVASRVFKMKLNQLMHDLKSGHVFGPILAFVYTIEWQKRGLPHAHILIFLHPSNKYPNPEDIDNIISAEIPNKDTDPELYQIVSNHMMHGPCGLANKRAPCMANGKCFRYVSAPEACWKIFAFPMHGRALAVEHLYFHLENQQPVYWKDSQEIGTVLAKSTIKESIGELFYMRMMLSSTKGSQCYEDIRIVENVVYHTFREACFAKGFLGSDQEFVGALREANTWGTPHYLRKLFVKLLFMNTMDRPEYVWKQTWQWMADDIVFNHKRQGIQLTDKEKMHLCLTEIENLLQANRKRLRDFPSMPYPLGYAAKTHQNNLIYNELAYDREILAAEFDKCYQSLTDEQASIFNKIMHVVATQSGGVYFLYEYGGTCKTFVWKTLSSAIRSTGGIVLIVASSGIASILLPGGRTTHSKFAIPVPATKNSTCNIHQGSDLAELLHITKLIIWDEAPMCHRYSIEALDKSLQDIMHNINPFGGKVIVFGGNFRQILPVVPRDIGDGKLAEPNDGYGEITIPDEFLIKDFQDPIQAIVEATYQDLLHNYSNDDFLQKRDVLASTKDVVDKINDYVLSLISGEEKEYCSADSVDKSDELLSPAFGVLTAEFLNSLKTSGIPNHKLIIKVGTPIILLRNLDQADGLCNGTRLIVTRLGSSVVEAEIITGPNIGHRTYIPRMNLSPSDSAWPFKLIRRQIPFMVSFAMTMNKSQGQSLAHVGLYLPTPVFSHGQLYVALSRVQSKKGLHILIHDNQGTPKNTTVNVVYKEVFSNL

SEQ ID NO: 142706 - protein, 215 aa, Glycine max
  Coding DNA Sequence Number=SeqID_25928
  Gene Ontology: Mol. function=translation elongation factor activity
  Homolog annotation: Hit_ID=Q0WL81; Match level="QueryCoverage=98%, HitCoverage=19%, E-value=6e-92, Identity=75%"; Hit description =Translation elongation factor EF-1 alpha
MQIEDMCHKTRASAVPVVAESEGTDSNPFSLDALAVFMFRVLQRVNHPGNLDKGSPNAGYVLLMFYHLYEGRNRREFEGELIERFGSLVKMPLLKSDRNPLPEPVQSVLEEGIDLYKLHTKRHGRLESTKGSYAKEWIKWEKQLRDILCGNAEYFNSIQVPFEFAVKQVLEQLRSIAKGEYTPPDTERRKFGTIVFAALSMPVTEIHGVLNKVRK

SEQ ID NO: 142707 - protein, 238 aa, Glycine max
  Coding DNA Sequence Number=SeqID_25929
  Gene Ontology: Mol. function=RNA-directed DNA polymerase activity; Biological process=RNA-dependent DNA replication
MAETQPPRQPSTKQPQPVQVPSPHMSEDHGEAIQVLREENVELRGHHSQLPLRRDIPQPSQVEVSSVPQASHLQGVTHPSNPVSTSLAPGLKSPFTARINDTPLPSTWKGVTLDKYDGIIDSGKHIDIYVVQVGFYNMNDVVLCKIALNFDDPVQHPIDPTFDIGSTGQFEAREERNAMIFPGELGPFINSFCKKLAIDLDDLHCRAAKYRQLEELIEYNCQLRSEASGSWKEPKKDF

SEQ ID NO: 142708 - protein, 59 aa, Glycine max
  Coding DNA Sequence Number=SeqID_25930
MLAQPGVSGWLAKPENWLSERLKISTSTNLLILPEIEMERLLNTQKWDTKYLLPIFNKK

SEQ ID NO: 142709 - protein, 110 aa, Glycine max
  Coding DNA Sequence Number=SeqID_25931
  Gene Ontology: Mol. function=protein binding; Biological process =defense response
  Homolog annotation: Hit_ID=Q1SW19; Match level="QueryCoverage=96%, HitCoverage=12%, E-value=7e-15, Identity=45%"; Hit description =Disease resistance protein
MGYRYSQLCAKNPYKLLKFIGKLHNLETLDIRRTYVKEMPKEILKLRMLRHLLVDDEELSPLRKGLGGMTSLQTLSHVKLTMDDDGVELSRELGMLTQLRNLGLNYVKKE

SEQ ID NO: 142710 - protein, 106 aa, Glycine max
  Coding DNA Sequence Number=SeqID_25932
LEVLFGSVVKFSKDLNCVILKLTPNSICTQGVIQSKSQIHNRKITNSCNIGITQGQKRKAADHIQNQNIPSMSNTTHMEHRSPTPCSKHHYTHTSNITNTSITQIG

SEQ ID NO: 142711 - protein, 115 aa, Glycine max
  Coding DNA Sequence Number=SeqID_25933
MADHGTRKTTTDRLEEAIVCLSNSQASINDRYNDLAGKGHQRNTVKFDIPRFDGRHPLGWIFKITQLFQYQNTPEEERITVASLYLDGAALSWYQWMFSNGFITPWNGFLQALES

SEQ ID NO: 142712 - protein, 857 aa, Glycine max
  Coding DNA Sequence Number=SeqID_25934
  Gene Ontology: Mol. function=protein binding
  Homolog annotation: Hit_ID=Q5JMB8; Match level="QueryCoverage=37%, HitCoverage=57%, E-value=4e-12, Identity=28%"; Hit description =Calmodulin-binding family protein-like
  Pfam annotation: Domain name=IQ; Domain location=124-144; Score=18.1; E_value=0.031; Accession=PF00612.17; Description=IQ calmodulin -binding motif
  Pfam annotation: Domain name=IQ; Domain location=146-166; Score=24.4; E_value=0.00042; Accession=PF00612.17; Description=IQ calmodulin -binding motif
  Pfam module annotation: Pfam domain module=IQ::IQ; Domain location =124-144::146-166
MGKSTSCFKLITCGGDAAEKDDYHQVSEIKESNDKRGWSFRKKSARHRVLSNTVIAEAPSSANKETSECSTFNFQPLPEPNVVEKIYTTNCSDEKPQLSSFESSQVEETNVIETEEKLDVNPPESDVIIIQAAIRGLLAQRELLQLKKVVKLQAAVRGHLVRRHAVGTLRCIQAIIKMQILVRARRAWQSRLENHLNHKDGKRDSSEALGNKNLMTKSNVSYISIEKLLSNRFASQLLESTPKNKHIHVKCDPSKSDSAWKWLERWMSVSSKDIAECKETSSLAEQSRESKDSSPLFQFETGIPSEPFPQAADSELTVEDSLLPSEDEEKLITYDANDFEFQASYSTSSIVKDDLVQVPPEERIAYDAKVASDEADSFLNEKSASDASAPPELNFIHKGPEIAPPSEHHSLQKGTEIAPPSEHSSLHKGPETAPPSEPNYFNQKPEIDGEQGIRSMKRFASDQLEAEGKKPVNGSRKVSNPAFIAAQSKFEELSSIANSVRTSSLSYQDSAVESQGDTSSVGNDTAYRSKEFAFENPAAYLSRFAGSECGTELSISSTLDSPDISEPGATENERDAKDLVEGIGILENTVNRDDEANGNVSHVIPASNLANSVLDKSEIVDDISANLGHSVVAVDSEEPAIKTEKNAPDLQRELPESVLQDLRSSPEASPRSHLTVPESQGTPSSEVSVKPKDSTISKTRSGNKRRSLSLSNKSPTNPNHDSGSKGSREQLPKDQQNGKRRNSFGLVKPDHIDQEPRDNSTNNNSLPHFMLATESARAKVNANNSPRSSPDVHERDIEVKKRHSLPGATGRQVSPRIQRSTSKAQQSAKGNNVHPPQGLCSLQESGLCLQIMSGYNL

SEQ ID NO: 142713 - protein, 406 aa, Glycine max
  Coding DNA Sequence Number=SeqID_25935
  Gene Ontology: Mol. function=nucleic acid binding
  Homolog annotation: Hit_ID=Q1SR04; Match level="QueryCoverage=92%, HitCoverage=86%, E-value=1e-103, Identity=59%"; Hit description=Zinc finger, CCCH-type
MAEVRLFLSEESPSQVGLNSQDHVQAKTSLLLHPDGAGSDDILPPGFEGTHAKSQSEIKLSQIPVIKWITPPKIEVNPTWRVAVGEESTEVEDQPQREMRVLEAIYPRISSIPQNPSVSMDVEESHCMDDQTALIPITPIEEEEAAAKALMDSLKPFDVSQSLQLAPGILKDSNSATSMQLACGLASDVVAAAFVALTSLVKRNEHGNFIDHESVNHILNNPEVIVKLVRDYRAANNSQYVHNAGSSLAAFSNPSIPIQGETTTPSSVVFSGTSSYAPPIGGLVEPITTQWPPRPAMSSAIVSSSIEVPPARNVNYYKSLIQQHGGDKQETLPYSSKRQIPQSATNYETTSYNHRGKDVGRELTVTTIMMHHFNHGVIPCQGYKVQRGSKWIMRLAVKMNSVGWWF

SEQ ID NO: 142714 - protein, 196 aa, Glycine max
  Coding DNA Sequence Number=SeqID_25936
  Homolog annotation: Hit_ID=Q9FKA2; Match level="QueryCoverage=61%, HitCoverage=88%, E-value=3e-44, Identity=73%"; Hit description =Arabidopsis thaliana genomic DNA, chromosome 5, P1 clone:MIJ24
MLKFLSRVKIEFNALDPRTASCMEFLAQCNSRKAKESNPACEVEVKRVREERAPQITVTFVNGVEEVFDATATPAQSIRNLILEKGQHLETEQMFREAGEPWPVVIPDEELSQIAPPTKVCVHHKLQWRIFWIHELCYKAICVWFPEDNYRLHALLTCLTATNFHIIFLVAANAKQLHDAVPARHPAALYNLLLPI

SEQ ID NO: 142715 - protein, 232 aa, Glycine max
  Coding DNA Sequence Number=SeqID_25937
  Gene Ontology: Mol. function=nucleoside-triphosphatase activity; Cellular component=integral to membrane; Biological process=transport
  Homolog annotation: Hit_ID=Q9C6W5; Match level="QueryCoverage=52%, HitCoverage=19%, E-value=1e-30, Identity=56%"; Hit description=White- brown complex homolog protein 14
  Pfam annotation: Domain name=ABC_tran; Domain location=36-162; Score=- 53.4; E_value=0.0092; Accession=PF00005.17; Description=ABC transporter
MDDLERLKKIRNHHGLRHYWGLRVRGQHTKCTGHRGKTVGVSKKVGSAVVFRDLDADDFHHPLDKQVHPIWRKLHESITYNGKAFSNAMKRSRGKRKRVSIGQEMLTNPSLLFLDASGLDSTIAKRIVSTLSNGGRTILMTIPQPSSRMYCMFQKVFMLSEGNLVYFGKGSEAMEYFSRFGYAPTTVMNPSDFLLNLANAIPRAAKKRHQREEVCIIFDMQICLVLMVALIA

SEQ ID NO: 142716 - protein, 436 aa, Glycine max
  Coding DNA Sequence Number=SeqID_25938
  Gene Ontology: Mol. function=RNA-directed DNA polymerase activity; Cellular component=chromatin; Biological process=chromatin assembly or disassembly
  Homolog annotation: Hit_ID=Q94HV4; Match level="QueryCoverage=99%, HitCoverage=39%, E-value=1e-90, Identity=40%"; Hit description =Putative retroelement
  Pfam annotation: Domain name=rve; Domain location=284-434; Score =112.1; E_value=1.6e-30; Accession=PF00665.16; Description=Integrase core domain
  Subcellular localization annotation: CTP_CleavageSite=27; ConfidenceScore=5.03e-01
MAFRTHNGRFKYLVMPFGLCNAPSMFQSAMNQLMQPFLCRFVTRYKCLFAQETIEYLGHIVSDKGVTPKPSKVQAMLQWPPPTMVKELRHSWGSPDFIGNSLRVTPPSQLHSQPCYAKTLSTEWAPSGILQQESWTPVTPHIHVYTRAPCRGGRGEKMEVIQTPEQHYYLSKLLGYEYSIQYKSGATNVVADALSRAPPPVGQLLILSIPQLDFLHDIKQSLTENLEFQQLTRAIQDHPTTYPDYSLGNGLKQDVKRFIKECVTCQQNKNSHRRPAGLLQPLPTSEGVWEDLSMDFITHLPTSNGFTVILVVVDRFSKGVHLGALPTGFTAFKVTSLFLDIICKLHGFPKSIVSDRDPIFVSKFWRELFRLSGTRLRLSTTYHPQSNGQMEVMNRIIEQYLCCFIHDQPSAWYQYLALVEWSYNTSVHSSSGLTPF

SEQ ID NO: 142717 - protein, 70 aa, Glycine max
  Coding DNA Sequence Number=SeqID_25939
MDDPLSQHDIKDVLRFKGGITSKGNLIINTVKINTTARIDVRIVAGVAIISPLLKNNLVLKVVHCVQSIP

SEQ ID NO: 142718 - protein, 86 aa, Glycine max
  Coding DNA Sequence Number=SeqID_25940
  Homolog annotation: Hit_ID=Q1T2D5; Match level="QueryCoverage=99%, HitCoverage=7%, E-value=1e-08, Identity=34%"; Hit description=Chromo
MVCVDQVEEKEGDLVHGVVGGNGAEMGTFRKLVDDDRIVVKPWEDGNLVIKSRDMSSQIEEGIGKGSIRGQLKLSCNRRSVLATPM

SEQ ID NO: 142719 - protein, 172 aa, Glycine max
  Coding DNA Sequence Number=SeqID_25941
  Gene Ontology: Mol. function=ubiquitin-protein ligase activity; Cellular component=chromosome, pericentric region; Biological process=cell division
  Homolog annotation: Hit_ID=UPI0000E49472; Match level="QueryCoverage =75%, HitCoverage=30%, E-value=2e-25, Identity=46%"; Hit description =PREDICTED: similar to RCC1-like protein
  Pfam annotation: Domain name=RCC1; Domain location=78-127; Score =41.3; E_value=3.2e-09; Accession=PF00415.9; Description=Regulator of chromosome condensation (RCC1)
MSASEAEKKVEEEEKNQEVKGGELLFCGATCWDIIGRRKGAVDGNLVSPSRLRPLVGVDIRYVASGCVSCHCVALDVEGRCYTWGRNEKGQLGHGDTIQRDRPTVVSELSKYKIVKAGSGRSHTVVVTEDGNSLAFGWNKHGQLGSGSESHMGGIKELEFAIETGDSRTGVT

SEQ ID NO: 142720 - protein, 358 aa, Glycine max
  Coding DNA Sequence Number=SeqID_25942
  Gene Ontology: Mol. function=protein binding; Cellular component =chromosome, pericentric region; Biological process=cell division
  Homolog annotation: Hit_ID=Q00SR2; Match level="QueryCoverage=57%, HitCoverage=42%, E-value=1e-54, Identity=50%"; Hit description=[S] KOG1426 FOG: RCC1 domain
  Pfam annotation: Domain name=RCC1; Domain location=165-216; Score =17.7; E_value=0.0087; Accession=PF00415.9; Description=Regulator of chromosome condensation (RCC1)
  Pfam annotation: Domain name=RCC1; Domain location=64-116; Score =14.2; E_value=0.02; Accession=PF00415.9; Description=Regulator of chromosome condensation (RCC1)
  Pfam module annotation: Pfam domain module=RCC1::RCC1; Domain location=165-216::64-116
MSHLFSSYHLWLEFYSIISYNSKDSSVRLVYEPQPRPRAIAALAGETIVKVACGTNHTVAVDKNGFVYTWGFGGYGRLGHREQKDEWVPRRVEVFQNRNVLPPDSVISAGSVNSSCTAGGGQLYMWGKLKNTGDDWMYPKPLMDLSGWNLRCMDSGNMHHFVGADSSCISWGLAQNGELGYGPTGQKSSAVPKKVDLLEGMHVISVACGMGHSMVIVDRANVADRLDQLDIYDGKAVGEGNEAVNTTPVPKQAAKKGAKGAADNSKKRKQLKDSSESEEEEDAEESEDSEDEINGEVEAKRPRSSGKGRGKAPKKAGAKGKGAKEKGSGRGRGGTAANKSSSKSPQVKTGKRGRPRKS

SEQ ID NO: 142721 - protein, 170 aa, Glycine max
  Coding DNA Sequence Number=SeqID_25943
  Gene Ontology: Mol. function=ribonuclease H activity
  Homolog annotation: Hit_ID=Q1SZM6; Match level="QueryCoverage=49%, HitCoverage=28%, E-value=2e-13, Identity=47%"; Hit description =Ribonuclease H
MHIEEADCDGEQNSSEQEELGIRKYAGLSRNEEIFNDKVQPVWHTLNDIICKEVTQSLQQPSVHAELLAIYHGLKIARDKGIGRLICESDSKLITGEINMFHQYFPTITLIHLSKQMDWEVTFVHVYREGNKCADWLAKTENSSQQDLIIHSARPYTKLTLVMPWVSQPK

SEQ ID NO: 142722 - protein, 52 aa, Glycine max
  Coding DNA Sequence Number=SeqID_25944
MSVKNHVGRLGAHDKTNHTLASQVTFTRLRGALGPSEPQGLHSEESVQGSPS

SEQ ID NO: 142723 - protein, 166 aa, Glycine max
  Coding DNA Sequence Number=SeqID_25945
MPGSPKRFNPPLTEDPDFQPITDSETVKQKETEIRGCTTVSDARSTTFAVDTSQVGALKSYSQIAPWMETQRKHEASNVQICGRGGGMDNITSWGMCARDHRGIFVATKTLFTVVGLKITRGEALGVHAIQCSVLADVVNVSEVGSIVSECKTLLPSQFNFKVKFM

SEQ ID NO: 142724 - protein, 406 aa, Glycine max
  Coding DNA Sequence Number=SeqID_25946
  Gene Ontology: Mol. function=transcription factor activity; Cellular component=nucleus; Biological process=regulation of transcription, DNA-dependent
  Homolog annotation: Hit_ID=Q0PWL2; Match level="QueryCoverage=82%, HitCoverage=99%, E-value=1e-100, Identity=57%"; Hit description=GAGA- binding transcriptional activator
  Pfam annotation: Domain name=DUF1004; Domain location=223-337; Score =312.9; E_value=5.7e-91; Accession=PF06217.3; Description=Protein of unknown function (DUF1004)
MDDAGHRENGRHKAADQYKSAQGQWLMQHQPSMKQIMAMIAERDAAIQERNLAISEKKAAYAERDMAYMQRDAAIAERNNAMLERDNAIATLQYRETSLSSGSMPSCPPGCQISRGVKHVHHPQQQVHHIPNMGDASYNTREMHTTEVLPAAPIPSETGKSRRAKRPKEPKSAPPNKKTSKPSKKVKKESEDLNNMFGKAHEWKSGQEMVNGGDDLNKQLAVSKADWKGQDLGLNQVAYDESTMPAPVCSCTGVLRQCYKWGNGGWQSACCTTTLSMYPLPAVPNKRHARVGGRKMSGSAFNKLLSRLAAESHDLSNPVDLKDHWAKHGTNRYITINHPGTLSALICKINYEVANMNPIPWFSKSMLLPVSALKFGDMLTLKQIEVLIFWLSSGIIYKGIVFSSYP

SEQ ID NO: 142725 - protein, 153 aa, Glycine max
  Coding DNA Sequence Number=SeqID_25947
  Homolog annotation: Hit_ID=Q0GPE5; Match level="QueryCoverage=22%, HitCoverage=7%, E-value=1e-10, Identity=100%"; Hit description=BZIP transcription factor bZIP11
MMNKSYETTSKLMLDHCLCTIDYTHTSPAPRPKVFDIGLKKKVFCFHYLAPLVGNNAMQFKAGDAMHCVESAVTESVPGDAIHCLESVVTKTVSLPDYASCRSMQLVRDSLPSSETARLKRRTSASKVSFKAAQTTTKIVIQLLNCKYVILIA

SEQ ID NO: 142726 - protein, 458 aa, Glycine max
  Coding DNA Sequence Number=SeqID_25948
  Gene Ontology: Mol. function=galactose oxidase activity; Biological process=cell wall catabolic process
  Homolog annotation: Hit_ID=Q10NU0; Match level="QueryCoverage=95%, HitCoverage=77%, E-value=1e-150, Identity=59%"; Hit description =Glyoxal oxidase, putative, expressed
  Pfam annotation: Domain name=Glyoxal_oxid_N; Domain location=36-280; Score=506.7; E_value=2.7e-149; Accession=PF07250.2; Description =Glyoxal oxidase N-terminus
MTTLVLLLLLLLSVTEASNSNGQWQLLQKSIGIVAMHVQLLNNDRLIIYDRTDFGFSNLTLPNGTCRHDPSEKVLNQTDCTAHSLEYDVASDTFRPLFVQTDIWCSSGTTVANGTLIQTGGYNDGERKIRSFTPCETCDWQETDNALLVKRWYSTDHYLPDGRQIIIGGRRQFNYEFYPKINSAEYDKPYVLPFLFETYDKGVENNLYPFVFLNVDGNLFIFANSRAILFDYQNDIVVRTYPEIPGGDPRSYPSTGSAVLLPLRNLEAPSVEAEVLICGGAPRGAFQLVPQGVFLQALDSCARIMITDPNATWTVESMPMGRVMSDMVMLPNGDILIINGAQLGTAGWDKAMEPVLEPVIYKTNGWVGSRFVLQSASSIPRMYHSTAILVRDGRVLVGGSNPHEKYDFSNVSYPTDLSLEAFSPYYLDPQFSPLRPMIVEPCSHANVTYGEKFKMGIE

SEQ ID NO: 142727 - protein, 66 aa, Glycine max
  Coding DNA Sequence Number=SeqID_25949
MVIHRLELCITMVRLAIEFVVSVAETVVIVQQRTAEPLGTLNRAILIETPRCPPAYFLDQRLIRLW

SEQ ID NO: 142728 - protein, 260 aa, Glycine max
  Coding DNA Sequence Number=SeqID_25950
  Gene Ontology: Mol. function=molecular_function; Cellular component =internal side of plasma membrane; Biological process=G-protein coupled receptor protein signaling pathway
  Homolog annotation: Hit_ID=Q3MV14; Match level="QueryCoverage=100%, HitCoverage=76%, E-value=9e-64, Identity=46%"; Hit description=WD repeat protein
  Pfam annotation: Domain name=WD40; Domain location=217-255; Score =10.2; E_value=2.4; Accession=PF00400.22; Description=WD domain, G -beta repeat
  Pfam annotation: Domain name=WD40; Domain location=51-91; Score=12.6; E_value=1.2; Accession=PF00400.22; Description=WD domain, G-beta repeat
  Pfam annotation: Domain name=WD40; Domain location=7-45; Score=51.4; E_value=3.1e-12; Accession=PF00400.22; Description=WD domain, G-beta repeat
  Pfam module annotation: Pfam domain module=WD40::WD40::WD40; Domain location=217-255::51-91::7-45
MSRRPPPDPVAVLRGHRASVTDISFHPSKPILFSGSADGEVRIWDTLQHRTVSSAWLHSAAHGIVAVAGSSSLGNNKFVSQGRDGTVKVWELGDAGKASEDSYRSELGGVPDREILEDRREEAYTNQSCSESFGENMYNEGLQYVALSGEKSSEVEIWDLKSAEKVVQLPSSNPSNSSSPCNKGGRGYKVLTTISYPIFQCRYEDGSMLWWDVRNPGVPVTSVKFHSEPVLSVCNDGSCKGGISGAADDKIVMYSLDHSS

SEQ ID NO: 142729 - protein, 274 aa, Glycine max
  Coding DNA Sequence Number=SeqID_25951
  Gene Ontology: Mol. function=protein serine/threonine kinase activity; Cellular component=integral to membrane; Biological process=protein amino acid phosphorylation
  Homolog annotation: Hit_ID=O65510; Match level="QueryCoverage=96%, HitCoverage=57%, E-value=4e-69, Identity=37%"; Hit description =Putative receptor protein kinase
  Pfam annotation: Domain name=LRR_1; Domain location=104-126; Score =15.9; E_value=0.15; Accession=PF00560.23; Description=Leucine Rich Repeat
  Pfam annotation: Domain name=LRR_1; Domain location=128-150; Score =15.0; E_value=0.28; Accession=PF00560.23; Description=Leucine Rich Repeat
  Pfam annotation: Domain name=LRR_1; Domain location=152-174; Score =7.4; E_value=12; Accession=PF00560.23; Description=Leucine Rich Repeat
  Pfam annotation: Domain name=LRR_1; Domain location=176-198; Score =14.1; E_value=0.5; Accession=PF00560.23; Description=Leucine Rich Repeat
  Pfam annotation: Domain name=LRR_1; Domain location=200-222; Score =11.3; E_value=2.2; Accession=PF00560.23; Description=Leucine Rich Repeat
  Pfam annotation: Domain name=LRR_1; Domain location=224-246; Score =8.4; E_value=7.8; Accession=PF00560.23; Description=Leucine Rich Repeat
  Pfam annotation: Domain name=LRR_1; Domain location=32-54; Score =19.0; E_value=0.018; Accession=PF00560.23; Description=Leucine Rich Repeat
  Pfam annotation: Domain name=LRR_1; Domain location=5-28; Score=3.4; E_value=67; Accession=PF00560.23; Description=Leucine Rich Repeat
  Pfam annotation: Domain name=LRR_1; Domain location=56-78; Score=7.8; E_value=10; Accession=PF00560.23; Description=Leucine Rich Repeat
  Pfam annotation: Domain name=LRR_1; Domain location=80-102; Score =14.8; E_value=0.31; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=104 -126::128-150::152-174::176-198::200-222::224-246::32-54::5-28::56 -78::80-102
ECDSVLEVLDVKENRIAHAPFPSWLTHAATTSLKALDLSGNFFTGSLPVDIGNLSALEELRVKNNLLSGGVPRSIVRCRGLTVLDLEGNRFSGLIPEFLGELRNLKELSLAGNKFTGSVPSSYGTLSALETLNLSDNKLTGVVPKEIMQLGNVSALNLSNNKFSGQVWANIGDMTGLQVLNLSQCGFSGRVPSSLGSLMRLTVLDLSKQNLSGELPLEVFGLPSLQVVALQENHLSGDVPEGFSSIVSLRFIVKIVKFDGVEPFFESIDRENSG

SEQ ID NO: 142730 - protein, 84 aa, Glycine max
  Coding DNA Sequence Number=SeqID_25952
  Gene Ontology: Mol. function=carboxylic ester hydrolase activity; Biological process=lipid metabolic process
  Homolog annotation: Hit_ID=Q6TGC0; Match level="QueryCoverage=55%, HitCoverage=11%, E-value=2e-18, Identity=85%"; Hit description =Triacylglycerol/steryl ester lipase-like protein
MTWLLNPPEQDLPLILADSGFDLWIANTRGTRYSRQHISLDPSSPAFLKAWKVACQSNSHISPHHTSKTDILAEAYYLQWSMQV

SEQ ID NO: 142731 - protein, 111 aa, Glycine max
  Coding DNA Sequence Number=SeqID_25953
CDWFDNTPYIGTRVDKKYEIVEGHRGLLAVMKTKAHSRITDNIVSETKQEAPYQDDELVGLQEVLEVDPDVINESLVDVDGGGEEIDVDLLKQLDLVELDDDECILSENDI

SEQ ID NO: 142732 - protein, 92 aa, Glycine max
  Coding DNA Sequence Number=SeqID_25954
MSRKLWNRSVSLCHRRVTGERENGVENEMLLGNERQNRCSSSGFRTHLPDIKPLTPLKISSSITILTLVFPPRALFLSTLLPQSCYFTVYNK

SEQ ID NO: 142733 - protein, 33 aa, Glycine max
  Coding DNA Sequence Number=SeqID_25955
MKTKAHSRITDNIVSETKQEAPYQDDELVGLQE

SEQ ID NO: 142734 - protein, 992 aa, Glycine max
  Coding DNA Sequence Number=SeqID_25956
  Gene Ontology: Mol. function=microtubule motor activity; Cellular component=microtubule associated complex; Biological process =microtubule-based movement
  Homolog annotation: Hit_ID=Q1S0D4; Match level="QueryCoverage=97%, HitCoverage=97%, E-value=1e-145, Identity=52%"; Hit description =Kinesin motor domain, putative
  Pfam annotation: Domain name=Kinesin; Domain location=35-354; Score =432.4; E_value=6e-127; Accession=PF00225.13; Description=Kinesin motor domain
MVKTGDTASMADVKEEQGNMALSNPLEERIFVSIRVRPLNDREKARHDVPDWECISGNTIRYKNNGHAEPRPLSMDTYAFDRVFGERCNTKQVYEQGIKEVALSVVRGINSSIFAYGQTSSGKTHTMSGITEYAVRDIYEYIEKHKDREFVVKFSAMEIYNEAVRDLLNAGATSLRILDDPEKGAVVEKLTEKTLTERRQLQQLLSICAAERTTEETAMNETSSRSHQILRLTVESNPCDYADTARSGALFASVNFVDLAGSERASQTMSAGSRLREGSHINRSLLSLGTVIRKLSKGRNEHIPYRDSKLTRILQNSLGGNARTAIICTISPARSQSEQSRNTLLFAGCAKQVTTNARVNLVMSDKVLVKQLQNELARLENELRSFTPNTMLLKERELQIQQMEKEIKELTRQRDLFQSRAENMVQPAGKDRLLRVDKDSASESSGAVAKNLLCRTDSASESLDRTTTSLQHTENSEDNFLLDGNSPTFAGPDPCHGWEEMTSSRESEENCKEVPYFEIKEVETEHKTDVNNTPPIPVFEETGGNTPMIQVVNVIAKSSSRNELRELSLVAVDNSQNALEGKTDESLQNTKDLIVDISKKSDGSSESESHISNAMSPPQIDKETSILPQITSNLEQNESPQFNKLDQESTSPPQCDVQELKTTLPPQLDKPYSASLVSFEDKLPESNLQATKRNSSRKYSPIHYRDASVEHKTTLHPQLDKPDSTSLVCFEDKLPESKLQAPKRNSSKKYIHYRDASVEDVESLWDSDVEDTASVLNFVGKMNERAKQKPFNKDMDDIMVRARTSGINKRVSKVKGVSFHGGPRTLTPYNFERQQRDTIQLWDACNIPLVHRSYFFLLIKGELADSVYFDVELRRLSFLKDTFFSATNIAGHGSDVTPNSSLMSLNRERKMLSKQVHKKFSMKEREELYVKWGIDLKSKHRSVQLAWRLWTNTKDLNHVRESAALVAKLVGFINSGEAPKKIFGFGFLVRRK

SEQ ID NO: 142735 - protein, 163 aa, Glycine max
  Coding DNA Sequence Number=SeqID_25957
  Gene Ontology: Mol. function=ribonuclease H activity; Biological process=RNA-dependent DNA replication
  Homolog annotation: Hit_ID=Q2HRR4; Match level="QueryCoverage=71%, HitCoverage=39%, E-value=6e-12, Identity=34%"; Hit description =Ribonuclease H
  Subcellular localization annotation: CTP_CleavageSite=44; ConfidenceScore=5.38e-01
MSLESTLRLMRILGPSPASLAQSFWSLLSNTFGGNGSTSNTLVVKATDSYIWKALTEQWSSFQEMEMWSIHNVMMSFLFVRSNLEEFVRNYKVNLPHSERGYQEIFVHWQPPLRGWFCLNMDGAVKGNGGIESCGGLIRNNNGQWKGGFAKYIGRSSVFVAKL

SEQ ID NO: 142736 - protein, 90 aa, Glycine max
  Coding DNA Sequence Number=SeqID_25958
  Homolog annotation: Hit_ID=Q10SS1; Match level="QueryCoverage=84%, HitCoverage=15%, E-value=4e-20, Identity=51%"; Hit description =Expressed protein
MQMVAGRFVNAYSSNDWTLGITFRASLLSHGLAGIQPVDVPGVENVDVTQLIEGHSSYLRMTQKILEQLELDNCCAVFKSGQENPQEEKS

SEQ ID NO: 142737 - protein, 109 aa, Glycine max
  Coding DNA Sequence Number=SeqID_25959
MASSMVYRLTWVMYTSRCSYGSVVSSYLSIVKFFQLEERVSSMMLGTKGFLNYDNYLLKVLKDRGKVSKLTLILVAQDKSTMVDSTSPPPNRLASGCCDLCASRSWLLH

SEQ ID NO: 142738 - protein, 352 aa, Glycine max
  Coding DNA Sequence Number=SeqID_25960
  Gene Ontology: Mol. function=oxidoreductase activity; Cellular component=cytoplasm; Biological process=flavonoid biosynthetic process
  Homolog annotation: Hit_ID=Q9LJ66; Match level="QueryCoverage=99%, HitCoverage=99%, E-value=1e-108, Identity=55%"; Hit description =Oxylase-like protein
  Pfam annotation: Domain name=2OG-FeII_Oxy; Domain location=197-298; Score=146.6; E_value=6.7e-41; Accession=PF03171.10; Description=2OG -Fe(II) oxygenase superfamily
MGEVDTAFIQEPEHRPKLSPNQAEGIPIIDLSPITNHAVSDPSAIENLVKEIESACKEWGFFQVTNHGVPLTLRQNIEKASRLFFEQTQEEKKKVSRDEKSTTGYYDTEHTKNVRDWKEVFDFLAKDPTFIPVTSDEHDDRVTHWTNVSPEYPPNFRDIMEEYIQEVEKLSFKLLELIALSLGLEAKRFEEFFMKDQTSFIRLNHYPPCPYPHLALGVGRHKDGGALTVLAQDEVGGLEVKRKADQEWIRVKPTPDAYIINVGDLIQVWSNDAYESVEHRVMVNSEKERFSIPFFFNPAHDIEVKPLEELTNEHNPSKYRPYKWGKFLVHRKGSNFKKQNVENIQIYHYKIT

SEQ ID NO: 142739 - protein, 115 aa, Glycine max
  Coding DNA Sequence Number=SeqID_25961
  Gene Ontology: Mol. function=oxidoreductase activity
  Homolog annotation: Hit_ID=Q9LJ65; Match level="QueryCoverage=99%, HitCoverage=42%, E-value=2e-20, Identity=36%"; Hit description =Oxidase-like protein
MGEVDPAFIQDPQHRPKLSIIQPEHIPVIDLSPITNNTVSDPSSIEGLVKEIGNACKEWGFFQSSPIGYYDTEHTKNIRNGKEVFDFLAKDPTFVPLTSDENDDQLTKWTNPSPQ

SEQ ID NO: 142740 - protein, 352 aa, Glycine max
  Coding DNA Sequence Number=SeqID_25962
  Gene Ontology: Mol. function=oxidoreductase activity; Cellular component=cytoplasm; Biological process=gibberellin biosynthetic process
  Homolog annotation: Hit_ID=Q9LJ66; Match level="QueryCoverage=99%, HitCoverage=99%, E-value=1e-113, Identity=56%"; Hit description =Oxylase-like protein
  Pfam annotation: Domain name=2OG-FeII_Oxy; Domain location=197-298; Score=141.4; E_value=2.4e-39; Accession=PF03171.10; Description=2OG -Fe(II) oxygenase superfamily
MGEVDPAFIQDPQHRPKFSTIQPEDIPVIDLSPITNHTLSDSSSIENLVKEIGSACKEWGFFQVTNHGVPLTLRQNIEIASRLFFAQSLEEKRKVSKSENNTLGYHDTEHTKNIRDWKEVFDFLARDPTFIPLTSDEHDDRLTQLTNQSPEYPPNFRVIIQEYIQEMEKLCFKLLELIALSLGIEANRFEEFFIKNQTSSIRLNHYPPCPYPGLALGVGRHKDPGALTILAQDEVGGLEVKRKADQEWIGVKPTLDAYIINVGDIIQVWSNDAYESVEHRVVVNSEKERFSIPFFFYPAHETEVKPLEELINEQNPSKYRPYKWGKFITHRKNTNFKNQNVENIQIYHYKLA

SEQ ID NO: 142741 - protein, 221 aa, Glycine max
  Coding DNA Sequence Number=SeqID_25963
  Homolog annotation: Hit_ID=Q69T79; Match level="QueryCoverage=30%, HitCoverage=28%, E-value=1e-12, Identity=50%"; Hit description =Putative glycine-rich cell wall structural protein
METALRRSSRVLCLILAIVGLIRCDNEVINGNASSSSSPSQGNNATFVTFPSQGVNEEVVKEKHNSYYNNNNKVHVKSTSWYYGGSGGGGGGGGGGGGYGWGWGGGGGGGGGGGGGGGGGGGGGGGGGGGGGGGGGGGGGGGGGEGGWKCVKRKGGGRGAHNHNHYNKKGMLDEKEYRVGEYAECMAKTRCRGMRLECPLHCGGPCYYDCHHMCKAHCRRP

SEQ ID NO: 142742 - protein, 269 aa, Glycine max
  Coding DNA Sequence Number=SeqID_25964
MEPQRFSTILVSELLEEDDESVTLMPGDIFKFSVHVYYRPINPGTRIRGSLVHRSPSRCIPCHNFFQEGREFFRRMLWRVPLYVESPEDIIENLMSTIGERFLHVDAAASPSPPPPSSESPHREIPFELTILILDTFNLELHAALVEESMLSFKMIPASNEAIETLLKKSTVMTRSESPCSICLEDLEINDECGTMPCKHTLPLIDVSISGKHRLFHKVSSQDKGIYIGHAQIDLSITYPHILTKGYQEVVMSKRTGKEHLNITWPGIA

SEQ ID NO: 142743 - protein, 381 aa, Glycine max
  Coding DNA Sequence Number=SeqID_25965
  Gene Ontology: Mol. function=RNA-directed DNA polymerase activity; Cellular component=intracellular; Biological process=RNA-dependent DNA replication
MGEERCRAVRQEVSKLTAAKFIKEIDYSTWLSNIVMVEKVEQEVEDVHGLHRLEPSMPKRRSAWIKPRSLLDDMVIKSDDLTTHLVGLREVLFQLKRYNMRLNLEKCVFRVGGRNFLGFMLTHRGIHANSDKCQTILEIRSPRNVKEAQRLAERITSLSRFLPRIVKKARLIMNLLIKAKIFVWDEDCKEVFRQLKETLATPPILSKLDTTKKLIVYLSIMVKAISLVLVQKEGIGKNGGPCVWATSLTSTIAELGSFWKYPATWPWHNPYILDSKPHAISDSKIATEQINKVFQTRDPKLLKYYHAFEKLRGQFEEVQVTHISQEVNDKADKLAQLATSPKLGQLKTFILHLVPKPNISRKNVYRWKKPSRGRDRRYSTT

SEQ ID NO: 142744 - protein, 380 aa, Glycine max
  Coding DNA Sequence Number=SeqID_25966
  Gene Ontology: Mol. function=oxidoreductase activity; Cellular component=cytoplasm; Biological process=flavonoid biosynthetic process
  Homolog annotation: Hit_ID=Q9LJ66; Match level="QueryCoverage=97%, HitCoverage=99%, E-value=1e-109, Identity=53%"; Hit description =Oxylase-like protein
  Pfam annotation: Domain name=2OG-FeII_Oxy; Domain location=201-324; Score=100.5; E_value=4.9e-27; Accession=PF03171.10; Description=2OG -Fe(II) oxygenase superfamily
MGEEVDTAFVQAPEHRPKSSVIVAEGIPLIDLSPINYQNEDTLLDSSIENLVKEIGSACKKWGFFQVINHKVPLDKRERIEEAAKKFFALGLEEKLKVRRDAVNVLGYFEAEHTKNVRDWKEIYDFNVQEPTFIPPSDEPDDEENVQFQWDNRWPQNPPEFKEACQEYAQEVEKLAYKLMELVALSLGLVPNRFRGYFTHNTSNIRLNHYPACPYPHLALGLGRHKDTGVLTVLAQDDTGGLEVRRKSDGEWIRVKPIFNSFIINVGDMIQVSNCGKVCLKLYSLSPHFHFTEVWSNDAYESVEHRVMVNSEKDRFSIPFFLKPALYTDVKPLEELLDDRNPPIYRPVNWGKFRSARMRSNFAKSKVENLQIYDFKFPSN

SEQ ID NO: 142745 - protein, 140 aa, Glycine max
  Coding DNA Sequence Number=SeqID_25967
  Gene Ontology: Mol. function=DNA binding
  Homolog annotation: Hit_ID=Q1S9R4; Match level="QueryCoverage=57%, HitCoverage=10%, E-value=3e-15, Identity=52%"; Hit description =Forkhead-associated
MKCEALEERGVEAFLYSKRLQYFNALSNDLQFIGKVIMDLQPNSIYSDYNLVSRYQHVESKRAIMRLELGAHSCIQRAIDSHGAFAILYSRHSKHYIKKPEVLLGRATEGVPVDIDLGKGGHGNAISRRQCMKMKDLCML

SEQ ID NO: 142746 - protein, 62 aa, Glycine max
  Coding DNA Sequence Number=SeqID_25968
  Gene Ontology: Mol. function=drug transporter activity; Cellular component=integral to membrane; Biological process=response to nematode
  Homolog annotation: Hit_ID=Q9FHB6; Match level="QueryCoverage=93%, HitCoverage=11%, E-value=5e-09, Identity=50%"; Hit description =Genomic DNA, chromosome 5, TAC clone:K24M7
MALWKEEAKKQLWLAGPMVFVSVFQYSLQVISLVFVGHLDELLLASTSLATSFVNATGFNVL

SEQ ID NO: 142747 - protein, 105 aa, Glycine max
  Coding DNA Sequence Number=SeqID_25969
  Homolog annotation: Hit_ID=Q10K51; Match level="QueryCoverage=94%, HitCoverage=15%, E-value=7e-11, Identity=36%"; Hit description =Pentatricopeptide, putative
NIVPLLMDLLGRVRQLDLALDAIQRMLLKVQAQAWGPLLSAYRIYGNVELGELATVRLLDSSPGSSGSGRRHMLRNLIDGKGLVKECGWSQVEVSDSYNTFAAGN

SEQ ID NO: 142748 - protein, 302 aa, Glycine max
  Coding DNA Sequence Number=SeqID_25970
  Gene Ontology: Mol. function=hydrolase activity; Cellular component =nucleus; Biological process=protein amino acid dephosphorylation
  Homolog annotation: Hit_ID=Q1STP0; Match level="QueryCoverage=96%, HitCoverage=98%, E-value=1e-160, Identity=90%"; Hit description =Serine/threonine-specific protein phosphatase and bis(5-nucleosyl)- tetraphosphatase
  Pfam annotation: Domain name=Metallophos; Domain location=51-246; Score=159.7; E_value=7.7e-45; Accession=PF00149.18; Description =Calcineurin-like phosphoesterase
MEGLDGLIERLLEVRKNRGKQIQLVESEIRSLCSTAKDLFLRQPNLLELEAPINVCGDIHGQYPDLLRVLEYGGFPPDSNYLFLGDYVDRGKQSVETICLLLAYKIKYPENFFLLRGNHECASINRIYGFYDECKRRFSVRLWKIFTDCFNCLPVAAVIDDKILCMHGGLSPDMESLNQIKAIERPVDVPDQGLLCDLLWADPDNEISGWGENDRGVSYTFGPDKVSEFLKKHDLDLICRAHQVVEDGYQFFADRQLVTIFSAPNYCGEFNNAGALMCVDQTLLCSFQIVKPFGTFRGKLTS

SEQ ID NO: 142749 - protein, 210 aa, Glycine max
  Coding DNA Sequence Number=SeqID_25971
  Gene Ontology: Mol. function=drug transporter activity; Cellular component=integral to membrane; Biological process=response to nematode
  Homolog annotation: Hit_ID=Q9FHB6; Match level="QueryCoverage=99%, HitCoverage=43%, E-value=1e-65, Identity=59%"; Hit description =Genomic DNA, chromosome 5, TAC clone:K24M7
  Pfam annotation: Domain name=MatE; Domain location=1-115; Score=20.3; E_value=0.00015; Accession=PF01554.9; Description=MatE
MGMSSALDTFCGQAYGAKQFHMLGVHTQGAMLVLTLVTIPLSIIWVFLGPILVALHQDKEIAAHAQLYARYLIPSLSANGLLRCITKFLQTQNIVFPMVLATGLTSFLHFFLCWVLVQKVGLGIKGSAIAICISNWFNTIILALYIKLSPSCKTTWTGFSKESLHNIPKFLKLAFPSTLMVCLESWTFEIMVLLSGALPDAKLQTSMLSI

SEQ ID NO: 142750 - protein, 171 aa, Glycine max
  Coding DNA Sequence Number=SeqID_25972
  Homolog annotation: Hit_ID=Q8H6Q8; Match level="QueryCoverage=64%, HitCoverage=46%, E-value=3e-07, Identity=31%"; Hit description=CTV.20
MREDSEQPFWKEKFLVSLPRSLGDKINNLLIETSEEETEDVSSEENLNLVQQDDQPWSTNDEDEDIQEINTQTRDQDLLFEAINSIPNLQEKKVFLNKLKKSLETKPKPKDFITNKKFDVSNILKRLENTSVKPTTIQDLQTEINNLKQEVKELRQQQEIHQIILSHFEEH

SEQ ID NO: 142751 - protein, 76 aa, Glycine max
  Coding DNA Sequence Number=SeqID_25973
MEIITMIVGTLLVFYYEKMVSYMPSSFANLVFAGERIEGGLRRGKFDYPTLMNGKPGANGENKKEGRIHTVIAVPI

SEQ ID NO: 142752 - protein, 144 aa, Glycine max
  Coding DNA Sequence Number=SeqID_25974
MAVIGKAAGADRQDRGRPRGCQTGPTVGVGTSVNVVAETESEGILVAMKKEPNKGLVMVIRGKEGPGKVTVVTGGHWRKDAEMACKQQQSHSWRSQDINFQESKGKYKRKWKKVQENVWDFISLTEHLGSFIEVPRLSPQQLLN

SEQ ID NO: 142753 - protein, 79 aa, Glycine max
  Coding DNA Sequence Number=SeqID_25975
MEQLTKTLASLFNLYEANRNSIHVHENAAEFHSLYVLLHLGSYSQPMVNLYIIDHSDLVVIRISSVLQQLRHYICSSAL

SEQ ID NO: 142754 - protein, 92 aa, Glycine max
  Coding DNA Sequence Number=SeqID_25976
MLGSNCKVWDLSHILILEVWDSSLGFYRSLGSPITTFHGHWMRKQGVELEDEDTHDNKDEVPDGVLPTMHKHVEEHPMRSGKDCGGEDSIFS

SEQ ID NO: 142755 - protein, 107 aa, Glycine max
  Coding DNA Sequence Number=SeqID_25977
MEGGNGNGSRTSTSVLSDTEEEEVQPSSNFVGTCPYMCPELQCWILYDGMSLLVRLVKNERVGLLPIGVGSGRRAFLMYIEDTIEVTSCAKEKEYKGMAFCLVSLEN

SEQ ID NO: 142756 - protein, 86 aa, Glycine max
  Coding DNA Sequence Number=SeqID_25978
  Homolog annotation: Hit_ID=O80783; Match level="QueryCoverage=47%, HitCoverage=30%, E-value=2e-07, Identity=61%"; Hit description =Expressed protein
  Pfam annotation: Domain name=DUF584; Domain location=1-43; Score= -41.9; E_value=0.01; Accession=PF04520.4; Description=Protein of unknown function, DUF584
MTPPHEIVKRRVAAKMAFLVCTGNGRTLKGRDLSQVKNSILSKQLSSWAIHEGLLCLCVQCPKVCAVYHILVRNVHFFNSREGFEF

SEQ ID NO: 142757 - protein, 120 aa, Glycine max
  Coding DNA Sequence Number=SeqID_25979
  Gene Ontology: Mol. function=beta-galactosidase activity; Cellular component=beta-galactosidase complex; Biological process =carbohydrate metabolic process
  Homolog annotation: Hit_ID=Q6X0N7; Match level="QueryCoverage=90%, HitCoverage=12%, E-value=2e-60, Identity=92%"; Hit description =Putative beta-galactosidase
  Pfam annotation: Domain name=Glyco_hydro_35; Domain location=1-120; Score=-117.4; E_value=1.2e-07; Accession=PF01301.10; Description =Glycosyl hydrolases family 35
MQYLTKHVTEFYQIENEYGKGGKEYRKWAAKKALSLGVGVPWVMCRQQDAPYDIIDTCNAYYCDGFKPNSHNKPTMWTENWDGWYTQWGERLPHRPVEDLAFAVACFFQRGGSFQNYYMA

SEQ ID NO: 142758 - protein, 1187 aa, Glycine max
  Coding DNA Sequence Number=SeqID_25980
  Gene Ontology: Mol. function=protein binding; Cellular component =membrane; Biological process=defense response
  Homolog annotation: Hit_ID=Q6R269; Match level="QueryCoverage=96%, HitCoverage=97%, E-value=0.0, Identity=56%"; Hit description=Disease resistance protein
  Pfam annotation: Domain name=FNIP; Domain location=996-1043; Score =7.7; E_value=0.099; Accession=PF05725.3; Description=FNIP Repeat
  Pfam annotation: Domain name=LRR_1; Domain location=1012-1038; Score =9.8; E_value=4.3; Accession=PF00560.23; Description=Leucine Rich Repeat
  Pfam annotation: Domain name=LRR_1; Domain location=1107-1130; Score =13.2; E_value=0.98; Accession=PF00560.23; Description=Leucine Rich Repeat
  Pfam annotation: Domain name=LRR_1; Domain location=525-547; Score =12.7; E_value=1.2; Accession=PF00560.23; Description=Leucine Rich Repeat
  Pfam annotation: Domain name=LRR_1; Domain location=549-571; Score =10.2; E_value=3.5; Accession=PF00560.23; Description=Leucine Rich Repeat
  Pfam annotation: Domain name=LRR_1; Domain location=572-594; Score =7.5; E_value=11; Accession=PF00560.23; Description=Leucine Rich Repeat
  Pfam annotation: Domain name=LRR_1; Domain location=596-617; Score =8.7; E_value=6.6; Accession=PF00560.23; Description=Leucine Rich Repeat
  Pfam annotation: Domain name=LRR_1; Domain location=729-750; Score =6.1; E_value=21; Accession=PF00560.23; Description=Leucine Rich Repeat
  Pfam annotation: Domain name=LRR_1; Domain location=805-828; Score =13.0; E_value=1; Accession=PF00560.23; Description=Leucine Rich Repeat
  Pfam annotation: Domain name=LRR_1; Domain location=848-872; Score =0.9; E_value=2e+02; Accession=PF00560.23; Description=Leucine Rich Repeat
  Pfam annotation: Domain name=LRR_1; Domain location=895-917; Score =4.8; E_value=37; Accession=PF00560.23; Description=Leucine Rich Repeat
  Pfam annotation: Domain name=LRR_1; Domain location=940-961; Score =1.8; E_value=1.3e+02; Accession=PF00560.23; Description=Leucine Rich Repeat
  Pfam annotation: Domain name=LRR_1; Domain location=963-986; Score =9.9; E_value=4; Accession=PF00560.23; Description=Leucine Rich Repeat
  Pfam annotation: Domain name=NB-ARC; Domain location=164-469; Score =297.5; E_value=2.5e-86; Accession=PF00931.13; Description=NB-ARC domain
  Pfam module annotation: Pfam domain module=FNIP::LRR_1::LRR_1::LRR _1::LRR_1::LRR_1::LRR_1::LRR_1::LRR_1::LRR_1::LRR_1::LRR_1::LRR_1::NB- ARC; Domain location=996-1043::1012-1038::1107-1130::525-547::549 -571::572-594::...
  Pfam module annotation: Domain location=596-617::729-750::805 -828::848-872::895-917::940-961::963-986::164-469
MPVLETLGGALFGAVLQVLLDKLDSCHVLDYFRGRKLDEKLLYKLKATLRSIDAVVDDAEQKQYSYSRVREWLLEVKQAVLDAEDLLDEIDCKALKYKLEDDSQTTTSKVRNLLNVFSLSSIDKEIESRMKQLLDLLELLASQKSDLGLKNACDVGIGSGLGSNVLKILPQTSLVAEDVIYGRDDEKEMILNWLTSDIDSRSQLSIFSVVGMGGLGKTTLAQHVYNDPQIEAKFAIKAWVYVSDDFDVLKVIKAIIGAINKSKGDSGDLEILHKYLKDELTGKKFFLVLDDVWNEDRDQWKALKTPLKYGAQGSKILVTTRSNNVASTMQSNKVCQLKTLQEDHSWQVFAKNAFQDDSLQLNVELKEIGTKIVEKCKGLPLALETVGCLLRTKRSSVSEWEGVMISKIWDLRIEDSKILPALLLSYYHLPSHLKRCFAYCALFPKDHEFDKESLILLWMAENFLQCSQQNKSPKEVGEQYFYDLLSSLYYAQRLRTFMPISRTTSFIDKWDCKILTHEFFSMFKFLRVLSFSGCRDLEGLPDSIGNLIHLGSLDLSHTRIKTLPDSTCSLCNLQILKLNCCFFLEELPITLHKLTNLHRLELMGTHVTKVPMHLGKLKNLQVLMSPFIVGQSNELGIQQLGELNLHGDLSIQNLQNIVNPLDALAADLKNKTHLVGLDLEWDLNQIIDDSSKEREILENLQPSRHLEQLSISNYGGNEFPRWLSDKLLNVVSLNLKDCKYCGHLPPLGLLPCLKDLRISGLDWVVCIKAAFCGSSDSSFSSLETLEFSDMKEWEEWELMTGAFPRLQRLSIQHCPKLKGHLPKQLCHLKELLVQDCKQLVTFAPKAIEICELDLEDCGKLHIDYHPTTLKRLQIRGYNMEASLLERIEHIIADTSLESLRISYCPNMNIPMNHCYDFLVRLEIYGGFDSLMTLPLDFIPKLCELVVSRCRNLRMISQMHPHKHLKSLSIHKCPQFESFPNEGLSAPRLDWFAIEGLNNLKSLPERMSILLPSLTSLCIRDCPRVEFSDGCLPSSLKHLDLLYCPKLVVSLKGALGANPSLERLHILKVDKESFPDIDLLPLSLTYLRILLSPDLRKLDYKGLCQLSSLEKLILYDCPSLQCLPEEGLPKSISTFKIQNCPLLKQRCKESEGNLENSEGSEVRNFWHPFGAGHCVVGSWGGFIHSLIG

SEQ ID NO: 142759 - protein, 85 aa, Glycine max
  Coding DNA Sequence Number=SeqID_25981
MGTGTYTDMKTGTGNGKSRNLKIRERELKSISWHKGKKEKGRKEKESEKSCHSGITGGRRKGGERGRSKKNPFYDGQKLLVFEYY

SEQ ID NO: 142760 - protein, 94 aa, Glycine max
  Coding DNA Sequence Number=SeqID_25982
  Homolog annotation: Hit_ID=Q6X0N7; Match level="QueryCoverage=43%, HitCoverage=4%, E-value=4e-16, Identity=95%"; Hit description =Putative beta-galactosidase
MNLVFLGQLREPKWGHLKDLHAALKLCEPALVATDSPTYIKLGPNQEIGTLSMLRSRFQSLPGAFNTCLVPFDKKQKGRFSSQRNLLRLLPHFH

SEQ ID NO: 142761 - protein, 75 aa, Glycine max
  Coding DNA Sequence Number=SeqID_25983
MVGAFSQNIVTLIGLHIPDKLMVCIYVRGRGCHTTGDGLETEEAVGVVNGKGVCFFVQIKPLVRPTKDIMSIRHC

SEQ ID NO: 142762 - protein, 119 aa, Glycine max
  Coding DNA Sequence Number=SeqID_25984
  Homolog annotation: Hit_ID=Q1T003; Match level="QueryCoverage=45%, HitCoverage=7%, E-value=8e-13, Identity=61%"; Hit description =Protein kinase; Concanavalin A-like lectin/glucanase
MGCYKWKPPSGGIRHPGQVSDLGGIGVDLKSGDSMNTWIEYNGNANGLCISVSYSNVRRKDPILKVDLDVGLPKVARRFTVLSGVWLRRRRGRRRLHGGPMIRAWVKGGGSKRMWWYRG

SEQ ID NO: 142763 - protein, 119 aa, Glycine max
  Coding DNA Sequence Number=SeqID_25985
GINCLIEFISSYPIAVANVGRGAVGALVPQLLPETESWQRLQTRSPAQGQFIFEFPAQVKAMQYSGDKEEAVPGLRITHQPSDLSLNWLGGMSGSQLSSFSSFLPMKGSCSLFSICGIL

SEQ ID NO: 142764 - protein, 137 aa, Glycine max
  Coding DNA Sequence Number=SeqID_25986
MLKLPPPPSPVNTHQPQLPRVLTKPKLQAVVPEQKEFHQNNKSVPKCKKATNEKKFNSRLIKRPPQTSDIIRNKQEEPFIIRPTSPTRASDIKNTKSKKNHPLSSNLLNNISNVPNLLPVKTDPSPSATKIPSKQVI

SEQ ID NO: 142765 - protein, 92 aa, Glycine max
  Coding DNA Sequence Number=SeqID_25987
MSGRNALIGCDIGIYVWGRGCHKHGLGWKRVKETQPNPHLGIKVETILDDLAPKRHRNRRSHHGGWCASPTPLVHGITMRGRHGDGGGTDGC

SEQ ID NO: 142766 - protein, 363 aa, Glycine max
  Coding DNA Sequence Number=SeqID_25988
  Homolog annotation: Hit_ID=Q9FIS0; Match level="QueryCoverage=42%, HitCoverage=20%, E-value=1e-17, Identity=41%"; Hit description =Arabidopsis thaliana genomic DNA, chromosome 5, P1 clone:MTG10
MLKLPPPPPVNTQPHLPRVLTKPKAQTLVPEQQEFHQNNKSVPKCKKATNEKFNSRLIKRPPQTSDIIRNKQEEPFIILRPTSPTGASDIKNTKSKKNHHPLSSNILLNNINNVPNLLPVKTDPSPPATKIPSKQVCDTCHQESKSSSQLSSCARQRYKQEGTTTTLLATRDRSENKPNNGAFSFSSTTVVQPHTPQELQYITAILARTTALKSQGIPTTLSLNQGWFSPTNPLDPSIFHHLEHPESDKDRNFSPKDQLGHRWNRRLLFDLVDEVLREILGPQEGEREKKRLWFLKGGVCNQKGSVVGLVERVWERVEEFPRAKCEVLEDIDELVDMQREKDGEKMEEEGEGLVAEIEGNIWD

SEQ ID NO: 142767 - protein, 82 aa, Glycine max
  Coding DNA Sequence Number=SeqID_25989
  Subcellular localization annotation: CTP_CleavageSite=43; ConfidenceScore=5.44e-01
MTIVVVIGAMMVVVAATTTSIMETKVVTVMVMVAAAVTTTTVMAAAVETIMVMVAIATTTIMVVVVAVVMVVIVTPSNPTLI

SEQ ID NO: 142768 - protein, 141 aa, Glycine max
  Coding DNA Sequence Number=SeqID_25990
MLSYPNFIRGLSFIDLLILPSRLTVLKHQLHSPRLASGSPRPPNDFRVKELTRLAEPITSGLSLSSPGRAASPLKWPFAYINRRARGAEKGFQGLEGEGIERRQKEEEEERRGNEVEALPNRNHDHSLLHFLFRVLCATVG

SEQ ID NO: 142769 - protein, 67 aa, Glycine max
  Coding DNA Sequence Number=SeqID_25991
MAGGKIGGEGFRESERLQGCVVIDYTNMVIDYQRATLPEITACNRLHYYGNRLPVVILARKQKQKAF

SEQ ID NO: 142770 - protein, 169 aa, Glycine max
  Coding DNA Sequence Number=SeqID_25992
MKHARTPRSFKEIYRQDLNFWNWAKNKMLIGNCHVEFLKPKSKELLRDSYQAQDTCFNRYKVLCNLQAWSEYYRWTIPVDHDNIIYINLAQGSHLGMAKRTSFIVCTSKTRLKTSLILSHRAIRFAFDSYNPYVKNCFEVMKLDNKISGAISNKSIELVRHCIFELTLL

SEQ ID NO: 142771 - protein, 461 aa, Glycine max
  Coding DNA Sequence Number=SeqID_25993
  Gene Ontology: Mol. function=RNA-directed DNA polymerase activity; Cellular component=chromatin; Biological process=chromatin assembly or disassembly
  Pfam annotation: Domain name=RVP_2; Domain location=127-252; Score= -34.4; E_value=0.00048; Accession=PF08284.2; Description=Retroviral aspartyl protease
  Subcellular localization annotation: CTP_CleavageSite=75; ConfidenceScore=5.68e-01
MSYARLQEEKLLDARRPSPYRTPTSTVGSTTTRSSSTNTTLSLLPTPVRNSTSIPFKRLTPEELASRREKGLCFHCDEKFSRGHKCASSLFFLVMEDEESTVEVDQLRDASSTPELLPESPPAQLSLQALSSHLAPETLCLKGFINNRPISILIYGGSTHNFLHNRVVVNLGLKPIETTPLHVTVGNGKEIRCHQLCTAVQVHIQQQSFTIDFHVLPLCGADVVLGVQWLKTLGPVLTDYDALTMKFITGGKLIELEGDREKEVEQVSPSQLRRFVHTNPTSTFFHIRIESAAKLTPQTTHSLLEIDTLITKYASLFQPLTNLPPSQPTDHTINLLPNSTLVNVRPYKYSYFQKKEIEEQVATMLARGFIQPSSNQFCSPVLLVKKKDGSWRFCVDYRALNAITVHDRFPIPTVDELLDKLGGAQWFSKLDLMQGYHQILMNTIDISKTAFRTIKGTTSFG

SEQ ID NO: 142772 - protein, 163 aa, Glycine max
  Coding DNA Sequence Number=SeqID_25994
MDVELRTGVGSRDSVVFVDEERVVVDPTVEVGVRYGEAPACTSLRIDGLNPEIKQLNTNGAGNPTILFARDSNSERAWRKADHEDNCTLRCIHWNHASAGPSIQLDRSHRIAERPASYGAVDCAMVSVLPTKTMAFAVVADSLRVATFGGGDHRSLSSWRVVK

SEQ ID NO: 142773 - protein, 219 aa, Glycine max
  Coding DNA Sequence Number=SeqID_25995
  Gene Ontology: Mol. function=RNA-directed DNA polymerase activity; Cellular component=chromatin; Biological process=chromatin assembly or disassembly
  Pfam annotation: Domain name=RnaseH; Domain location=55-171; Score= -33.5; E_value=0.076; Accession=PF00075.14; Description=RNase H
MYIRATALEYLGHMVAGNGVTPVPEKEASDAFQNLKNALTAAPVLALPDFSAPFMVETDASGSGMGVVLTQGGHPLAYFSKQFCPKLLNSSTYVRELAAITAAVRKWRQYLLGHHFVILTDHHSLRELMNQTIQTPEQHRYLARLLGFDYTIQYRARRSNVVADALSRAMEGQAASLYLLSMPRFVFLDDLRKELASLATFLDLRDRIQEDPAAYGIIH

SEQ ID NO: 142774 - protein, 100 aa, Glycine max
  Coding DNA Sequence Number=SeqID_25996
MSMEEKNDQSPTKMTPREGNKNSGSTNGGRGRRIAAMQMEAHCAGNFADYLTMDVKYLEAVKRRLHATKQWSPDEIRGIGNEDRCHPLKNLSQEARSQPP

SEQ ID NO: 142775 - protein, 121 aa, Glycine max
  Coding DNA Sequence Number=SeqID_25997
  Gene Ontology: Mol. function=nucleic acid binding; Cellular component= nucleus; Biological process=type I hypersensitivity
  Homolog annotation: Hit_ID=Q5N8W4; Match level="QueryCoverage=86%, HitCoverage=35%, E-value=2e-47, Identity=84%"; Hit description =Putative RRM-containing protein SEB-4
  Pfam annotation: Domain name=RRM_1; Domain location=18-88; Score =59.7; E_value=9.5e-15; Accession=PF00076.12; Description=RNA recognition motif. (a.k.a. RRM, R
MTPVNLAGQFGDTTYTKVFVGGLAWETQKETMKKYFKQFGEILEAAVITDKATGRSKGYGFVTFREPEAAMRACVDPAPVIDGRKANYNLASLGVQRSKPSTPKHVVNGEQVRWVHRRQRS

SEQ ID NO: 142776 - protein, 117 aa, Glycine max
  Coding DNA Sequence Number=SeqID_25998
  Subcellular localization annotation: CTP_CleavageSite=30; ConfidenceScore=5.56e-01
MVSPPDSPPPPPPSPPPPLPPPSDASASPSAMKRTHKATLVHVDPATGKADSPDRKKLRTYLGIVARDKVDVTYENGKEVPTAQKDLIWEDIQVEFEIPEASDSRTKKKLLKTVNER

SEQ ID NO: 142777 - protein, 59 aa, Glycine max
  Coding DNA Sequence Number=SeqID_25999
MDDWNIPEIPQDQLYVPETIKNKHNFDYIIKTVENNIPLGQDIGEEFHLLSKIQFMNIV

SEQ ID NO: 142778 - protein, 99 aa, Glycine max
  Coding DNA Sequence Number=SeqID_26000
AADAPPPPRQADPAGSFGMEQYLQHLVRQQVANHRGQVQTHECLYQLSLSLQSHGFAPFACPTPNQFRVGQRLHGPEIGLRPRQERHPQRLLAMQMRPA

SEQ ID NO: 142779 - protein, 148 aa, Glycine max
  Coding DNA Sequence Number=SeqID_26001
MELLNIGFSKTDVNYFMLTSLKKIEISEAVRLKTLPYLFSLSSFCLKLLFSFSSRPKSAGNRFVGTHIVIGRTHRTPYTAGKPTLSSLEPTEPTLSWVKENPRYRVATRVLKQSSVLKGQSFLREAPLTCVCCWVLFIKVTVDNCLGL

SEQ ID NO: 142780 - protein, 74 aa, Glycine max
  Coding DNA Sequence Number=SeqID_26002
  Gene Ontology: Mol. function=nucleoside-triphosphatase activity; Cellular component=membrane; Biological process=DNA replication
  Homolog annotation: Hit_ID=Q9CAM7; Match level="QueryCoverage=97%, HitCoverage=25%, E-value=2e-17, Identity=59%"; Hit description =Replication factor, putative; 74998-73295
MSLSSSSNAYNVPWVEKYHPIKVADAVVNEDAVSRLQGPPRTIKTTSILALMHKLLGGPNCKEAILELNASDER

SEQ ID NO: 142781 - protein, 39 aa, Glycine max
  Coding DNA Sequence Number=SeqID_26003
MPESEDFRIRHPNQVVFKDCRNWFHSKVNLGSKSMLLRP

SEQ ID NO: 142782 - protein, 41 aa, Glycine max
  Coding DNA Sequence Number=SeqID_26004
CPSIFSLTFGNSIRVIRGKIEESQKIARDVAIAVGRHVSPA

SEQ ID NO: 142783 - protein, 139 aa, Glycine max
  Coding DNA Sequence Number=SeqID_26005
MLLRGVYADLPRAPASWLVEIWVHGRLRRDKMVDEPRSRPITCEPVSSGPIDDPLRARTLPTRPQKRPQWRTGAQVPWKGAPERVRAPSCPDPVAPRGAVGESGCLECSPNRAGSGWGRRCVPVGCGTVRAGPPIDSGH

SEQ ID NO: 142784 - protein, 329 aa, Glycine max
  Coding DNA Sequence Number=SeqID_26006
  Homolog annotation: Hit_ID=Q8TGM5; Match level="QueryCoverage=11%, HitCoverage=58%, E-value=3e-07, Identity=74%"; Hit description =Uncharacterized protein ART3
MSDSLVRVSRRAEWGAHRPTPGARRCRGTPRARAAIHNRDDDVSTSISTARAWATIAIRVGQCPESIGGPALTVPHPTGTHRRPHPLPSRHFKHSLTLFSKSFSSFLAVLVAIGLSPVFSLGRNLPPDWGCIPNNPTRRQRLVVRQGPGTTGLSPSLAPPSRGLGPRSATEDASPDYNSDAEGDPIFMVGFFPRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCM

SEQ ID NO: 142785 - protein, 70 aa, Glycine max
  Coding DNA Sequence Number=SeqID_26007
  Subcellular localization annotation: CTP_CleavageSite=34; ConfidenceScore=5.04e-01
MDVSARWSGFGSGQQSFTIPGMQLDRRSQWFGARVDLVQSARARLFLRADRHVADRGDEKVLRGGVDVTF

SEQ ID NO: 142786 - protein, 279 aa, Glycine max
  Coding DNA Sequence Number=SeqID_26008
  Gene Ontology: Mol. function=5'-3' exonuclease activity; Biological process=DNA recombination
  Homolog annotation: Hit_ID=Q7CGT9; Match level="QueryCoverage=98%, HitCoverage=48%, E-value=1e-128, Identity=77%"; Hit description =SsDNA exonuclease
  Pfam annotation: Domain name=DHHA1; Domain location=83-152; Score =69.7; E_value=9.4e-18; Accession=PF02272.9; Description=DHHA1 domain
MSVGVALLLTEDIAQARMLASELDALNQTRKEIEQGMKSEALALCDELERQHRDLPLGLAFYHPEWHQGVVGILASRLKERFHRPVIAFAPAGDGTLKGSGRSIAGLHLRDALERIDTLYPGLIIKFGGHAMAAGLSLEEAKYDEFRQRFAALIDEWLEGEALQGVMWSDGELHAQEFTLHTAEMLREAGPWGQAFPEPVFDGQFKLLQQRLVGERHLKVMVEPLGGGPLLDGIAFNVDTSLWPDSSVRQVQLAYKLDINEYRGNRSVQLIIDHIWPQS

SEQ ID NO: 142787 - protein, 140 aa, Glycine max
  Coding DNA Sequence Number=SeqID_26009
MATMIEAMMSIKEIMEVSAAYRTRARARVMGEVEEKMATRMEAMMSMKKITEANVVRIAATSAVAKVNPMPPSGLNQMNHPTPYMVDKDLGSTSGPHYVQIQNKHAFTPYGLPSNYTPPNVAYTPNENVNNSTPILIDSQ

SEQ ID NO: 142788 - protein, 71 aa, Glycine max
  Coding DNA Sequence Number=SeqID_26010
MATPRTFPPLESAPVSLALARPRRARCDSWRLHWGLFFSPTGLSEKGPYTWVHGNLRSGGESIIMLGLRLA

SEQ ID NO: 142789 - protein, 155 aa, Glycine max
  Coding DNA Sequence Number=SeqID_26011
  Gene Ontology: Mol. function=chitin binding; Cellular component =extracellular region; Biological process=chitin metabolic process
  Homolog annotation: Hit_ID=Q86AI8; Match level="QueryCoverage=92%, HitCoverage=31%, E-value=1e-13, Identity=35%"; Hit description =Similar to Homo sapiens (Human). Mucin 2
VDPWVLVPITFRGLHVLTIKGLHALTSRGLHVLALRGLHVLSTRGLHALTSRGLHVLALRGLHALTLGTSYPHQGLPVLALRGLHALTLGTSYPHQGLHVLAIRGLHALTSRGLPVLALRGLHALTLGTSYPHQGLHVLALRGLHALTLGTSYPH

SEQ ID NO: 142790 - protein, 151 aa, Glycine max
  Coding DNA Sequence Number=SeqID_26012
VLKCRLLTTGSDEGIRKTAWIGERREKGESAHDAWKVGEESDSKPSAIDHAHQMQTWLLLALARPSTASTADAADLDLDVPSIAKEVAELVLWDLDSDFPYSSLNPIGNPSLSAPEPNESVWYAEASPSPEAEVERKEVACAWRALSSEAD

SEQ ID NO: 142791 - protein, 221 aa, Glycine max
  Coding DNA Sequence Number=SeqID_26013
MNILTAHDQEWEQELSSYDQYEEERTPNLETVFEEFMAYHASSKANQSSMKNHEIHFGKSYSIENFHAGPKLQPYYQNEAERGSNMDKLLMKFMETTKSTQQALQSVEIQVGELAEAVTQFMSRREKSFVEAEAQEKSPIKEHESREKDEEKDEEQTQQQWEKYSTVENQQGNILQSNNLPHQLIDKKGRQGEHEETLSAIISLITNTFLEMNWNVLPDYM

SEQ ID NO: 142792 - protein, 117 aa, Glycine max
  Coding DNA Sequence Number=SeqID_26014
MVSPPSPHSSCESTEPNQEDNNNNNNEDDNNNNNGGDDNNHNNNDDDNNNNNIIIINNNNNNNNNNNNNGDNNNNNNGDNNNNHHHPEAPSLVLVGFPHCLMYLRITSCAQNAKALI

SEQ ID NO: 142793 - protein, 151 aa, Glycine max
  Coding DNA Sequence Number=SeqID_26015
MFIYQHFHSVGNGTFKTGSIFNLSGSDSFYWVYDCGSTRKTSLKHKIQNMSTHPCFPSNIDMLVLSHFDEDHVNGVEDLLRHCHVKSLVLPFSEWTQSVREISVLGKKGTSPSTALLQLNPLQWLATREFDVQVDEVVLIQGGSDRPPNAL

SEQ ID NO: 142794 - protein, 78 aa, Glycine max
  Coding DNA Sequence Number=SeqID_26016
MDHPGEPPNNSLSLGFYLFLFYILSNSLGERKGLLIEPFTGGDAQGAIKLVTRPRKLISGRNMSRSLDFAVYNYESLP

SEQ ID NO: 142795 - protein, 76 aa, Glycine max
  Coding DNA Sequence Number=SeqID_26017
WATGDGVLMPGLVEMGCLLCAIARSPPSTTYDGVVPQDMSRGSGDLGDVRWGAIAQNQAWPISTQPGHSKPVRTCD

SEQ ID NO: 142796 - protein, 95 aa, Glycine max
  Coding DNA Sequence Number=SeqID_26018
  Gene Ontology: Mol. function=drug transporter activity; Cellular component=membrane; Biological process=multidrug transport
  Homolog annotation: Hit_ID=Q8LF49; Match level="QueryCoverage=88%, HitCoverage=18%, E-value=2e-18, Identity=52%"; Hit description =Putative integral membrane protein
VARGCGWQKLGAYVNLGSYYFLGVPFSVVSAFVFHMKGQGLFLGILIALTVQVVCFLLVTLRANWEKEAKKAAKRVGGDGVQLGDLPCDQNANTA

SEQ ID NO: 142797 - protein, 238 aa, Glycine max
  Coding DNA Sequence Number=SeqID_26019
  Gene Ontology: Cellular component=integral to membrane
  Homolog annotation: Hit_ID=Q8L4G8; Match level="QueryCoverage=80%, HitCoverage=35%, E-value=3e-22, Identity=38%"; Hit description=C4 -dicarboxylate transporter-like protein
  Pfam annotation: Domain name=C4dic_mal_tran; Domain location=52-222; Score=-63.9; E_value=0.0016; Accession=PF03595.8; Description=C4 -dicarboxylate transportermalic acid transport protein
MATQALRPEIELVVDDTTTSNVISHSNHEPTSLMVAKRSLTSLNSILTKFHAGYFRISLSLGGQALWWKTLIESPTHDVTSALRRLLCTLPSSAFLALWMVKADFLHPVRVNYLFAPWISWLLLLQSAPFVAPKTPTYLVMWWFTKVKRLFIDGSKPDEPDVGDRELGRGTSCGEYGLERESGLLVFAGDGALLGAVCYPLSAFRWRSPSGVVEAGFLLVLCSTECGKLGFRIHGWHL

SEQ ID NO: 142798 - protein, 54 aa, Glycine max
  Coding DNA Sequence Number=SeqID_26020
MSLMFVGHLDELLLAGASLATSFVNVTGFNVLLKYPEELILHFVVKLCFHKFLV

SEQ ID NO: 142799 - protein, 261 aa, Glycine max
  Coding DNA Sequence Number=SeqID_26021
  Homolog annotation: Hit_ID=Q9XGX0; Match level="QueryCoverage=74%, HitCoverage=55%, E-value=9e-43, Identity=49%"; Hit description =Putative zinc finger protein SHI
  Pfam annotation: Domain name=DUF702; Domain location=99-243; Score =299.2; E_value=7.7e-87; Accession=PF05142.3; Description=Domain of unknown function (DUF702)
MAGFFSLGGSQNKEEEEVEKGGDKNNLLLLRNEEIYNSKGGFEIWPQSSSSYHQHQNQAYQNYFAFGVGPSRRNRSEDVSLCVSDHESTRFGLTVMRSGVSSSMSMNCQDCGNQAKKDCSHLRCRTCCKSRGFQCQTHVKSTWVPAAKRRERHQQLAALQQQHQHPKRHHRDTTTTQLASAPQPIIGLELGQFPPEVSTSAVFRCVRVSAVDASDEQCAYQTSVNIGGHVFKGFLYDQGPESSYTTSAAAEGSSGGEPQPL

SEQ ID NO: 142800 - protein, 169 aa, Glycine max
  Coding DNA Sequence Number=SeqID_26022
  Gene Ontology: Mol. function=hydrolase activity; Cellular component =membrane; Biological process=proton transport
  Homolog annotation: Hit_ID=Q9SVI5; Match level="QueryCoverage=98%, HitCoverage=20%, E-value=1e-27, Identity=41%"; Hit description =Putative proton pump
MARRLRLFKEQMTKAGVSPSTWSTRDNHFDLEHLEVKLEELEAELLEINANNEKLQHTYNELLEYKLVLEKVGEFFSSAKNKAVAQQKELEFQTTVEGSIDSPLLLEQEETTTKQIKLRFISGLVHREKSIPFERIIFRATRGNVFLKQAVIQHPVLDPLSGEKVILNS

SEQ ID NO: 142801 - protein, 46 aa, Glycine max
  Coding DNA Sequence Number=SeqID_26023
MASNRSSSWARGEGEGSRKRDYVRVWVWCGVYLCVRTGNAKSLTSY

SEQ ID NO: 142802 - protein, 99 aa, Glycine max
  Coding DNA Sequence Number=SeqID_26024
  Subcellular localization annotation: CTP_CleavageSite=92; ConfidenceScore=5.33e-01
MGKWLTTESSGRPVRGSSGSSGRTFSGRSVLPEVTKRLSEEHFFRKTSGKRLPGTFRKKWFIRKNSGRRPLPEEVSNFRKTFPEEPFFRSVSGRTTSSG

SEQ ID NO: 142803 - protein, 342 aa, Glycine max
  Coding DNA Sequence Number=SeqID_26025
  Gene Ontology: Mol. function=tRNA (guanine-N2-)-methyltransferase activity; Cellular component=mitochondrion; Biological process=tRNA processing
  Homolog annotation: Hit_ID=Q8RXS4; Match level="QueryCoverage=93%, HitCoverage=44%, E-value=1e-140, Identity=75%"; Hit description =Putative N2,N2-dimethylguanine tRNA methyltransferase
  Pfam annotation: Domain name=TRM; Domain location=1-210; Score=-42.6; E_value=1.6e-10; Accession=PF02005.7; Description=N2,N2 -dimethylguanosine tRNA methyltransferase
MALRIVLACIESHANRYKRYIVPVLSVQMDFYLRVFVRIYTSASAMKNTPLKLSYVYQCTGCDSFHLQPIGRTISKNTSVRYLPGFGPVVPQECRDCGKKFNMGGPIWSAPIHDQEWVAAILADVKSMKDRYPAYDRISAVLTTISEELPDVPLFLSLHNLCATLKCTSPSAIIFRSAVINAGYRISGTHVNPLGLKSDAPMDVIWDIMRCWVKNHPVKPQPADQPGSIILAKEPVLQGFWAMMIAMNLDMILVQILAFGLAYDKANFARAVASLSKAQAKKVARFLPNPERHWGPKLRAGRQITSKHVSLLGPEAINGALNQEDDEEPKSKKPKTEDSVTS

SEQ ID NO: 142804 - protein, 238 aa, Glycine max
  Coding DNA Sequence Number=SeqID_26026
  Gene Ontology: Mol. function=hydrolase activity; Cellular component =membrane; Biological process=proton transport
  Homolog annotation: Hit_ID=Q1S045; Match level="QueryCoverage=100%, HitCoverage=29%, E-value=2e-92, Identity=69%"; Hit description=V -type ATPase, 116 kDa subunit
MAFGGRYIIMLMALFSIYTGLIYNEFFSVPFELFGPSAYGCRDSSCRDASTTGFIKVRSTYPFGVDPKWHGTRSELPFLNSLKMKMSILLGVSQMNLGIIMSYFNAKYFENNINIWYQFVPQIIFLNSLFGYLSLLIIIKWSTGSQADLYHVMIYMFLSPTDDLGENQLFVGQKLLQLVLLLLALVAVPWMLVPKPFLLKKQHQERHQGQSYDLLYGTDDPLESESQSIPHDEFDFSE

SEQ ID NO: 142805 - protein, 102 aa, Glycine max
  Coding DNA Sequence Number=SeqID_26027
  Gene Ontology: Mol. function=hydrolase activity; Cellular component =membrane; Biological process=proton transport
  Homolog annotation: Hit_ID=Q1S045; Match level="QueryCoverage=91%, HitCoverage=11%, E-value=8e-37, Identity=76%"; Hit description=V -type ATPase, 116 kDa subunit
MARSQICGRVHTHTLAHSELSSVFYDKVLLLAWGYNSTIVLIVGIFVFICATVGVLLLMESLSAFLHALRLHWVEYQNKFYEGDGYKFFPFSFTLLTDEDEL

SEQ ID NO: 142806 - protein, 395 aa, Glycine max
  Coding DNA Sequence Number=SeqID_26028
  Gene Ontology: Mol. function=cysteine-type endopeptidase activity; Cellular component=lysosome; Biological process=proteolysis
  Homolog annotation: Hit_ID=O24322; Match level="QueryCoverage=82%, HitCoverage=90%, E-value=1e-149, Identity=76%"; Hit description =Cysteine proteinase precursor
  Pfam annotation: Domain name=Inhibitor_I29; Domain location=51-107; Score=94.6; E_value=2.9e-25; Accession=PF08246.2; Description =Cathepsin propeptide inhibitor domain (
  Pfam annotation: Domain name=Peptidase_C1; Domain location=134-347; Score=348.5; E_value=1.1e-101; Accession=PF00112.13; Description =Papain family cysteine protease
  Pfam module annotation: Pfam domain module=Inhibitor_I29::Peptidase _C1; Domain location=51-107::134-347
MANPSLLFFSLLLLSATVAAAERIDDEDDLLIRQVVPDAEDHHLLNAEHHFSAFKTKFGKTYATQEEHDHRFRIFKNNLLRAKSHQKLDPSAVHGVTRFSDLTPAEFRRQFLGLKPLRLPSDAQKAPILPTNDLPTDFDWREHGAVTGVKNQGSCGSCWSFSAVGALEGAHFLSTGELVSLSEQQLVDCDHECDPEERGACDSGCNGGLMTTAFEYTLQAGGLMREKDYPYTGRDRGPCKFDKSKVAASVANFSVVSLDEEQIAANLVQNGPLAVFMQTYIGGVSCPYICGKHLDHGVLLVGYGSGAYAPIRFKEKPYWIIKNSWGESWGEEGYYKICRGRNLTLPIPSTTRPLQEKSAKRTVHVHAMPSALGKHLKWLSTRSANGMETSVFHSS

SEQ ID NO: 142807 - protein, 204 aa, Glycine max
  Coding DNA Sequence Number=SeqID_26029
MDALGLLRSVTPKTVESREADAAMMAEDEALEKVDIAVMVAMVEAKQRKMDEENGYSGSISSNLETTKAERSVWLMKCPLVVAKSWQTHPPSQPLAKVVLSLDPLHPEEDDPSAVQTTEENERIVGSILLIERQNPKITGALRERGRGAIEDRCWVIFGPRVIKLGRKPDLRKAEQQLAEKHRAHQASIFNDDTGRSGKNMTWI

SEQ ID NO: 142808 - protein, 45 aa, Glycine max
  Coding DNA Sequence Number=SeqID_26030
MKFPAPAVTRLAVALALSLATPLVAARDVPAGFEDLVEGQTEQLE

SEQ ID NO: 142809 - protein, 329 aa, Glycine max
  Coding DNA Sequence Number=SeqID_26031
  Homolog annotation: Hit_ID=Q48NG2; Match level="QueryCoverage=47%, HitCoverage=94%, E-value=3e-22, Identity=41%"; Hit description =Adhesin major subunit pilin
MRAGAGALRAGGLLLHGNGDDAFVATALGDRRLGGLRDAQRHRDGCARQRAVKQIRSGEILRGHGQRLAVEADGQWYRGAAAIGIEQLRGAADAHFDVLVFVVGVDAHLLGPRHQAGDRVVDHVDHRIQRGAIGLEQGQGRVDVGPDLDVGVERGEFESPPPQGEREGGADRGGGHGRRENGRIMQISSRLECKKPHCVAFVASSDTRLSLEAHRVRMSRARLDATCRNRERPSTRGHHGDVLHVDVGGLEAVRIHLTVQLHQGGRADSLVAGQILVVDFHIDLAGGVLEAVALMADPGHQCAPQHHRVVVTLGARLGYRGDGTGGARA

SEQ ID NO: 142810 - protein, 108 aa, Glycine max
  Coding DNA Sequence Number=SeqID_26032
HLTETSVRAGNSDVYGFLEPQSIQRSRQSQFESESYIKSWIQSSKRDVYLGAYLNGALNGLDDTPQPKSKVAARWIVIKCNRQKGITECGYYLMHWMSTIILGSFRNN

SEQ ID NO: 142811 - protein, 157 aa, Glycine max
  Coding DNA Sequence Number=SeqID_26033
  Gene Ontology: Mol. function=alpha,alpha-trehalose-phosphate synthase (UDP-forming) activity; Cellular component=cytosol; Biological process=trehalose biosynthetic process
  Homolog annotation: Hit_ID=P0A1Q0; Match level="QueryCoverage=68%, HitCoverage=22%, E-value=1e-44, Identity=84%"; Hit description=Alpha, alpha-trehalose-phosphate synthase [UDP-forming]
MKVFRYSDVGLVTPLRDGMNLVAKEFVAAQDPENPGVLVLSQFAGAANELTSALIVNPYDRDEVAAALDRALTMPLAERIIRHGKMLKAIESNDIDNWQAQFVADLKRALVVVAADDQVDVMLKAKILHVVAKFAAGDGHFADRVVRLGGEFIKKTT

SEQ ID NO: 142812 - protein, 393 aa, Glycine max
  Coding DNA Sequence Number=SeqID_26034
  Gene Ontology: Mol. function=GPI anchor binding; Cellular component =anchored to membrane; Biological process=root hair cell differentiation
  Homolog annotation: Hit_ID=Q69F98; Match level="QueryCoverage=94%, HitCoverage=82%, E-value=0.0, Identity=84%"; Hit description =Phytochelatin synthetase-like protein
  Pfam annotation: Domain name=Phytochel_synth; Domain location=1-159; Score=343.2; E_value=4.2e-100; Accession=PF04833.5; Description =Phytochelatin synthetase-like conserv
MNNFQQYRHISEPGWSLGWTWAKKEVIWSMVGGQTTEQGDCSKYKGNIPHCCKKNPVVVDLLPGTPYNQQIANCCKGGVLSSWAQDQSKAVSAFQVSVGSAGTTNKTVKLPKDFTLKAPGPGYTCGPATIVKPTLFIQPDKRRVTQALMTWNVTCTYSQFLAQRTPSCCVSLSSFYNDTVVPCTTCACGCQGNSSQLGECVDPDSSPHLQSVVSNPGPGKSSITPLVRCTRHMCPIRVHWHVKLNYKEYWRVKVTVTNFNYGMNYSNWNLVVQHPNFDNLTQLFSFNYKSITPYGSINDTAMLWGVKFYNDFLMQAGPLGNVQSELLFRKDKSTFTFDKGWAFPRRVYFNGDVCVMPPPDSYPWLPNAGSKQEVSLLALVMSSLVALVLYAYA

SEQ ID NO: 142813 - protein, 248 aa, Glycine max
  Coding DNA Sequence Number=SeqID_26035
  Gene Ontology: Mol. function=RNA polymerase II transcription factor activity; Cellular component=transcription factor TFIIF complex; Biological process=transcription initiation from RNA polymerase II promoter
  Homolog annotation: Hit_ID=Q5N8X8; Match level="QueryCoverage=65%, HitCoverage=58%, E-value=1e-61, Identity=69%"; Hit description =Putative transcription initiation factor IIF beta subunit
  Pfam annotation: Domain name=TFIIF_beta; Domain location=12-248; Score=5.1; E_value=2.7e-10; Accession=PF02270.6; Description =Transcription initiation factor IIF, beta subunit
MGMCTGTKFGYHVDLVIGESHGLGTETRIKISSHMGMGIIFPIPIFRAILIGRTAYETSYIDFEKLFSVVNMMFMLRWDAGKTSKSKMEGGKVAMEGKVEHKFDMKPHGENIEEYGKLCRERTNKSMIKNRQIQVIDNDRGVLMRPMPGMIGLVSSNSKDKKKTQPVKQSDTKRTRRDRGELEDIMFKLFERQPNWALKQLVQETDQPAQFLKEILNELCVYNKRGANQGTYELKPEYKKSVEDTSAE

SEQ ID NO: 142814 - protein, 187 aa, Glycine max
  Coding DNA Sequence Number=SeqID_26036
  Gene Ontology: Mol. function=binding; Cellular component =mitochondrial inner membrane; Biological process=transport
  Homolog annotation: Hit_ID=Q69FA0; Match level="QueryCoverage=96%, HitCoverage=48%, E-value=2e-51, Identity=59%"; Hit description =Mitochondrial carrier protein
  Pfam annotation: Domain name=Mito_carr; Domain location=1-63; Score =20.5; E_value=4.6e-05; Accession=PF00153.17; Description =Mitochondrial carrier protein
  Pfam annotation: Domain name=Mito_carr; Domain location=77-166; Score= 79.1; E_value=1.4e-20; Accession=PF00153.17; Description =Mitochondrial carrier protein
  Pfam module annotation: Pfam domain module=Mito_carr::Mito_carr; Domain location=1-63::77-166
MVQGLSGHAQYSGGLDVARKVLRSDGIRGLYRGFGLSVMTYVPSNVVWWASYGSSQRYLWRFLGDNSEEYTPSLPKIIFAQATGGIIAGATASCITNPLDTIKTRLQVLGLEKKIPVKQVVKDLIAEDGWKGVYRGLGPRLFSTSAWGTSMILAYEYLSKNLLSDFIVLIILFVYTGLVYLNIEITM

SEQ ID NO: 142815 - protein, 93 aa, Glycine max
  Coding DNA Sequence Number=SeqID_26037
  Gene Ontology: Mol. function=oxidoreductase activity
MISDLTGQDHKDFSYNVIKDVQVMSSFIGEWGDVVITLKDGTKVDLRSVPKFREIAKYCLTMTQNSLGGGCLVAVRGVYSCVGSVQRCEGNNK

SEQ ID NO: 142816 - protein, 58 aa, Glycine max
  Coding DNA Sequence Number=SeqID_26038
MVRFGGKGFSVQIDTEGEESNTMISIPAVIITKDCMVKKIMGLVHTQLNCKFLCGGAI

SEQ ID NO: 142817 - protein, 443 aa, Glycine max
  Coding DNA Sequence Number=SeqID_26039
  Gene Ontology: Mol. function=hydrolase activity, acting on glycosyl bonds; Cellular component=beta-galactosidase complex; Biological process=carbohydrate metabolic process
  Homolog annotation: Hit_ID=Q9ZRV9; Match level="QueryCoverage=97%, HitCoverage=58%, E-value=0.0, Identity=75%"; Hit description=Beta -galactosidase
  Pfam annotation: Domain name=Glyco_hydro_2_N; Domain location=137 -272; Score=-41.1; E_value=0.0023; Accession=PF02837.8; Description =Glycosyl hydrolases family 2, sugar binding domain
MCFNEKCQYHGGTNFGRSAGGPFITTSYDYDAPIDEYGLIRQPKYSHLKELHKAIKRCEHALAHVFSTGTGTCAAFLANYNAQSAATVTFDSKHYDLPPWSISILPDCKTDVFNTAKVRVQSSLVKMLPVKKKFSWESYNEDLSSLAENSRITAPGLLEQLDVTRDTSDYLWYITSIGISSSESFFRGGQKPSINVKSAGHAVRVFVNGQFSGSAFGTREQRNCTFNGPVDLRAGTNKIALLSVAVGLQNVGRHYETWEAGITGPVLIHGLDQGQKDLTWNKWSYKVGLRGEAMNLVSPNGVSSVDWVQESLATQSRSQLKWNKAREQLLAYIACFNAPEGNEPLALDMASMGKGQVWINGRSIGRYWLAYAKGDCNSCTYSGTFRPVKCQLGCGQPTQRWYHVPRSWLKPTKNLIVVFEELGGNPWKISLVKRVAHTPAVHG

SEQ ID NO: 142818 - protein, 340 aa, Glycine max
  Coding DNA Sequence Number=SeqID_26040
  Gene Ontology: Mol. function=transcription factor activity; Cellular component=nucleus; Biological process=regulation of transcription, DNA-dependent
  Homolog annotation: Hit_ID=Q9LQZ2; Match level="QueryCoverage=68%, HitCoverage=91%, E-value=7e-32, Identity=38%"; Hit description =Dehydration-responsive element-binding protein 2D
  Pfam annotation: Domain name=AP2; Domain location=37-101; Score =116.9; E_value=5.7e-32; Accession=PF00847.10; Description=AP2 domain
MLKSGMGIEERKQVKKPAQASSRKGCMRGKGGPENASCTYKGVRQRTWGKWVAEIREPNRGARLWLGTFETSHEAALAYDAAARKLYGSDAKLNLPELSIKSQSQCPPPPSSVSNNTQIPQMENLQQQIQNNYMDMATCSNNFNNNTNNPSEVSMASQQVGVGVPIYTSDSIVSLPLDTNPKPVENDGDFRPSWGTMNEGLPVFDDSIWAEAAMSLDFPQIAAETAIYSSGNNLADVGVWDSLQTPWCINLLSLHCWEPEVFAALLNQPHAVPSSLGATKLGPSLKTRGSTPNLERAGPQIAATVQPSKPESCSITLKPPLGSQAGVTQLGKQKYFPQGL

SEQ ID NO: 142819 - protein, 253 aa, Glycine max
  Coding DNA Sequence Number=SeqID_26041
  Gene Ontology: Mol. function=protein binding; Cellular component =nucleus
  Homolog annotation: Hit_ID=UPI0000519FFE; Match level="QueryCoverage =47%, HitCoverage=51%, E-value=2e-13, Identity=39%"; Hit description =PREDICTED: similar to BWK-1 isoform 2
MLRYLLGFSLHFNISSPAVCRAEPQRSWEMLLTPEKFIAFLLDPIISCEDFLDDKFHLSLGIFHFALEGNALKAIELTEQLAKDILENNKDLQFDLLSLHFVELVCSRKCTEALEFAQTKLGPFGKEPKYMEKLEDFMALLAYKEPEKSPMFHLLSLEYRQQVADSLNRAILGCTLESSQLHSNGEANTAGYSCKTMLKSRSWQGCTSTIFLKGFSQKLMENSKKWRVNWGMKLVVYLELSCLIGLVYGFIMV

SEQ ID NO: 142820 - protein, 972 aa, Glycine max
  Coding DNA Sequence Number=SeqID_26042
  Gene Ontology: Mol. function=acid phosphatase activity; Cellular component=extracellular space; Biological process=biological_process
  Homolog annotation: Hit_ID=Q9SDZ9; Match level="QueryCoverage=94%, HitCoverage=94%, E-value=0.0, Identity=74%"; Hit description=Purple acid phosphatase precursor
  Pfam annotation: Domain name=Metallophos; Domain location=617-816; Score=85.6; E_value=1.5e-22; Accession=PF00149.18; Description =Calcineurin-like phosphoesterase
  Pfam annotation: Domain name=Metallophos; Domain location=92-299; Score=35.7; E_value=1.6e-07; Accession=PF00149.18; Description =Calcineurin-like phosphoesterase
  Pfam module annotation: Pfam domain module=Metallophos::Metallophos; Domain location=617-816::92-299
MDEKTTTFVRDDSLSVDMPIDSDVFRVPPGYNAPQQVHITQGDHVGKGVIISWITPHEPGSSTVKYWAENSEFELKAHGFYLAYKYFNYTSGYIHHCTIHNLEFDTKYYYEVGIGNTTRQFWFKTPPPVGPNVPYTFGLIDDFPYHDNTKWDTWGRFTERIAAYQPWIWTAGNHEIDFAPELGETRPFKPYTCRYHLPYTASNSTSPLWYSIKRASTYIIVLSSYSAFGKYTPQYKWLVKELPKVNRTETPWLIVLMHSPMYNSYVNHYMEGETVRVLYEKWFVEYKVDVVFAGHVHAYERSKRVSNIAYSIVNGLHNPINDQSAPVYITIGDGGNIEGLATAMTEPQPSYSAYREASFGHGILDIKNRTHAYFSWNRNQDGPQFAELGYASLSSKWGHQSDGTVFGLAGAQREAGLTEQRIPQASNSGGITGCCNSSPQWPATGIRINREEMGLNWHRWVVSAFLLVAWALILDTGEICFCMGGKTSDFLRNDYLSLDMPIDSDTFRVPPGYNAPQQVHITQGDHVGKGVIISWISPHEPGSSTVIYWAENSEFKWQAHGFFLTYKYFNYTSGYIHHCTVHNLEFDTKYYYEVGIGNTTRQFWFKTPPPVGPDVPYTFGLIGDLGQTYNSNRTLTHYEQSPAKGQTILYVGDLSYADDYPLHDNIRWDTWGRFTERIAAYQPWIWTAGNHEIDFAPQLGETRPFKPYTARYHVPYKASDSTSPLWYSIKRASAYIIVMSSYSALGKYTPQYKWLEKELPKVNRTETPWLIVLMHSPIYNSYVTHYMEGETVRVMYEKWFVEYKVDVVFAGHVHAYERSERVSNIAYNVVNGLCRPINDQSAPVYITIGDGGNLEGLATAMTEPQPSYSAYREASFGHGILDIKNRTHAHFSWNRNQDGYAVVADSVWLHNRYWNHPEQTSLAAFRILNMMVMIFPIPSIAYEPRGEVGDNEGTLPTKVSNNEEERVNLVVN

SEQ ID NO: 142821 - protein, 274 aa, Glycine max
  Coding DNA Sequence Number=SeqID_26043
  Gene Ontology: Mol. function=molecular_function; Cellular component =membrane; Biological process=auxin mediated signaling pathway
  Homolog annotation: Hit_ID=Q94AP3; Match level="QueryCoverage=91%, HitCoverage=66%, E-value=3e-93, Identity=68%"; Hit description =Putative nodulin protein
  Pfam annotation: Domain name=DUF6; Domain location=99-228; Score =59.7; E_value=9.6e-15; Accession=PF00892.11; Description=Integral membrane protein DUF6
  Pfam annotation: Domain name=TPT; Domain location=90-228; Score= -32.1; E_value=0.042; Accession=PF03151.7; Description=Triose -phosphate Transporter family
  Pfam module annotation: Pfam domain module=DUF6::TPT; Domain location= 99-228::90-228
KERPAITLNFLLQFFLLALVGIEQVRLNRKDGISKVAGTIFCVAGATVITLYKGPTIYSPTPPLHSERPAVVDFGTLSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASIALGEEFYLGGIIGAVLIVVGLYFVLWGKSEERKFAKEHAAITSTPEHSGIRSSSHAKTSLTQPLLPSSTENV

SEQ ID NO: 142822 - protein, 107 aa, Glycine max
  Coding DNA Sequence Number=SeqID_26044
  Subcellular localization annotation: CTP_CleavageSite=16; ConfidenceScore=5.08e-01
MVQGNGLTRPLWTAVAAACYPSTVGSLRPAECSQSPTQQARRLFHHSDAPTWMTSWRNPARQTVVLFQEHHQDHIENPAYAVMLIASYKDCAWKFAEQKQLMTESLR

SEQ ID NO: 142823 - protein, 104 aa, Glycine max
  Coding DNA Sequence Number=SeqID_26045
MVRQWLWRTLVRNLVVANLEPSQTKTMMKLNLPNRKNNVVVLLQPTSIPFKLQIHLLLEVVKLIENWTWPTTPSWGADLEATHGALGRQQQQWQQQPHHAKLGV

SEQ ID NO: 142824 - protein, 262 aa, Glycine max
  Coding DNA Sequence Number=SeqID_26046
  Homolog annotation: Hit_ID=UPI0000660FEE; Match level="QueryCoverage =16%, HitCoverage=30%, E-value=1e-09, Identity=56%"; Hit description =UPI0000660FEE related cluster
MSSSGAKRSGPPKHQNKKLEEDSDPSLRSLGCALVARIKSNGNDVMESTSLFFNQPNVRDVPSVLYVKLTIACVLGFGKWVVLKLVQCGKKNRFLECGGGKRKRVVPRSMVDISEVEAEQKMLEEAIKNSRERERRSLLRAMNKDKTKSSNSVPTDTKGNKVGQLFPNASLEDYAILNRVNVEHDDGAICNDKYVDNEGEVCEDEDNSDDEDNSDNEDCDEDGNSENEDCDDEDGNNENEDCDENDDKNDENIPDHTNAKNE

SEQ ID NO: 142825 - protein, 91 aa, Glycine max
  Coding DNA Sequence Number=SeqID_26047
MEVSLACQHPCHCFDHHFDHRFGDIDVIKELLILILTLQSALFSPIAITIGERQKRKAKGSEILFLSSFKEIKVHWREVPEEKGTSLPMEK

SEQ ID NO: 142826 - protein, 46 aa, Glycine max
  Coding DNA Sequence Number=SeqID_26048
MAMGEKRALSGQEGDLISRSSMLICGWKAAVRAIKNSFRSLSREIL

SEQ ID NO: 142827 - protein, 78 aa, Glycine max
  Coding DNA Sequence Number=SeqID_26049
  Gene Ontology: Mol. function=hydrolase activity, acting on glycosyl bonds; Cellular component=beta-galactosidase complex; Biological process=carbohydrate metabolic process
  Homolog annotation: Hit_ID=Q94B17; Match level="QueryCoverage=99%, HitCoverage=8%, E-value=2e-26, Identity=90%"; Hit description =Putative beta-galactosidase BG1
MVRGESSSRAPFTIPEAPLSFVLFCLLQMWEDLIRKAKHGGLDVIDTYVFWDVHEPSPGNYNFEGRYDLARFIKTVQK

SEQ ID NO: 142828 - protein, 85 aa, Glycine max
  Coding DNA Sequence Number=SeqID_26050
  Gene Ontology: Mol. function=carbohydrate binding; Cellular component= 6-phosphofructo-2-kinase/fructose-2,6-biphosphatase 1 complex; Biological process=fructose 2,6-bisphosphate metabolic process
  Homolog annotation: Hit_ID=Q93XR7; Match level="QueryCoverage=93%, HitCoverage=10%, E-value=4e-33, Identity=83%"; Hit description =Fructose-6-phosphate 2-kinase/fructose-2,6-bisphosphatase
MQHRNIVSEAGELYSKKLAKFVGKRLKSEWAASIWTSTLQRTILTATPIIGFPKIQWRALDEINAGVCDGMAYAEIKKNMPEEYE

SEQ ID NO: 142829 - protein, 69 aa, Glycine max
  Coding DNA Sequence Number=SeqID_26051
MGKKKLELGFKDQKIDFDLFVEDKPAPEQNVCLQVMEVDELAKRTYRAKQVHLVRMNTYPLAEMLVAKQ

SEQ ID NO: 142830 - protein, 105 aa, Glycine max
  Coding DNA Sequence Number=SeqID_26052
  Subcellular localization annotation: CTP_CleavageSite=51; ConfidenceScore=5.04e-01
MGIAPTKTPSGPEEVQQGPRVSSSGSACRPQQGHQVPPTNRAFIKKFCVSRQAQGETPQQPGDGRQRAIDAPPSPLEFTSAHPQKGLSIAYTTWPNNRRPSPKPK

SEQ ID NO: 142831 - protein, 66 aa, Glycine max
  Coding DNA Sequence Number=SeqID_26053
MDFEICPIMQKNAVELCNKFLMCAEKCLCIAGYGKEFFASALFSWFRIVSWYLELNCLDIVEAWRD

SEQ ID NO: 142832 - protein, 119 aa, Glycine max
  Coding DNA Sequence Number=SeqID_26054
MTKLGLCLSSGPPALDDKGVRITVRMTKLGLCLSSGPPPLDDKRVRITIRMTKLGLCLSSGPPLLDDKRVRINHKVSPRATQLLESWRQKAVWFDKKRGSCSYVSSNEEFQTSVVLDNL

SEQ ID NO: 142833 - protein, 108 aa, Glycine max
  Coding DNA Sequence Number=SeqID_26055
MKNDEEQRRTSTESLMETSRKRYRSTLAWIFFLLPLVLTNFKTLWIPWGRVSSVWKWSNEVRILANDGSWMKLGYDSCPLSYPNFVRGPLLDDMRPFFGPCEVLGTHH

SEQ ID NO: 142834 - protein, 197 aa, Glycine max
  Coding DNA Sequence Number=SeqID_26056
  Gene Ontology: Mol. function=structural constituent of cell wall; Biological process=cellulose and pectin-containing cell wall organization and biogenesis
  Homolog annotation: Hit_ID=UPI000065F7CF; Match level="QueryCoverage =79%, HitCoverage=20%, E-value=6e-09, Identity=31%"; Hit description =Homolog of Homo sapiens "Leucine-rich repeats and IQ motif containing 1
RGLHAIAIRGLHVLALRGLHVLTIRGLHALTIRGLRVLALRGLHALTLVTLTVERTTRPRLERTTRPHHQRAARPHLQRTTCPRLERATRPHLGGLHILANRGLHALTFRGPHVLALRGLHALTLGLHALTSRGLHVLALRGLHALTLGTSYPHRQRTTRPRLERTTRPHHQRAARPHLQRTISPRLERATRPHLGY

SEQ ID NO: 142835 - protein, 149 aa, Glycine max
  Coding DNA Sequence Number=SeqID_26057
ETTLVSACYQAFRLTDSKKVYTDNHSGISARQRDSKVSMTDLVSAEDDAFRLTDCKKVYTDNHSGISARQRDSKVSMTDLVSAEDDAFRLTDSKKVYTDNHSGISARQRDSKVSMTDLVSAEDDAFRLTDCKKVYTDNHSGIAARQRDS

SEQ ID NO: 142836 - protein, 52 aa, Glycine max
  Coding DNA Sequence Number=SeqID_26058
MKKKKVEAAGVLLSEAYALSDSLNESFVSSHAQRAQLAKRKSTNSRLAGKWR

SEQ ID NO: 142837 - protein, 46 aa, Glycine max
  Coding DNA Sequence Number=SeqID_26059
MAMSAASERESQALQDSLPPMLPLPQGEEQRCSRHYDDSADRGKVT

SEQ ID NO: 142838 - protein, 131 aa, Glycine max
  Coding DNA Sequence Number=SeqID_26060
MAIGEVVEVDDEMDELHRLDRARILVKTPWQPLIQHKVSAWINGDANGDRRYNARTDPLAEEDIPPSTDGDEQSQRNTEERQTEGQNRHKEPQVNNQESLTRAQEWVTFDTCSGQKQVDRSNHRPDKSEQT

SEQ ID NO: 142839 - protein, 127 aa, Glycine max
  Coding DNA Sequence Number=SeqID_26061
MAMGVKPSEAINNGLRNNALLDFWNVAELYGLRNNTLFDFQNVVRLYGLHNDGDGVAFEGALDDDWKFDFSVHNARLLVCTNQAGITRRLLAGLLAIESHILHYLIVRILLPRSLNLAQVSEEDLIV

SEQ ID NO: 142840 - protein, 156 aa, Glycine max
  Coding DNA Sequence Number=SeqID_26062
  Homolog annotation: Hit_ID=Q2S7D9; Match level="QueryCoverage=52%, HitCoverage=22%, E-value=1e-07, Identity=38%"; Hit description =Predicted membrane protein
MRYFNWIGRNTLQIYVIHRIFIEFFGMSAILFAQRHHLFEQAWFALLWACFYPLAIVGICSLCSVAVWSLTNRGLGQSLFVFPTLIGLKRTPLRPYCNLRCPSPISITPSMAILLYLTNGHQAGVAAGGRGIDAQRALNQQTFQQQIGLAAGKALH

SEQ ID NO: 142841 - protein, 53 aa, Glycine max
  Coding DNA Sequence Number=SeqID_26063
IHDVHSVSAGFMTDTMSLRLCRIPDMHNVSTGFLTDTVSLRLCRILDVHNVFA

SEQ ID NO: 142842 - protein, 444 aa, Glycine max
  Coding DNA Sequence Number=SeqID_26064
  Gene Ontology: Mol. function=nucleic acid binding; Cellular component= chromatin; Biological process=DNA integration
  Homolog annotation: Hit_ID=Q1S7C5; Match level="QueryCoverage=69%, HitCoverage=30%, E-value=1e-100, Identity=53%"; Hit description =Integrase, catalytic region
MISLGRLCCQANITENIDNGGKRLKHAIEINGSSSSSQSDPPVQSDLPQSVSVQSSNPEQTDQPIVSNTVISSNSESSSSSSNSSPLLLLDHPIFTLCKPDLNLSVKQALTDPNCFSAMKQEYEALMNNHTRDLVPLPPNRKAIGFCGFDFSATFSPVVKPVTIRLILTLALTNQWKLTQLDVNNSFLDGLLNETVYMSQPPGFQSSNSSIVCKVNRALYGLKQALQQWFERLQSTLIQFGFVASKCDPSLFIYKTTSHTIYLLVYEDDIIITGSSDQLIQHLTSQLNSKFSLKQLGLLDYFLGIEVKALPDNYLGLCDADWESDIDDRRSTSGAAIYFGPNLISWWSGKQQVVARSTTEAEYISLAQTTAEISWIQTLLTELRVSFSTPIIFCDNQSAVAIAHNPVLHARTKHTEIDVLFVCEKILTKAKLNVLEASSKSQPP

SEQ ID NO: 142843 - protein, 91 aa, Glycine max
  Coding DNA Sequence Number=SeqID_26065
MEDSIGKITKITFPSQEGPLLTVKNTLENGGFNREITKITFPSQEGPLLTVKNTLENGGSNRENNKDHISQSRGSALDVEEHIGEWIQSGK

SEQ ID NO: 142844 - protein, 33 aa, Glycine max
  Coding DNA Sequence Number=SeqID_26066
MKIVLFNSIQDMLDAMGLLLGKMRKFKHMKFEK

SEQ ID NO: 142845 - protein, 61 aa, Glycine max
  Coding DNA Sequence Number=SeqID_26067
MTYLGMDFFNKLLPVEDKMEGDARLTGASFKKGETLRVATNVYSRKTLKKPNWKRSRVCIF

SEQ ID NO: 142846 - protein, 126 aa, Glycine max
  Coding DNA Sequence Number=SeqID_26068
MVIDATVWKVVARLDMGGVHKFEESDDGYSKMQTYRSMLLDPSRNMRNHLGVGGLTTKDKMLVYLITYILTPRSNNHAQIVDFTKASNEITERHLKKLGMRFVKHKWIMVGAPPAAANMDQMEDEA

SEQ ID NO: 142847 - protein, 92 aa, Glycine max
  Coding DNA Sequence Number=SeqID_26069
  Gene Ontology: Mol. function=binding; Biological process=cell division
  Homolog annotation: Hit_ID=Q8LGU6; Match level="QueryCoverage=94%, HitCoverage=13%, E-value=4e-23, Identity=54%"; Hit description =HOBBIT protein
MEKAILEDKKNPIPIIDEALDVLEELKEAQPHESSVYALMGNIYGRRHTHERAMFHYGVALDLKPSVTNAATIKVIVEKLIIPDEFQDKDDC

SEQ ID NO: 142848 - protein, 69 aa, Glycine max
  Coding DNA Sequence Number=SeqID_26070
MYQPIESRLRALFLLPLGGLGLLLSSGGVDSHLQKRDKGFEGGGSKCWSNGGFDEVKTKKCDGLHATDT

SEQ ID NO: 142849 - protein, 751 aa, Glycine max
  Coding DNA Sequence Number=SeqID_26071
  Homolog annotation: Hit_ID=Q1T2S5; Match level="QueryCoverage=38%, HitCoverage=77%, E-value=2e-37, Identity=38%"; Hit description =Cyclin-like F-box; F-box protein interaction domain; Galactose oxidase, central
  Pfam annotation: Domain name=F-box; Domain location=239-286; Score =34.1; E_value=4.9e-07; Accession=PF00646.23; Description=F-box domain
GSSLCEGMGEGCCTQPYPCICKEAVSGFEPMTNNFGLGLDRDLDRGWLGSGPFVVRFLTQTFMTFSYVMCSRSLESGELEFASALHSASSMRDRYYSERAYSQKSNWSRCNCLAWEYPMFFFWQAFRETLPTNSMRFACHLAPNAFCMRCSAHEETMLHAPWDCPHSKEVEEYHRHCVFQSVPTTKVWSPPTNQFVKLNLDESWLPRIDGEGAGRYTRSAAEPFAKRMKKINKKMNKMKRKVTLPFDLIVEILLRLSVRSLLRFKCVSKSWCALISDPEFAKSHIDMAAAPTHRFLFTSSNASELNAIDVEAEEPLCDDSANVVFKVPPSSTFKYYKHSVRVVGSCRGFILLMFTGLDSIGFIVWNPSTGLGKEILHKPMERSCEYLSGFGYDPSTDDYVIVNVILSRRKHPKIECFSLRANSWSCTKSKAPYRENLTFGDGVFLNGALHWLVKPKDKVAVIIAFDVTKRTLLEIPLPHDLAIMLKFNLFRFMVRQGCLVLCSFGWKNTRLMPEMWTMKEYKVQSSWIRSLVPYKNYYNLFDLFLPSLTHSFLSKSHLSFFATSTPPSSSPSTLTLKSSTAFNLPLLATSLDAHDDIVYRYNVHANLIEPNLSLGKGCFEDNVADCAFWGNSLVCITKANQLFYIVDFRNPSAMKLLDPKIEEMPHYTTMIKLQYTLQYTTFMLKLQEDEIVAILTVVEHEENKDELKEANLQRGGIVEEHNGCLMLGWHTKPLISTFVWQLAAKPVMAAH

SEQ ID NO: 142850 - protein, 184 aa, Glycine max
  Coding DNA Sequence Number=SeqID_26072
  Gene Ontology: Mol. function=3-oxoadipate enol-lactonase activity; Biological process=aromatic compound metabolic process
  Homolog annotation: Hit_ID=Q6W256; Match level="QueryCoverage=88%, HitCoverage=60%, E-value=8e-32, Identity=44%"; Hit description=3 -oxoadipate enol-lactonase
  Pfam annotation: Domain name=Abhydrolase_4; Domain location=77-175; Score=-12.1; E_value=0.02; Accession=PF08386.1; Description=TAP-like protein
MGALIASGLAIDYPQRVSHAVVMSGVYRRNEQARRAVLQRARELAAGEAQLDSPLARWFSNDAKEAILREQVGGWLAEVNLQGYAAAYQAFAGGDRVYADRWQEIRCPVLVLTGELDANSSPQMAREMAAAAPLGQAIIIDGARHMVSLTDAPRVNHEMLSFLQCGSARQSNNANTAGLTHANR

SEQ ID NO: 142851 - protein, 54 aa, Glycine max
  Coding DNA Sequence Number=SeqID_26073
MILQIPTVEMCGIESRTTYQNFTTMQRFGGLREKERVLGGEGGKTKMRRRGCEN

SEQ ID NO: 142852 - protein, 80 aa, Glycine max
  Coding DNA Sequence Number=SeqID_26074
MDDGGTDYVKLHAKHSVAITIGTRASCEIKMIMLVSGLEKGDGVMNERVLFVFLDRWDKMSTAPSTRDMWGDAMMPCGSC

SEQ ID NO: 142853 - protein, 256 aa, Glycine max
  Coding DNA Sequence Number=SeqID_26075
  Gene Ontology: Mol. function=mismatched DNA binding; Cellular component=intracellular; Biological process=mismatch repair
  Homolog annotation: Hit_ID=Q1XBQ8; Match level="QueryCoverage=97%, HitCoverage=22%, E-value=1e-125, Identity=89%"; Hit description=DNA mismatch repair protein
MEFCRIKNVLDEILLMNKTSELNDILKHLIDPTWVATGLEIDFETLVAGCEVASTKIGDIISLDGGNDQKINSFSLIPHEFFEDIESKWKGRIKRIHIDDVFTAVEKAAEALHIAVTEDFVPILSRIKATVSPLGGPKGEISYAREHEAVWFKGKRFTPNLWAGSPGEEQIKQLSHALDSKGKKAGEEWFTTLKVEAALTRYHEANGKAKERVLEILRGLAAELQYNINILVFSSTLLVIAKALFAHASDIYFAVH

SEQ ID NO: 142854 - protein, 78 aa, Glycine max
  Coding DNA Sequence Number=SeqID_26076
  Gene Ontology: Mol. function=RNA-directed DNA polymerase activity
  Homolog annotation: Hit_ID=Q1RX17; Match level="QueryCoverage=56%, HitCoverage=20%, E-value=1e-10, Identity=60%"; Hit description=RNA -directed DNA polymerase (EC 2.7.7.49)-fruit fly (Drosophila melanogaster) transposable element BS
MDTYQGKAVGLDDIPVEVWMWMGEQGFIWLPMLFNEILRSKKMPDEWRKSFAGHPQPMQLDEQVLLNVVLAALHAELS

SEQ ID NO: 142855 - protein, 345 aa, Glycine max
  Coding DNA Sequence Number=SeqID_26077
MAPHNMVPTMSYAEAVATRIENTGQRRNTTISLARYGGSHSSVQLKILAGEKKWYTDAWVGRLKKQEIFERVDDEIPWILGSNVVPKYLGDYMVLLLRLLDIKAEEMSNEENNHGSSLFYSLEKWNPAMKPGNRLVWIQCWGIPIVAWDIGHICKIVAAMGDLVEVDDDVEELRRLDRARVLIRTPWRPTIQHSIDVHIDGEIHTVHIVEENSSAEGKCTHQCRSTPGSSEEIVSDDSDTGTPLLRLINFSPRTIASEPNNGIIINENLSLPSGYRDNVDPMGKDRGNLAHCPIHVTCEAEIEMGKEAELESRPLSETSACSGEKETYNVQTKAKHGDKGKKAMR

SEQ ID NO: 142856 - protein, 121 aa, Glycine max
  Coding DNA Sequence Number=SeqID_26078
  Subcellular localization annotation: CTP_CleavageSite=45; ConfidenceScore=5.19e-01
MEHTNLGIPRSCGSACHRALGSRGNTGSNKNRRKSLKVYQSHTVCGEKVTSAQDFVGNQRERTTLGRGLGLTFSPWVKVYDKLGFWLKACRTAGHDICQGLASGSGIKGMSYIISMIHMQQ

SEQ ID NO: 142857 - protein, 204 aa, Glycine max
  Coding DNA Sequence Number=SeqID_26079
  Gene Ontology: Mol. function=RNA-directed DNA polymerase activity; Cellular component=intracellular; Biological process=RNA-dependent DNA replication
  Homolog annotation: Hit_ID=Q1T251; Match level="QueryCoverage=64%, HitCoverage=45%, E-value=5e-17, Identity=36%"; Hit description =Multicopper oxidase, copper-binding site
MAKYPRLYQLSSQQQQLIRHMGSHNNVGWEWNFSWRRPLFDNEVAMAVEFLEETAQLTIHQNRVDLWVQKADPSGNYSTKSTYELLSGATMGENEDGTFVELWKLKIPPKAAIFAWRLIRDRLPTKANLQRRQVEITNTLCPLCNNKEEDAAHLFFNCSKTLPLWWESLSWVNTMDAFPQNVKDHFLQHSSGIADGIKATRWKC

SEQ ID NO: 142858 - protein, 178 aa, Glycine max
  Coding DNA Sequence Number=SeqID_26080
  Subcellular localization annotation: CTP_CleavageSite=31; ConfidenceScore=5.01e-01
MADFHGGFSKKRHRIAVAWRVWDGGAMAVVAVMAGWRKMAFFFCFLSAVGVGLTRLNPTRTTFHLRENPTASLPCTSRVPPAPHTRNEPRHPQPHAHAAATTSGSDTPAQTAVTSSGNDAPVTNGGLQREVLAEKTKLSRRRRRRRFFTFRHEPPSAINNIGLTLPIGYSSNHSIYGQ

SEQ ID NO: 142859 - protein, 164 aa, Glycine max
  Coding DNA Sequence Number=SeqID_26081
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRAVAWLRETTGAVAKASLHRAIVTAYGPEPG

SEQ ID NO: 142860 - protein, 86 aa, Glycine max
  Coding DNA Sequence Number=SeqID_26082
SKAARKEEAEAPEESEEVQALKAELERPRAVKEKFKSMTIKVRKEYDELRDVGHHQSLGMRNQEDPKGRTRSEQVPRSFMGQQQQA

SEQ ID NO: 142861 - protein, 372 aa, Glycine max
  Coding DNA Sequence Number=SeqID_26083
  Gene Ontology: Mol. function=transporter activity; Cellular component= integral to membrane; Biological process=transport
  Homolog annotation: Hit_ID=Q6D6X9; Match level="QueryCoverage=57%, HitCoverage=51%, E-value=9e-86, Identity=72%"; Hit description =Putative transport system membrane protein
  Pfam annotation: Domain name=ABC_tran; Domain location=2-138; Score =66.3; E_value=9.9e-17; Accession=PF00005.17; Description=ABC transporter
  Pfam annotation: Domain name=MFS_1; Domain location=156-369; Score= -14.9; E_value=0.0015; Accession=PF07690.6; Description=Major Facilitator Superfamily
  Pfam annotation: Domain name=PRA1; Domain location=102-273; Score= -50.3; E_value=0.052; Accession=PF03208.9; Description=PRA1 family protein
  Pfam module annotation: Pfam domain module=ABC_tran::MFS_1::PRA1; Domain location=2-138::156-369::102-273
LGRRVAFVEQHGMTDANMRVRDVVKLGRIPHHSPFSNWSAHDDETVTAALQRVDMLEKSEQGWLSLSGGERQRVHIARALAQTPSEILLDEPTNHLDIHHQMQLMQLISELPVTSIVAIHDLNHASMFCDSLIVMQNGQIIATGTPQDILTEALLWQVFRFVFNIGFYAVVPFLAIFLRDDMLLSGGVIGLILGLRTFSQQGMFLLGGALSDRYGAKIIILCGCLVRIAGYLLLALGQSLWPIILGACLTGIGGALFSPSIEALLAKAGTQSEAQGKRGRAEWFALFAVCGELGAVLGPVAGALLTGFGFRQVALAGAAVFVIALIVLYFFLPATGNSKQALKIVPWWMTFRQPRFVAFIVAYSSWLLSYNQ

SEQ ID NO: 142862 - protein, 68 aa, Glycine max
  Coding DNA Sequence Number=SeqID_26084
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=99%, HitCoverage=19%, E-value=4e-29, Identity=93%"; Hit description =Acetyl-coenzyme A carboxylase carboxyl transferase subunit beta
MGSSDRIELSIDSGTWNPMDEDMVSLDPIEFHSEEEPYKDRIDSYQRKTGLTEAVQTVYGGQYGIRSR

SEQ ID NO: 142863 - protein, 117 aa, Glycine max
  Coding DNA Sequence Number=SeqID_26085
MHLKDLLKEGKYPFYFFFFLLPSSLIHLVLSLHSFILMREEVQCVHFDRGASVTVMYGDQWMYDSITSKEVDMNEENEKEPSVNEENGEKASVHQHVDCSNTFNTSKVFATHDDVLH

SEQ ID NO: 142864 - protein, 70 aa, Glycine max
  Coding DNA Sequence Number=SeqID_26086
MTINSWGSGLDVGERTNNANQSIRGAPDSMIRFDGGGCMNNARQSIRGAPDSMVEDARTTLGNQFVGLRT

SEQ ID NO: 142865 - protein, 178 aa, Glycine max
  Coding DNA Sequence Number=SeqID_26087
  Homolog annotation: Hit_ID=Q9AVH2; Match level="QueryCoverage=26%, HitCoverage=16%, E-value=5e-20, Identity=97%"; Hit description =Putative senescence-associated protein
MTEGVGGAGLWPRAKFRIGWPPPPPRDQFCCQDFANFWLAPRWLSLCLGGGSSWEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 142866 - protein, 92 aa, Glycine max
  Coding DNA Sequence Number=SeqID_26088
MFIDGLRPQTKQLFDASLGGKIKLKTHEEATELIENMSASNHAILHDRVHQSTKKSLLELSSHDALLAQNKLLSRQLEILIETLGYRLYHLW

SEQ ID NO: 142867 - protein, 77 aa, Glycine max
  Coding DNA Sequence Number=SeqID_26089
MYNSTSAKNDDRSRSKKEASPNDADRTFPYRHHAYFMMRIMKLAKYRLEAQVEKDEGLSGEGQSPRVEKDEGPSGER

SEQ ID NO: 142868 - protein, 297 aa, Glycine max
  Coding DNA Sequence Number=SeqID_26090
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=2e-41, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLTTSTLTFRRLHALAFRGLHVLAFRGMHALAFRGLHVLPFKGLHVLTFRGLHILTFRELHVLAFKGLHALTIRGLHAITLRGLHALAFRELHVLAFRGYTSSPSEATRLQVLAFRGLHVLSFGGLHALTFRGLHVLAFRGLHVLSFKGLHALIFRGLHALTFRGLQVLAFRELHALAFRGLHTLAFRRLHALTFRGLHALAFRGLHALAFRGLHALAFRGLHVLAFRGLPTLAFRGLHALAFRGLHALAFRGLHAFAFRGLHVLTFRGLHVVAFRGLNVLAFRGLNICAFRELK

SEQ ID NO: 142869 - protein, 172 aa, Glycine max
  Coding DNA Sequence Number=SeqID_26091
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=100%, E-value=1e-18, Identity=29%"; Hit description= UPI00006A17C9 related cluster
TTRPPHHWTTVLAFKGLRVLFIRGLHVLAFIGLHVLAFRGLHLLPLKGLLILTFRGLHDLTFRGLYILAFRVLHVLPFKGLHAVAIRGLHVLAFRGLHSLTFRRLHVLSFRGLHVLAFEGLHVLAFRGLHVLSFSGLHVLAFRGLHVLSFRALHVLAFRGLHVLAFRGLHVL

SEQ ID NO: 142870 - protein, 212 aa, Glycine max
  Coding DNA Sequence Number=SeqID_26092
MERNFLNRSYPPMGGRFRNSGDLLQRLKGEVTITLNDVAFLLHLLITSAFHSFKALHVDEVMLLLVELLEHCPSIAEAITTKDYHERKPRDHHAVKDFELISCFSGHIRWGLVVVIHQPERVVWQFGYVQTIPPHSPGSRLCLEDIDDRWMHFFEYLTLVGQICVVPRQCALDYINWFYMISHPFMRSAQPEDPARHSSILQDDTYVKPDMP

SEQ ID NO: 142871 - protein, 193 aa, Glycine max
  Coding DNA Sequence Number=SeqID_26093
MNILIAHDQRWEQELSLYNQYEKERTHNLESVFEEFMAYHASSKANQNSMKNNEIHFGKSYSIENFQGGLELQHYYQNKAERGSNLDKLLMQFMETTKSTQQALQSVEIQVGELAKAVTQFMVRQKKSFVEIEAQKKSPVKEHESREKDDEKDEEQAQQQWEKYSIVENQQENILQTNNLPNQLIDKKGRQEE

SEQ ID NO: 142872 - protein, 57 aa, Glycine max
  Coding DNA Sequence Number=SeqID_26094
  Homolog annotation: Hit_ID=P09363; Match level="QueryCoverage=50%, HitCoverage=20%, E-value=2e-08, Identity=93%"; Hit description =Hypothetical 16.8 kDa protein
MTSKELNEEPYEVKISCTFRKGTGAGYHETKDFLSKEIRFGTTICPRSNMERIQRFP

SEQ ID NO: 142873 - protein, 70 aa, Glycine max
  Coding DNA Sequence Number=SeqID_26095
  Gene Ontology: Mol. function=DNA binding; Biological process=DNA integration
  Homolog annotation: Hit_ID=Q1SA33; Match level="QueryCoverage=99%, HitCoverage=10%, E-value=1e-18, Identity=70%"; Hit description =Integrase, catalytic region
MSMMGELKFFLGLQIKQDNKSIYIHQQNYTKELLKKFKMEDAKLMKTPMHASNLLSKDESDFSLILENHI

SEQ ID NO: 142874 - protein, 49 aa, Glycine max
  Coding DNA Sequence Number=SeqID_26096
MLNSRRTLPGGSGLNLQHPWLRTSTPGCGANVMEACLWSFYGGWIYELQ

SEQ ID NO: 142875 - protein, 91 aa, Glycine max
  Coding DNA Sequence Number=SeqID_26097
MALVFIALELSFPNFGQGRSFANVWIFASQIELLNTNCHAIHKASLWLAWATINLRVEVTSSPGRARLLLEEASSSPGRAVVQPPPLISYK

SEQ ID NO: 142876 - protein, 114 aa, Glycine max
  Coding DNA Sequence Number=SeqID_26098
MAEINQGKTMTGHDWSHIIWLLLAGSSGKTLTHKEGGDMVNVPLKKKCGRLARLGEQPLHSKYKNEGGEHFCIQTPPPPSFKREDLQRLAVLAPSSHFWLPFAFIFGVIVHSNK

SEQ ID NO: 142877 - protein, 167 aa, Glycine max
  Coding DNA Sequence Number=SeqID_26099
  Subcellular localization annotation: CTP_CleavageSite=45; ConfidenceScore=5.48e-01
MSFWRHHHSFSKRSSIPHILFSAGRARILRSLLPSSVFQGTHKARAQGSEGPSAPAPASTSTPTPSTSAPPLPSALVQTSTSAQSSDLTVLMLQSLHHDLCLPSPSGGGEASTAQEPQPELEVTSEATLETTPQVSPATSPIMDVVEGEEGIEDTDYAVDLQVVQST

SEQ ID NO: 142878 - protein, 112 aa, Glycine max
  Coding DNA Sequence Number=SeqID_26100
MEVKYLEAVKRRLHATKQWSPDEIRVYGIKMVIDQPLFYDLSQLSSKGVPFEGTLDDDWKFDFSVHDARRLVCTNLADMTGRLLAGSLALESCILHYLIVRILLPRSSNLAQ

SEQ ID NO: 142879 - protein, 80 aa, Glycine max
  Coding DNA Sequence Number=SeqID_26101
MAKWCGMIIICLYMSSGSPSLDDKRRRMTIICLCVPSDTIVSRWRKGGSPPLDDKRRIMTIICLCVPFDTIVSGWRKGAE

SEQ ID NO: 142880 - protein, 83 aa, Glycine max
  Coding DNA Sequence Number=SeqID_26102
  Gene Ontology: Mol. function=RNA-directed DNA polymerase activity; Cellular component=chromatin; Biological process=RNA-dependent DNA replication
MSFGLKNAGATYQRAMVTLFHDMMHKEIEVYVDDMIAKSRMEEEHLVNLRKLLGRLRKYMLRLNPAKCTFGVKSGKLLGFVVS

SEQ ID NO: 142881 - protein, 81 aa, Glycine max
  Coding DNA Sequence Number=SeqID_26103
MASGSEASVYEEFILKIDTNLVHTKNEVTIHIEHLFDVLVVEGIGLNLNEAMLCCVEFKTTYAIVSTVLGKKMTLSMEIIA

SEQ ID NO: 142882 - protein, 139 aa, Glycine max
  Coding DNA Sequence Number=SeqID_26104
  Gene Ontology: Mol. function=DNA binding; Biological process=DNA integration
  Homolog annotation: Hit_ID=Q1SDG1; Match level="QueryCoverage=83%, HitCoverage=9%, E-value=3e-12, Identity=36%"; Hit description =Integrase, catalytic region; Zinc finger, CCHC-type
MAKTILNDNSSPKNFWVEDNLGKFASKCDNGIFLWYSETLKTYRVYESRTLIVEEVIHVKFNNTNADKELLEADESFAYLRLDDGIKNFVSSSYNTKIAASNPPLDSPQEEIREPTGHNMRKNHPESQIIGDLTKQIPN

SEQ ID NO: 142883 - protein, 156 aa, Glycine max
  Coding DNA Sequence Number=SeqID_26105
MEFTLQWEKDFEDDKFISRLNKLPIIFNNIVYDLTKMDKRGTSRIMWCNFMKSSSTEKEARVKKQVVDNTTNIIKVFMDLTISGAMHEVEEQVTSPFKSNAIKDDKVNPTCQPKHASKQADTSNDASSLQNEVPNVVFVFCSNLDVASSSSCPSNA

SEQ ID NO: 142884 - protein, 155 aa, Glycine max
  Coding DNA Sequence Number=SeqID_26106
MQSLQELVQQRPIMSVEKFIEKVAWPGARPSFVGDNESFTAQAPQQHELEPENDHSSEATISGAVDFKKRRLETRSNEAAHHGPVPASADAPFLGVDPSSPQHVADSSIPILEIHEGQTIPVLPLDTSLPATLVWHLTNEKDVQIEDNQDQSQEF

SEQ ID NO: 142885 - protein, 59 aa, Glycine max
  Coding DNA Sequence Number=SeqID_26107
MRKSTVEFKGLPHQACLGCELTTINYMSINVNVCHMSSMGQKIKDELGTDARFVLLARL

SEQ ID NO: 142886 - protein, 112 aa, Glycine max
  Coding DNA Sequence Number=SeqID_26108
  Gene Ontology: Mol. function=transcription regulator activity; Cellular component=nucleus; Biological process=regulation of transcription
  Homolog annotation: Hit_ID=Q1SHA2; Match level="QueryCoverage=61%, HitCoverage=20%, E-value=1e-18, Identity=75%"; Hit description=Helix- loop-helix DNA-binding
  Pfam annotation: Domain name=HLH; Domain location=26-75; Score=60.7; E_value=4.8e-15; Accession=PF00010.16; Description=Helix-loop-helix DNA-binding domain
EGVEALAEEVPTKAASSRSSSKRSRAAEVHNLSEKRRRSRINEKMKALQNLIPNSNKTDKASMLDEAIEYLKQLQLQVQYVWETAEYRKFEKILAGTVVVLTPRNEPDLTSR

SEQ ID NO: 142887 - protein, 192 aa, Glycine max
  Coding DNA Sequence Number=SeqID_26109
  Subcellular localization annotation: CTP_CleavageSite=44; ConfidenceScore=5.44e-01
MGDMYHFDKNLSSQDEISLFLRQILLRSSPPSSSSSSRPMPTVSCTSNVAHQNVNAHPSFTASQLQDGKILALDSTASFASGSAACSPFKGQGASAANVSSSSAGVSENKNDDYDCESERHQHTPTTTTTVGINNPSSLRQTTTNYHATKPNHHHQSTTAQPNPYNTTASKPEGMVLNTIVFMRHKSTVCGL

SEQ ID NO: 142888 - protein, 59 aa, Glycine max
  Coding DNA Sequence Number=SeqID_26110
GQPLVVKEKCKEVSVSSKRHFASIATPLGLEFIPQVKKLLDEGFGSQELKSLCFFGAQN

SEQ ID NO: 142889 - protein, 60 aa, Glycine max
  Coding DNA Sequence Number=SeqID_26111
MSKHAPTKCSVKCPNDGQHRRFKIGAQMQFQAYEPKLVASMQGNILMAKNPNFGFRIRKA

SEQ ID NO: 142890 - protein, 138 aa, Glycine max
  Coding DNA Sequence Number=SeqID_26112
  Homolog annotation: Hit_ID=Q9FFQ1; Match level="QueryCoverage=30%, HitCoverage=5%, E-value=3e-11, Identity=76%"; Hit description=DEAD -box ATP-dependent RNA helicase 31
MKGLDAVGYWWQRIRVAVEANKLLKYNPTIGVEVVIGGTRLALEQKRMQPNPCQVLRLVIISGLQVEGFKSWLLDTWSACTHKKKVMASSLMAFWNLSSKIDKFEASTLISTHVVPFLLLGVEYGHLIVGNFICLSTF

SEQ ID NO: 142891 - protein, 406 aa, Glycine max
  Coding DNA Sequence Number=SeqID_26113
IEQMKVDMETMKEQMTMMMEAIISMRKMMEVNVATTVVASTTIERDLIHTPDFNQESHPVSDVVGQGGEAVANGYGPHYVQLQSKSSFPPYGLPPNYTLPIVVYAPSENINNLVPVFIENQQHQSDHTHAYVSQPMGETHEAPQDHTLTNFKVYLGYTTEGHAFSNVPMPNAPGGPQYRLPSQTLHFVMGGGPPTIFEEEKLDQIEERLRALKEEEIMALLTYQNCAWYPTKMEAYAKDEKLLMQFFQKSLAGEAITCYKTCAREIMNHSKNMLKGYMPSSFANLVFTGKRIEVGLRRGKFDYADCANSSNRRLEMSGGKEKEGEAHVVTIVPTRLNFPLAPYNPMYQYATQLYHYSANISFAHYPPFYQPRTPNQPQRPPVNRLQNPPAAQPRPNTTPNTNQNTN

SEQ ID NO: 142892 - protein, 92 aa, Glycine max
  Coding DNA Sequence Number=SeqID_26114
  Homolog annotation: Hit_ID=Q1STZ2; Match level="QueryCoverage=81%, HitCoverage=16%, E-value=5e-08, Identity=38%"; Hit description=IMP dehydrogenase/GMP reductase
MGSNQAPSFKKRFYHVKAKSLEVASLRELGQQMDQVRRQAFHKTYGKIYDLAMIEVSIEVIASLAQYYDQLLRCFTFGDFQLVPTIEEFEGI

SEQ ID NO: 142893 - protein, 194 aa, Glycine max
  Coding DNA Sequence Number=SeqID_26115
INESYVDSSGNDRHTGDSNKCGLYIKDNPPCLVSLGRLYEGSTTVHNIHLLHDQIKVGVEGVRDADVLIPVPTKEGVVGPVKPADRPDHDVDDPLYLMTLTIPQLFLKSLQVMWDATMFGVFNENFPLYIKHEDLSEIAHDGQCLSISVIQLWILHMTETSMRAGNADVYGFHEPQFIQRSGQSQFESESYIKN

SEQ ID NO: 142894 - protein, 390 aa, Glycine max
  Coding DNA Sequence Number=SeqID_26116
  Gene Ontology: Mol. function=oxygen transporter activity; Cellular component=flagellin-based flagellum; Biological process=flagellum organization and biogenesis
  Homolog annotation: Hit_ID=Q4ACL1; Match level="QueryCoverage=91%, HitCoverage=80%, E-value=1e-107, Identity=53%"; Hit description =Flagella (R) hook associated protein HAP2
MDFGGHPGVFTVAGEEVGDLIRFLVERFIELGAVDFKLAGFGIGRDPEVAKAFQLRVVLSGAERAFNRGLNATQGVIAQQRAVLGALRFTAFHRGIFGQRAEGVEQRIVVIDPLFDFVGGAAFIDADHQVLRFAGFGGGFQVDGDALQRIGNRVGAALNFGAVDDNLRILSGNGLFHRAAVAAAVVIEDGAELIVVIHLHRHGVFLAGAGGAQRQLIVIVADAHDTGGDAGFRFIDGVAHLDQDGTIAAARRAQFGLLVGNRRLSGQRLRLRQFQHLDRVVARHRFVGGGHGKLIVLGGGSVVEELWLGQVFAQIVKLLQRAFQRTVSGQLGVIAGLLGGVRRQTLLFRFGQLVQQTVKRIRRYQKGRWLTPWANKPEPFNHVAQNATDS

SEQ ID NO: 142895 - protein, 91 aa, Glycine max
  Coding DNA Sequence Number=SeqID_26117
MNIQINNPYGSYGSSIHTVYTDCQSILPIRMVIRIVDLYEPYRLLIRMFLSFFAYFFFFSAAGCPSKNAGCPKQQPKKDEGCLQWESNTDH

SEQ ID NO: 142896 - protein, 99 aa, Glycine max
  Coding DNA Sequence Number=SeqID_26118
MEIFFQLNSCDSVQTREFTRVYPSPPSLPKNEFASESNRRDQDRRRMHCILRRSVTTCPSWASEGEAYGCAFQRRKDAQSHHQRLFVGNVGKTEGNRSK

SEQ ID NO: 142897 - protein, 85 aa, Glycine max
  Coding DNA Sequence Number=SeqID_26119
MPLWFRDLLCARAFCVSPSEPQTIGELELLSAQSLKRHESKNACIDAILLRKGLVTRAMSKRLQEDWAKAAEEGPRVLMNLRVDF

SEQ ID NO: 142898 - protein, 109 aa, Glycine max
  Coding DNA Sequence Number=SeqID_26120
  Gene Ontology: Mol. function=DNA binding; Biological process=DNA integration
  Homolog annotation: Hit_ID=Q1RVQ5; Match level="QueryCoverage=95%, HitCoverage=6%, E-value=1e-41, Identity=77%"; Hit description =Integrase, catalytic region; Zinc finger, CCHC-type
MSPKNDINIVGNREEIPKAIDCLKKEFEMKDLGRTKFWLGLQIEYLNSGVFVHQETYITKVLKRFYMDKSHPLCTPMVLRSLDMDKDPFRQQEKDEEQLGLEVSYLTAI

SEQ ID NO: 142899 - protein, 90 aa, Glycine max
  Coding DNA Sequence Number=SeqID_26121
MNDLVSEYQQYQDATAEDEGEYEDEEEEDGEADDPYVKRLKCEDALCLYLCYVMLRVEFGTFGYMLCGTYRATKIPMQLECRRKLLPGEN

SEQ ID NO: 142900 - protein, 194 aa, Glycine max
  Coding DNA Sequence Number=SeqID_26122
  Gene Ontology: Mol. function=chitin binding; Cellular component =extracellular region; Biological process=chitin metabolic process
  Homolog annotation: Hit_ID=UPI00006A17C9; Match level="QueryCoverage =80%, HitCoverage=100%, E-value=4e-13, Identity=28%"; Hit description= UPI00006A17C9 related cluster
  Subcellular localization annotation: CTP_CleavageSite=67; ConfidenceScore=5.12e-01
MSSPSEGYMSSPSEEFISSSSEGYTPSPWVLVTLTVKRTTRPRLERTTCPHLQRTTRPRLERTTHPRQQRAARPHLQRTTCPRLERATRPHLGGLHALTSRGLHVLALRGLHALTLGTSYLHLQRTTRPRLQRIMYLQLQRTTRPRRQRVMCLHLCRACPHLQRIARPCHHRTTLPRLRKVTRPELQRATRPRL

SEQ ID NO: 142901 - protein, 285 aa, Glycine max
  Coding DNA Sequence Number=SeqID_26123
  Gene Ontology: Mol. function=chitin binding; Cellular component =extracellular region; Biological process=chitin metabolic process
  Homolog annotation: Hit_ID=UPI000044A8F0; Match level="QueryCoverage =67%, HitCoverage=99%, E-value=9e-34, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
NLMLSHKGGPLGTTTLTFRGLHALAFRGLHALAFRGLHALAFRGLHVLAFRGLHALTFRGLHVLTFRGLHILAIRGLHALAFRGLHVLAFRGLHALAFRGLHALTFRGLHVLAFRGLHTLAFKGLLTLPFRGLHVLAIRGLHVLTFRGLQALAFRGLHILTFRGLHTLVFRGLLVLAFSGLHALTFRGLHNLTFRGLHVLAIRGTTRPRLQWATCPDEGKDPLEGLGGPMTRARARKAKEALQQVLSILFEYKPKFQGEKSKGPIGNLSISLLGDQMGADLMAVG

SEQ ID NO: 142902 - protein, 56 aa, Glycine max
  Coding DNA Sequence Number=SeqID_26124
MENACADKKEEIAEENTANPRKIRLEAVKTMRFMSYANRLTRTMFLYDKGVSIKCY

SEQ ID NO: 142903 - protein, 109 aa, Glycine max
  Coding DNA Sequence Number=SeqID_26125
HDDWMWNYLDFVEAWEDLWGPDVERNEDKGYVGVRELSWRWATGDGGLYVICGCGESFCTIARPPPKWYPGDMSRGSGDLGDVRRAPGNQPIKEQRPQSREACVVAGQQ

SEQ ID NO: 142904 - protein, 276 aa, Glycine max
  Coding DNA Sequence Number=SeqID_26126
  Gene Ontology: Mol. function=calpain activity; Cellular component =intracellular; Biological process=proteolysis
  Homolog annotation: Hit_ID=Q1S668; Match level="QueryCoverage=94%, HitCoverage=65%, E-value=3e-34, Identity=37%"; Hit description =Cyclin-like F-box; F-box protein interaction domain
  Pfam annotation: Domain name=F-box; Domain location=1-48; Score=36.0; E_value=1.3e-07; Accession=PF00646.23; Description=F-box domain
MAKETFPIELIVEILSWLPVKPLIRFRCVSKTWKSLISHPIMVKLHLQRSSKNPHVLLTFEDNNRNNDNCYSFAATCSIRRLLENPSSTVDDGCYQFNDKNHFVVGVCNGLVCLLNSLDRDDYEEYWVRFWNPATRTMSEDSPRLSLHWRKYKTGRNDWVCGYPRCGFGYDGLSDTYKVVIILSNVKLQRTEVRVHSVGDTRWRKTLTCPVFPFMEQLDGKFVGGTVNWLALHMSSSYYRWEDVNVNEIVIFSYDLKTQTYKYLLLPDGLARGCLG

SEQ ID NO: 142905 - protein, 54 aa, Glycine max
  Coding DNA Sequence Number=SeqID_26127
MKRSKREREGVELDNPKENCSRDRAFVFSERAREGGDMQRPKSLLWAELHKLKA

SEQ ID NO: 142906 - protein, 54 aa, Glycine max
  Coding DNA Sequence Number=SeqID_26128
ELEYGKKVSHGEIWIATHEHANGEFVNILRIGTCSGVRIGTLFISGVWTRCTIV

SEQ ID NO: 142907 - protein, 99 aa, Glycine max
  Coding DNA Sequence Number=SeqID_26129
  Homolog annotation: Hit_ID=Q9Z621; Match level="QueryCoverage=81%, HitCoverage=50%, E-value=1e-30, Identity=79%"; Hit description=CigR
  Pfam annotation: Domain name=DUF1236; Domain location=28-95; Score= -4.2; E_value=0.034; Accession=PF06823.3; Description=Protein of unknown function (DUF1236)
MAMAMAMAMAMAMAMAITARALAVNYGLVGYQSLPPGIAKKVARGKALPPGIAKKNLPASMINALPHYPGYEWRAVGDDLVLIALSTAVVTAVINGVFN

SEQ ID NO: 142908 - protein, 70 aa, Glycine max
  Coding DNA Sequence Number=SeqID_26130
MEKEGGGLESLIIHGQYIDDAHVSYFMLYRNRKILILGGMSLNFELPCDSADHHGRELHVHDRVTSTLAA

SEQ ID NO: 142909 - protein, 97 aa, Glycine max
  Coding DNA Sequence Number=SeqID_26131
MDHETFLYQTKYCKELLKKFDMEKIKEVTTPMATNCYLSQPTLRREGNLRAHECVFQGRKMRGVATNVYLRKTLEKPKRVFPSLLRILNCDEEIRPM

SEQ ID NO: 142910 - protein, 353 aa, Glycine max
  Coding DNA Sequence Number=SeqID_26132
  Gene Ontology: Mol. function=phosphatidate cytidylyltransferase activity; Cellular component=membrane; Biological process =phospholipid biosynthetic process
  Homolog annotation: Hit_ID=Q2HT24; Match level="QueryCoverage=90%, HitCoverage=74%, E-value=1e-177, Identity=93%"; Hit description =Phosphatidate cytidylyltransferase
  Pfam annotation: Domain name=CTP_transf_1; Domain location=1-305; Score=388.3; E_value=1.2e-113; Accession=PF01148.10; Description =Cytidylyltransferase family
MVVVIQIFMARELFNLLRRAHEDRQLPGFRLLNWHFFFTAMLFVYGRILSQRLVNTVTSDMVLYRLVSNLIKYHMVICYSLYIAGFMWFILTLKKKMYKYQFGQYAWTHMILIVVFGQSSFTVASIFEGIFWFLLPATLIVINDIAAYIFGFFFGRTPLIKLSPKKTWEGFIGASVTTIISAFMLANIMGRSQWLTCPRKDLSTGWLHCDPGPLFKPESYPLQGWISHWFAWKEISILPIQWHSLCLGLFASIIAPFGGFFASGFKRAFKIKDFGDSIPGHGGITDRMDCQMVMAVFAYIYHQSFVVPQTLSVEMILDQGERKRYSVHAFSIFWVRRFKGSEAVKMCIVYVDR

SEQ ID NO: 142911 - protein, 134 aa, Glycine max
  Coding DNA Sequence Number=SeqID_26133
  Homolog annotation: Hit_ID=O22797; Match level="QueryCoverage=75%, HitCoverage=50%, E-value=1e-39, Identity=77%"; Hit description =Expressed protein
  Pfam annotation: Domain name=GLTP; Domain location=10-134; Score =35.4; E_value=1.3e-10; Accession=PF08718.1; Description=Glycolipid transfer protein (GLTP)
MEGTVFTPALEGIKLVKSEQGEILTQPFLDACKHILPVIDKFGAAMALVKSDIGGNISRLESKYSSNPTKFNYLYSLVQVEVETKTAKSSSSCTNGLLWLTRCSMIIDNDRYGKLKKESTKVLPTTSFLQRLTT

SEQ ID NO: 142912 - protein, 758 aa, Glycine max
  Coding DNA Sequence Number=SeqID_26134
  Gene Ontology: Mol. function=microtubule motor activity; Cellular component=microtubule associated complex; Biological process =microtubule-based movement
  Homolog annotation: Hit_ID=O23291; Match level="QueryCoverage=98%, HitCoverage=72%, E-value=0.0, Identity=55%"; Hit description=Kinesin like protein
  Pfam annotation: Domain name=Kinesin; Domain location=56-381; Score =286.4; E_value=5.4e-83; Accession=PF00225.13; Description=Kinesin motor domain
  Subcellular localization annotation: CTP_CleavageSite=40; ConfidenceScore=5.44e-01
MAPTPSSKQNHPTQLKTPQSKHRLNFNGLKSAPSPNPNSVANKEPPPEHPIEVIARIRDYPDRKDKPLSVLQTNSNSSSIRVRADFGYRDFTLDGVSVSEEEDLDVFYKKFVESRIHGVKLGDKCTIMMYGPTGSGKSHTMFGSSKQAGIVYRSLRDILGDGDSADGDSGGGLGTFVQVTVLEIYNEEIYDLLSTNGGGGGGGFGFGWPKGGSASKVKLEVMGKKAKNATYISGNEAGKISKEIQKVEKRRIVKSTLCNDRSSRSHCMVILDVPTVGGRLMLVDMAGSENIEQAGQTGFEAKMQTAKINQGNIALKRVVESIANGDSHVPFRDSKLTMLLQDSFEDDKSKILMILCASPDPKEIHKTISTLEYGAKAKCIVRGPHTPVKDDESSSAVILGSRIAAMDEFILKLQMETKQREKERNEAHKKLLKKEEEIAALRAKLDMAEGKGTPPSEEEINLKVNERTRLLRQELEKKLEECQRMTNEFVELERKRMEERILQQQEEVETLRRRLEEIELQLCSKQGCCVENESKDMESSGFMRRLLRVYKSEDDPGMVKSMDLDMDDQEPLGHEVNIVGGVMSRSDYNVKQDLSNQPCPNALTGVKEDAHVFSPNFGQRVCLSTVYEEEGEGDEDKGEDEEVEKGVIEEKRVCSVDKPSAAGSLGTLNLSNTSPNKEEFCFKVSSVDNDSRLLRIQNIFTLCGNQRELSQHIGTPVQPTKKRSDETFEVSPAKTSDKDSVFKISNKENFEPHNVLGN

SEQ ID NO: 142913 - protein, 133 aa, Glycine max
  Coding DNA Sequence Number=SeqID_26135
MTSGVVKGQMKGLLKGLRYISQIFGRKGRSVNYARKEMGPFGGNIYVWKLVGWVFGVVLGLEDGVISVESAIGGDSYAYKVLMEDKQSSRNHGRMIWMKVSDRGGFFEGGSLCMKVATKNRLPTKKISGVEGY

SEQ ID NO: 142914 - protein, 206 aa, Glycine max
  Coding DNA Sequence Number=SeqID_26136
  Gene Ontology: Mol. function=structural constituent of ribosome; Cellular component=intracellular; Biological process=translation
  Homolog annotation: Hit_ID=P55844; Match level="QueryCoverage=63%, HitCoverage=99%, E-value=2e-57, Identity=84%"; Hit description =Probable 60 ribosomal protein L14
  Pfam annotation: Domain name=KOW; Domain location=81-113; Score=17.7; E_value=0.043; Accession=PF00467.19; Description=KOW motif
  Pfam annotation: Domain name=Ribosomal_L14e; Domain location=118-194; Score=135.8; E_value=1.2e-37; Accession=PF01929.7; Description =Ribosomal protein L14
  Pfam module annotation: Pfam domain module=KOW::Ribosomal_L14e; Domain location=81-113::118-194
MARGNGSVVPTDPQAMAVVKKKTQSSRSWILFDPTGQGSLLDVDKYAIMHRHIKAIISAEEPPYRVASLQSTAKMPFKRYVEIGRVAQINYGKEYGRLVVIVDVIDQNRALVDAPDMVRSQVNFKRLSLTDIKIDIKRVPKKKDLVKAMEDADVKTKWEKSSWGRKLIVRKRRASLNDFDRFKIMLAKIKKAAVVRQELAKLRKSA

SEQ ID NO: 142915 - protein, 183 aa, Glycine max
  Coding DNA Sequence Number=SeqID_26137
  Homolog annotation: Hit_ID=UPI0000162C4B; Match level="QueryCoverage =48%, HitCoverage=41%, E-value=1e-09, Identity=40%"; Hit description =RIC3 (ROP-INTERACTIVE CRIB MOTIF-CONTAINING PROTEIN 3)
  Pfam annotation: Domain name=PBD; Domain location=11-59; Score=26.2; E_value=0.0001; Accession=PF00786.18; Description=P21-Rho-binding domain
MEDEEDEKEIQIGFPTDVKHLAHIGAENAKASQPSWLAEFKESSEASSGTVVNPTKATTEDNNSDANSKGEGKRSHNRKSRPRSTESQSSTSRDISNAEGSKPSRRHHSESSRRMNRHLSEEEKEKAPTTTKHSQRNRKSKMTSSEEKDEKEGSSRRAPRSQRHSKGDSLTDFSFSDSGPGPT

SEQ ID NO: 142916 - protein, 164 aa, Glycine max
  Coding DNA Sequence Number=SeqID_26138
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SWW1; Match level="QueryCoverage=99%, HitCoverage=32%, E-value=1e-52, Identity=68%"; Hit description =Glycoside hydrolase, family 1
MKAISPSFLCLIILVTLLAGSIESAPANVKPSHYAAPFNRSVFPSGFLFGIGSAAYQIEGAAAIDGRGPSIWDTYTKQQPGKIWDHSDGSLAIDFYHRYKRIKLHARTISQSDIKMVKEVGLDSYRFSISWSRIFPKGKGAVNTLGVKLKAICHAVSLGPPTSS

SEQ ID NO: 142917 - protein, 178 aa, Glycine max
  Coding DNA Sequence Number=SeqID_26139
  Gene Ontology: Mol. function=sequence-specific DNA binding; Cellular component=nucleus; Biological process=regulation of transcription, DNA-dependent
  Homolog annotation: Hit_ID=Q1SSH7; Match level="QueryCoverage=93%, HitCoverage=61%, E-value=1e-65, Identity=77%"; Hit description =Leucine zipper, homeobox-associated; Homeodomain-related
  Pfam annotation: Domain name=HALZ; Domain location=134-178; Score =40.8; E_value=4.6e-09; Accession=PF02183.8; Description=Homeobox associated leucine zipper
  Pfam annotation: Domain name=Homeobox; Domain location=79-133; Score =75.6; E_value=1.6e-19; Accession=PF00046.19; Description=Homeobox domain
  Pfam module annotation: Pfam domain module=HALZ::Homeobox; Domain location=134-178::79-133
MAFLPSHGFTFNTTHEEDHCHFPPTSLDPFPSLPPQHFQGGAPFMLKRSMSLSGIENKCNEVHGDDELSDDGVFQSGEKKKRLNLEQVKALEKSFDQGNKLEPERKVQLAKALGLQPRQVAIWFQNRRARWKTKQLEKEYEVLKKQFEAVKADNDVLKVRNQKLQAEQNRAAILKFVL

SEQ ID NO: 142918 - protein, 64 aa, Glycine max
  Coding DNA Sequence Number=SeqID_26140
MSNSTPKASLKGESYSSLIYSTSGCGIFKDDKYPSSVGPMKRIPGQIEISEFVEITNFRRDSPI

SEQ ID NO: 142919 - protein, 44 aa, Glycine max
  Coding DNA Sequence Number=SeqID_26141
MGRRLPPSLPRFFCHTKRPEAALSVVCTLSPNAKLSPTVTFSTT

SEQ ID NO: 142920 - protein, 277 aa, Glycine max
  Coding DNA Sequence Number=SeqID_26142
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9LW60; Match level="QueryCoverage=99%, HitCoverage=99%, E-value=2e-60, Identity=47%"; Hit description =Protein phosphatase 2C-like protein
  Pfam annotation: Domain name=PP2C; Domain location=42-269; Score =22.3; E_value=3.1e-07; Accession=PF00481.12; Description=Protein phosphatase 2C
MGFYLNLKRNAFRLKRFLLGHEGRKRKYKQPKKPSWMRPMAYGYQVVEHNMARDGSDDSVVAQREEMDQTELWYFGIFDALIGDKVTKYMQSYFFDKKLQETHIRRKSKEALKRAYLGVRATIREEHKLEETCRMGSASVMLINGEKLVVANMGDYRTVVCRDGIAHQTTGTNQRSTKIHWSRRLFAGPILACQSGNAAGAKHSRGSALVIRSERIDSDTEFLILASTGIWEVMQNQEAVNLISHIEDPQEAAECLAKEALIRMSKSSISCLIIRFD

SEQ ID NO: 142921 - protein, 235 aa, Glycine max
  Coding DNA Sequence Number=SeqID_26143
  Gene Ontology: Mol. function=chitin binding; Cellular component =extracellular region; Biological process=chitin metabolic process
  Homolog annotation: Hit_ID=UPI000044A8F0; Match level="QueryCoverage =66%, HitCoverage=99%, E-value=3e-20, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHALAFKGLHVLSFRGLHALAFRGLHVLDFRGLHALAFRGLHVHTFRGLHGLAFRGLRVLPFRGLHALAFVGLHAFTFRRLQALAVRGLHVLAFRGLHALAFRGLHVLTFKGLHVLAFRGLHVLPFIGLHSFAFVSLLKHVHILVKEHRDYFSLTHHKSKNYVVHWHAETPDSNPHTPFVIQRLESPVACGDTLWLSAPRHSETSSPIDKQKPMSSPAPFPEMSASSSRGYEKI

SEQ ID NO: 142922 - protein, 321 aa, Glycine max
  Coding DNA Sequence Number=SeqID_26144
  Gene Ontology: Mol. function=lipid binding
  Homolog annotation: Hit_ID=Q9LW61; Match level="QueryCoverage=99%, HitCoverage=99%, E-value=1e-48, Identity=38%"; Hit description =Arabidopsis thaliana genomic DNA, chromosome 3, P1 clone: MLM24
  Pfam annotation: Domain name=ENTH; Domain location=31-155; Score =137.1; E_value=4.7e-38; Accession=PF01417.11; Description=ENTH domain
MGSLFLGQIKKQTSTFLQEKYKSARMAFTDVSEAEMLAEEATNKDDCCPHAKTMTRIAEASFDVDEYWRIVDVLHKRLYNIDWDQWKQSYKALVLLEFLLTHGTREFAQEFQCDAEIIEELGIFTHIDKKGFNWGSRMLKLSEQILKLLQDEEALIEARLKALKITNEIQGFGSSLNSPTSSSPSPCSLSSEASQGSSCFYSLSTTSTPTYIFDSNDQLNKHHSPSIANDGNINIVLPPKNVTKNHVWKRLAGEENNILIDSDEDEDMEKPRGFVSEICSKIIGGSPIKGDNREKIEFRCLSDVGSKVTQKKFDRQYSIWF

SEQ ID NO: 142923 - protein, 194 aa, Glycine max
  Coding DNA Sequence Number=SeqID_26145
  Gene Ontology: Mol. function=RNA-directed DNA polymerase activity; Cellular component=membrane; Biological process=RNA-dependent DNA replication
  Homolog annotation: Hit_ID=Q1T0R3; Match level="QueryCoverage=64%, HitCoverage=64%, E-value=6e-21, Identity=48%"; Hit description =Hypothetical mitochondrial protein atmg00310
MKVSMGWRAESKESCVGQMGDNLSTKGKGWLGNKRNQDIQQGIAREVEMEHAAVELRIVGWNIGVEDLMEVTHENQLNRVLQNETIWKVGCGDKIRFWEDKWVGEGETLMRKYPRLPLFDNEVAATIGFLEDISRFPIHRHLTDCWVWKSEPNGHYSTRSAYHLMQHEAAKANTDPAFEEIWKLKIPAKAAIFA

SEQ ID NO: 142924 - protein, 186 aa, Glycine max
  Coding DNA Sequence Number=SeqID_26146
  Pfam annotation: Domain name=zf-C2H2; Domain location=32-54; Score =17.5; E_value=0.049; Accession=PF00096.16; Description=Zinc finger, C2H2 type
  Subcellular localization annotation: CTP_CleavageSite=25; ConfidenceScore=5.47e-01
MPMNISNFFNNSYQPSFFNSGQDPRQNSQNGFRCRLCNHVFPSYQALKAHFESHFTLENPAIRNLYSSSHVNSQRGMIPNPLRPNFPRPMVMQETRNFVNMNFQAPPQQPMVMPQSRANLFPLVIQHNVAASQSLQGPPQATQFVNNYVETAHLLAPPIHQGEMEVSPIDGTKPYIDLLDKPIDNN

SEQ ID NO: 142925 - protein, 110 aa, Glycine max
  Coding DNA Sequence Number=SeqID_26147
MARVTLGRRDHNWKCVRKGSRMRRHAPWIAAVWLVKGAVRENSDGDVSDRFEESSAGNGLKEVEPDASGSPKKMKIIARDNGSIEVPLLGSRYPVSEYSTGLSLYRLIAL

SEQ ID NO: 142926 - protein, 434 aa, Glycine max
  Coding DNA Sequence Number=SeqID_26148
  Gene Ontology: Biological process=cell cycle
  Homolog annotation: Hit_ID=Q2QVB9; Match level="QueryCoverage=67%, HitCoverage=35%, E-value=3e-48, Identity=38%"; Hit description =Expressed protein
ISEESVKLADASSEIRKSIQQYSPSYMSSSSKPNFERSLRSQVTQEDSMTQEDGTRDRRFNKDSLEKVSGVSKTGVMDDKEKTKEGRKGQEQFTMRNELLENELVNNLSDDDSTKKGKFNSTTHLLNKKLHDHPTSILMNDKTEDVTNVKSPPQSAENYGLFISSQTHNQAEEINTMNDVHVGTACHEDVNVNGSFHNNETELKAEVEMLREELREAAALEVSMYSVIAEHGSSSNKVHAPARRLSRFYFHACRVGSPATMATAAQSAVSGFVLVSKACGNDVPRAIVSKEVENIHFGDGPSINSESDGTGNTLHKEEKDNTEKHFHRWEDPETFLVALEKVEAWIFSRIVESVWWQTLTPYMQSAAAKNSSSRKAYERRYRVGDQDQGSFSIDLWKRAFKDACERICPLRAGGHECGCLLVIARLVQFNIDIP

SEQ ID NO: 142927 - protein, 255 aa, Glycine max
  Coding DNA Sequence Number=SeqID_26149
  Gene Ontology: Biological process=cell cycle
  Homolog annotation: Hit_ID=Q2QVB9; Match level="QueryCoverage=79%, HitCoverage=22%, E-value=3e-29, Identity=37%"; Hit description =Expressed protein
MVLGIRSKSKKSVSIQVHYIIHVQEIKPWPPSQSLRSVQTVLLQWENGDQNSGSLPSTAGNGKIEFNESFRLSVLMCREASKKGKHRETFQKNCLEFYLYDKTVKSQLLGSATINLADFGIIKETKALSIQFNCKKSSRISSQPFLYVNIQPFDIESSSSSPSSSLSKELSLEKEGSESVSQSLKDDDNLEIASFTDDDSDDIPSNTSQTSRPASEITGGLASLNEKVCIHALVCSMIVKLQHKMSKYLNSKSVD

SEQ ID NO: 142928 - protein, 57 aa, Glycine max
  Coding DNA Sequence Number=SeqID_26150
MACGLVVFLETVLWGIFGITMAKEMKFPKFIIEKDSKAAQHLVVKKSERTHHCYEIM

SEQ ID NO: 142929 - protein, 343 aa, Glycine max
  Coding DNA Sequence Number=SeqID_26151
  Gene Ontology: Mol. function=triose-phosphate isomerase activity; Cellular component=integral to membrane; Biological process =metabolic process
  Homolog annotation: Hit_ID=UPI000045C000; Match level="QueryCoverage =68%, HitCoverage=89%, E-value=4e-61, Identity=52%"; Hit description =COG0767: ABC-type transport system involved in resistance to organic solvents, permease component
  Pfam annotation: Domain name=DUF140; Domain location=91-332; Score =264.7; E_value=1.8e-76; Accession=PF02405.7; Description=Domain of unknown function DUF140
  Subcellular localization annotation: CTP_CleavageSite=31; ConfidenceScore=5.51e-01
MQTTSYSHPLFCFSCRNISTNGKSKGSVKFRAPYPSQLGRKCGFNGRPRVYISPSPIKPNRLYVLHNTGDNHPSAFSVDDEMNTNHAPNGMSPTFLSNWSPPRAGGCQDSKGKDHWRNTLQQLERVGPKSVGVCLLTSAFVGMAFTIQFVREFTRLGLNRSVGGVLALAFSRELSPVVTAIVVAGRIGSAFAAELGTMQVSEQTDTLRVLGSDPVDYLVTPRVLATCIALPLLTLLCFTLGMASSALLADGVYGLSINIIMDSAQRALRSWDIISAMIKSQVFGAIISIVSCAWGVTTLGGAKGVGESTTSAVVISLVGIFIADFALSYVFFQGAGDQLKNCV

SEQ ID NO: 142930 - protein, 66 aa, Glycine max
  Coding DNA Sequence Number=SeqID_26152
MTLAQAFYQTGSRQIRKLDKSQELPEPGQQKLSTTTQRDIGRFNHRYKLEYDCKLEPTKGMNYTNH

SEQ ID NO: 142931 - protein, 136 aa, Glycine max
  Coding DNA Sequence Number=SeqID_26153
  Gene Ontology: Mol. function=structural molecule activity; Cellular component=integral to membrane; Biological process=lipid transport
  Homolog annotation: Hit_ID=Q39574; Match level="QueryCoverage=95%, HitCoverage=93%, E-value=1e-28, Identity=47%"; Hit description=14 kDa polypeptide
  Pfam annotation: Domain name=Tryp_alpha_amyl; Domain location=53-135; Score=61.4; E_value=2.9e-15; Accession=PF00234.12; Description =Protease inhibitorseed storageLTP f
  Subcellular localization annotation: CTP_CleavageSite=46; ConfidenceScore=5.60e-01
MAPKMCVIVALNVVMFFALVSGCDKCPPVTNTSITTTSITVTSTPSLNATTGCPRDVLKLGVCSGILNGWMNFSMGLPLKTHCCSAIEGLYDFEVALCVCTALKANIMGINLDIPISFTKLINTCDKKVPNGFICD

SEQ ID NO: 142932 - protein, 116 aa, Glycine max
  Coding DNA Sequence Number=SeqID_26154
  Gene Ontology: Mol. function=calcium ion binding; Cellular component =mitochondrion; Biological process=protein amino acid dephosphorylatio n
  Homolog annotation: Hit_ID=Q5QIT3; Match level="QueryCoverage=79%, HitCoverage=17%, E-value=8e-43, Identity=86%"; Hit description =Protein phosphatase 2A beta
MNRSGNGRLTLRELKRGNLIDAILHVDEEEDINKVLRYFSYEHFYVIYCKFWELDTDHDFFIDRENLIKYGNHSLTYRIVDRIFSQVCWYFTSLTMCLVQPCSTVYGYSKPHTENC

SEQ ID NO: 142933 - protein, 111 aa, Glycine max
  Coding DNA Sequence Number=SeqID_26155
  Gene Ontology: Mol. function=structural molecule activity; Cellular component=chloroplast thylakoid membrane; Biological process=lipid transport
  Homolog annotation: Hit_ID=Q39574; Match level="QueryCoverage=95%, HitCoverage=90%, E-value=3e-19, Identity=42%"; Hit description=14 kDa polypeptide
  Pfam annotation: Domain name=Tryp_alpha_amyl; Domain location=43-110; Score=48.5; E_value=2.2e-11; Accession=PF00234.12; Description =Protease inhibitorseed storageLTP f
  Subcellular localization annotation: CTP_CleavageSite=18; ConfidenceScore=5.13e-01
MDTLALGLAIVSGCDKCSAVTNTSVDTTVVITATTTLSSDVGCPRNVLKLGLPPETQCCSAIADLYGLEVAVCLCTALKANIMGINLGIPISFTKLINTCDKKVPNGFICG

SEQ ID NO: 142934 - protein, 186 aa, Glycine max
  Coding DNA Sequence Number=SeqID_26156
  Homolog annotation: Hit_ID=Q7XDE0; Match level="QueryCoverage=44%, HitCoverage=15%, E-value=4e-08, Identity=45%"; Hit description=EF hand family protein, expressed
MDVEETEKLVSLDPDLLLLPEVSPFALKSSPYVVEELFTQWLSLPDTCRLVFYKPKPVNPMLTNPNTKRTEKSNCLYSFSTSHNPPPKLLPDSAASRALLCFNPVKSLLADAKAGARLSALENSTNTNALSINSLPSLFPAGSTPPLSPRSSSGSPRTTKQRNSPSLGSPLKLASEPVREREVIPQ

SEQ ID NO: 142935 - protein, 328 aa, Glycine max
  Coding DNA Sequence Number=SeqID_26157
  Gene Ontology: Mol. function=protein binding; Biological process=red or far red light signaling pathway
  Homolog annotation: Hit_ID=Q8LAW2; Match level="QueryCoverage=99%, HitCoverage=89%, E-value=2e-86, Identity=47%"; Hit description =Protein AFR
  Pfam annotation: Domain name=Kelch_1; Domain location=127-165; Score =11.9; E_value=0.17; Accession=PF01344.15; Description=Kelch motif
  Pfam annotation: Domain name=Kelch_1; Domain location=167-213; Score =4.8; E_value=1.1; Accession=PF01344.15; Description=Kelch motif
  Pfam annotation: Domain name=Kelch_1; Domain location=215-256; Score =0.7; E_value=3.2; Accession=PF01344.15; Description=Kelch motif
  Pfam annotation: Domain name=Kelch_1; Domain location=81-123; Score =11.6; E_value=0.19; Accession=PF01344.15; Description=Kelch motif
  Pfam annotation: Domain name=Kelch_2; Domain location=127-165; Score =12.5; E_value=0.86; Accession=PF07646.5; Description=Kelch motif
  Pfam annotation: Domain name=Kelch_2; Domain location=216-256; Score =3.4; E_value=14; Accession=PF07646.5; Description=Kelch motif
  Pfam annotation: Domain name=Kelch_2; Domain location=81-123; Score =6.7; E_value=5; Accession=PF07646.5; Description=Kelch motif
  Pfam module annotation: Pfam domain module=Kelch_1::Kelch_1::Kelch _1::Kelch_1::Kelch_2::Kelch_2::Kelch_2; Domain location=127-165::167 -213::215-256::81-123::127-165::216-256::81-123
  Subcellular localization annotation: CTP_CleavageSite=95; ConfidenceScore=5.14e-01
LCLLHVPYPYQALSRSVSSTWNRAITHPSFIFSKKTLSRPHLFVLAFHSQTGKIQWQALDPSSGRWFVLPQMPLQENSCPTEFACAALPHQGKLFVMAGGGGGSDTLVYRAATNQWALAAPMPGGRKRGFFAAEGVEGKIVAVGRSGTDIYDPESDTWREGKKQGGELKRYEVVAAGGKVYVSEGWWWPFMYRPRGWVYETEKDTWREMGVGMRDGWSGVSVAVGGRVFVIAEYGDAPVRVYDEEQDTWRYVKGGSFPRDVIKRPFLATGLDNRIYVASYNLNVAIGKMKSDRIQGKGDFEVSVTWEVVEAPSAFREFSPCTCQVLYA

SEQ ID NO: 142936 - protein, 183 aa, Glycine max
  Coding DNA Sequence Number=SeqID_26158
  Gene Ontology: Mol. function=RNA-directed DNA polymerase activity; Cellular component=extracellular region; Biological process=RNA -dependent DNA replication
MEVHQAFMSMNSYKALGPNGFQPIFLNIYWEITGDDVWQFVARVFQSGTFDTRVVEALMVLIPKEDSPTTFKHSWPINLLNVVYRLMLKVLGTKGNASVLQEVIHHMGMSRKRDGEVILKLDLEKAYDQRLGAMVSKEVKEGHWEPIQVTRNGLNISHLFLAYDVFFFAKATLDQAWKLREWS

SEQ ID NO: 142937 - protein, 419 aa, Glycine max
  Coding DNA Sequence Number=SeqID_26159
  Homolog annotation: Hit_ID=Q5KS41; Match level="QueryCoverage=97%, HitCoverage=86%, E-value=1e-39, Identity=26%"; Hit description =FOLDED PETALS
  Pfam annotation: Domain name=DUF1298; Domain location=307-419; Score=- 66.0; E_value=0.0002; Accession=PF06974.4; Description=Protein of unknown function (DUF1298)
  Pfam annotation: Domain name=UPF0089; Domain location=12-259; Score= -82.9; E_value=0.00022; Accession=PF03007.7; Description =Uncharacterised protein family (UPF0089)
  Pfam module annotation: Pfam domain module=DUF1298::UPF0089; Domain location=307-419::12-259
MEYLKEEQEEPVSPMGQYFNSSVLCIYIIGVLEFEVPIHDLQTFALIKDVFLPINPRFSSVMVQDKDGEKRWKQVDVNLKEHVHFPKFPKGKTVESYDKFFHDYLSSMAMEQLPQSKPLWSIHIINYPTNDASSSIIFKLHHALGDGYSLVGALLSCLQRADDPSLPLSFPSLRPSKPQSSTENFWRRFSWMCSSAFNTVSDFGWSVLKSSIISDDETPIRSGDEGTEFRPICISSMDFSIDHIKDIKSRLGVTINDVITGIVFYGTRLYMQDMDSKSKTADSTALVLLNTRNIEGYQSINEMLNNKAKGPWGNKISFLHVPIPKLNQNKMSNPLDFIWDSHNIIKRKKQSLAVALTGILLDTESKFRGQEAVAKHLRGTVTKSSAVISSLVGPMQQMSLANHPVKGLYFTLAGGPEVS

SEQ ID NO: 142938 - protein, 105 aa, Glycine max
  Coding DNA Sequence Number=SeqID_26160
MGATPRRVPREVANSKQYDGYSKRFSLGCGGEVRKRDSFWVEILESKYEGLRRLERGYGGLEGWRVDMEPTMEMDHVQMGACDLLQLQQLLVPCVLRYGVADSWM

SEQ ID NO: 142939 - protein, 254 aa, Glycine max
  Coding DNA Sequence Number=SeqID_26161
  Homolog annotation: Hit_ID=Q5KS41; Match level="QueryCoverage=96%, HitCoverage=51%, E-value=2e-24, Identity=30%"; Hit description =FOLDED PETALS
  Pfam annotation: Domain name=UPF0089; Domain location=12-254; Score= -120.1; E_value=0.078; Accession=PF03007.7; Description =Uncharacterised protein family (UPF0089)
MEHQKEEQAEPVSPVGQYFNSSVLCIYIIGVLEFEVPIDDLQTYALLKDVFLPINPRFSSIMVQDKDGEKRWKQVAVNLKDHVKIPTFPEGKTVETYDKYFQDYLSSIAMEQLPQSRPLWDIHIINHRTSDASSTIIFKLHHALGDGYSLMGALLSCLQRADNPSLPLSFPSLKQSKPEPSTKSFSRKISWMCSSAFNTVSDFGWSVLKSSIITDDKTPIRFGDEGADFQPISISSMTFSIDHIREIKSRLEVV

SEQ ID NO: 142940 - protein, 164 aa, Glycine max
  Coding DNA Sequence Number=SeqID_26162
  Homolog annotation: Hit_ID=Q5KS41; Match level="QueryCoverage=99%, HitCoverage=34%, E-value=8e-12, Identity=28%"; Hit description =FOLDED PETALS
  Pfam annotation: Domain name=DUF1298; Domain location=54-164; Score= -65.0; E_value=0.00017; Accession=PF06974.4; Description=Protein of unknown function (DUF1298)
TINDVVTGIIFYGTRLYMQDIDSKSKTAQSTALVLLNTRNIEGYQSINDMLNTKAKGPWGNRITFLHVPIPKLNETRNSNPLEFVWDSHNIIKRKKQSLGVVLTGTLLEIEGKLRGQEAVAKRIRGTLTKSSAVISNLVGPIQQMALANHPVKGLYFTLAGGPE

SEQ ID NO: 142941 - protein, 135 aa, Glycine max
  Coding DNA Sequence Number=SeqID_26163
MFSCKVEIVCFAPKELCKFCPKKYTLKPRHNRRRQEANLIEGIISNQKTNLLLPTTTSPPPLSLTYLLLLTMTMMISMIPASPSSLPSSLQSQKNRAPPLIDTAPDSPPLVRSRSEGDIDLFFMKRSRKKNFIGK

SEQ ID NO: 142942 - protein, 491 aa, Glycine max
  Coding DNA Sequence Number=SeqID_26164
  Gene Ontology: Mol. function=protein-tyrosine kinase activity; Cellular component=intracellular; Biological process=protein amino acid phosphorylation
  Homolog annotation: Hit_ID=Q1SSI5; Match level="QueryCoverage=99%, HitCoverage=74%, E-value=1e-175, Identity=54%"; Hit description =Tyrosine protein kinase, active site
  Pfam annotation: Domain name=LRR_1; Domain location=110-132; Score =10.8; E_value=2.8; Accession=PF00560.23; Description=Leucine Rich Repeat
  Pfam annotation: Domain name=LRR_1; Domain location=134-156; Score =18.5; E_value=0.025; Accession=PF00560.23; Description=Leucine Rich Repeat
  Pfam annotation: Domain name=LRR_1; Domain location=14-36; Score =13.7; E_value=0.67; Accession=PF00560.23; Description=Leucine Rich Repeat
  Pfam annotation: Domain name=LRR_1; Domain location=158-180; Score =12.6; E_value=1.3; Accession=PF00560.23; Description=Leucine Rich Repeat
  Pfam annotation: Domain name=LRR_1; Domain location=182-201; Score =9.0; E_value=6; Accession=PF00560.23; Description=Leucine Rich Repeat
  Pfam annotation: Domain name=LRR_1; Domain location=203-225; Score =12.1; E_value=1.6; Accession=PF00560.23; Description=Leucine Rich Repeat
  Pfam annotation: Domain name=LRR_1; Domain location=38-60; Score=6.8; E_value=15; Accession=PF00560.23; Description=Leucine Rich Repeat
  Pfam annotation: Domain name=LRR_1; Domain location=62-84; Score =12.9; E_value=1.1; Accession=PF00560.23; Description=Leucine Rich Repeat
  Pfam annotation: Domain name=LRR_1; Domain location=86-108; Score =17.6; E_value=0.045; Accession=PF00560.23; Description=Leucine Rich Repeat
  Pfam annotation: Domain name=Pkinase; Domain location=319-491; Score=- 10.5; E_value=6.2e-08; Accession=PF00069.15; Description=Protein kinase domain
  Pfam annotation: Domain name=Pkinase_Tyr; Domain location=319-489; Score=-20.3; E_value=3.2e-11; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::Pkinase::Pkinase_Tyr; Domain location=110-132::134-156::14-36::158-180::182-201::203-225::38 -60::62-84::86-108::319-491::319-489
FIGPIPVEIGQLNNVKHLSLGENKLNGSIPLEIGNLNNLLILDLNTNSLTEVILQDLHNLTSLTELNLSNNEIFNLIPQKLSQLTQLKYLNISNNKFFGEIPADIGNLSKILVLDMSRNMLAGEIPASFCTCSKLEKLILSHNNINGSIPSHIGDLVSLALIDLSHNSISGEIPYQLGSVKYTRILDLSYNELNGTIPRSLVSLGRLDLSYNSLEGEIPVALQKSFPPKAFTGNDNLCGDIAHFASCYYSSPHKSLMKIFLPLTALLALLCTAYVFLRWCKAGNCMSVSKETKNGDMFSIWNYDGKIAYKDIIEATEGFDIKYCIGAGGYGSVYRAQLPSGRVVALKKLYNLGPDEPAIHRIFKNEVRMLTKIRHRNIVKLYGFCLHNRCKFLVLEYMERGSLYCVLRNDIEAVELDWTKRVNIVKGIAHSLSYLHHDCKPAIIHRDVTTKNVLLNLEMKACLSDFGIARLLKSGSFNRTVLAGTYGYIAP

SEQ ID NO: 142943 - protein, 35 aa, Glycine max
  Coding DNA Sequence Number=SeqID_26165
MTLIRSFYKPESAGNRLHDLSMRTSSGTLTPLQLK

SEQ ID NO: 142944 - protein, 207 aa, Glycine max
  Coding DNA Sequence Number=SeqID_26166
  Gene Ontology: Mol. function=protein serine/threonine kinase activity; Cellular component=cytoplasm; Biological process=protein amino acid phosphorylation
  Homolog annotation: Hit_ID=Q9ZWB3; Match level="QueryCoverage=83%, HitCoverage=30%, E-value=2e-71, Identity=79%"; Hit description=ADK1
  Pfam annotation: Domain name=Pkinase; Domain location=9-207; Score= -49.6; E_value=1.3e-05; Accession=PF00069.15; Description=Protein kinase domain
  Pfam annotation: Domain name=Pkinase_Tyr; Domain location=9-201; Score=-170.2; E_value=0.05; Accession=PF07714.7; Description=Protein tyrosine kinase
  Pfam module annotation: Pfam domain module=Pkinase::Pkinase_Tyr; Domain location=9-207::9-201
MDHVIGGKFKLGRKIGSGSFGELYLGVNVQSGEEVAVKLILCLLLLPCVTEKKGLFRITVELEMLLESVKTKHPQLHYESKLYMLLQGGTGIPHLKWFGVEGDYNVMVIDLLGPSLEDLFNYCNRKLSLKTVLMLADQLINRVEYMHSRGFLHRDIKPDNFLMGLGRKANQPYPVGCLCMTSHLYFEVVSVVIQDYDQRFLSHYGYM

SEQ ID NO: 142945 - protein, 34 aa, Glycine max
  Coding DNA Sequence Number=SeqID_26167
  Homolog annotation: Hit_ID=P61430; Match level="QueryCoverage=77%, HitCoverage=3%, E-value=6e-08, Identity=88%"; Hit description =Synaptonemal complex protein 2
MSIKGGGHPHPSNIGDLFSEGSLNPYAEDPYAFD

SEQ ID NO: 142946 - protein, 249 aa, Glycine max
  Coding DNA Sequence Number=SeqID_26168
  Gene Ontology: Mol. function=protein serine/threonine kinase activity; Cellular component=phragmoplast; Biological process =protein amino acid phosphorylation
  Homolog annotation: Hit_ID=Q53VE2; Match level="QueryCoverage=98%, HitCoverage=43%, E-value=1e-114, Identity=86%"; Hit description =Ser/Thr protein kinase
  Pfam annotation: Domain name=Pkinase; Domain location=127-247; Score=- 67.0; E_value=0.00014; Accession=PF00069.15; Description=Protein kinase domain
  Pfam annotation: Domain name=Pkinase_Tyr; Domain location=127-247; Score=-175.1; E_value=0.1; Accession=PF07714.7; Description=Protein tyrosine kinase
  Pfam module annotation: Pfam domain module=Pkinase::Pkinase_Tyr; Domain location=127-247::127-247
MDRCWFNKFKPKDKTPSSKNKETGIAKGSKPPTNDEAPSNVTKQKVAAAKQYIENHYKKQMQDLQERKERLCARNFSRWKLLRNMLEKKLADAEVSEEEQNNLLKYFEKKEREYMRLKRHKMGADDFEPLTMIGKGAFGEVRVCREKATGHVYAMKKLKKSEMLRRGQVEHVKAERNLLAEVDSNCIVKLYYSFQDEEYLYLIMEYLPGGDMMTLLMRKDILTENEARFYVGETVLAIESIHKHNYIHR

SEQ ID NO: 142947 - protein, 207 aa, Glycine max
  Coding DNA Sequence Number=SeqID_26169
MEVTTLEMTTLEKTTLGKTLPTAIKNGFRCIFCNLVFITLLALMAHFASVHFVENPAISSLYLSNHVNLQREMILSPLHPNFPRLMVTQETRISVNNMVRVFRAPPEQPMAMPQPRANLIPYATQSMVATSQPFQGPGPSQSMLSASNNVAERAQLFAPPIHHREMEVSPIDETQPYISLLDIPINNNELFNRSIINGDNLDLELRL

SEQ ID NO: 142948 - protein, 81 aa, Glycine max
  Coding DNA Sequence Number=SeqID_26170
MWALNCCIVRPPRNFRKHLRAWLMHAHNSFQILPPQLKISESVKFELHGEDQIKEDREEEETKVGTLKTNQYVKSVVNPVT

SEQ ID NO: 142949 - protein, 45 aa, Glycine max
  Coding DNA Sequence Number=SeqID_26171
MENGEDNVTGKRCPKQREKVRVRDQRGLIEKEAVFWTLGLLWKWK

SEQ ID NO: 142950 - protein, 354 aa, Glycine max
  Coding DNA Sequence Number=SeqID_26172
  Gene Ontology: Mol. function=isomerase activity; Cellular component =periplasmic space; Biological process=carbohydrate metabolic process
  Homolog annotation: Hit_ID=Q1SSI6; Match level="QueryCoverage=97%, HitCoverage=95%, E-value=1e-169, Identity=83%"; Hit description =Galactose mutarotase-like
  Pfam annotation: Domain name=Aldose_epim; Domain location=18-343; Score=396.3; E_value=4.4e-116; Accession=PF01263.10; Description =Aldose 1-epimerase
SSSGFVNCSDVEKEEKIGIFELKKGDLSLRVTNWGASILSLVIPDKNGKLGDVVLGYDSVKDYSVSLLSTTVGRVANRIGGAQFTLNGIYYKLVANEGNNTLHGGARGFSDVLWKVKRYQKEGPSPSITFRYHSVDGEQGFPGDLLVTVSYILTGKNQLVILMKGKALNKPTPVNLANHAYWNLGGHNSGNILNEVVQIFGSKITPVDNKLIPTGKFASVKGTAYDFLKPQTVGSRINQLAGTKGYDINYVIDGEKGQKIKLAAIVQDKKSGRVLELFTNAPGLQFYTGNYIKDLKGKGGYVYNAHAGLCLESQAFPDSVNHPNFPSTIVTQEKPYKHYMLFKFSTKNPYISSK

SEQ ID NO: 142951 - protein, 170 aa, Glycine max
  Coding DNA Sequence Number=SeqID_26173
  Gene Ontology: Mol. function=protein-tyrosine kinase activity; Cellular component=integral to membrane; Biological process=protein amino acid phosphorylation
  Homolog annotation: Hit_ID=Q1SSI5; Match level="QueryCoverage=67%, HitCoverage=28%, E-value=1e-39, Identity=55%"; Hit description =Tyrosine protein kinase, active site
  Pfam annotation: Domain name=LRR_1; Domain location=105-127; Score =10.0; E_value=3.9; Accession=PF00560.23; Description=Leucine Rich Repeat
  Pfam annotation: Domain name=LRR_1; Domain location=129-151; Score =16.2; E_value=0.12; Accession=PF00560.23; Description=Leucine Rich Repeat
  Pfam annotation: Domain name=LRR_1; Domain location=153-167; Score =5.0; E_value=33; Accession=PF00560.23; Description=Leucine Rich Repeat
  Pfam module annotation: Pfam domain module=LRR_1::LRR_1::LRR_1; Domain location=105-127::129-151::153-167
MAMPFPNYMVVGAWYILLVISWNCFSISIASNAASKSESSLLEAEAHVLLESEWWPSNYTNHVSSRCQWAGITCNNAGSITNITLPDELQLGNKLWRFNFSCFQNLVHLNLAALGISGSIPYGFGTLSKLTYLDLSFNDIMGTIPSDIWNLRNLVTLNLARNKLSGLIPP

SEQ ID NO: 142952 - protein, 103 aa, Glycine max
  Coding DNA Sequence Number=SeqID_26174
  Subcellular localization annotation: CTP_CleavageSite=61; ConfidenceScore=5.04e-01
MRLHCHQASWRPNMTTDRPPLLMAHIDPGIGPNISMCARVPSGVTNCRNLPFGRGTKRSLRWAKANNAPMRGVSTCFLGIDLFGVSGLSSSFSRKLLKIKDED

SEQ ID NO: 142953 - protein, 108 aa, Glycine max
  Coding DNA Sequence Number=SeqID_26175
MGEIEEVQERMKADMEAMKKQMITMMEAMMSTKKITEVNVAAVAATSAVAQVDPTPLSGLNQINHPTSNMVGQEGKELGSAGSPHFVQVQNEHPFPPYGLPPNYMPPN

SEQ ID NO: 142954 - protein, 473 aa, Glycine max
  Coding DNA Sequence Number=SeqID_26176
  Homolog annotation: Hit_ID=O04237; Match level="QueryCoverage=33%, HitCoverage=46%, E-value=3e-39, Identity=50%"; Hit description =Transcription factor
  Pfam annotation: Domain name=HABP4_PAI-RBP1; Domain location=40-148; Score=166.2; E_value=8.1e-47; Accession=PF04774.5; Description =Hyaluronan  mRNA binding family
RVAGIKTRLWWTRGPYRGGSSRHGRRGGFSNGEAGDEGCPRRAFKRHSGTGRGNEFKREGFGRGNWGTQNEDIAEVIEEVVNETEKILADEKPVGEEDAAEGNKDSPANENEEKEPEDKEMTLEEYEKVLEEKRKALQAQKTEARKVDIKEFASMQPLACLKLAGNSAAYSSLKPCEKTICTAPFLKASSGFAATEPFCILNTRRYGCEVYNLGTGKGTSVLEMVNAFEQASGKAECDAKVRGVTVMSSEQDRVRADVLELVAEQKELAAQLHAVESEIAKASMEAQFVPTMKADIEAMHHEIQRGSPHLLFPFLLLVSFAFPLSQCPHFFKLNVLGFPSFSQSLHFPAAQEEPFLAAQSIGAKSMMKFESGYSVEIVFDGSELGIEPYAVELLNEAEVAAVAEEKETHSFEIDPSQALYVMNPNKFRACEFLINFHERTCGDKIIVFADNLFALTEYAMKLRKPMIYGVTRC

SEQ ID NO: 142955 - protein, 367 aa, Glycine max
  Coding DNA Sequence Number=SeqID_26177
  Gene Ontology: Mol. function=electron carrier activity; Biological process=electron transport
  Homolog annotation: Hit_ID=Q01UL0; Match level="QueryCoverage=98%, HitCoverage=76%, E-value=9e-49, Identity=30%"; Hit description =Pyrrolo-quinoline quinone precursor
  Pfam annotation: Domain name=PQQ; Domain location=269-306; Score =12.6; E_value=0.29; Accession=PF01011.11; Description=PQQ enzyme repeat
  Pfam annotation: Domain name=PQQ; Domain location=34-71; Score=9.4; E_ value=0.8; Accession=PF01011.11; Description=PQQ enzyme repeat
  Pfam annotation: Domain name=PQQ; Domain location=91-129; Score=14.8; E_value=0.14; Accession=PF01011.11; Description=PQQ enzyme repeat
  Pfam module annotation: Pfam domain module=PQQ::PQQ::PQQ; Domain location=269-306::34-71::91-129
MEHKISVETFSNLSLKWEFYAGKDITATPAIFDGTLYFPCWNGDIFAVRAKYGSLVWKQNLGNLTGLSATGFVAGVNWTVARATPTIAEDDLLIVGIYGPAVVIAVKRSTGDLVWETRLDSHNSSVVTMSGTYLRGFSKLDIESGAILWQTYMIPDNHGEKGEYSGAAVWGSSPPIDASRNHIYIATGNLYTAPLDILECQEKENNVTQPTHPDDIKWYHPLGGFDVWFVSCLNLSIPSINCPPGPSPDADFGEAPMMLTIDINGTKQDVVVAVQKSGFAWPLHRDDGKLIWSTETGRGGITGGGTWGAATDKERVYTNIANSEGKNFTLRPSKKTTTSGGWVAMEACSGKILWSTANPSNAKANGP

SEQ ID NO: 142956 - protein, 66 aa, Glycine max
  Coding DNA Sequence Number=SeqID_26178
  Homolog annotation: Hit_ID=Q2QYC5; Match level="QueryCoverage=68%, HitCoverage=38%, E-value=8e-11, Identity=65%"; Hit description=ZF-HD protein dimerisation region containing protein
MSSSSTTGTRSRMRRTATCRTSHGCAGPFSSIGHELAAAIHNMSSNSTCKIPAALTIFHVLHNRHW

SEQ ID NO: 142957 - protein, 82 aa, Glycine max
  Coding DNA Sequence Number=SeqID_26179
  Gene Ontology: Mol. function=DNA binding; Cellular component=nucleus; Biological process=regulation of transcription
  Homolog annotation: Hit_ID=Q2QYC5; Match level="QueryCoverage=65%, HitCoverage=45%, E-value=5e-15, Identity=64%"; Hit description=ZF-HD protein dimerisation region containing protein
  Pfam annotation: Domain name=ZF-HD_dimer; Domain location=23-82; Score=91.6; E_value=2.4e-24; Accession=PF04770.3; Description=ZF-HD protein dimerisation region
MWRVILHSDGTVRCWNNSPVTIVKHVKYRECCRNLACRIGGHIVDRCSEFVAYGAEGTSAAMTCATCGCHRNFHRKEEQIQL

SEQ ID NO: 142958 - protein, 139 aa, Glycine max
  Coding DNA Sequence Number=SeqID_26180
MGPYKLVAIATALTPLIKLFEQPFRFPPEQLDGLTELSCEAHVFGQDLHMKTVFEQPPPQFNEFVTSVSEKMLIHSQACRVLGLKALYMPGFRKTLMVGQMKLTNDAHVLRQRASHIDNSSVASYVIYVNPTKTMFYYK

SEQ ID NO: 142959 - protein, 85 aa, Glycine max
  Coding DNA Sequence Number=SeqID_26181
  Gene Ontology: Mol. function=sequence-specific DNA binding; Cellular component=nucleus; Biological process=response to brassinosteroid stimulus
  Homolog annotation: Hit_ID=Q2QYC5; Match level="QueryCoverage=68%, HitCoverage=53%, E-value=2e-15, Identity=56%"; Hit description=ZF-HD protein dimerisation region containing protein
  Pfam annotation: Domain name=ZF-HD_dimer; Domain location=17-75; Score=88.9; E_value=1.6e-23; Accession=PF04770.3; Description=ZF-HD protein dimerisation region
GLKDSLYHEEMPAQFLVTNVKYHECRWNHACRDGGYILDGCREFVASGAEGTDSAMTCATCGCHRNYHRREDFCDCPSHPAANGA

SEQ ID NO: 142960 - protein, 466 aa, Glycine max
  Coding DNA Sequence Number=SeqID_26182
  Gene Ontology: Mol. function=electron carrier activity; Cellular component=outer membrane-bounded periplasmic space; Biological process=electron transport
  Homolog annotation: Hit_ID=Q01UL0; Match level="QueryCoverage=98%, HitCoverage=85%, E-value=1e-88, Identity=39%"; Hit description =Pyrrolo-quinoline quinone precursor
  Pfam annotation: Domain name=PQQ; Domain location=147-185; Score =13.8; E_value=0.2; Accession=PF01011.11; Description=PQQ enzyme repeat
  Pfam annotation: Domain name=PQQ; Domain location=243-275; Score =10.6; E_value=0.56; Accession=PF01011.11; Description=PQQ enzyme repeat
  Pfam annotation: Domain name=PQQ; Domain location=31-68; Score=25.1; E_value=0.00025; Accession=PF01011.11; Description=PQQ enzyme repeat
  Pfam annotation: Domain name=PQQ; Domain location=311-348; Score =13.6; E_value=0.21; Accession=PF01011.11; Description=PQQ enzyme repeat
  Pfam annotation: Domain name=PQQ; Domain location=376-410; Score=6.6; E_value=1.9; Accession=PF01011.11; Description=PQQ enzyme repeat
  Pfam annotation: Domain name=PQQ; Domain location=415-454; Score =36.4; E_value=9.6e-08; Accession=PF01011.11; Description=PQQ enzyme repeat
  Pfam annotation: Domain name=PQQ; Domain location=88-126; Score=11.9; E_value=0.36; Accession=PF01011.11; Description=PQQ enzyme repeat
  Pfam module annotation: Pfam domain module=PQQ::PQQ::PQQ::PQQ::PQQ::PQ Q::PQQ; Domain location=147-185::243-275::31-68::311-348::376 -410::415-454::88-126
MISPKTAPNLRLKWKFNAGKDISATPAIYGGTVYFPSWNGYIYAVKEADGSLVWKQNLENLTGLSATGFVRNVNWTVSRSTPTVAGDDSLLIGIYGPAVVICVNRTTGELVWKTTLDHHPAAVITMSGTYYKGDFYVGISSLEITVPTVEECCTFRGSFTKLNARTGRMRWKTYMLPDNNNRTGEYAGASIWGSSPSIDVERNHVYTATGNLYSAPLRIRQCRERQINRTQPTQPGDECVEPDNHSDSMLALDLDSGKMKWYRQLGGLDIWTIACINPSTPNCPPQAERPDVDFGQSPMMLTTYINRTKQDIVVAVQKSGIAWALYRNNGNILWSTNAGPYGLSGGGIWGAATDVKRVYTNIANTGARNFTLAPSNVTTTAGGWVAMDASNGRILWSTANPSNRTANGPVSVANGVVFAGSADRMGSVYAIDAMNGKILWSYQTGASVYGGMSISKGCIFVGHGYG

SEQ ID NO: 142961 - protein, 500 aa, Glycine max
  Coding DNA Sequence Number=SeqID_26183
  Gene Ontology: Mol. function=electron carrier activity; Biological process=electron transport
  Homolog annotation: Hit_ID=Q01UL0; Match level="QueryCoverage=92%, HitCoverage=90%, E-value=3e-60, Identity=31%"; Hit description =Pyrrolo-quinoline quinone precursor
  Pfam annotation: Domain name=PQQ; Domain location=119-157; Score =14.6; E_value=0.15; Accession=PF01011.11; Description=PQQ enzyme repeat
  Pfam annotation: Domain name=PQQ; Domain location=254-286; Score=3.1; E_value=6; Accession=PF01011.11; Description=PQQ enzyme repeat
  Pfam annotation: Domain name=PQQ; Domain location=322-359; Score =23.9; E_value=0.00056; Accession=PF01011.11; Description=PQQ enzyme repeat
  Pfam annotation: Domain name=PQQ; Domain location=387-421; Score=2.6; E_value=7; Accession=PF01011.11; Description=PQQ enzyme repeat
  Pfam annotation: Domain name=PQQ; Domain location=422-461; Score =32.1; E_value=1.9e-06; Accession=PF01011.11; Description=PQQ enzyme repeat
  Pfam annotation: Domain name=PQQ; Domain location=62-99; Score=15.9; E_value=0.1; Accession=PF01011.11; Description=PQQ enzyme repeat
  Pfam module annotation: Pfam domain module=PQQ::PQQ::PQQ::PQQ::PQQ::PQ Q; Domain location=119-157::254-286::322-359::387-421::422-461::62-99
MIPPKYNMLLALRLLLLCVHVVIVFAASSNHKISPRTAPKLRLKWKFYAGKDITATPAIYGGALYFPSWNGYIYAVKEADGSLIWMKNLLMLTGLNATDGVVPNVNSTVSRSTPTVAGDLLIFGTYSPAAIIALKIKTGELVWKITLDDHPEALITMSGTYYNGGYYVGISSLEALVPIERCCTFRGKLYNNNRRGEYAGAAIWGSSPSIDVKRNHVYIGTGNLYSAPLHIRQCRERQNNRTEPTQPDECIEPDNHSNSILALDLDSGKIRWYRQCGGFDIFFLACINASAPNCPPRGLWQDADFGEAPMMLTIYINRTKKDVVVAVQKSGYAWALDRNNGNLMWFTPAGPGGITGGGTWGAATDERRVYTNIANSEAKNFTLAPSNMTTTAGGWVAMNASNGRVLWSTANPTNGPVSVANEVVIAGSTDRMGSIYAFDANNGKILWTYKTGATVYGGMSINNGCIYVGHGYNVFVSSLINNFTGGASLFAFYTVKNLRG

SEQ ID NO: 142962 - protein, 87 aa, Glycine max
  Coding DNA Sequence Number=SeqID_26184
MGEGSDIRDDNVCSGNDVCKDHKVKCEDRRKRKNVTNVLRELEEGCDIRIGKLRQMMDAMVVEKHVESILSEGKDYFELNIEDKGLK

SEQ ID NO: 142963 - protein, 76 aa, Glycine max
  Coding DNA Sequence Number=SeqID_26185
MEATQRKRSKREDDFVEAATQRRLKGRFGRFKNKKVETMGEGGDVRDDNVWSDIDICNDGKAKCEDQRKWKKVTNV

SEQ ID NO: 142964 - protein, 64 aa, Glycine max
  Coding DNA Sequence Number=SeqID_26186
  Subcellular localization annotation: CTP_CleavageSite=20; ConfidenceScore=5.12e-01
MVQLSAHRCAKPNIFTKALSAAATLSPKCLLEVTTSSWAYREARLSASVKLKRHVGTLSAPYEF

SEQ ID NO: 142965 - protein, 358 aa, Glycine max
  Coding DNA Sequence Number=SeqID_26187
  Gene Ontology: Mol. function=electron carrier activity; Biological process=electron transport
  Homolog annotation: Hit_ID=Q01UL0; Match level="QueryCoverage=96%, HitCoverage=64%, E-value=4e-49, Identity=35%"; Hit description =Pyrrolo-quinoline quinone precursor
  Pfam annotation: Domain name=PQQ; Domain location=117-148; Score =10.7; E_value=0.54; Accession=PF01011.11; Description=PQQ enzyme repeat
  Pfam annotation: Domain name=PQQ; Domain location=184-221; Score =29.6; E_value=1.1e-05; Accession=PF01011.11; Description=PQQ enzyme repeat
  Pfam annotation: Domain name=PQQ; Domain location=249-283; Score=9.4; E_value=0.8; Accession=PF01011.11; Description=PQQ enzyme repeat
  Pfam annotation: Domain name=PQQ; Domain location=288-327; Score =35.7; E_value=1.6e-07; Accession=PF01011.11; Description=PQQ enzyme repeat
  Pfam module annotation: Pfam domain module=PQQ::PQQ::PQQ::PQQ; Domain location=117-148::184-221::249-283::288-327
MSGTYYKGYYYVGISSQESLLPKEQCCISRGSFVKLSARSGETLWRTYMLPDNNNRRGEYAGAAIWGSSPSIDVKRNHVYIATGNLYSAPLHILQCRERQNNRTEPTQPDECIEPENHSNSILALDLDSGKIIWYCQLGGYDVWTLDCNNASTPNCPPRGLRQDADFGEAPMMLTTYINQTKKDIVVAVQKSGYAWALDRNNGNIIWSTEAGPGGLTGGGTWGAATDGKTVYTNIVNSDAKNFTLAPSNVITTAGGWVAMDARNGRVLWSTANPSNSTANGPVSVANEVVFAGSADRLGYIYAIDAKSGKILWSYKTGASVYGGMSISNGCIYVGHGYSVGLVFSYTGGTKLFAFCIV

SEQ ID NO: 142966 - protein, 512 aa, Glycine max
  Coding DNA Sequence Number=SeqID_26188
  Gene Ontology: Mol. function=electron carrier activity; Cellular component=outer membrane-bounded periplasmic space; Biological process=electron transport
  Homolog annotation: Hit_ID=Q01UL0; Match level="QueryCoverage=97%, HitCoverage=94%, E-value=1e-82, Identity=35%"; Hit description =Pyrrolo-quinoline quinone precursor
  Pfam annotation: Domain name=PQQ; Domain location=114-152; Score =12.9; E_value=0.27; Accession=PF01011.11; Description=PQQ enzyme repeat
  Pfam annotation: Domain name=PQQ; Domain location=175-210; Score=5.7; E_value=2.6; Accession=PF01011.11; Description=PQQ enzyme repeat
  Pfam annotation: Domain name=PQQ; Domain location=268-299; Score =11.2; E_value=0.45; Accession=PF01011.11; Description=PQQ enzyme repeat
  Pfam annotation: Domain name=PQQ; Domain location=335-372; Score =33.3; E_value=8.8e-07; Accession=PF01011.11; Description=PQQ enzyme repeat
  Pfam annotation: Domain name=PQQ; Domain location=400-434; Score=3.5; E_value=5.3; Accession=PF01011.11; Description=PQQ enzyme repeat
  Pfam annotation: Domain name=PQQ; Domain location=439-478; Score =38.7; E_value=2.1e-08; Accession=PF01011.11; Description=PQQ enzyme repeat
  Pfam annotation: Domain name=PQQ; Domain location=58-95; Score=20.6; E_value=0.0055; Accession=PF01011.11; Description=PQQ enzyme repeat
  Pfam module annotation: Pfam domain module=PQQ::PQQ::PQQ::PQQ::PQQ::PQ Q::PQQ; Domain location=114-152::175-210::268-299::335-372::400 -434::439-478::58-95
MGHGHKSQDWLNHGGDLFNRRYAYKEHKISPKTAPNLRLKWKFNAGKDISATPAIYDGTLYFPSWNGNIYAVKEADGSLVWKQNLQNLTGINATGYVTTVNWTVSRSTPTVAGDRLIIGVYGPCILIAVKRTTGELVWKTTLDNHPAAIITMSGTYYNRHLYIGISSVEYFAPFEQCCTFRGSFVKLNARSGAILWKTFMLPDNNNTRGEYAGASVWGSSPSIDVKRNHVYIATGNLYSAPLRIRQCRERQINGTEPTQPDACVEPENHSDSMLALDLDSGKIKWYRQLGGVDIWLFDCVDPSTPNCPPQGINPDADFAEAPMMLTTYVNRTKKDIVVAGQKSGIVWALDRNNGNLVWSKQAGPGGVTGGATWGASTDERRVYTNIANSEARNFTLAPSNITTTAGGWVAMNASNGRVLWSIANPSNSTAHGPVSVANDVVFAGSTDRNGSIFAIDAKSGKILWSYQTGASVYGGMSISNGCIYVGHGYSVWGPDLFNFSGGIWLFGFCVEF

SEQ ID NO: 142967 - protein, 438 aa, Glycine max
  Coding DNA Sequence Number=SeqID_26189
  Gene Ontology: Mol. function=zinc ion binding
  Homolog annotation: Hit_ID=Q7XI08; Match level="QueryCoverage=99%, HitCoverage=100%, E-value=3e-89, Identity=39%"; Hit description =Auxin-regulated protein-like protein
  Pfam annotation: Domain name=Ank; Domain location=39-72; Score=15.1; E_value=0.2; Accession=PF00023.20; Description=Ankyrin repeat
  Pfam annotation: Domain name=Ank; Domain location=75-107; Score=34.3; E_value=4.2e-07; Accession=PF00023.20; Description=Ankyrin repeat
  Pfam annotation: Domain name=zf-C3HC4; Domain location=387-425; Score= 17.5; E_value=0.0024; Accession=PF00097.15; Description=Zinc finger, C3HC4 type (RING finger)
  Pfam module annotation: Pfam domain module=Ank::Ank::zf-C3HC4; Domain location=39-72::75-107::387-425
MGQGQSKDELLYQQVSYGNAEGIKTLHREGAGLEWRDKDAKTPLIVACMNPQLYNVAKTLIELGANVNAFRPGRHGGTPLHHAAKRDFDSIVNLLLLHGANPLVLNDDCLTALEVARAKGHSNVVRTIESSMLVLRLVARVSWSWVSRSSSSSVGIKESVVGSRTLAKPYKLELAIYSRLQDAQPHTVIGLWNADLQEPKLHQSDPSVTVVNHTTSTLLYCALSPCSFSFPASPAFLQNNVPTGPPTAPPDAEDTELAMAISASLQSAMQERPPFPDTQPSFDASSSSSAVNTDNHGFLGTPNPNTSDSELVQEANPDGNTQHLQSCVNPSALDLNPSAPPITNEIPGDGPIQYPSIDLSPVDMASPDAEKLLKEGEKSAGGSSSSCVICLDAPAEGACIPCGHVAGCMSCLNEVKSKKWGCPVCRAKIDQVIKLYHV

SEQ ID NO: 142968 - protein, 164 aa, Glycine max
  Coding DNA Sequence Number=SeqID_26190
MSRLRVGKKLEPAKKTWKSISKKVQSKVHKLNIPKSIEATFKHLLAILHSLHHLITSRGRRRRSLPSNNYHVHHCKKNMSAIRIDNLFTEPSSVHAHDQGKTSRGKEVIIDSSMDTIEDAWKALVAKTPELHVDQKVEEFIAKFREEMRLQKERSLQEFLEMLA

SEQ ID NO: 142969 - protein, 205 aa, Glycine max
  Coding DNA Sequence Number=SeqID_26191
  Gene Ontology: Mol. function=molybdate-transporting ATPase activity; Cellular component=1-2nm peptidoglycan-based cell wall; Biological process=molybdate ion transport
  Homolog annotation: Hit_ID=Q8ZGX6; Match level="QueryCoverage=99%, HitCoverage=63%, E-value=4e-84, Identity=83%"; Hit description =Molybdenum import ATP-binding protein modC
  Pfam annotation: Domain name=ABC_tran; Domain location=24-164; Score =8.2; E_value=3.2e-08; Accession=PF00005.17; Description=ABC transporter
MLELDFSQQLGDLNLNVRADLPAQGITAIFGLSGAGKTSLINAIGGLTRLQQGRIALNGRTLVDTAAGLCLPPEKRRIGYVFQDARLFPHYRVRGNLQYGMAAGMRAQFNTIVELLGIGPLLNRLPLTLSGAAGLARSAAQTRAAAVSGAVGAGRQHPHPLRQPQPGRDPTPGRAGDGAGSRRGARVWRAGSCLGQQRAAAVAAA

SEQ ID NO: 142970 - protein, 115 aa, Glycine max
  Coding DNA Sequence Number=SeqID_26192
MKVDMEAMKDQMATMMEAMLSTNKIMEVNAAAVVATSATVEVDPTHPSFFNQVNPPVSNIVGQGSEALGSMGGPHFVQFLNKHSFPPYGLPPNNTPPNVAHAPNENVNNSISHTH

SEQ ID NO: 142971 - protein, 408 aa, Glycine max
  Coding DNA Sequence Number=SeqID_26193
  Gene Ontology: Mol. function=DNA binding; Cellular component =mitochondrion; Biological process=metabolic process
  Homolog annotation: Hit_ID=Q2HUF5; Match level="QueryCoverage=96%, HitCoverage=80%, E-value=1e-104, Identity=50%"; Hit description =Tetratricopeptide-like helical
  Pfam annotation: Domain name=PPR; Domain location=118-152; Score =16.9; E_value=0.072; Accession=PF01535.11; Description=PPR repeat
  Pfam annotation: Domain name=PPR; Domain location=154-188; Score=2.1; E_value=4.3; Accession=PF01535.11; Description=PPR repeat
  Pfam annotation: Domain name=PPR; Domain location=224-258; Score =11.8; E_value=0.3; Accession=PF01535.11; Description=PPR repeat
  Pfam annotation: Domain name=PPR; Domain location=259-293; Score =24.6; E_value=0.00035; Accession=PF01535.11; Description=PPR repeat
  Pfam annotation: Domain name=PPR; Domain location=294-327; Score=3.7; E_value=2.8; Accession=PF01535.11; Description=PPR repeat
  Pfam annotation: Domain name=PPR; Domain location=49-82; Score=16.6; E_value=0.081; Accession=PF01535.11; Description=PPR repeat
  Pfam annotation: Domain name=PPR; Domain location=83-117; Score=26.3; E_value=0.00011; Accession=PF01535.11; Description=PPR repeat
  Pfam module annotation: Pfam domain module=PPR::PPR::PPR::PPR::PPR::PP R::PPR; Domain location=118-152::154-188::224-258::259-293::294 -327::49-82::83-117
MVSEWMSSKGLPISSRDQAVQLDLIGRVHGVESAERYLQSLSDGDKTWKVHGALLNCYVREGLVDKSLSLMQKMKDMGFVSFLNYNNIMSLYTQTQQYEKVPGVLEQMKKDGVPPNIFSYRICINSYCVRGDLANVEKLLEEMEREPHIGIDWITYSMVTNFYIKADMREKALVCLMKCEKKTHRGNTVAYNHLISHNAALRSKGGMMRAWKLQKANCKKQLNREYITMLGCLVKLGELDKAEKVLGEWELSGNTCDFRVPNILLIGYCQRGLVEKAEALLRKMVAEGKTPIPNSWSIVASGYVAKENMEKAFQCMKEAVAVHAQNKRWRPKVDVISSIFSWVTNNRDIEEAEDFVNSWKSVNAMNRGMYLSLMKMCIRYGKHVDGILESMKADNIEIDEEIKETLNS

SEQ ID NO: 142972 - protein, 257 aa, Glycine max
  Coding DNA Sequence Number=SeqID_26194
  Gene Ontology: Cellular component=extracellular region; Biological process=cellulose and pectin-containing cell wall organization and biogenesis
  Homolog annotation: Hit_ID=Q8LKJ9; Match level="QueryCoverage=99%, HitCoverage=100%, E-value=1e-115, Identity=73%"; Hit description =Alpha-expansin precursor
  Pfam annotation: Domain name=DPBB_1; Domain location=68-152; Score =135.5; E_value=1.5e-37; Accession=PF03330.8; Description=Rare lipoprotein A (RlpA)-like double
  Pfam annotation: Domain name=Pollen_allerg_1; Domain location=163 -241; Score=146.4; E_value=7.6e-41; Accession=PF01357.11; Description= Pollen allergen
  Pfam module annotation: Pfam domain module=DPBB_1::Pollen_allerg_1; Domain location=68-152::163-241
MGPLVISSSFLWYLSFVLSAAVRVVHVQANYGWLNAHATFYGANQNPTTLGGACGYDDTFHAGFGVNTAAVSTMLFRDGEVCGACYQVMCDFRADPKWCLISRGVTVTATNFCPPNNHGGWCDPPYHHFDMSMPAFFRIARQGNEGIVPVLYRRVTCKRRGGVRFTLKGQSNFNMVMISNVGGSGDVKAVWIRGSRSGAWLPMHRNWGANWQSSADLRNQRLSFKMTLVDGKTLVFLNVVPSTWSFGQTFSSKSQFF

SEQ ID NO: 142973 - protein, 181 aa, Glycine max
  Coding DNA Sequence Number=SeqID_26195
MKLASTVVKVLTIKISIPWIMGSNQAHAFKERFIKSRKECALRCLYRTCAKARVMSEIKEVQEQMKADMEAMKEKMTTMMEAMMSMRKMMEVNTTIVVAATEVDPTHPSGPNQVNPPVLNMVGQGGEALGSTGGPHFVQVQNKHSFSPYGLPPNYTPPNVAFTPNENVDNSAPIPTKSQQP

SEQ ID NO: 142974 - protein, 79 aa, Glycine max
  Coding DNA Sequence Number=SeqID_26196
MEEIELRHWGRGDVSFPFEFLKGVENFLHLSDDKWFVFKHDNVEAEKVVETMKFKSWIWLSSKLGSFRYSVHEWSNFFT

SEQ ID NO: 142975 - protein, 81 aa, Glycine max
  Coding DNA Sequence Number=SeqID_26197
  Subcellular localization annotation: CTP_CleavageSite=57; ConfidenceScore=5.06e-01
MSPLYPYPYQSGTSSDAYFMGTQPPLQPGYVMADLFGSPSPAGTPSFAHGCQISMPNAPMDPPWSVSRNISNITDLLGVDL

SEQ ID NO: 142976 - protein, 103 aa, Glycine max
  Coding DNA Sequence Number=SeqID_26198
MKHDQFLWMPYLLYVQTMPPQAFNDSHIWTALVHYAVVVYNRQTRQEKVLVRQHVQGLLHQTPKYLQWYHINSVQPRNITPQPNNNGPYDMLNEDLEAHHHQQ

SEQ ID NO: 142977 - protein, 85 aa, Glycine max
  Coding DNA Sequence Number=SeqID_26199
MAKIQGLKEGKNYSNIYKEELTQPWPMGSEIYPEMEELERVQSVVKLVAQILSLDVSQSQAEIDIATTLNDMDSIEREALEKAIL

SEQ ID NO: 142978 - protein, 119 aa, Glycine max
  Coding DNA Sequence Number=SeqID_26200
  Subcellular localization annotation: CTP_CleavageSite=28; ConfidenceScore=5.49e-01
FVFFFLPHSISAIPSLHHNGGTMKVKVRCSMLVRGGCGDCAKRKCKWSRLQVRLSFARLRGCECVVAAATVKCVIVIMLKESHSFAYLDVANPMTLDLIGLLFEFTFLLPSLEKWNIIS

SEQ ID NO: 142979 - protein, 125 aa, Glycine max
  Coding DNA Sequence Number=SeqID_26201
MVSKDTKFLSGRHDTKSRKKIDIGTHSSFRDTTIRYGKGQSLQALEGRFFRCILLVQASGKVKRLSLLKFLSLLPWIYNSCWFSYVPSMLMQSYPPRVLDRRLQEDWARAAKEGPRVLMNLKVDL

SEQ ID NO: 142980 - protein, 83 aa, Glycine max
  Coding DNA Sequence Number=SeqID_26202
MDTFVDLNRKTLSAHGRNPSSVWNISDPSLSCSLLLLIVGYCFGVRIWWVEEKWALEFRKSSFMGDGFECSVQEKHYAIEEGL

SEQ ID NO: 142981 - protein, 55 aa, Glycine max
  Coding DNA Sequence Number=SeqID_26203
MEDEFFLDIMGVMDEKVVRIKIVMNILVGEHNQFLQSVMLKADKHWEMMTTPTTI

SEQ ID NO: 142982 - protein, 75 aa, Glycine max
  Coding DNA Sequence Number=SeqID_26204
MVETNACPDNYLDGYMEAPGWSINNPRDFLKTRRHSLKKNVTTKKMSFNIVLFNISYLKIDVVKHLQHRFSNNRC

SEQ ID NO: 142983 - protein, 580 aa, Glycine max
  Coding DNA Sequence Number=SeqID_26205
  Gene Ontology: Mol. function=RNA-directed DNA polymerase activity; Cellular component=nucleus; Biological process=RNA-dependent DNA replication
MLQKTDGTLLENQSEIEDEIMDFYKKLMGTEDSQLHRIDIDAMRNGKQVNMEQRRYLRALEGIGDDKSPGIDGFRAKFFKASWCIVKEDVIASILEFFNIGRLYRGFNNTVVTLIPKGDNARYVKDYRPIAGCTTVYKIIAKIITERLRKILPSIISHSQAAFVPGQNIHNHILLAYELLNGYGRKGGGPWNGDSKSVSMMMETIRKFSDSTGLKVNPAKCQMFFGGMDGCSKENLRRITDFAEGKLPVRYLGVPLSCKRLTIQQYMPLIDKIVDRVKHWTSKLLSYAGRIQLVKSITSAIAMYWMQCFPLPQFILRKINAICRSFVWTGKQEISKKSLVAWDTMCRNKSQGGVGIINLQGNDAITAFVRPNSSWILKNIMKQRDKLGQIQQHWDQALSRQKFPMSAMYHGLTEEHQRVSWRSVMCGNKARPRAVICLWLACHKKLSTKDRLRRFGMIQSSDCSICNCADESINHLFFNCSGTREIWGNILDWLGRRHDPREWDMELAWIIENTKGKDWKSALLKMATAETVYNVWHYRNSMCFGTVVDKQVIERNIIDNIVYRSWQYPTLRSHVAKLMM

SEQ ID NO: 142984 - protein, 382 aa, Glycine max
  Coding DNA Sequence Number=SeqID_26206
  Gene Ontology: Mol. function=nucleic acid binding; Biological process= RNA-dependent DNA replication
  Homolog annotation: Hit_ID=Q2HRL0; Match level="QueryCoverage=35%, HitCoverage=27%, E-value=2e-33, Identity=41%"; Hit description=RNA -processing protein, HAT helix
MAKRGRGRPPNTVPPPPVNHPQPATNLVVETENHELQKHEETIEEFEATTKSPETLIEEPKEVTDRKLWVDVLNNNRNPSNGVTMEFVAPKLINGEVEVEIEAEDIASELQFWENAMILYVLGGSLSMTMLKNYMVKMWNFVTLPDMLYHDDGYFLLHFKNREDRETVMMRGPYTIRHMPIILKEWTPDFNLSKDLERTMPIWVKLPQLPLCLWGLKSLNKIGSAIGNPLMTDECTTQKLRVSYARILVEVDITQKLVEEITISDRTGGKIKQIVEYEWKPEFCEKCQKAGHQCGKKKVVKKWIPRNKQADEVKADPLPKTPVQNTETEGEDKPEGWITVGKAARHIGKAIEVIGTSNVDCSNGFKALEVLNDSLGGLGVVT

SEQ ID NO: 142985 - protein, 48 aa, Glycine max
  Coding DNA Sequence Number=SeqID_26207
MSSASSARANTHGISNPPSASNVALESIIYVVFSNILKNTQIHLLADL

SEQ ID NO: 142986 - protein, 97 aa, Glycine max
  Coding DNA Sequence Number=SeqID_26208
  Gene Ontology: Mol. function=oxidoreductase activity; Cellular component=membrane; Biological process=electron transport
  Homolog annotation: Hit_ID=Q1S4X7; Match level="QueryCoverage=85%, HitCoverage=15%, E-value=3e-30, Identity=77%"; Hit description =Berberine and berberine like, putative
  Subcellular localization annotation: CTP_CleavageSite=43; ConfidenceScore=5.10e-01
MGFKGLHAYKYFNMHRFDPTSFKTIFFSQNQFRKAFFHHLEESVSTTKELSIIRCCDSSLSFVPNSGWLNDDSDEEILINIGCHFLPSVENPGCILL

SEQ ID NO: 142987 - protein, 150 aa, Glycine max
  Coding DNA Sequence Number=SeqID_26209
  Gene Ontology: Mol. function=oxidoreductase activity; Cellular component=membrane; Biological process=electron transport
  Homolog annotation: Hit_ID=Q1S4X7; Match level="QueryCoverage=98%, HitCoverage=27%, E-value=2e-73, Identity=86%"; Hit description =Berberine and berberine like, putative
  Pfam annotation: Domain name=FAD_binding_4; Domain location=1-125; Score=62.0; E_value=2e-15; Accession=PF01565.13; Description=FAD binding domain
TCSKKLGIHLRIRSGGHDYEGLSYVSEVETPFIIVDLSKLHAVNVDIEDNTAWIQVGATIGEVYYKIYEKSLVHGFPAGLCTSLGVGGHITGGAYGSMMRKYGLGVDNVLDARIVDANGQILDREAVGEDLFWAIRKGGGASFGILLWWK

SEQ ID NO: 142988 - protein, 142 aa, Glycine max
  Coding DNA Sequence Number=SeqID_26210
MEMASNYGAFMETKTEDTESTNASAKTEETETTSEETESMSSESEKLRRLLIEMVVEATFEALNIDLPYLPSADASPNPTLFEVMEKPSEEYVVAPLDASVVKAWVAHDELEEGGQGGRGIRGKEWEGLGAEEVNEGGESIF

SEQ ID NO: 142989 - protein, 519 aa, Glycine max
  Coding DNA Sequence Number=SeqID_26211
  Homolog annotation: Hit_ID=Q9LDG7; Match level="QueryCoverage=57%, HitCoverage=32%, E-value=6e-83, Identity=56%"; Hit description=WD-40 repeat protein-like
  Pfam annotation: Domain name=WD40; Domain location=372-410; Score =40.4; E_value=6.4e-09; Accession=PF00400.22; Description=WD domain, G-beta repeat
MTQETVDHDHQQDDDTESCFFHDSNDRLLSSSSSCSTSTSDDDTPTTQNDTLTHRNDASINALPQFPFPTMCKYDAWISEPSSLSERRSRLLRQFGLPAPPPSSAAIPRSASSHHCTDTSSTAASIPRSKSDNTSDRGTKHCKSSVVPIHDNDDGFLVNNSNNRGGGGSVCVNNNRICVSVYEDDDDGGGGIGEGNVNVSNVVDETVQACTIRDLDNGKEFVVKEDGVWNEVKEVGTGRRLTVEEFEMTVGHSPIVQELMRRQNVEEGGNGEGVDGDRDGDGGVGGDDDEGDGGKVKRKGGWFKFMSLKSVVVGQKERRSGDEKDTSLSEKGGGQRSSSATDDSQDGGGLVHGGERVRVRQYGKSFKEVTGLYRSPEIQAHEGSIWCIKFSLDGRYLASAGEDCVIHVWQVVESERKGELLVEKPEDGNLNIMFLVNGSPEPSSPGMDNNSEKKRRGRLSVSRKSLSLDQLVVPETVFALTEKPVCSFKGHLHDVLDLSWSKSQIKSLRGNSWTFQLIG

SEQ ID NO: 142990 - protein, 135 aa, Glycine max
  Coding DNA Sequence Number=SeqID_26212
MTTVKISLVEVAIVAMTVVEVTLVVVVMFDGGGSDGDVGDGGGISGDGSNVSGISDDGGDNDGGGIVGSGDGGGGGNNNINDNDGAMTMVHGGNDDVRVAVLVFVVVTNSNDDDKDDDDGDNDKSGISGSDVGRQ

SEQ ID NO: 142991 - protein, 133 aa, Glycine max
  Coding DNA Sequence Number=SeqID_26213
  Gene Ontology: Mol. function=structural constituent of ribosome; Cellular component=ribonucleoprotein complex; Biological process =translation
  Homolog annotation: Hit_ID=P56804; Match level="QueryCoverage=73%, HitCoverage=99%, E-value=5e-39, Identity=79%"; Hit description =Chloroplast 30S ribosomal protein S14
  Pfam annotation: Domain name=Ribosomal_S14; Domain location=45-99; Score=83.6; E_value=6e-22; Accession=PF00253.11; Description =Ribosomal protein S14pS29e
MARKSVIQREKKRQKLEQKYHLIRRSSKKEISKVPSLSDKWKIHGKLESLPRNSAPIRLHRRCFSTGRPRANYRDFGLSGHILREMVHACLLPGATRSSCYQFFSLSRSRATLVARKAHNLEVTGSNPVSATF

SEQ ID NO: 142992 - protein, 45 aa, Glycine max
  Coding DNA Sequence Number=SeqID_26214
MYRGPRGSFGVEGRSKVGPSGQAEGIYTNAPDPIKTPHLSVLGRE

SEQ ID NO: 142993 - protein, 325 aa, Glycine max
  Coding DNA Sequence Number=SeqID_26215
  Gene Ontology: Mol. function=aspartic-type endopeptidase activity; Biological process=proteolysis
  Homolog annotation: Hit_ID=Q8H6Q8; Match level="QueryCoverage=95%, HitCoverage=8%, E-value=2e-14, Identity=25%"; Hit description=CTV.20
MVFPELQGIKKDIDYPWKQDIIGDPSTNVITNWQIRDGELIQSELPPTTKYQLPNIKDSNNKPVMATPFKTKDINEEVTSEDIKSLMEQENYTNKYLQVLGETIKTKVVPKQKSVEEASPSIPIEKPLFKPFKVSEKAKRKIRELRKTKSLVEGVGDNHSELLNKIGSLLKVIPDTSQTSENTSKMVTRSTSKLINVINEDSDQNSDNITELGSVSEKNINPINSKHWKTPSKLYYQRPAAFDLLLEERGENNFKIFSANNIYEWNIDAQMEYNITNTLQHMTMVAMAYQTSHECSKETIIDILVAGFSGQLKGWWDNYLTNEEK

SEQ ID NO: 142994 - protein, 88 aa, Glycine max
  Coding DNA Sequence Number=SeqID_26216
MAMGWGGDEYCLPNPRPRLPNMSPYTYPILDGSGFGVKADALISYPYPYPTFGCRGKPELMPGQLGYYPSKSGQIWTGTHGYRFSCHV

SEQ ID NO: 142995 - protein, 125 aa, Glycine max
  Coding DNA Sequence Number=SeqID_26217
  Gene Ontology: Mol. function=protein serine/threonine kinase activity; Cellular component=membrane; Biological process=protein amino acid phosphorylation
  Homolog annotation: Hit_ID=Q7G6W1; Match level="QueryCoverage=51%, HitCoverage=7%, E-value=5e-23, Identity=76%"; Hit description =Putative receptor-like protein kinase
MIEGWDKEGTKENTHLLEEIEKILCYVCDEVCICLLHSYGLLHSYDHRVVTVKCLKNVTSGDAEFWAEVTIIARMHHLNLVRMWGFCAEKGQRILVYEHIPGGSLDKYLFRVNKSHNNNHLKEQS

SEQ ID NO: 142996 - protein, 362 aa, Glycine max
  Coding DNA Sequence Number=SeqID_26218
  Gene Ontology: Mol. function=protein phosphatase type 2A regulator activity; Cellular component=protein phosphatase type 2A complex; Biological process=signal transduction
  Homolog annotation: Hit_ID=Q9LDG7; Match level="QueryCoverage=99%, HitCoverage=37%, E-value=1e-111, Identity=60%"; Hit description=WD -40 repeat protein-like
  Pfam annotation: Domain name=WD40; Domain location=115-153; Score =6.5; E_value=6.3; Accession=PF00400.22; Description=WD domain, G -beta repeat
  Pfam annotation: Domain name=WD40; Domain location=155-195; Score =17.8; E_value=0.04; Accession=PF00400.22; Description=WD domain, G -beta repeat
  Pfam module annotation: Pfam domain module=WD40::WD40; Domain location=115-153::155-195
TCIQFNPVDDRYFISGSLDAKVRIWSIPDRQVVDWADLHEMVTAACYTPDGQGALVGTYKGRCHLYNTSGIISEILFTCIYTILMIAGPLIIVIIIIFSPFHSENKLQQKSQINLQNRKKRSNHKKITGFQFVPGSSSEVLITSSDSRIRLVDGIELVHKFKGFRNANSQISACLTANGKYVVSASEDSHVYIWKNEADCRPSRSKGVTVTSTYEHFHCKDVSVAIPWSGMDDTWEMHDSYFAEEPELDDDGDEDEVSSANHPPTPVEENLGSEGSQFASGCNNSPLHGTIASATDSYFLDRISATWPEEKLLTTRDRSPRVSVDLSNGVNQNMSAWGMVIVTASLQGEIKIFQNFGLPLGI

SEQ ID NO: 142997 - protein, 66 aa, Glycine max
  Coding DNA Sequence Number=SeqID_26219
MRGDDIDNGSDIEQDLRHLGFIDIINKPLMEALDLNDVEIKQYLSEVLGSILKCQMHYFGINGFNS

SEQ ID NO: 142998 - protein, 316 aa, Glycine max
  Coding DNA Sequence Number=SeqID_26220
  Gene Ontology: Mol. function=nucleic acid binding
  Homolog annotation: Hit_ID=Q1SUD8; Match level="QueryCoverage=73%, HitCoverage=68%, E-value=2e-35, Identity=42%"; Hit description=Zinc finger, CCHC-type; Zinc finger, SWIM-type
MALGVMAARPGELLLHPEVALLAQVSSTHPGELVTSPLSYLGVLLSGFRKKLRMTLLPSPLDLARGNGWEKTYSIITDQDLAIGAAIKKVFPETRHRLCLWHIRKKFPEKLAHVYHKRSTFKCEFKRCIRESPCIDIVEEEWKHLMKEYNLEGNEWFKGLYRIKESWIPIFNRSIFFADLDSKVAKCDGQLFEFMGILWRHILVIFQEKGVVQIPDHFVLQLWTKDANKCIEVSDIGNNFDGQSTTSRILRRMHTQQQANILVDLAEELEEIYRFIVLELGQTHKLAIVMKTSLPTGDNIPLLESSLTIGNKLCMP

SEQ ID NO: 142999 - protein, 44 aa, Glycine max
  Coding DNA Sequence Number=SeqID_26221
MAIVAMTLGSLGSDLDEGDGARHWCDGDGLCGVKISLGRWLIQT

SEQ ID NO: 143000 - protein, 431 aa, Glycine max
  Coding DNA Sequence Number=SeqID_26222
  Gene Ontology: Mol. function=choline transporter activity; Cellular component=integral to membrane; Biological process=positive regulation of I-kappaB kinase/NF-kappaB cascade
  Homolog annotation: Hit_ID=Q9LUQ4; Match level="QueryCoverage=98%, HitCoverage=57%, E-value=1e-141, Identity=63%"; Hit description =Arabidopsis thaliana genomic DNA, chromosome 3, P1 clone: MJK13
  Pfam annotation: Domain name=DUF580; Domain location=31-429; Score =427.9; E_value=1.4e-125; Accession=PF04515.3; Description=Protein of unknown function, DUF580
GWIGNDAISPIIGEHDPYISVYGRELTHIRVVTILMTFIMVVAILTSIAIVRRILMATSVLKVAAKVIGEVQALIIFPLIPYTVLAVFYMFWISAALHLFSSGQVVQNNCNSNCCTYDLIAKRVNCDRCCGYSIHYTPHIGVAILFHLFGCYWATQFFIACSSTVIAGSVASYYWARGETSPEIPFLSVFSSMKRLMRYSLGSVALGSLIVSFVESIRFLLEAIRRKLKVSSHGHDSCLGKAAYQFSQCFLRCIEWTIKSVNRNGYIMRLKFISLLWLCIHREQNMSQSCILIAITGKSFFSASFIATELIMNNILKIGRLNVIGDVILFLGKLCVSLSCALFAFLMLDTHKYNSAHNKTSSPLLPVVVCWALGYIVATLFFAVVEMSIDTIVLSFCQDSEEHQGTAQYAPPLLVETLSDQNEMQRLTQGP

SEQ ID NO: 143001 - protein, 53 aa, Glycine max
  Coding DNA Sequence Number=SeqID_26223
MGSRGIVPDKWSMRILWACAIGSAVKRQAQNRQRMLAEELKAMESGESNGEDG

SEQ ID NO: 143002 - protein, 161 aa, Glycine max
  Coding DNA Sequence Number=SeqID_26224
MVPIVVSTHEEMSTMMTTLFICHQIGLETHDIMYQLPGQLVEIVKPVVQNKMQQSKELEAKKVHVSENYASINPIGLGEYGFMSTWQETLSNMASTGVAFTWYSNLPPNSIQNWVDMDKCDRFYRSQPEVTIVNLMNMRQMVDKLAIDFTKRLEVTAQCNC

SEQ ID NO: 143003 - protein, 313 aa, Glycine max
  Coding DNA Sequence Number=SeqID_26225
MAMQIWLRSWRLLSDAIGDLANLANDSRIDFNMDGSEAKASLKGMAKDTKTVLEAGKGLMVILAYELFFFLAETEVRQEEGWGWLGVWAIGYEHPRSSKGWSNKEGISSPTIGRPKMVAISCSVMVMKPKRNIKVFVAVNQKLKKLKIESNYSFEPPIIRVKTPRTSAQIGRGRSYLKPRSNANQISIMVKVMPKKSDNIYHIISARKKVIMSFKILKRINEATKSYRLFFILIVRKLEKKDERTIGGRHGEIKGKIIRGERRRKQGLGANKKSRGIFPDVAPCGACRPWIFFINGVLYFLKINGSGMEKEER

SEQ ID NO: 143004 - protein, 300 aa, Glycine max
  Coding DNA Sequence Number=SeqID_26226
  Gene Ontology: Mol. function=endonuclease activity
  Homolog annotation: Hit_ID=Q10R99; Match level="QueryCoverage=92%, HitCoverage=51%, E-value=2e-89, Identity=52%"; Hit description =Endonuclease/Exonuclease/phosphatase family protein, expressed
MSVLVEENMLLAVNITGSDTWYRVQSDKKVAVCSIHPSEQATLQCLGCVKAKIPVSKSYHCTTKCFSDAWQHHRVLHDRAASALNENGNEEEEVFGRFNSTGSGATNSSLSASASSASLTNGSATPLYPAAITQRSGETWFEVGRSKTYTPTADDVGHVLKFECVVVDAETKLPVGHANTILTSRVIPAPSPIPRRIISVDGMAHLDVDGRMTSSGTFTVLSYNVLSEAYASNDLYNYCPSWALSWPYRRQNLLREIVGYRPDIICLQEVYSGNTNTIDGCATFFRRDRFSHVKKYDAAT

SEQ ID NO: 143005 - protein, 179 aa, Glycine max
  Coding DNA Sequence Number=SeqID_26227
  Gene Ontology: Mol. function=endonuclease activity; Cellular component=nucleus; Biological process=regulation of transcription, DNA-dependent
  Homolog annotation: Hit_ID=Q338D5; Match level="QueryCoverage=90%, HitCoverage=27%, E-value=2e-63, Identity=75%"; Hit description =Endonuclease/exonuclease/phosphatase family protein, putative, expressed
ANTHVNVPQDLKDVKLWQVHTLLKGLEKIAASADIPMLVCGDFNSVPGSAPHALLAMGKVDPSHPDLAVDPLNILRPHSKLVHQLPLVSAYSSFARTVGLGYEQHKRRMDGGTNEPLFTNVTRDFIGTLDYIFYTADSLVVESLLELLDEESLRKDTALPSPECAWVETKDAMDENNEM

SEQ ID NO: 143006 - protein, 58 aa, Glycine max
  Coding DNA Sequence Number=SeqID_26228
MGFRCCDTPTREGGATIWVCAVPRQCASDYIHWFYMISHPFMMPKQPENPPRHPPMMR

SEQ ID NO: 143007 - protein, 84 aa, Glycine max
  Coding DNA Sequence Number=SeqID_26229
MKPTSMTGLFKASTKHKVIVIAKETQKAIKDFVPQQQKEATSVPSDHFEEETDEIRVEERETARASSGTEARVDGGIVVEISGP

SEQ ID NO: 143008 - protein, 184 aa, Glycine max
  Coding DNA Sequence Number=SeqID_26230
MGKRQKGQKGSIPDQAPLKVMGRRGVLEGPMTPKNDCYWVVMTGCPSLGEFTKEGRESREESSKEGSRAASLQEPFDLVYSSRNPSRLQWLKALFDLACSHQDDREAGTKVRNPYNVGDKSGNLHPESWRGCTPVDKAVQEEGSDKAHESEGELLGHNDRRSKIWRVYRRIKKGNQEENQEMFG

SEQ ID NO: 143009 - protein, 102 aa, Glycine max
  Coding DNA Sequence Number=SeqID_26231
MQRYLMVIRTFCQLEASEPVDTQRITSSSAPLSSRDGKSNDMRRYLMVILTFFQLEASEPVDMQRLASSSTPSSEMSASSGRDCKKVSFAIRKTQSSIACSD

SEQ ID NO: 143010 - protein, 173 aa, Glycine max
  Coding DNA Sequence Number=SeqID_26232
  Gene Ontology: Mol. function=RNA-directed DNA polymerase activity; Cellular component=intracellular; Biological process=RNA-dependent DNA replication
MGEEKCQTIRQEVAKLMAARFIREFDYSTWLSNVIMEKMTFITKSANFGYKVKPFGLKNAKATYQRLMDKVFQGQLGRKLEIYVNDMVVKFDDLTTHLTALEKFFGQLRKYNMRLNLEKYVFGEAQRLADKIASLLRFLPRIIERARPIMKLLKKAKKFVWDEKCKEAFRQLK

SEQ ID NO: 143011 - protein, 85 aa, Glycine max
  Coding DNA Sequence Number=SeqID_26233
  Subcellular localization annotation: CTP_CleavageSite=36; ConfidenceScore=5.23e-01
MSVQLPWSTWVFLTVQLAISRMITTRSSYTRIDALKSSVVKAGAPLPMKPLTMVFITYLVGREECIGYNVALEATDPSSRRHELC

SEQ ID NO: 143012 - protein, 368 aa, Glycine max
  Coding DNA Sequence Number=SeqID_26234
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=23%, E-value=3e-53, Identity=50%"; Hit description=Chromo
MTRENSFKTWIAFMRALETEFGPSPCECPRSQLFKLTQIGSVQSYYVQFTALANRVQGITQEALLDCFVGGLKPNIRMDVIAQSPTSLLRTVSLAKLYEEKYTPKLKPFSSSFSSKTQTSNTNSNLNTNQNSPQSLKSTSLPPLLPTPYTKPINVKKMTSAEMQLRRERGLSFTCDDKFSPSHRCPNKQHFVLQWEEEDDPALQPDPLDEVETVGDPSLQNHHLSYNALKGSSGLGIMKFQGSINGLGVQILLDSGSSDNFLQPRLAQCLKLPVEPIPNLQVLVGNGNALTAERLIQDLEVKIQGHTLKLPVYLLPISGADLVLGAAWLATIGPDLFDYSTLTLKFYLGNQFITLHGFFILPTTTGLI

SEQ ID NO: 143013 - protein, 67 aa, Glycine max
  Coding DNA Sequence Number=SeqID_26235
MENCTKQSLRIAPSSWVEDARTKTQFMGLRKRVEDGESHYAVTMHGSKFVGKGRMNKNAIHGVPKKG

SEQ ID NO: 143014 - protein, 137 aa, Glycine max
  Coding DNA Sequence Number=SeqID_26236
  Gene Ontology: Mol. function=transition metal ion binding; Biological process=cytoskeleton organization and biogenesis
  Pfam annotation: Domain name=Transposase_21; Domain location=1-124; Score=-46.2; E_value=1.2e-10; Accession=PF02992.5; Description =Transposase family tnp2
MMISGPRQLGNDIDVYLSSLIEDLTKLWDEEVSMFDGFQNETFDLHAMLFCIINDFPTYGKLNGYNVKGHHACPICEEDTSYIQLKHEKNVYDSVIGKLLNIQGKTKDVLNTRQDLAEMGIQAQLHPRSDGKKYTCL

SEQ ID NO: 143015 - protein, 134 aa, Glycine max
  Coding DNA Sequence Number=SeqID_26237
MAVPKSENMQRQVETNKEQAYNHESAWDVRNGFGRKKEKKMMFFLSYLDYKAQNAQVSNALGNGNLAHTPGIFSTIPTAKFREDPTVNEGWTTFLLRQLHVASLRSFIKRLPQEASSWLLSEAFSRVFFEKLML

SEQ ID NO: 143016 - protein, 121 aa, Glycine max
  Coding DNA Sequence Number=SeqID_26238
MVKNLKEGAMAGDFEEGLATQGGCIDLVRCPWWGKIEWLKILNIFERMFRIFNSSMVFVLDGAHEIEWLKSLNISEGMFRIFNSSMIFALDGAHDDHHGGGGSYGARQGGLDTYCIVSLSE

SEQ ID NO: 143017 - protein, 192 aa, Glycine max
  Coding DNA Sequence Number=SeqID_26239
  Homolog annotation: Hit_ID=Q6YYW0; Match level="QueryCoverage=29%, HitCoverage=14%, E-value=1e-18, Identity=73%"; Hit description =Putative transparent testa 1
  Pfam annotation: Domain name=APC10; Domain location=76-192; Score= -70.3; E_value=0.003; Accession=PF03256.7; Description=Anaphase -promoting complex, subunit 10 (APC10)
MDRSRVFVAIVDMNKRLMGLRCNQKQFSVLSDLRTCEKHCGDLKWQCTCGTSFSRKDKLMGHVALFMGHQPVAAINNNNALSYSAKLEQQHTLKMQIEVEENPTLLLELCGSKKPYTALGTVVGAQSSKLSTLPVNKLIVLFLVFKLDESYTPSKVSIRADDGFHNLKENKTVELVKATGWVYLSLFGADPR

SEQ ID NO: 143018 - protein, 54 aa, Glycine max
  Coding DNA Sequence Number=SeqID_26240
  Gene Ontology: Mol. function=DNA binding; Cellular component=nucleus; Biological process=regulation of transcription
  Homolog annotation: Hit_ID=Q0PJC1; Match level="QueryCoverage=72%, HitCoverage=45%, E-value=2e-09, Identity=50%"; Hit description=MYB transcription factor MYB122
MVTTPSCDKSGMRKGLARCGKSYRFRWMNYLRPNMKRGNFLILGTIGLLDYMLL

SEQ ID NO: 143019 - protein, 348 aa, Glycine max
  Coding DNA Sequence Number=SeqID_26241
MAPEDLEQLMQQIRDQLEESIIEKVTRQLMLSFSQMQFQFQSQMQSQGLALPPEPEVGPSTARVSTKESCVNPSGNDPDTDDSDKCRLYIEENPPRLVVLGKVYEGSITIHNIPLLHDQVKVGFKEVRDADAPIPVPTKEVKLVEQTLNTFLAWSTHLVKHLSEQGAMGPAKPADRPDHDVDDPLYLMTLTIPQLFLKPLQVMWDATMFGVFNEDFPLYIKHEDLSEIAHSESYIKNWMQNSKRDVYLGAYLNGALKGLDDTPQSKSKAGARWIVVKYNRQKGSTECGYYVMHWMSTIILGSFKNNWEIYFNDARPLELERLKALRIQWFSKTDVNDNTFNVNTFNIS

SEQ ID NO: 143020 - protein, 109 aa, Glycine max
  Coding DNA Sequence Number=SeqID_26242
MPMPSRQLSGSSPESYSLHPDTIILLPRTMFAIITASAKDPRRSVHFAPHEHTQHPMYERDPKQVPKTLEGQCTLPPTNIQNMHMPMHFQHQSTFHFHIILNIDIISSQ

SEQ ID NO: 143021 - protein, 98 aa, Glycine max
  Coding DNA Sequence Number=SeqID_26243
MKRGKPFRFLVLPKPNVASGFLLSLDGGNQGGTLEDSNGEGFATDLGDVRGGDEFLFREIASLAHCDDHEYKHMVNVLTSELSSLTLKHQNGTGEMNH

SEQ ID NO: 143022 - protein, 217 aa, Glycine max
  Coding DNA Sequence Number=SeqID_26244
  Gene Ontology: Mol. function=RNA-directed DNA polymerase activity; Biological process=RNA-dependent DNA replication
MASPRHFNTSSHVMYADDVLISCKGTKRNIKHIMLLFDKYVEASGQLINKEKSHFYSSSISPGRISIISDLISFTHGVLPFTYLGVPLFQGKSKKVHLQPIADRIMLKLFSWKVAIPISHEDDHLIWSKSHAGDLQLKDSYMFLYPKLKARFENLQTKFDSIIFEISTSVHLAGSISSSIMSNFVSDFGILERFFISSHPQQHQPIKQVIWRPPRAN

SEQ ID NO: 143023 - protein, 69 aa, Glycine max
  Coding DNA Sequence Number=SeqID_26245
MTTAPKSVGDLSVAGAAATRTAGEMVRAKRCVLAAVRGENKKKKKEKKMREEGRNVGKGLAICEKVRIA

SEQ ID NO: 143024 - protein, 69 aa, Glycine max
  Coding DNA Sequence Number=SeqID_26246
MSMHKQVKVAMEANKQLEHETPTPALEVDQQNASASVGFSMPNFDGVYHQVAALQTTIINAVLKELGIL

SEQ ID NO: 143025 - protein, 303 aa, Glycine max
  Coding DNA Sequence Number=SeqID_26247
MVRTLSCDKSGMRKGTWTPEEDMNDVVGNNSTGCMIMVSWPFGIARMPRRLSVLAVTKQAKTCFITKGSDVLKLNVELYEAIAPLDRELKYLCFVGVQNRYYEAPNPYDRWDSLDRFVLIFGFNTNLGAHIGHLSDQGIPKDPKRIKVIPEWPTPARTMFPHGKMPRKGGISPEFQEPLDLRSNPFQWGGMMQSYPLRALNRRLKEDWTRDAREGPRVFMSLRVPNSPKRRGKGGTTKEGGAPLPAPLVQGPVTQGHHGGNGTGEPRCSLTRGNEGRAKGKRREQGRRDSEGMRDNWRPLSLL

SEQ ID NO: 143026 - protein, 66 aa, Glycine max
  Coding DNA Sequence Number=SeqID_26248
MEHETFLATWLAEIDFSPNGLRFSNLEPQPRLINHEKPMLCGWHKLNPLKIEGTRVALDSPRDYFP

SEQ ID NO: 143027 - protein, 60 aa, Glycine max
  Coding DNA Sequence Number=SeqID_26249
MKTHVSSEVVVLSCWGFENKRSQLALHLVYTVYTKLLHTNRGLGGLLETSHTPLKNVQIQ

SEQ ID NO: 143028 - protein, 125 aa, Glycine max
  Coding DNA Sequence Number=SeqID_26250
MRETHEIPHHSLANFEPCLEYATEGHAIGGVPLPNTLEGPQFRPQPHPLHFVVGRAPPATAEKEKLDHIEERLRAIERGGDILLLTWNHMKLYCWKMGAYAKDEKLLMHFFQESHTGTVVTGVLL

SEQ ID NO: 143029 - protein, 91 aa, Glycine max
  Coding DNA Sequence Number=SeqID_26251
MAPRKLSAKRSRRDAAAEGTSAAPEFDSHRFRSAEHQQRFKAIKGWSFHRERRVQLRDDEYTNFQEEIAHRHWTSLVTPMAKFDPEIVLEF

SEQ ID NO: 143030 - protein, 39 aa, Glycine max
  Coding DNA Sequence Number=SeqID_26252
MKEARGGALAAQQDWFHRLPVLVYLITLNGNRVPEHKLG

SEQ ID NO: 143031 - protein, 229 aa, Glycine max
  Coding DNA Sequence Number=SeqID_26253
  Gene Ontology: Mol. function=transporter activity; Cellular component= integral to membrane; Biological process=transport
  Homolog annotation: Hit_ID=Q1GXK6; Match level="QueryCoverage=54%, HitCoverage=24%, E-value=4e-41, Identity=71%"; Hit description =Sulphate transporter
  Subcellular localization annotation: CTP_CleavageSite=50; ConfidenceScore=5.57e-01
MARPLTKPSMTGCGTMRINLPNLATANRICNSPMRTMVANRYCTPCCTTRATMTTASAPAAPEIMPGRPPKAEVIKDTITAAYKPVRGETWAISAKAIASGTIASATVSPLSSHHHSPEIGRPAGIEYLGNCKGWFQSAADRDVTRLYVRVHSRGAWFVVKVGVYKPGAYYSMCLLSLRYGAGVRWLHRVLRKMYGLGGEGDFCTVLADDVSNFQEHILLDMMIVHPIP

SEQ ID NO: 143032 - protein, 112 aa, Glycine max
  Coding DNA Sequence Number=SeqID_26254
MTWNKNLLRVFHNKKSYSLKEQKHFILLRIPWPIHLQFNKELIESSNCTIDLFQERFILLFFLNSQKGLRDRGSLVVEKSEHKGTIVLVFSELVKGFYKIVKLSSGVLGDWT

SEQ ID NO: 143033 - protein, 120 aa, Glycine max
  Coding DNA Sequence Number=SeqID_26255
SPHQLDLAPYASGPYNAQGNALGLLHDKQTSCSSRILGEMEVEELLVGVVFAIGSAVDRLCGRFRDGLCGYLGGGMGFSLFLTLFICPSFLSRPSRMIKFASFRTHIDPFTGEDQIRKAL

SEQ ID NO: 143034 - protein, 109 aa, Glycine max
  Coding DNA Sequence Number=SeqID_26256
MGQDSWSVFRNHLLKELANFSEDYIKLFGGTERSEELRMSLLVDGLTKVTTDKWMNITDMRHVIASRIELTFFSHTQQAKSWPNPYISRMQHYKSFVMFKKDYVDINDD

SEQ ID NO: 143035 - protein, 166 aa, Glycine max
  Coding DNA Sequence Number=SeqID_26257
  Subcellular localization annotation: CTP_CleavageSite=66; ConfidenceScore=5.21e-01
QQQRKLVLHLLIMKRDMLGAPSNIAGAPSNLLKASFLGGLLLRETSSPSSSPQGFSLPFAFKMNLRVEDAGKNGGSLVTVSLPEDPLGVLPELPEEDLPEDFRKKGSFGSNETNSGRTGLPKSSWTPSSGMFPEDVLLPETFRKRVLPDDLLVVPEDPSSGMFPEE

SEQ ID NO: 143036 - protein, 225 aa, Glycine max
  Coding DNA Sequence Number=SeqID_26258
  Gene Ontology: Mol. function=oxidoreductase activity; Biological process=electron transport
  Homolog annotation: Hit_ID=Q2XFA1; Match level="QueryCoverage=89%, HitCoverage=52%, E-value=2e-80, Identity=69%"; Hit description =Salicylate hydroxylase precursor
  Pfam annotation: Domain name=DAO; Domain location=3-213; Score=-49.6; E_value=0.011; Accession=PF01266.14; Description=FAD dependent oxidoreductase
MKRIAVIGAGLGGLAAGSLLQKAGFHVTVYEQSPAFSRLGAGIHMGPNVLKVFRRMGIEQQLEDLASHPDFWFSRDGETGEYLSRIPLGAYARKEYGAAYVTVHRGDLQAMQMTSLQPGSVQFGKCLSSVEDSGSDVVLRFQDGSEARADIVIGADGINSKLREHLLGVEAPTYSGWVAHRALIRGEQLRKYNLSFEDCVKWWSEDRHLMVYYTTKARDEYYYVS

SEQ ID NO: 143037 - protein, 310 aa, Glycine max
  Coding DNA Sequence Number=SeqID_26259
  Gene Ontology: Mol. function=aminopeptidase activity
  Homolog annotation: Hit_ID=Q0K319; Match level="QueryCoverage=99%, HitCoverage=88%, E-value=2e-85, Identity=50%"; Hit description =Putative peptidase, M29 family
MAVNQSQLGQMFEQVLRLSKVDASQSVAILKSHYSDARTVQAATDAALRLGAKVYCVELPAFNHPTAMGNDMTAYCGDTALTGNIAAQRALEAADLIVDTMMLLHSPEQEQILKTGTRILLAVEPPEVLARMLPTEEDKSRVLAAAAVLEKARMMTVKSPVGSDFRAPLGQYPTVTEYGYADEPGRWDHWPSGFLFTWPNEDQAEGVLVLDVGDILLPFKSYARERITLEIEQGFVTHIHGGFEAEYLRDYMRYFNDPEVYGISHIGWGLQPRAQWTAMGLHDKNDGMCMDARAFYGNFLFSTGPNTEVG

SEQ ID NO: 143038 - protein, 64 aa, Glycine max
  Coding DNA Sequence Number=SeqID_26260
MAVRICMGIRFPHSSAMIYYGAQSDIRDKTSACFQLYVEIQRYGYGRLYLRWASFINNEGLNVS

SEQ ID NO: 143039 - protein, 172 aa, Glycine max
  Coding DNA Sequence Number=SeqID_26261
MKIQSDIPKLGTQRGNNIEVHGLLVWGGLEMHMELNIEEGMVPMETSYGKSTRICLSGEVRKRQNSSSSYGNYRYVPSKNKGRIWRLTHNRLQTMDNLKKRKIISTGTDDCTLLTTLGDDLREEGALGMVDCLGCCDLLYLEATECIKFNSSLCNQKEVVTLMLSARCRARF

SEQ ID NO: 143040 - protein, 227 aa, Glycine max
  Coding DNA Sequence Number=SeqID_26262
  Gene Ontology: Mol. function=structural constituent of ribosome; Cellular component=ribonucleoprotein complex; Biological process =translation
  Homolog annotation: Hit_ID=P42353; Match level="QueryCoverage=52%, HitCoverage=86%, E-value=7e-62, Identity=98%"; Hit description =Chloroplast 50S ribosomal protein L16
  Pfam annotation: Domain name=Ribosomal_L14; Domain location=110-227; Score=200.2; E_value=4.8e-57; Accession=PF00238.10; Description =Ribosomal protein L14pL23e
  Pfam annotation: Domain name=Ribosomal_L16; Domain location=1-116; Score=266.4; E_value=5.7e-77; Accession=PF00252.8; Description =Ribosomal protein L16
  Pfam module annotation: Pfam domain module=Ribosomal_L14::Ribosomal _L16; Domain location=110-227::1-116
MKGISYRGNHICFGRYALQALEPAWITSRQIEAGRRAMSRNVRRGGQIWVRIFPDKPVTVRPTETRMGSGKGSPEYWVAVVKPGKILYEMGGVPENIARKAISIASSKMPIRTQFIISGGARELMCIRILGASNRRYAYIGDIVVAVIKQAVPNTNLERSEVIRAVIVRTCKELKRSNGIIIQYDDNAAVVIDQEGNPKGTRIFCAIARELRQLNFTKIVSLAPEVL

SEQ ID NO: 143041 - protein, 69 aa, Glycine max
  Coding DNA Sequence Number=SeqID_26263
MAMLRSTHDMCCLSMARVGLAWLVLSHMKKSSSMSLLLENGHATFNMARADLYVVVLTVFSINRKMEVF

SEQ ID NO: 143042 - protein, 177 aa, Glycine max
  Coding DNA Sequence Number=SeqID_26264
  Gene Ontology: Mol. function=electron carrier activity; Cellular component=membrane; Biological process=electron transport
  Homolog annotation: Hit_ID=Q9XIL1; Match level="QueryCoverage=84%, HitCoverage=57%, E-value=2e-40, Identity=51%"; Hit description =Expressed protein
  Pfam annotation: Domain name=Cu_bind_like; Domain location=66-161; Score=-20.1; E_value=0.0087; Accession=PF02298.8; Description =Plastocyanin-like domain
MATKFAHALTLFVLVASMLSMSMANKDWSFGSNSNYSDWWSRFRNRHQNKTEQEPRKIIVGGSEGWHFGFNYTDWAFKNGPFYLNDTLVFKYDAPNATSFPHSVYIFPNLWSFLNCDVKSAKMLANPTQGGGEGFHFVLNRWQPYFFACGERNGFHCNSGQMKFAVMPIIRPFWPWP

SEQ ID NO: 143043 - protein, 89 aa, Glycine max
  Coding DNA Sequence Number=SeqID_26265
MMLTTYINRTKKGIVVAVQKSAYAWALDRNNANIVWSMFLFQEAELDGVQGGGSLGATTDEKTVYTNFVNSDAKNFTFAPSNVITTAGG

SEQ ID NO: 143044 - protein, 173 aa, Glycine max
  Coding DNA Sequence Number=SeqID_26266
  Homolog annotation: Hit_ID=Q40538; Match level="QueryCoverage=20%, HitCoverage=64%, E-value=1e-07, Identity=86%"; Hit description =Nicotiana tabacum (clone 5) activating factor DNA sequence
MGNRKSIIIVCEGAIDRNLKPIKPEEVKQILEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143045 - protein, 538 aa, Glycine max
  Coding DNA Sequence Number=SeqID_26267
  Gene Ontology: Mol. function=sequence-specific DNA binding; Cellular component=nucleus; Biological process=regulation of transcription
  Homolog annotation: Hit_ID=Q1T4J9; Match level="QueryCoverage=97%, HitCoverage=88%, E-value=7e-67, Identity=34%"; Hit description=DNA -binding WRKY
  Pfam annotation: Domain name=WRKY; Domain location=188-248; Score =139.7; E_value=7.8e-39; Accession=PF03106.6; Description=WRKY DNA -binding domain
MSSPNGPEIEEKRVTKEDKFKSAKTEMGEVKEENERLKMMLERVEKDYHSLQLRFFDILHKDVSKKGLAVSSTSLDHETAEPELVSLCLGRSPMEPKKELARIGYSNKPKEEDVGPNLTLGLDSKHLLSMEVVSDLSPTNSSEEPKEVEAEGTNQSAKVINVNDDVSDQMPAKRARVSVRARCDTPTMNDGCQWRKYGQKIAKGNPCPRAYYRCTVAPTCPVRKQVQRCAEDLSILITTYEGTHNHPLAVSATAMASTTSAAASMLLSGSSTSHLTSHNSASFGNAPTTLLNGVSFSHQFDELRAKQMLSPPNHVSPNLFSTITLDMTSSASNSSSSTQFHHRLPSTIASISNPKFSPASLSFCSQDNNFIPSIWGKGGDTSTTPIDKIPMTRPVIKGNQYFQENFYQQSITKQTPSKEALAETITKAISTDPSLRSVIAAAVSSIVGNGSSSGNQEESDNVLGSGLNLKLGEHFQLASPNPLNQNRKECLTSYFKSLSSKNSEAGSFIFLQPPLPFSFSKSSTNQVNHYVQEMNSHH

SEQ ID NO: 143046 - protein, 136 aa, Glycine max
  Coding DNA Sequence Number=SeqID_26268
MDLRKRQPTVFALWTAVDPEEPRRNRPWDPGRLGRTRNTLRTRCYLMGSGMIQLILGSARNKGYKAQKEGCTTSLLERVCAEWLAGAKRANKILLAMLFNVGQKLNYYTPNSCKKYVAQDQVPLWAVISYFLTGVE

SEQ ID NO: 143047 - protein, 356 aa, Glycine max
  Coding DNA Sequence Number=SeqID_26269
  Gene Ontology: Mol. function=electron carrier activity; Biological process=electron transport
  Homolog annotation: Hit_ID=Q01UL0; Match level="QueryCoverage=94%, HitCoverage=63%, E-value=1e-53, Identity=37%"; Hit description =Pyrrolo-quinoline quinone precursor
  Pfam annotation: Domain name=PQQ; Domain location=111-143; Score =11.6; E_value=0.4; Accession=PF01011.11; Description=PQQ enzyme repeat
  Pfam annotation: Domain name=PQQ; Domain location=181-218; Score =23.3; E_value=0.00085; Accession=PF01011.11; Description=PQQ enzyme repeat
  Pfam annotation: Domain name=PQQ; Domain location=19-54; Score=5.8; E_ value=2.5; Accession=PF01011.11; Description=PQQ enzyme repeat
  Pfam annotation: Domain name=PQQ; Domain location=246-280; Score=9.4; E_value=0.82; Accession=PF01011.11; Description=PQQ enzyme repeat
  Pfam annotation: Domain name=PQQ; Domain location=285-324; Score =31.5; E_value=3e-06; Accession=PF01011.11; Description=PQQ enzyme repeat
  Pfam module annotation: Pfam domain module=PQQ::PQQ::PQQ::PQQ::PQQ; Domain location=111-143::181-218::19-54::246-280::285-324
MVKGYYVGTSSLESLVPLEKCCTFRGSFVKLNPRSGAIYWRTYTLPDNKNTKGEYAGAAIWGSSPSIDVERNLVYIGTGNLYSAPLRIQQCRERQLNQTQPTQQDECVEPDNHSNSILALDLDSGKIIWYRQFGGYDVSILPCSDTSTPSPDCPPLGDKPDIDFGEAPMMLTIYINRTKKDIVVAVQKSGFAWALDRNNGNLIWYKKAGPYGLAGGGSWGAATDEKRIYTNIVNSDAKNFTLAPSNKITTAGGWVAMDANNGRVLWSTANPGNSTAYGPVSIANEVAFAGSADRMGYIYAIDAMSGKILWSYKTGASVYGGMSISNGCIYVGHGYNVAYGYSLNLTSGKFLFAFCV

SEQ ID NO: 143048 - protein, 66 aa, Glycine max
  Coding DNA Sequence Number=SeqID_26270
MGKEEKSGKKHVGRGYSRRSKTEENRGRCVIRCSEKWGEILRGFNAGRGMNASEIEMEREKQWFGK

SEQ ID NO: 143049 - protein, 103 aa, Glycine max
  Coding DNA Sequence Number=SeqID_26271
MEGLLETLDSANHHHDTSLGTTILEGKEIPYVERSDDDEVIPLVFLEVLKSCEMEVVILREREEMGGVEEVDECALHLPFIDWVGKCERHGRVHREVELHTQD

SEQ ID NO: 143050 - protein, 104 aa, Glycine max
  Coding DNA Sequence Number=SeqID_26272
MYNTNLIALIHICPIHTNSIGEYILRGASAVVLSDAIFDKDAIAQHDFDKIQNLAHSAALLGNKSVNSKSMFIAIKFVAQLPSAQVFMIFWCSVDVEGSISTWY

SEQ ID NO: 143051 - protein, 81 aa, Glycine max
  Coding DNA Sequence Number=SeqID_26273
  Gene Ontology: Mol. function=catalytic activity; Biological process =metabolic process
  Homolog annotation: Hit_ID=Q0EUV7; Match level="QueryCoverage=95%, HitCoverage=35%, E-value=2e-07, Identity=38%"; Hit description=2 -dehydro-3-deoxyphosphogluconate aldolase/4-hydroxy-2-oxoglutarate aldolase
MVGTVLRIEDAKSAINAGAKFLMSPATVKDIMVMDYVQSGEILYIPGTMTPTEILSTWDEGAKIVKVGLCIFFNVYYVEEC

SEQ ID NO: 143052 - protein, 141 aa, Glycine max
  Coding DNA Sequence Number=SeqID_26274
  Subcellular localization annotation: CTP_CleavageSite=34; ConfidenceScore=5.47e-01
MGTATATLSLCQWLSSSSSMRMHVRFSCRTPHLTASAVPNQQFCAEVAMEAAKAAIAGGISVLEIVVLTPGVFEVVYLNFSTPSLVLFLDFEFICFWSICAGSTAAGEGASYNGPRDMLSSFKFLSSFSHGINVLFKVYTM

SEQ ID NO: 143053 - protein, 160 aa, Glycine max
  Coding DNA Sequence Number=SeqID_26275
MSISPCRCIGWDCAHKTPSWPEEVQQGPGVSSSGYGPLLVLQGARSPSENRTHKDTQRTRRSPVGPWGFQLWLRASIVLQGARQGHVIIGIAPARHPVDPKKVPVTSSKGIRPPTNRAFIKKYYVSRQAQGETPQQPGDGQQRATDAPPSPLEFTSAHPQ

SEQ ID NO: 143054 - protein, 389 aa, Glycine max
  Coding DNA Sequence Number=SeqID_26276
  Gene Ontology: Mol. function=transcription factor activity; Cellular component=nucleus; Biological process=regulation of transcription, DNA-dependent
  Homolog annotation: Hit_ID=Q1SQ04; Match level="QueryCoverage=99%, HitCoverage=97%, E-value=1e-142, Identity=70%"; Hit description =Pathogenesis-related transcriptional factor and ERF
  Pfam annotation: Domain name=AP2; Domain location=169-234; Score =104.5; E_value=3.1e-28; Accession=PF00847.10; Description=AP2 domain
  Pfam annotation: Domain name=AP2; Domain location=70-140; Score =105.5; E_value=1.5e-28; Accession=PF00847.10; Description=AP2 domain
  Pfam module annotation: Pfam domain module=AP2::AP2; Domain location =169-234::70-140
MVMMKENIIEEKLGRSQMSMVEGEFQGTWGVKRRRREVAAAASSGDDNHHQQLPQQEVGENSSISTTKRSSRFRGVSRHRWTGRYEAHLWDKLSWNITQKKKGKQGAYDEEESAARAYDLAALKYWGNSTFTNFPISDYEKEIEIMQTMTKEEYLATLRRKSSGFSRGVSKYRGVARHHHNGRWEARIGRVFGNKYLYLGTYSTQEEAARAYDIAAIEYRGIHAVTNFDLSTYIKWLKPSGGGTPEENLESHAVLEHQKLASPSNYALTEESKSLVLPNSFISPDSLDSPVKHESFGNKTYQFSRNKSSSPTALGLLLRSSLFRELVEKNSNVSGEEADGEVTKDQQPQLASDDDLDGIFFDSFGDIPFVCDPTRYNLELQERDLHSIF

SEQ ID NO: 143055 - protein, 153 aa, Glycine max
  Coding DNA Sequence Number=SeqID_26277
  Gene Ontology: Mol. function=RNA-directed DNA polymerase activity; Biological process=RNA-dependent DNA replication
  Homolog annotation: Hit_ID=Q2HUU9; Match level="QueryCoverage=71%, HitCoverage=64%, E-value=1e-08, Identity=28%"; Hit description=Helix- turn-helix, Fis-type
QQLHPLREDTWIWKPEPTGDYSTKSGYDLIWGELMEEEEDEHLFFNCSKTLTLWWESMSWVNLITVMPQNHRDHFLQHGMEVADGVRSKTWKCWWIALTWTIWHHRNKVVFQDTTFHGTKLLEDALFLLWSWIKAMDKDFTLHFNQWSSNLKE

SEQ ID NO: 143056 - protein, 171 aa, Glycine max
  Coding DNA Sequence Number=SeqID_26278
  Gene Ontology: Mol. function=protein serine/threonine kinase activity; Biological process=protein amino acid phosphorylation
  Homolog annotation: Hit_ID=Q2QDF4; Match level="QueryCoverage=93%, HitCoverage=26%, E-value=6e-73, Identity=81%"; Hit description=CDPK -related protein kinase
LTTLGMCDTNLYALSKTLTADELYYLTGQFALLEPSKNGSISLENVNKALMKYATDAMKESRIPDFLSSLNSLQYRRMDFEEFCAAALSVHQLEALDRWEQHARCAYELFDKDGNRAIVIEELASELGLGPSIPVHVVLHDWIRHTDGKLSFLGFVKLLHGVSSRSLAKVQ

SEQ ID NO: 143057 - protein, 168 aa, Glycine max
  Coding DNA Sequence Number=SeqID_26279
  Homolog annotation: Hit_ID=Q10K64; Match level="QueryCoverage=90%, HitCoverage=45%, E-value=2e-47, Identity=58%"; Hit description =Nodulation protein, putative, expressed
MADDLSSLAKDVLLVKGLKSSTLVWRLVVLTLAMIGTSSKIGFLDIKVVQKPCPEPNIEPWEIPYVHYPNPKTYSRAECACHPVRYFAILSMQRSGSGWFETFLNSHANISSNGEIFSVKVRRSNMSTITETLDTIYNLDWLSSASKNECTTAVGLKWMLNQVTTCVA

SEQ ID NO: 143058 - protein, 440 aa, Glycine max
  Coding DNA Sequence Number=SeqID_26280
  Gene Ontology: Mol. function=pectate lyase activity; Cellular component=anchored to membrane
  Homolog annotation: Hit_ID=Q1SQ06; Match level="QueryCoverage=99%, HitCoverage=100%, E-value=0.0, Identity=67%"; Hit description =Pectate lyase, N-terminal; Pectolytic enzyme, Pectin lyase fold
  Pfam annotation: Domain name=Pec_lyase_C; Domain location=171-356; Score=278.5; E_value=1.3e-80; Accession=PF00544.9; Description =Pectate lyase
  Pfam annotation: Domain name=Pec_lyase_N; Domain location=26-79; Score=79.2; E_value=1.3e-20; Accession=PF04431.4; Description =Pectate lyase, N terminus
  Pfam module annotation: Pfam domain module=Pec_lyase_C::Pec_lyase_N; Domain location=171-356::26-79
MAGSASKVTFIFLVAFAISIPCLEAGIAEFDDFLKAQADEAHEIALRSYEPDPINVTAEFNIHVHRALMEESNDTRRELKQKYRGPCLATNPIDRCWRCRKDWAQDRYRLASCGKGFGRRAVGGLHGKIYVVTDSSDDEPINPRPGTLRYGVLQREPLWIIFAQSMVITLKFELLISSDKTIDGRGANVVIKGGAGLAMQFVNNIIIHGIRINKIKSMEGTMLRDLWNHVGIRTRCDGDAVSIFGSSNIWLDHLSLSECEDGLIDIVQGSTGITISNCHMTKHNDVMLFGASDTYAGDKIMQVTVAFNHFGQGLIQRMPRCRWGFVHVINNDYTHWLMYAIGGSSEPTILSQGNRFIAPNNNAAKEITHRDYAPPEEWSKWQWKSENDLFMNGATFLQSGSPLGKLPFNKGLMMKPRPGAEANRLTRFAGALNCKVGKPC

SEQ ID NO: 143059 - protein, 64 aa, Glycine max
  Coding DNA Sequence Number=SeqID_26281
MARPTLLQGDGARFQGDTILQSAGCSASGRHAFRELGHKMCRFELRLECSILRRFFETALECAT

SEQ ID NO: 143060 - protein, 45 aa, Glycine max
  Coding DNA Sequence Number=SeqID_26282
VMHTRRRCIGNILGISVRISQVQLNDLINYRNKNGYNASMRGNVV

SEQ ID NO: 143061 - protein, 148 aa, Glycine max
  Coding DNA Sequence Number=SeqID_26283
  Gene Ontology: Mol. function=RNA-directed DNA polymerase activity; Biological process=RNA-dependent DNA replication
MHPELPDEDIMAMFEEEGEDKDKDKWTIWFDGASNVLDQGIGEVLVSPDKKSLVIHQMEGEWETRDHKLIPYQAYIKELMELFDYISFHHIPRKENQMANALATLSSMFKISPYGDFSCIEIKCHIKPAYCSLIEEEQDGKPWYFDIK

SEQ ID NO: 143062 - protein, 37 aa, Glycine max
  Coding DNA Sequence Number=SeqID_26284
MEWCVQHEDFGGKKLAWASFGRRRARFSCKREEIIIL

SEQ ID NO: 143063 - protein, 54 aa, Glycine max
  Coding DNA Sequence Number=SeqID_26285
MAPKKLTSKKARKTTTGEGSNTTTPVEIEFNGHCFEVIKDWSFLKERRVQLAEA

SEQ ID NO: 143064 - protein, 66 aa, Glycine max
  Coding DNA Sequence Number=SeqID_26286
MLGSALSAPIALSLNYSLLGFLALGFAILGFRLSCKPIRGNADKRGENPCVCAGNHDERTKHAYCA

SEQ ID NO: 143065 - protein, 105 aa, Glycine max
  Coding DNA Sequence Number=SeqID_26287
MNVEEFLQKMAWLGVQPSPLGGGEASAAQEPQQDQEDNILEASKPIPHEPFIFENDPVIVQEDVAIPKPSPQPKPEPSASVLDLPLSQDPSSAPTRDLNEYAQDH

SEQ ID NO: 143066 - protein, 148 aa, Glycine max
  Coding DNA Sequence Number=SeqID_26288
MEEPSKKRKGTSSRSQRHSGAQETPIPSSIPSGSLFSSEKQRNLMSEVYGTKMVIDQPLFYDLTQLPSEGVPFEGALIDDWKFDFSVHDVYRLVCTNQADMTGRLLAGSLAFESRILHYLIVCILLPRSSNLAQVSEEDLIVMWAFHK

SEQ ID NO: 143067 - protein, 95 aa, Glycine max
  Coding DNA Sequence Number=SeqID_26289
VESLVEGLGSIIPIGNTIATSTESDILTLASQVGTSNSSGREDMFCPKHEGYQQRKGIPCKLYSSTIANKDYESKDDEPKEEQGNEGSIFGSIDV

SEQ ID NO: 143068 - protein, 69 aa, Glycine max
  Coding DNA Sequence Number=SeqID_26290
MMIWKQRAKLVMATARWALKHPVYGIVILRTMFLKENCRNLPFGGRATRDSRDACSTKGIRAESPPTFI

SEQ ID NO: 143069 - protein, 105 aa, Glycine max
  Coding DNA Sequence Number=SeqID_26291
  Subcellular localization annotation: CTP_CleavageSite=69; ConfidenceScore=5.11e-01
MADRGRGGGRRTFNRGTKRGTHNLRAPITTNPSPSSIHISTSESMIHVVAQTPNTLPTAQGQPNPTFVRESIPTTTTRKYTFNICYLEHSTSVLKPMLKVTMLNV

SEQ ID NO: 143070 - protein, 304 aa, Glycine max
  Coding DNA Sequence Number=SeqID_26292
  Gene Ontology: Mol. function=hydrolase activity; Cellular component =nucleus; Biological process=metabolic process
  Homolog annotation: Hit_ID=Q1SZI1; Match level="QueryCoverage=98%, HitCoverage=94%, E-value=1e-116, Identity=65%"; Hit description =Lipolytic enzyme
  Pfam annotation: Domain name=Abhydrolase_3; Domain location=79-279; Score=176.2; E_value=7.9e-50; Accession=PF07859.3; Description =alphabeta hydrolase fold
  Pfam annotation: Domain name=Chlorophyllase; Domain location=30-277; Score=-194.0; E_value=0.091; Accession=PF07224.2; Description =Chlorophyllase
  Pfam module annotation: Pfam domain module=Abhydrolase_3::Chlorophylla se; Domain location=79-279::30-277
MDSTTAANEVVHEFLPLLRVYKDGRIERLLGTETTPSGTDPRTTVQSKDVTINAQTGVAVRLYLPPAAASSATKKLPLLIYIHGGAFCVCTPYNPAYHHHLNAVSAAANVVVASVHYRLAPEHPLPAAYEDAWEVLQWAAAGPEPWLNSHADLNTVFLAGDSAGANIAHNVAMRGTMEGFTGLTLQGMVLLHPYFGSDKKDELLEFLYPSYGGFEDFKIHSQQDPKLSELGCPRMLIFLSEKDFLRERGRSYYEALKNSGWKGKVEMVEFEGEDHVFHLFDPTKDKSVDLVKQFVAFISQRSQL

SEQ ID NO: 143071 - protein, 56 aa, Glycine max
  Coding DNA Sequence Number=SeqID_26293
MWWKGSNVDYETVRDFSNDQDAMDLASIPDPPYEEPYTNFKEMHDLETGYEIEEML

SEQ ID NO: 143072 - protein, 127 aa, Glycine max
  Coding DNA Sequence Number=SeqID_26294
  Gene Ontology: Mol. function=hydrolase activity; Biological process =metabolic process
MEIPFFHSWTWLRKQFDGARKQRFHNLDSSTNEERVLHILQHIILSNKNQHAIASKPQTQFSPLPKSKDAPKTIPSTFTPGSPWAPAREYPCAVRCSLIRRRFWKSLRLWRWRLLRDRDPAERRRSL

SEQ ID NO: 143073 - protein, 131 aa, Glycine max
  Coding DNA Sequence Number=SeqID_26295
  Homolog annotation: Hit_ID=Q7F805; Match level="QueryCoverage=83%, HitCoverage=10%, E-value=5e-08, Identity=32%"; Hit description=Oryza sativa (japonica cultivar-group) genomic DNA, chromosome 1, PAC clone:P0433F09
MDFRSIPPLAINPNIPEGLGGELRRVILQKEESDVRRWKGSMNGEFSGKATYLHLHGKIFGNYFDVDFQEIWRINVPSKINIFIWRVFRNRMPTADNLRKINLLTSEMDGKCPFCKEDDESLSHGLFTYRM

SEQ ID NO: 143074 - protein, 78 aa, Glycine max
  Coding DNA Sequence Number=SeqID_26296
VEILCCAEQEIVALLLAVPHFKEQSELVVPVHDARRGGPESRQLVPPLIKRVLHLQFHRSEAPIHRKERTIRDGSMER

SEQ ID NO: 143075 - protein, 139 aa, Glycine max
  Coding DNA Sequence Number=SeqID_26297
  Gene Ontology: Mol. function=hydrolase activity, acting on glycosyl bonds; Cellular component=beta-galactosidase complex; Biological process=carbohydrate metabolic process
  Homolog annotation: Hit_ID=Q0EDA9; Match level="QueryCoverage=58%, HitCoverage=11%, E-value=9e-30, Identity=72%"; Hit description=Beta -D-galactosidase
  Pfam annotation: Domain name=Glyco_hydro_35; Domain location=10-139; Score=-184.7; E_value=0.0027; Accession=PF01301.10; Description =Glycosyl hydrolases family 35
LAFVSRDHKAIIINGQRMILLSGSIHYLRSTPEMWPDLVQKAKEGGLDVIQTYVSGMDMNLHLENKQASMLTSELVLMFVLNGTSDLTIVEFFSNRNLESVDIASSTFAKTASPFSLSPNPAPAPAPDFLNLTELLTVA

SEQ ID NO: 143076 - protein, 108 aa, Glycine max
  Coding DNA Sequence Number=SeqID_26298
MAATVSNSVRFRKSGAGAGAGFGLREKGLAVLANVELKSSIMLLTMKIIENSISSLATGLSYLAISTLSKFLFEKNSTMEIHLSLPEVPLSTNIRTNSEVNIEACLLH

SEQ ID NO: 143077 - protein, 85 aa, Glycine max
  Coding DNA Sequence Number=SeqID_26299
MPCHISILWLSSQPVQEHGLWEVKHDVASGNTMLQCKKSEDVSVKKEEDIKDTNTSTSEAGTIKNQATSEDVKDNRRLRAIAINT

SEQ ID NO: 143078 - protein, 188 aa, Glycine max
  Coding DNA Sequence Number=SeqID_26300
  Homolog annotation: Hit_ID=Q9ZUS6; Match level="QueryCoverage=30%, HitCoverage=16%, E-value=4e-07, Identity=52%"; Hit description =Chloroplast lumen common protein family
MEHLQSMDGCCRLPSCSNYPNQYSYSLLLLPRPYPWILFPNCATLLHFPLPYPLPSLSPPHFPSLSFRLSFIRTSSSSSQNNLAFCTPRKTPPFSPQNHLHRHRRYCLLLHALPPHARHHRCLAHFLVVETDTSFTKEEAGRILKECLSTNPCDTDALHTLMEVKIKPRKMDEVFGVLDRLIELEPEK

SEQ ID NO: 143079 - protein, 124 aa, Glycine max
  Coding DNA Sequence Number=SeqID_26301
MGEAEEVQEKMKAEVEAMKERMATMVESMMSIKEMVEVSAAYQTRARAKIMGEVEKAKIWEVWAAPHYAQIQNKHAFPPYGWPPNYTPPNVAYIPNEDFNNSDPILIEMSLNPWARHMKFPTTI

SEQ ID NO: 143080 - protein, 231 aa, Glycine max
  Coding DNA Sequence Number=SeqID_26302
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=93%, HitCoverage=31%, E-value=1e-28, Identity=45%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKKSKVRFADNRVIQAEGAGNVAVRRLDGRQAMITYVLYVLGMKSNLISMGQLLEKGFSMEMSNGSLEVYDTTKKMIMKAPLAKNKTFKKNLLHNFWGEAAMTATHVLNRCPTKRLNSMVPEEAWSDSKPSVKHFIIFDSLCCKHVPDQKRKKHYDKSEPMIFVGYNSKGSYKLYNPNTIEVLFSRDVYFDESKSWSEPQSITETIPRLQLDWEEIDIGKEATQGTLNTKQ

SEQ ID NO: 143081 - protein, 117 aa, Glycine max
  Coding DNA Sequence Number=SeqID_26303
  Subcellular localization annotation: CTP_CleavageSite=51; ConfidenceScore=5.29e-01
MGECKRCSLTIAAIEQPSSSQHSISKKRKTTASFQLRSSDTQFPDTIVSPEASVSSTGTVVSGDFCSDRSCCSSSHFKDLHSVPSDLQTKGFQTVEDSTNRYFKPFSESRVNNVICR

SEQ ID NO: 143082 - protein, 258 aa, Glycine max
  Coding DNA Sequence Number=SeqID_26304
  Gene Ontology: Mol. function=oxidoreductase activity; Cellular component=vacuole; Biological process=hydrogen peroxide catabolic process
  Homolog annotation: Hit_ID=Q9FX85; Match level="QueryCoverage=97%, HitCoverage=72%, E-value=6e-81, Identity=60%"; Hit description =Peroxidase 10 precursor
  Pfam annotation: Domain name=peroxidase; Domain location=1-221; Score= 304.8; E_value=1.6e-88; Accession=PF00141.13; Description=Peroxidase
MYGCDASVLLDDTPYFTGEKNALPNRNSLRGFEVIDDIKEHLERICPSTVSCADILALAAREAIDQIGGPSWQVQLGRRDATTTSKEAAEQQIPSPIEPLENITAKFFSKGLDMKDVVALSGAHTIGFARCFTFKGRLFDFQGSGRPDPALDFSLLSKLQNTCPNEDASNSNLAPLDATSTMMFDNEYYRNIVYNTALLESDQALLKDRRTAPTVYYYSNNRFSFYNDFAKSMVKLSNVGVLTGAEGQIRYKCGSVNY

SEQ ID NO: 143083 - protein, 135 aa, Glycine max
  Coding DNA Sequence Number=SeqID_26305
  Gene Ontology: Mol. function=phosphoprotein phosphatase activity; Cellular component=cytoplasm; Biological process=protein amino acid dephosphorylation
  Homolog annotation: Hit_ID=O04951; Match level="QueryCoverage=89%, HitCoverage=39%, E-value=2e-69, Identity=95%"; Hit description =Serine/threonine-protein phosphatase PP2A-5 catalytic subunit
MSPGLPNNCTCMLQVPHEGPMCDLLWSDPDDRCGWGISPRGAGYTFGQDIAAQFNHTNGLSLISRAHQLVMEGFNWCQDKNVVTVFSAPNYCYRCGNMAAILEIGENMDQNFLQFDPAPRQIEPDTTRKTPDYFL

SEQ ID NO: 143084 - protein, 106 aa, Glycine max
  Coding DNA Sequence Number=SeqID_26306
MSTPFVQQPPPIEVTQQAYTTHSGHGLCSGRRVMGHGEFDVETWVETKCSSCVDGRIAPPPPRPRPPPPPEHNSGEESPPEEPPQEIKEQQQQREEEQHSHSPSNS

SEQ ID NO: 143085 - protein, 179 aa, Glycine max
  Coding DNA Sequence Number=SeqID_26307
  Homolog annotation: Hit_ID=Q1T0Y0; Match level="QueryCoverage=33%, HitCoverage=6%, E-value=1e-09, Identity=49%"; Hit description =Ovarian tumour, otubain
MVKLMCRSHNHDLAKSLVGHPYAGRLTKDEKIIIVDMTKSMMKPRNIFLTLKEHNVNSYTTIKQIYNARNAYHSSISGVTTYSSDMITLQHTEIKRRLSFSDQWLSEPEVNITKEMETISKRFEEFHVCGKVTLKSKLWEIVYPDLNSMCAPLEKVKIKCAQKKLMTKHQRSTKRDPSY

SEQ ID NO: 143086 - protein, 97 aa, Glycine max
  Coding DNA Sequence Number=SeqID_26308
  Gene Ontology: Mol. function=hydrolase activity; Cellular component =protein phosphatase type 2A complex; Biological process=negative regulation of tyrosine phosphorylation of Stat3 protein
  Homolog annotation: Hit_ID=Q6VUQ4; Match level="QueryCoverage=90%, HitCoverage=81%, E-value=2e-41, Identity=85%"; Hit description =Protein phosphatase 2A catalytic subunit
MPSHADLERQIEQLMDCKPLSESEVKALCDQARTILVEEWNVQPVKCPVTVCGDIHGQFYDLIELFRIGGNAPDTNYLFMGDYVGQSFFFNSISPSL

SEQ ID NO: 143087 - protein, 73 aa, Glycine max
  Coding DNA Sequence Number=SeqID_26309
MGASISNDGSRDSKPAKQIRSNKIYNNFSIVSSGGGGLFLKGTRQWGWRVGHVAASGGLTSGVGELLWSRHSY

SEQ ID NO: 143088 - protein, 293 aa, Glycine max
  Coding DNA Sequence Number=SeqID_26310
  Gene Ontology: Mol. function=chitin binding; Cellular component =extracellular region; Biological process=chitin metabolic process
  Homolog annotation: Hit_ID=UPI000044A8F0; Match level="QueryCoverage =54%, HitCoverage=99%, E-value=5e-24, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAFIGLHGLTFRELQVLTFRGLHALTFRGPHVLAIKGLHALTFRGLHVLTFRGPHVLTFRGLHALTLRGLHALTFRGLHALAFVGLHALTFKGLHVLTIGGLHALAFRGLHVLAIRGLHALTFRGLHVLSFRGLHALAFRGLHVLSFRGLHALAFRGLRVLTFMRIMHTNMTTLTQIWMTLLLSNIPPGDHNADLPLRKDRAHKTPSGPKEVQQGPGVSSSSYGPLSVPQGIAPARHPVDPEKSNRLLRFLALITGLCQFYGVPIAPNKVIRPPINRAFVKKYYASQAGA

SEQ ID NO: 143089 - protein, 102 aa, Glycine max
  Coding DNA Sequence Number=SeqID_26311
MDQCSFEHPEHSVIGESEHSMVDYSFEHSENMAQPPPRERTQREMVAPDFTYESLCIQYPDEDFPYVLKTGLIHLLPKFHGLAGSGKGLAILPCSKVHHELG

SEQ ID NO: 143090 - protein, 43 aa, Glycine max
  Coding DNA Sequence Number=SeqID_26312
MVKKPTCLGKLQLPQSDPLPINRRPRGVLNGSKVQKLRELREE

SEQ ID NO: 143091 - protein, 69 aa, Glycine max
  Coding DNA Sequence Number=SeqID_26313
MASTLIYLPSPEVASTLTYLPSLEVASSKIKQSAPSQVHIIWNLRGNTSGKRQEGIHYTKAYIESIKRE

SEQ ID NO: 143092 - protein, 85 aa, Glycine max
  Coding DNA Sequence Number=SeqID_26314
MSSLSTVVVATDNHVDDDNNGYDNNHDSDSGIKSFVVHVNGDSDKLTITMTTAVMVVVPVDNHGGDCYDGHDSCRENGNDSNDKF

SEQ ID NO: 143093 - protein, 161 aa, Glycine max
  Coding DNA Sequence Number=SeqID_26315
  Gene Ontology: Mol. function=receptor activity; Cellular component =outer membrane-bounded periplasmic space
  Homolog annotation: Hit_ID=Q0K3Z7; Match level="QueryCoverage=100%, HitCoverage=49%, E-value=4e-57, Identity=65%"; Hit description =Probable extra-cytoplasmic solute receptor precursor
VVEGGRAAAVRYVYDRGLGGGLVEFAYHVYRRAHAGRAEVQRFRLGLGLRGKLGKGGGLQRWIGHHNVRHLGDDGDELQVVGGAVVQGFVDAVGGVQADGAEQQGVAIGPGIGHVFAADMAAGAGPVLDHDGLAIELAQVFGEQAPLDVRTAAGRERYDDP

SEQ ID NO: 143094 - protein, 186 aa, Glycine max
  Coding DNA Sequence Number=SeqID_26316
  Gene Ontology: Mol. function=transcription factor activity; Cellular component=membrane; Biological process=regulation of transcription, DNA-dependent
  Homolog annotation: Hit_ID=Q0K3Z6; Match level="QueryCoverage=94%, HitCoverage=57%, E-value=1e-63, Identity=66%"; Hit description =Transcriptional regulator, LysR-family
MVGPHHADRRALVQAVQRQVRAVQRHRRHHHVVGAMQQAFAQVLAANGLHVDVHVGIALREFLDRARQHAQAQRRRAGQPQHAAAAAAHGCHAVLDALQAHEVPLDGVEQVLGLACRTQAATLHVEQLQAAGLLRLRQQAADRRLGGAQHLRGTRGGAGQHYRVEGFDLTEIQRSAHGVTGYCKPA

SEQ ID NO: 143095 - protein, 106 aa, Glycine max
  Coding DNA Sequence Number=SeqID_26317
MEDFLEGPLLGNHGTQLQTQKWRTHERQRNSFMRLRNKMRMEDSLEGPFLGNHGTQLQTRKWRTHERQCNSFMWLRNKMRMEDCLEGLLLGNHGTQLQTRKWRTHE

SEQ ID NO: 143096 - protein, 177 aa, Glycine max
  Coding DNA Sequence Number=SeqID_26318
  Gene Ontology: Mol. function=transition metal ion binding; Biological process=cytoskeleton organization and biogenesis
MTAVASDITRSAKISVPPTCHTMSTVEKRIFCKCLRNVKVPQGYSSNIKSLIALNDLKLVGLKSHDCHVLMQQLLPVAIRGILPDKVRVAITHLCFFSMPSIAKSLTLNNRMIWRMRLPLSFVNWRFQAFGVLETRHDWTRGGKGTRGYNVVTMTQQDVSQAHFYILNNTQEVIPYI

SEQ ID NO: 143097 - protein, 104 aa, Glycine max
  Coding DNA Sequence Number=SeqID_26319
MSTLSRATIPKYVVNFFLWGPSALPIAGSTWTTGLLAPSGLVDNDRRREAFHVRFTADGEADVSEIGGGRGGEGGEGGGGGGGVLEAEKKEGSDQQFEGCTFRN

SEQ ID NO: 143098 - protein, 70 aa, Glycine max
  Coding DNA Sequence Number=SeqID_26320
MRVPLRLKCSSWCEVRRQATTARGGYRWSWVVEKKVLSKLVSLSGSPLFALSATIRTEPNSLCTNSHLVH

SEQ ID NO: 143099 - protein, 338 aa, Glycine max
  Coding DNA Sequence Number=SeqID_26321
  Gene Ontology: Mol. function=serine-type endopeptidase activity; Cellular component=periplasmic space; Biological process=proteolysis
  Homolog annotation: Hit_ID=Q7CKD3; Match level="QueryCoverage=78%, HitCoverage=55%, E-value=1e-116, Identity=79%"; Hit description =Periplasmic serine protease Do
  Pfam annotation: Domain name=PDZ; Domain location=201-278; Score =30.8; E_value=4.7e-06; Accession=PF00595.14; Description=PDZ domain (Also known as DHR or GLGF)
  Pfam annotation: Domain name=PDZ; Domain location=96-185; Score=63.8; E_value=5.5e-16; Accession=PF00595.14; Description=PDZ domain (Also known as DHR or GLGF)
  Pfam module annotation: Pfam domain module=PDZ::PDZ; Domain location =201-278::96-185
LRVGDYTVAIGNPYGLGETVTSGIVSALGRSGLNVENYENFIQTDAAINRGNSGGALVNLNGELIGINTAILAPDGGNIGIGFAIPSSMVKNLTAQMVEYGQVKRGELGIMGTELNSELAKAMKVDAQRGAFVSQVLPNSAAAKAGVKAGDVVVSMNGKALTSFAALRAEVGSLPVGTKLQLGLLRDGKPLNVTVELQQSSQDKVQSATIYTGIEGADLSNVDSNGQKGVRVDSVKAGSAAARIGLKKGDVILGVNQQAVSNLGELRLAFFIACMLLRPQSSVPSQCDRCRNSGNRPAAMCSCTMPGAIGMRILSWRSRAYWRIARGRAAGAVTGQGG

SEQ ID NO: 143100 - protein, 364 aa, Glycine max
  Coding DNA Sequence Number=SeqID_26322
  Gene Ontology: Cellular component=membrane; Biological process =polysaccharide biosynthetic process
  Homolog annotation: Hit_ID=Q4ZRG8; Match level="QueryCoverage=56%, HitCoverage=50%, E-value=5e-30, Identity=34%"; Hit description =Polysaccharide biosynthesis protein
PDAAHSQFTAVPQPAAESVSDDAFLLFAADGFAPSAALLQEVATLSHQRPELNCMLVSLAPRALSSGLQPSLQLFQQLQAQRLWQQNNYAVILRAALVKNAAPLVRIQDVMLAGLLNTQTVWLLDARAEHQVTTVNPPPSYQQFMTEYEKVTPFRYGSLRSRGLLFYIADLAAAAGRGRFNHADARGGTLPGKSGRICLVSGAVCHADPLLSVLHPGAGGARLAGDAMDRHALAGCAALARQRCGGGRGDHGLAQRREPDHYHAAYFWRGTGDPAVPESAADLLYLAIAGVDCRGRLLYLEILAAFSSAVWTFISQIDRLVLSKTLPLSEYGSFTVVATAATGILLLSSPIMQAIVPRMTGMKT

SEQ ID NO: 143101 - protein, 128 aa, Glycine max
  Coding DNA Sequence Number=SeqID_26323
  Homolog annotation: Hit_ID=Q0PJC1; Match level="QueryCoverage=23%, HitCoverage=19%, E-value=9e-09, Identity=90%"; Hit description=MYB transcription factor MYB122
MVRTPSCDKSGMRKGTWTPKEDMKLIAYVTSDVVGSNSIGCLIMVSWPFGIARMPRRLSVLAVTKRAKTCGLDWFGFGSRITITTTDIHLLHVHGVERAYEVEELNHEEALELFNWRAFRGNKLILVI

SEQ ID NO: 143102 - protein, 79 aa, Glycine max
  Coding DNA Sequence Number=SeqID_26324
MSLCGSPPTRYKFGDGAIAFGVGGVFAGAFGAAAGAGEMAMVVEKRSRKSEKEKIVACFIFQLPSQALWMALMILDECE

SEQ ID NO: 143103 - protein, 403 aa, Glycine max
  Coding DNA Sequence Number=SeqID_26325
  Gene Ontology: Mol. function=lipoic acid binding; Cellular component =mitochondrion; Biological process=glycolysis
  Homolog annotation: Hit_ID=Q8UFG7; Match level="QueryCoverage=99%, HitCoverage=85%, E-value=0.0, Identity=87%"; Hit description =Pyruvate dehydrogenase beta subunit
  Pfam annotation: Domain name=Biotin_lipoyl; Domain location=2-64; Score=62.3; E_value=1.6e-15; Accession=PF00364.12; Description =Biotin-requiring enzyme
  Pfam annotation: Domain name=Transket_pyr; Domain location=136-314; Score=243.8; E_value=3.6e-70; Accession=PF02779.14; Description =Transketolase, pyrimidine binding dom
  Pfam annotation: Domain name=Transketolase_C; Domain location=328 -403; Score=67.1; E_value=5.5e-17; Accession=PF02780.10; Description =Transketolase, C-terminal domain
  Pfam module annotation: Pfam domain module=Biotin_lipoyl::Transket _pyr::Transketolase_C; Domain location=2-64::136-314::328-403
MEEGTLSKWLKKEGDKVTSGDVIAEIETDKATMEVEAVDEGVIGKLLIDAGTEGVKVNTPIAVLIQEGESADDISSSAKKEEPKAEAANSGSDAAGGKTREATEEPSASKEAAKVPAAPKIEVAADPDIPEGTEMVMTTVREALRDAMAEEMRADEKVFIMGEEVAEYQGAYKITQGLLDEFGPKRVVDTPITEHGFAGVGVGAAFAGLRPIVEFMTFNFAMQAIDQIVNSAAKTLYMSGGQMGAPMVFRGPSGAAARVAAQHSQCYAAWYSHIPGLKVVMPYTAADAKGLLKAAIRDPNPVIFLENEILYGHHFDVPKLDDFVLPIGKARIHKQGKDATIVSFGIGMTYAVKAAEELAEQGIDVEIIDLRTIRPMDIPTVIESVKKTGRLVTVEEGFPQSSV

SEQ ID NO: 143104 - protein, 149 aa, Glycine max
  Coding DNA Sequence Number=SeqID_26326
  Gene Ontology: Mol. function=RNA-directed DNA polymerase activity; Cellular component=intracellular; Biological process=RNA-dependent DNA replication
MKFQTLTSEIVIVKVDQKQARQCYTEILKVAPYLPIKELGKPHPTSRGNDNQANAKWRMCTNYTNLNRVCPKDYALPNFDRPLDGAFGFQLLSFLDICSEYNQIRMHPLGEEKTAFITKDTHFCYRVVPFRQKNRRATHQRLMDQVFKQ

SEQ ID NO: 143105 - protein, 119 aa, Glycine max
  Coding DNA Sequence Number=SeqID_26327
MKVLPYIVDESNIVGGVRSGGRMTNKLEMPNIAICPFFSDKLLLNLLSIPVSGKGSDPYRGKACCATASCKHCFTPEKKDTFLLNTEYLSLLRGTEFVSMASIGVLLGIASRELLLAIV

SEQ ID NO: 143106 - protein, 128 aa, Glycine max
  Coding DNA Sequence Number=SeqID_26328
MSGHRVRHRGSCSFTSALDFYLALYSNSSILGQDQLQYSRAGCQDIVSDIVDPATYLALCISPVESPTVATYPSAGGRHGAHGCIFQGRKARGVATNVYSRKTSEKPERCGLRTLIVKGSGVVFMHGE

SEQ ID NO: 143107 - protein, 105 aa, Glycine max
  Coding DNA Sequence Number=SeqID_26329
  Subcellular localization annotation: CTP_CleavageSite=50; ConfidenceScore=5.21e-01
MACSKNTWMWVHVIFGSKNTSQKCMLGSKNTSQKKWPQESFHQRGPGRTLSEKAPELPSQLTHILTGTDSGEQSISSASRPSRDGHSSERGDGSLLVGLLWRLDL

SEQ ID NO: 143108 - protein, 138 aa, Glycine max
  Coding DNA Sequence Number=SeqID_26330
MQYTDLLPSLLSNQLAVVSLGRVYQPPFPRWYKPNATCPYHGGIPRLTFQEDSPNVFRKAGMVEYNGDKGDRSPLHPWELHDVETCLVSKELLQGLIDEGRIEIGRVMREEGEVFMQSSDTNLEMLPLKCLEVSNPLW

SEQ ID NO: 143109 - protein, 47 aa, Glycine max
  Coding DNA Sequence Number=SeqID_26331
MEKGTSHSMEKGFKILLFPIIDSLGNPLRIFTCRIRACVMKFMILEE

SEQ ID NO: 143110 - protein, 50 aa, Glycine max
  Coding DNA Sequence Number=SeqID_26332
ETAGQIGEFQVAEVAVVGSGGRLAFSDGRPKASCNCHWRVKGKLQLPLAS

SEQ ID NO: 143111 - protein, 94 aa, Glycine max
  Coding DNA Sequence Number=SeqID_26333
MGHLSHFNQTHAEVNVWRIAYSYDADIGFMSWGGNLIDIQQFSNGGIDLYVCVAYIELDINYICEREFFRGCITEELQEIQKVLKGGSELGSTA

SEQ ID NO: 143112 - protein, 107 aa, Glycine max
  Coding DNA Sequence Number=SeqID_26334
  Pfam annotation: Domain name=LRR_1; Domain location=2-24; Score=15.2; E_value=0.24; Accession=PF00560.23; Description=Leucine Rich Repeat
  Pfam annotation: Domain name=LRR_1; Domain location=31-53; Score=6.6; E_value=16; Accession=PF00560.23; Description=Leucine Rich Repeat
  Pfam annotation: Domain name=LRR_1; Domain location=55-77; Score=7.8; E_value=10; Accession=PF00560.23; Description=Leucine Rich Repeat
  Pfam annotation: Domain name=LRR_1; Domain location=79-100; Score =4.7; E_value=37; Accession=PF00560.23; Description=Leucine Rich Repeat
  Pfam module annotation: Pfam domain module=LRR_1::LRR_1::LRR_1::LRR _1; Domain location=2-24::31-53::55-77::79-100
MKLKKLVLAGNYLTGRIPNAFYGLNELLIFQLLIFELSSSSLSGSLPLTLGRLTSALKLDVNNNHLEGNLLNEFANLNYLTLMDLRNNRFTRGLTLMPPLHKALLSG

SEQ ID NO: 143113 - protein, 65 aa, Glycine max
  Coding DNA Sequence Number=SeqID_26335
MGILYGGDNNYNNNNNNNNNNDGDDARGGVVIMVAIGNDGCDGGNDNYKNDYYQMIMNGECVFQN

SEQ ID NO: 143114 - protein, 66 aa, Glycine max
  Coding DNA Sequence Number=SeqID_26336
  Gene Ontology: Mol. function=unspecific monooxygenase activity
  Homolog annotation: Hit_ID=UPI00006A2901; Match level="QueryCoverage =47%, HitCoverage=20%, E-value=2e-10, Identity=96%"; Hit description =UPI00006A2901 related cluster
  Subcellular localization annotation: CTP_CleavageSite=5; ConfidenceScore=5.04e-01
ASAARAGRRVPVGGRIGNGPFGASSPGVEQSTQNCALNVKVKKFNQARVNGGSNYDSLKVAKCLVI

SEQ ID NO: 143115 - protein, 161 aa, Glycine max
  Coding DNA Sequence Number=SeqID_26337
  Homolog annotation: Hit_ID=Q5CEG7; Match level="QueryCoverage=55%, HitCoverage=84%, E-value=2e-36, Identity=82%"; Hit description =Senescence-associated protein
  Subcellular localization annotation: CTP_CleavageSite=37; ConfidenceScore=5.56e-01
MNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 143116 - protein, 75 aa, Glycine max
  Coding DNA Sequence Number=SeqID_26338
MYVNLPNYGYFCLLSEAVVSSALSARLALSQISLTHAKRKNGASAPSRNFSIDKCTVSLELDRAGLDNCSARHSV

SEQ ID NO: 143117 - protein, 203 aa, Glycine max
  Coding DNA Sequence Number=SeqID_26339
  Gene Ontology: Biological process=nitrogen fixation
  Homolog annotation: Hit_ID=Q9M2C3; Match level="QueryCoverage=64%, HitCoverage=83%, E-value=7e-30, Identity=47%"; Hit description =Nodulin-like protein
  Pfam annotation: Domain name=DUF125; Domain location=44-163; Score =28.0; E_value=1.3e-05; Accession=PF01988.9; Description=Integral membrane protein DUF125
MENNNIQPCHDDLDRREANNPPKMLNLEVEGQREGFDYAKRPKWLRAAVLGANDGFVSTTSLMMGVGGVRKDVKSMLLTGVAGMVAGVCSLAIGDFVFVYSQYAIGIGVQLLGAAFFNTYKARLGVVVAVVTLALIIFGDFGAFLGKAPRVKSTLRSAGVQFAQRDQVVQPNNPISQPSMTTNVPNREQASARQEAVAQLAES

SEQ ID NO: 143118 - protein, 56 aa, Glycine max
  Coding DNA Sequence Number=SeqID_26340
  Homolog annotation: Hit_ID=Q9CA40; Match level="QueryCoverage=57%, HitCoverage=22%, E-value=1e-07, Identity=60%"; Hit description=Nudix hydrolase 1
MVDVDVVKEQVPQNLEPTKCDGWDWYEWDHLSHPLLGPLEKMDARKFVKRLIQKQH

SEQ ID NO: 143119 - protein, 179 aa, Glycine max
  Coding DNA Sequence Number=SeqID_26341
  Subcellular localization annotation: CTP_CleavageSite=62; ConfidenceScore=5.24e-01
MDRARLVYGLVTNIDMNIGALISVNFRGARKARVRPTDVPSSSTPPAPSTSTTHIPTPPGLSAQDSQRFKSMLQSLHQGQILLMQSLQVVAPLGSILTVEQFIEKVSWPGTLPSLEREGGGPSAQVPRQVQDASSEATIPEPFIFEADETQVRQEAATPERSPHISLDPPSPVVDQSSL

SEQ ID NO: 143120 - protein, 88 aa, Glycine max
  Coding DNA Sequence Number=SeqID_26342
MRKTSTNSRVSNSERVKQEQLGGCSAAQIFDVVGSTSPDLQSRPKTRVDMCHRVVGQWIHVTKNKHGWAMAWWKLAPLNEANAVNAVK

SEQ ID NO: 143121 - protein, 67 aa, Glycine max
  Coding DNA Sequence Number=SeqID_26343
MDLRRGWQHKPRSTIATKNKGGYVSSGGWAVDTCDQEQAWLGSGLVEASAIQRSKHCRRGEIDLGVT

SEQ ID NO: 143122 - protein, 103 aa, Glycine max
  Coding DNA Sequence Number=SeqID_26344
MMKLDLYKYGKKFDSSLPKSLWGKTLKNTIYIFLRYQLKYSLRTLIGLSQGNPNIRHMHIWGCPAEAMPYKLHEDKLDLKSSLSIPSTSRGGPVPAFVPFSEG

SEQ ID NO: 143123 - protein, 102 aa, Glycine max
  Coding DNA Sequence Number=SeqID_26345
MRILFIGQGSKWSKVVSQQGLFSWEPDLDIWGTTNSCVKARVTLMIRKQRAKLVMATARWALKHPVYGIVILQLGIYTNRPNVSKLCSFIGSMKPSILISVI

SEQ ID NO: 143124 - protein, 275 aa, Glycine max
  Coding DNA Sequence Number=SeqID_26346
  Gene Ontology: Mol. function=oxidoreductase activity, acting on the CH-CH group of donors; Biological process=electron transport
  Homolog annotation: Hit_ID=Q65YX1; Match level="QueryCoverage=98%, HitCoverage=66%, E-value=3e-90, Identity=58%"; Hit description=Acyl -CoA dehydrogenase-family protein
  Pfam annotation: Domain name=Acyl-CoA_dh_M; Domain location=120-170; Score=16.6; E_value=0.0008; Accession=PF02770.9; Description=Acyl -CoA dehydrogenase, middle domain
MSILSTGTDYDTLAAHFRPLFARIAAGAAERERTRTLPYEPLQWLKEAGFGTVRIPQQKGGWGASLPQLFQLLIELAEADSNLPQALRAHFAFVEDRLNQPDNAERDAWFRRFVDGELVGSGWTEIGNVRLGDVITRVTPAANGWTLNGEKFYSTGALFADWIDVYARRDDNQGDVIALVNTHQPGVTREDDWDGFGQRLTGSGTTRFEHAHVETQHVYDFATRFRYQTAYYQHVLLATLAGIARAVARDGAAAVAARNRVYSPGNGAASRQDAQ

SEQ ID NO: 143125 - protein, 217 aa, Glycine max
  Coding DNA Sequence Number=SeqID_26347
FSSYRQQKVYTDSHSGIFARQRDSKVSMTDLVSAEDDVNLRVQLKVYTDNNTGISARQRDSKVNMTDLVSVEDYRDSKVNMTDLVSAEDDTAKVYTDNHSGISARQRDSIESMTDLVGAEDDVYLRVSTGFSSYRQQKVYTDNHSGISARLRHSKVSMTDLVSAEDDGTEDDVSLCVLLGFSSYRQQKVYTDNHSGISARQRDSQVSMTDLVSAEDD

SEQ ID NO: 143126 - protein, 177 aa, Glycine max
  Coding DNA Sequence Number=SeqID_26348
  Gene Ontology: Mol. function=diaminohydroxyphosphoribosylaminopyrimidi ne deaminase activity; Biological process=riboflavin biosynthetic process
  Homolog annotation: Hit_ID=P44326; Match level="QueryCoverage=60%, HitCoverage=29%, E-value=2e-49, Identity=87%"; Hit description =Riboflavin biosynthesis protein ribD [Includes: ...
  Homolog annotation: Hit description=Diaminohydroxyphosphoribosylaminop yrimidine deaminase (EC 3.5.4.26) (Riboflavin-specific deaminase); 5 -amino-6-(5- phosphoribosylamino)uracil reductase (EC 1.1.1.193) (HTP reductase)]
  Pfam annotation: Domain name=dCMP_cyt_deam_1; Domain location=6-106; Score=159.2; E_value=1e-44; Accession=PF00383.13; Description =Cytidine and deoxycytidylate deaminas
MSDTFSPDDVKFMQLALELAAKGQYTTTPNPSVGCVLVKNGEIVGKGFHFKAGQPHAERVALADAGEKAKGATAYVTLEPCSHYGRTPPCALGLIEAGVSRVVAAMADPNPQDQAYRYRRPRGGARYQLLFPLVRVNFELGVIMVIAVSCVKLLSAHNSTQHTSRKHKSVKSGVPNE

SEQ ID NO: 143127 - protein, 152 aa, Glycine max
  Coding DNA Sequence Number=SeqID_26349
QEVAALIQRKQLKDLGRGCRSKGFAFDVLMMPYDRDDLMSYENALIKFNSRQQSKNTRYNIKKISSILGREFQIEIAKGSLVVKKYEHKGRVALVWFRTCKGILQDSGTLKQVAWGLDVGTRGPVTRVMSKRLQEDWARAIEEGPRVLMNLR

SEQ ID NO: 143128 - protein, 63 aa, Glycine max
  Coding DNA Sequence Number=SeqID_26350
LLKLQTLDQTLVSREKHQLCKEMQRGQSKDQGIEVMESVGMLGTYLRKILLKNGIILFAWGQA

SEQ ID NO: 143129 - protein, 138 aa, Glycine max
  Coding DNA Sequence Number=SeqID_26351
MYTDNHSGISARRRDSKVSMTDFVSTEDDVNLRVSTGLSAAIDEGRRRRHSKKVYTDDHSGISARQRDSKVSMTDLVSAEDDVNLRVSMGLSLAIDEGRRRQRYSLCSIRLFVLPIAKRFIQMTTRVSPPVSVTQKSV

SEQ ID NO: 143130 - protein, 36 aa, Glycine max
  Coding DNA Sequence Number=SeqID_26352
MAVLPSSSSSLELTISVPGFASSPTLLPSSSVVSMI

SEQ ID NO: 143131 - protein, 116 aa, Glycine max
  Coding DNA Sequence Number=SeqID_26353
MDSHCLLSLRLVFQLLVLAQRRVVLIPQGAIQARVGVEEVRDADAPIPVPTEEVKLVGQALNTFLAWATHLVKRLPKQGAVEPVKPTDRPNHDIDDPLYLMILTIPQLFLKSLQVM

SEQ ID NO: 143132 - protein, 157 aa, Glycine max
  Coding DNA Sequence Number=SeqID_26354
  Gene Ontology: Mol. function=RNA-directed DNA polymerase activity; Biological process=RNA-dependent DNA replication
MVIPKFKVPDFDKYKGTTCPKNHLKMSFRKMGAYAKDEELLIHFFQESLTGVVATWYTNLEPSRVHSWKDLMVSFVRQYQYNFDMVPDRMQLQNMCKKGHESFKEYAQRWRDLAAQVARIFQRIRPEMERPGSSSGTSNDGERDDHNNSRHITSVLL

SEQ ID NO: 143133 - protein, 53 aa, Glycine max
  Coding DNA Sequence Number=SeqID_26355
MAYTAILLVGLGPAHTTEKTVGSAISETGNLTACLGASNLNAMREGGLRFHER

SEQ ID NO: 143134 - protein, 130 aa, Glycine max
  Coding DNA Sequence Number=SeqID_26356
  Subcellular localization annotation: CTP_CleavageSite=57; ConfidenceScore=5.03e-01
MKRMRMRETLAMTAIPTRPSHYPPPSHPQRLSLNHPQSLLAAHPMPSANQNTNQEVNFAAKKPVEFTPIPVSYADCGSNVFQVYFDDAKDSSQESRVKSQAIFKNQRVVQSKQISRIKIKVKIQEKTQLR

SEQ ID NO: 143135 - protein, 185 aa, Glycine max
  Coding DNA Sequence Number=SeqID_26357
MEESNRKNNKDHICQSSGSVLDGEEHIGEWRNPIGKITKITFPCQEGSALDGEEHIGEWKNPIGKITKITFPSQEGSALDGDEHVGEWKNPIGKITKITFPSQEGGARYQLLFPLVRVNFELGVIMVIAVSFGKPVVPAALMNRPTRGERRFAYWALAECILAYYVGTDEGVSEVLHVAGEKMLH

SEQ ID NO: 143136 - protein, 153 aa, Glycine max
  Coding DNA Sequence Number=SeqID_26358
MGSNQTPMPKKRFYQVKIKSLEVASLRELGQLMGQLQRQAFTKAYGKIWDLATIEDFQLVPTVEEFEEILRCPLGGKKPYLFSGFYPSMARVSKAKALANQGEWASFVDILALLIFGVVLFPNVKGVVDLAVIDIFLAFHHGKESPIVAILAD

SEQ ID NO: 143137 - protein, 298 aa, Glycine max
  Coding DNA Sequence Number=SeqID_26359
MRQFGMQQPIPVPVMQPENIHDLTLKGKEGRNWMRLMQPALNEWNSRYERRVELTPPQTGTLSLNSEYMRWYRRKTKGEIVKTLHFMVSPVGRRVCTFDDLLPCIEKITLLSEEEDRILEAHQDAPPSQPQFEHQQFNILQRSVETRGLGRRRQTVDAAPYSLPSMPEREHGMYYTPPVFTQEPSQMAPMYSYPHDFQPGYSMTGIFGSSPPSGGTPSFTQNNELPTPNAPLGGPWNVPGNIPDMNDLLGVDLRHDFSAEADEVDERGNLRRRNPDRAARNWDRPCGTSSRHHRHSHD

SEQ ID NO: 143138 - protein, 296 aa, Glycine max
  Coding DNA Sequence Number=SeqID_26360
  Gene Ontology: Mol. function=DNA-directed RNA polymerase activity; Cellular component=mitochondrion; Biological process=transcription
  Homolog annotation: Hit_ID=O47884; Match level="QueryCoverage=82%, HitCoverage=22%, E-value=3e-53, Identity=51%"; Hit description=RNA polymerase
MAAKDLYYYPKQTTNKTMLTTRQFKCMLEKHKLFLLPVRFQSTSNWISHFANTLDMPENKSENRAKIESFWEGALKDIYEETLMYDNNDVVHSPDECVDPETRKIKVPKSEFVKTYKNSVFSLLDCYRYENNDAQTLESLQREIEDLTLNFSEDSIYKTSPNIMVMLTKNNLPSAKEFLRGKYLMDKEYPGRMTIYAESRSGDSLETSGSELSDEENKNLRCVLSESDKSLLVELGEHSIECLLVHTLGHLFNLENIVSLASLVDRIERNVRDYASSSTLYYNSRVCNLSMDAVDK

SEQ ID NO: 143139 - protein, 49 aa, Glycine max
  Coding DNA Sequence Number=SeqID_26361
HLPLANKPALQVTSSSVRLVSSTTRDLRNEWHAPSGYSVNVATANATQV

SEQ ID NO: 143140 - protein, 101 aa, Glycine max
  Coding DNA Sequence Number=SeqID_26362
MENPHCRVLNGQFTTLFGVISFLPLIISKLFCYLKRKNVPAITLGRHMKIKVVVGVGYDKLDDEDPLLEVDSPEEVMPASKADSTAEGGPGAMAISGGSSS

SEQ ID NO: 143141 - protein, 136 aa, Glycine max
  Coding DNA Sequence Number=SeqID_26363
MEKGAEFLYAHLPLDSLLLNDKRAQNSSMRVYHPICEICMAKGTEFVYAHLPLDSLLLNDKGRTIRLCAFITQFAKSEWQRAQNSSMRVYHSTRCSLMIKGAESVSARLPPNLSFVNDTGRRVHLCAFTIQLVVPQ

SEQ ID NO: 143142 - protein, 51 aa, Glycine max
  Coding DNA Sequence Number=SeqID_26364
MSDMPFRGLKSVRKRVVFSAFFGKRDELAKQACYAKRVHQYSLYELMKHWA

SEQ ID NO: 143143 - protein, 176 aa, Glycine max
  Coding DNA Sequence Number=SeqID_26365
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=11%, E-value=2e-63, Identity=66%"; Hit description=Chromo
MPFGITIAPATFQSLMNEVFQCYLRKFVLVLFDDILIYSPNWSAYLQHLETVLKVLEQHKLYAKLSKCSFGLQEIDYLGHIVSGKGVTMDQEKAQAVLNWPYPINLKQLRGFLGLTGYYRKFIKGYVSIATPLSNLLKKKNLHWNDHTSMAFDNLKAAITKAPVLALPDFSKAFTF

SEQ ID NO: 143144 - protein, 439 aa, Glycine max
  Coding DNA Sequence Number=SeqID_26366
  Gene Ontology: Mol. function=lyase activity; Cellular component =membrane; Biological process=DNA replication
  Homolog annotation: Hit_ID=Q3Y2U5; Match level="QueryCoverage=97%, HitCoverage=87%, E-value=1e-127, Identity=54%"; Hit description =Carboxylyase-related protein
  Pfam annotation: Domain name=UbiD; Domain location=20-439; Score =218.9; E_value=1.1e-62; Accession=PF01977.7; Description=3 -octaprenyl-4-hydroxybenzoate carboxy-lyase
MSNTSPSSHSSEVYDLRSAIELLKQFDGEYIETDEPVNPEAELSGVYRYVGAGGTVMRPTQTGPAMVFNHIKGYDNFRVLIGLLASRQRVARLLGVPKEKLAHLLRSSVHNAIAPVEISQQQAVCQEVVHLATDDGFDIRRLLPAPTNTPEDAGPYFTMGMCYAADPETGEHDVTIHRLCVQGKDEISMYFVPGRHLDQFRIKAEQAGKALPITISIGVDPAIEIGACFEPPTTPLGFDELAIAGGLRGRAVELVKGVAVDARAIAHAEIVIEGELVPDYRVQEDQHTHSGKAMPEFPGYTGEAQAAVPVIKVKAVTHRKNPILQTCIGPSDEHTNLAGIPTEASILDMVERALPGLVKNVHCPSPGTGKYVAVLQINKRGPQDEGRQRQAALLAFSAFSELKHVFLVDEDVDVFDLNDVIWAMTTRYQGDADTIFIPG

SEQ ID NO: 143145 - protein, 153 aa, Glycine max
  Coding DNA Sequence Number=SeqID_26367
  Gene Ontology: Mol. function=serine carboxypeptidase activity; Cellular component=cellulose and pectin-containing cell wall; Biological process=proteolysis
  Homolog annotation: Hit_ID=Q9SGA9; Match level="QueryCoverage=88%, HitCoverage=28%, E-value=5e-66, Identity=81%"; Hit description =Putative serine carboxypeptidase II
  Pfam annotation: Domain name=Peptidase_S10; Domain location=1-153; Score=-124.8; E_value=1.3e-06; Accession=PF00450.12; Description =Serine carboxypeptidase
MTNESYTCMLMCSLHCSAQDSLEFVIQWLERFPRYKNRELYITGESYAGHYVPQLAKEILTYNAKTKHPINLKGIMVGNAVTDNYYDNLGTVTYWWSHAMISDQTYRQLMSTCDFHRQKESDECESVYSYAMDQEFGNIDQYNIYAPPCNNSD

SEQ ID NO: 143146 - protein, 183 aa, Glycine max
  Coding DNA Sequence Number=SeqID_26368
  Gene Ontology: Mol. function=serine carboxypeptidase activity; Cellular component=cellulose and pectin-containing cell wall; Biological process=proteolysis
  Homolog annotation: Hit_ID=Q9SGA9; Match level="QueryCoverage=85%, HitCoverage=32%, E-value=5e-57, Identity=70%"; Hit description =Putative serine carboxypeptidase II
  Pfam annotation: Domain name=Peptidase_S10; Domain location=40-179; Score=-56.8; E_value=3.7e-10; Accession=PF00450.12; Description =Serine carboxypeptidase
MAQRQIFAHVVILLLMVLVGARFAKAEGGGEAADRILELPGQPKVSFQQFSGYVTVNKVAGRALFYWLTEAAQNPLTKPLVIWLNGGPGCSSVAYGASEEIGPFRINKTASGLYINKFSWNTVANLLFLEAPAGVGFSYANRSSDLLNTGDRRTGRAHIPPVPTLIASTLHGSYMFLGDDFFL

SEQ ID NO: 143147 - protein, 707 aa, Glycine max
  Coding DNA Sequence Number=SeqID_26369
  Gene Ontology: Mol. function=phosphatidylinositol phosphate kinase activity; Cellular component=plasma membrane; Biological process =phosphatidylinositol metabolic process
  Homolog annotation: Hit_ID=Q1S1T3; Match level="QueryCoverage=99%, HitCoverage=100%, E-value=0.0, Identity=69%"; Hit description =Phosphatidylinositol-4-phosphate 5-kinase
  Pfam annotation: Domain name=MORN; Domain location=102-124; Score =33.5; E_value=7.3e-07; Accession=PF02493.10; Description=MORN repeat
  Pfam annotation: Domain name=MORN; Domain location=125-147; Score =28.6; E_value=2.3e-05; Accession=PF02493.10; Description=MORN repeat
  Pfam annotation: Domain name=MORN; Domain location=148-170; Score =29.7; E_value=1e-05; Accession=PF02493.10; Description=MORN repeat
  Pfam annotation: Domain name=MORN; Domain location=171-193; Score =38.4; E_value=2.4e-08; Accession=PF02493.10; Description=MORN repeat
  Pfam annotation: Domain name=MORN; Domain location=194-216; Score =35.2; E_value=2.3e-07; Accession=PF02493.10; Description=MORN repeat
  Pfam annotation: Domain name=MORN; Domain location=56-78; Score=27.6; E_value=4.5e-05; Accession=PF02493.10; Description=MORN repeat
  Pfam annotation: Domain name=MORN; Domain location=79-101; Score =37.1; E_value=6e-08; Accession=PF02493.10; Description=MORN repeat
  Pfam annotation: Domain name=PIP5K; Domain location=399-703; Score =500.8; E_value=1.5e-147; Accession=PF01504.9; Description =Phosphatidylinositol-4-phosphate 5-Kinase
  Pfam module annotation: Pfam domain module=MORN::MORN::MORN::MORN::MOR N::MORN::MORN::PIP5K; Domain location=102-124::125-147::148-170::171 -193::194-216::56-78::79-101::399-703
MQETLLSLSEHHHQDDSNNKDIELLLVPPPCRRQPRMARRVSPGAVEKALPCGDIYSGSLSGNVPHGTGKYLWSDGCMYEGEWKKGKACGKGRFSWPTGATYEGEFAAGRMQGHGTFVGVDGDTYRGAWLSDRKHGFGEKRYANGDVYEGFWRCNLQEGEGRYTWRNGNEYVGEWKNGAISGNGVLVWKNGNRYEGCWENGVPKGRGVFTWRDGNTSSGNWGKEFVNEKRVSVDECSNNNNNNNSNSNNKSVSFPRICIWELDGEAGDITCDIVEASMIYGGGGVCESDVQLQKSPCGSVDGDVKKPGHTVSKGHKNYDLMLNLQLGIRYSVGKHASVFRELRPGDFDPKEKFWTRFPPEGSKFTPPHQSVDFRWKDYCPVVFRHLRELFGIDPADYMLAICGNDTLREMSSPGKSGSFFYLTQDDRFIIKTLKKSEVKVLIRMLPSYYQHVRQYKNSLVTKFLGVHCVKPIGGQKTRFIVMGNVFCSEYRIHKRFDLKGSSHGRTTDKPQEEIDETTTLKDLDLCFVFRLEESWFQELKWQLDRDCEFLEAEGIMDYSFLIGLHFRDDSSVDEVVKSLPDELCSGKRDMQNDDVQDMKWIPIDRGPLIRLGTNMPARAERVCKAGLDQHTGTGSSNSIPSESGGEVSDVILYFGIIDILQDYDISKKLEHAYKSLQVDPSSISAVDPKLYSKRFRDFIHRIFVEDK

SEQ ID NO: 143148 - protein, 182 aa, Glycine max
  Coding DNA Sequence Number=SeqID_26370
  Gene Ontology: Mol. function=translation initiation factor activity; Cellular component=intracellular; Biological process=translational initiation
  Homolog annotation: Hit_ID=Q6ET52; Match level="QueryCoverage=50%, HitCoverage=15%, E-value=9e-22, Identity=59%"; Hit description =Putative LepA protein
MAVAWGMDVNFDVMEGGNMVFGSCRSWWCLMIVMVEDVKESQFQWPQKFVAGLYSYPLKLNCNSETSKMCSSMLNVAEREEALPDSTHPNAALVLPPFQMRPRFAAAQCAGSPAPTSNPPPKQARIVSLRNFCIIAHIDHGKSTLADKLLQVTGTVQQREMKDQFLDNMDLERERGITIKLQ

SEQ ID NO: 143149 - protein, 93 aa, Glycine max
  Coding DNA Sequence Number=SeqID_26371
MGINLRKMGLKEINYPSVERRYCAKGVQAMKMDSMCFANDAGETHVDREHFANASGGTNGGWWMAGCQDACMGMHAMHGVCFASGDGETHMTQ

SEQ ID NO: 143150 - protein, 550 aa, Glycine max
  Coding DNA Sequence Number=SeqID_26372
  Gene Ontology: Mol. function=GTPase activity; Cellular component =intracellular; Biological process=translational initiation
  Homolog annotation: Hit_ID=Q8RWP3; Match level="QueryCoverage=89%, HitCoverage=75%, E-value=0.0, Identity=76%"; Hit description=GTP -binding protein LepA homolog
  Pfam annotation: Domain name=EFG_C; Domain location=282-371; Score =128.9; E_value=1.4e-35; Accession=PF00679.14; Description=Elongation factor G C-terminus
  Pfam annotation: Domain name=GTP_EFTU; Domain location=1-97; Score =5.9; E_value=1.2e-07; Accession=PF00009.17; Description=Elongation factor Tu GTP binding domain
  Pfam annotation: Domain name=GTP_EFTU_D2; Domain location=118-188; Score=49.4; E_value=1.2e-11; Accession=PF03144.15; Description =Elongation factor Tu domain 2
  Pfam annotation: Domain name=LepA_C; Domain location=372-489; Score =248.0; E_value=1.9e-71; Accession=PF06421.3; Description=GTP-binding protein LepA C-terminus
  Pfam module annotation: Pfam domain module=EFG_C::GTP_EFTU::GTP_EFTU _D2::LepA_C; Domain location=282-371::1-97::118-188::372-489
VSRSLAACEGALLVVDASQGVEAQTLANVYLALENNLEIIPVLNKIDLPGAEPDRVIKEIEEIVGLDCSNAILCSAKEGIGIIEILNAIVARIPPPEDTSKRPLRALIFDSYYDPYRGVIVYFRVVDGTIKKGDRVYFMASGKDYFADEIGVLSPSQLQVEELYAGEVGYLSASIRTVADARVGDTITHYGRKADNSLPGYEEATPMVFCGLFPVDADQFPDLRDALEKLQLNDAALKFEPETSSAMGFGFRCGFLGLLHMEIVQVECSNPSLLPEPGKRKSIEEPFVKIEMLTPKDYIGPLMELAQERRGQFKEMKFIAENRASITYELPLAEMVGDFFDQLKSRSKGYASMEYTFVGYIESNLIKLDIRINGDCVEPLATIVHNDKKINRGLYFQAYSVGRALTLKLKELIPRQMFKVPIQACIGSKVIASEAISAIRKDVLAKCYGGDISRKKKLLKKQAEGKKRMKSIGKVDVPQEAFMAVLKLEKELRTRFWIIDRIPLPLKIENLVNALMVKTSTSVLAEFEIFNWRSVCFNIIKLYASWSIQF

SEQ ID NO: 143151 - protein, 66 aa, Glycine max
  Coding DNA Sequence Number=SeqID_26373
MVIKSASRGLIITGIVYKRAEKVGEREEIQRASPGAAVKLCLGDLLVMGSNSETASTSFMCVACQL

SEQ ID NO: 143152 - protein, 292 aa, Glycine max
  Coding DNA Sequence Number=SeqID_26374
  Gene Ontology: Mol. function=receptor activity; Cellular component =mitochondrion
  Homolog annotation: Hit_ID=Q1S1U3; Match level="QueryCoverage=99%, HitCoverage=47%, E-value=1e-108, Identity=68%"; Hit description=Trp repressor/replication initiator
  Pfam annotation: Domain name=DUF668; Domain location=37-121; Score =154.0; E_value=4e-43; Accession=PF05003.3; Description=Protein of unknown function (DUF668)
MEKLVDIVHFLHLEISNAFGNADDHKPFIGHMSNRQRLGPAGLALHYANIVLQIDTLVARSSIPANTKDALYQSLPPNIKLALRSKLPSLRVVEELTIADITDEMEKTLHWLSPMATNTSKAHHGFGWVGEWANTGSEVRKTGVMQIETFHHADKDKVEYYILELLLWLHRLAIRSKAVSDAGKVRPAIKSPVGTALQNTNEQISLLTIDEQNMLLDLNKKIPIRRISKSLDFDSLNIRFRENCRLAKSRSHSSSRSKEISFNRIFSKLPVIDFDIDKERALNVIDRLDVVR

SEQ ID NO: 143153 - protein, 449 aa, Glycine max
  Coding DNA Sequence Number=SeqID_26375
  Homolog annotation: Hit_ID=Q1S1U3; Match level="QueryCoverage=49%, HitCoverage=33%, E-value=1e-62, Identity=60%"; Hit description=Trp repressor/replication initiator
MVETHSISSPMVSNCKLSRHGADLFHDPTLYRCVIGALHYASLTRPEIDFAVNKGTLFHGLLLQPTSITKPLVLHVFCDADWASDVDDKRSTSKVAIFLGPNSVMSIAHNPMFHNHTNHMKIDVFFIREKILAKQLFIVHILAQDQWVDALTKPLSVARFEVLKDKLNMAGDSNSKRRVSRSTESKNTQDININIIEGNNNPKAQVQERAAVFDQHFYDGIPFFADNKPSRTNEKASTTAGEEFYDGIPRFPEDSLPNKPKSKVSEVSLRLGKAVTTGIAIGLEKAVEVLDTLGSSLTNLNVSSGFSSGAAIKGNKISILAFEVANTIVKGFNLLQSLSAKSIRHLKEEVLLSVAVQNLVSKDMDELLRIVAADKRQELEVFSNEVIRFGNRSKDPQWRNLDCYFEKQTHMLKDGNPSRISREINVQRLSRDEPELIMLQLMTLADFTV

SEQ ID NO: 143154 - protein, 237 aa, Glycine max
  Coding DNA Sequence Number=SeqID_26376
  Gene Ontology: Mol. function=receptor activity; Cellular component =mitochondrion; Biological process=protein amino acid phosphorylation
  Homolog annotation: Hit_ID=Q1S1U3; Match level="QueryCoverage=86%, HitCoverage=31%, E-value=7e-79, Identity=74%"; Hit description=Trp repressor/replication initiator
MKISAELFSIQVSEVSFRLGKAGTTGIAIGLEKAVEVLDTLGSSMTNLNASSGFVSGAAIKGNEISILAFEVANTIVKGFNLLQSLSAKSIRHLKEEVLLSHAVQDLVSKDMDELLRIVAADKRQELNVFSDEVIRFGNRSKNPQWHNLDRYFEKVSKELNGQRLSRDEAESIMQQLMTLVQFTAELYHELHALDRFEQDIQRKGEEEEDQRAVKLCLGDLLVMGSNPETASLHMQG

SEQ ID NO: 143155 - protein, 139 aa, Glycine max
  Coding DNA Sequence Number=SeqID_26377
MASAPSNFISQSFLNSIAEKLDDLNYLHWRQHASYEVPCSTASHRNYSGKIKGHVDELADVEVLVHHEEYVDALLEGLSSDYASTIFVIKSKKHTPSITKIETLLYGHETRLTRYSKDELVISSPSLNYTQRLLAPKYL

SEQ ID NO: 143156 - protein, 221 aa, Glycine max
  Coding DNA Sequence Number=SeqID_26378
  Gene Ontology: Mol. function=protein binding; Cellular component =integral to membrane
  Homolog annotation: Hit_ID=Q5N731; Match level="QueryCoverage=99%, HitCoverage=70%, E-value=9e-80, Identity=59%"; Hit description =Putative NTS2 protein
  Pfam annotation: Domain name=DUF803; Domain location=1-176; Score =157.4; E_value=3.8e-44; Accession=PF05653.4; Description=Protein of unknown function (DUF803)
MASAVLAHFMLNEKLQKMGMLGCLLCIVGSTVIVLHAPQEKPLSSVEEIWQLALQPGMLLLEVMSIKAIGIAIRLTIEGADQFVQFQTWIFTMVAISCIITQLNYLNMALDTFNTAVVSPIYYALFTSFTILASAIMFKDYSGQSISSIASELCGFITVLSGTTVLHSTREPDPPVNTDLYSPLSPKVSWYIQGNGEPWKQKEEDGPPFNLITVIRQDHFK

SEQ ID NO: 143157 - protein, 87 aa, Glycine max
  Coding DNA Sequence Number=SeqID_26379
MKRTTYLIMMVITGISKPPTKPKLLLYFRGGHEILPLREADISDHGCKGALWKEDLVKEEVRFGVDLKGTEFYPLVNDYQKAVIDYQ

SEQ ID NO: 143158 - protein, 318 aa, Glycine max
  Coding DNA Sequence Number=SeqID_26380
MANSSSSLLPLANNNTFNLSLQLPPITIKLDRDNYSLWRSTIISALETFELESFILSPAPPNETRITTTSDGVSILEPNPDFLLWKKKDRLVCRSKASSHESRFKVQDLKNQDQDSRLKIHESREGYIYLGLTENKRGYISCGSVLVEGTSTRFKENKGGALSIVVCASSSHMAWTAIDKTFQAQIRARCMALKAQLQTLNKDLVDSKLLHVSYVSLVDQMADIFTKPLSKERMNLLRFKLQAMSNKFRALLNNKTWSLVPRPPHVNLVGCKWIFRIKQRSDGSLEHHKAHLVAQGYSQEHGIDYFDTFNPVIKPTTI

SEQ ID NO: 143159 - protein, 109 aa, Glycine max
  Coding DNA Sequence Number=SeqID_26381
  Gene Ontology: Mol. function=DNA binding; Cellular component =mitochondrion; Biological process=DNA integration
MAYTSTELLWINQLLQELHATLPHPPRMLCDNVGAIFMTNNPVIHTRSKHIALDFHFIRDLVDSKLLHISYVSSVDQMANIFTKPLSKERMKRLRSKLQVRPDLLLAGG

SEQ ID NO: 143160 - protein, 62 aa, Glycine max
  Coding DNA Sequence Number=SeqID_26382
MSCCDNIAESSVVLPFQYNVFQIAFVALAGLTFVYYAALGFKFGNIRDGEERSLVVGACGAT

SEQ ID NO: 143161 - protein, 281 aa, Glycine max
  Coding DNA Sequence Number=SeqID_26383
  Gene Ontology: Mol. function=hydrolase activity, acting on ester bonds; Biological process=lipid metabolic process
  Homolog annotation: Hit_ID=Q9AYM5; Match level="QueryCoverage=99%, HitCoverage=95%, E-value=4e-87, Identity=59%"; Hit description =CPRD49 protein
  Pfam annotation: Domain name=Lipase_GDSL; Domain location=9-238; Score=94.5; E_value=3.1e-25; Accession=PF00657.12; Description=GDSL -like LipaseAcylhydrolase
MVGPARPQFVLFGSSIVEFSYSDQGWGAILANLYARKAIHSLSFLASVVNDDCKRADIILRGYAGWNSRRALQNLDKIFPKDATDQTSLVIVYFGGNDSMHPHPSGLSPHVPLQEYIENMRKIVIHLKSLSKKTRIIFLSSPPINEVQMHETLSDLLGPLKRTNEACRIYSEACLELCREMNVKAIDLWSALQQRHDWLDVCFTKSVNALLIHLMGVVIDRDGIHLSNEGSKIVAKEILKVLGEADWEPSLHWNSMPIEFAEDSLYEPISADENTPIDVSN

SEQ ID NO: 143162 - protein, 39 aa, Glycine max
  Coding DNA Sequence Number=SeqID_26384
MESLETTEIASQFLHKNEETSPAFSLVAQVAQDAYFRHF

SEQ ID NO: 143163 - protein, 522 aa, Glycine max
  Coding DNA Sequence Number=SeqID_26385
  Homolog annotation: Hit_ID=Q658I5; Match level="QueryCoverage=95%, HitCoverage=58%, E-value=3e-66, Identity=55%"; Hit description=LMBR1 integral membrane family protein-like
  Pfam annotation: Domain name=LMBR1; Domain location=20-522; Score =59.4; E_value=1.2e-14; Accession=PF04791.6; Description=LMBR1-like membrane protein
MIEKGDHTKGARFSDRDAKLMILRTNKSVGKRIKSALLWMVTTAIVCALVLGILYAVLSLLFCFVFVCEVGARCVCEQWDENLELERVELAVLKLKFRTIPGLCLRGCVRGLIGKVDFTVRHLSSSTSQFPSTWDFNSGQQCIGNTHQCSAFTASPSSEKTWTMRTTFPEYVVALATIVGSVLFAIFGGVGIACLPLGLIFSFIRRPKAVITRSQYIKEATELGKKAKELKKAAESLHQEERSGSKGRKFRKNVKSVEKELFQLEEDVKLLEEMYPQGEKAETTWALTVLGYLAKFVLGILGEYSCITIAQCYQIAAMAAEWRCGNLKKRHQIAVTLRVADGSAMAAAIAMAIGVGLTRPNRNLTFACKRGEQRKQERHHANATRHAGMPAPRTNTTATTANSAPHTSTTHTTNGRRRRYSLRRTAIVVLCLPSHVLSNLSFENCARFIVSVAWVAHIIIYLLIDPPLSPFLNEVFIKLDDIWGLLGTAAFAFFCFYLLLAVIAGAMMLGLRLVFITIHPMK

SEQ ID NO: 143164 - protein, 65 aa, Glycine max
  Coding DNA Sequence Number=SeqID_26386
MGIGEEEEEGERFWLVGSVVGNVELLSCPCERRVCMFVVGCELCGKRSSFQSSSDHTRLYCTSGM

SEQ ID NO: 143165 - protein, 177 aa, Glycine max
  Coding DNA Sequence Number=SeqID_26387
  Gene Ontology: Mol. function=catalytic activity; Cellular component =endoplasmic reticulum; Biological process=metabolic process
  Homolog annotation: Hit_ID=Q2HW64; Match level="QueryCoverage=99%, HitCoverage=35%, E-value=4e-54, Identity=56%"; Hit description =Sterol desaturase
  Pfam annotation: Domain name=Sterol_desat; Domain location=36-174; Score=59.8; E_value=8.9e-15; Accession=PF01598.8; Description=Sterol desaturase
MASRPGILSDWPWKPLGSFKEYMLLAPCIVHSSYSMMVKDNSEKDMFNFLILPFLLWRMLHNQIWITFSRYRTAKGNARIVDKGIEFDQVDRERNWDDQILFSGLIFYLANYVFAGASHIPLWKTDGAVMAILLHMGPVEFLYYWLHRALHHHFLYSRYHSHHHSSIVTEPITCESH

SEQ ID NO: 143166 - protein, 72 aa, Glycine max
  Coding DNA Sequence Number=SeqID_26388
  Gene Ontology: Mol. function=structural constituent of ribosome; Cellular component=ribonucleoprotein complex; Biological process =translation
  Homolog annotation: Hit_ID=Q9M573; Match level="QueryCoverage=98%, HitCoverage=59%, E-value=1e-15, Identity=58%"; Hit description=60S ribosomal protein L31
  Pfam annotation: Domain name=Ribosomal_L31e; Domain location=1-54; Score=35.4; E_value=7.5e-08; Accession=PF01198.9; Description =Ribosomal protein L31e
MGTNDVKVDMKLNKVVWSHGIRSVSRRIRVRIAHKRNNDEDAKEELYSLVIVIKIAKDELKGLGTKVIDDED

SEQ ID NO: 143167 - protein, 1234 aa, Glycine max
  Coding DNA Sequence Number=SeqID_26389
  Gene Ontology: Mol. function=protein serine/threonine kinase activity; Cellular component=integral to membrane; Biological process=protein amino acid phosphorylation
  Homolog annotation: Hit_ID=Q337M0; Match level="QueryCoverage=97%, HitCoverage=98%, E-value=0.0, Identity=47%"; Hit description=Leucine Rich Repeat family protein, expressed
  Pfam annotation: Domain name=LRRNT_2; Domain location=28-71; Score =26.1; E_value=0.00012; Accession=PF08263.3; Description=Leucine rich repeat N-terminal domain
  Pfam annotation: Domain name=LRR_1; Domain location=101-123; Score =11.6; E_value=2; Accession=PF00560.23; Description=Leucine Rich Repeat
  Pfam annotation: Domain name=LRR_1; Domain location=125-147; Score =12.0; E_value=1.6; Accession=PF00560.23; Description=Leucine Rich Repeat
  Pfam annotation: Domain name=LRR_1; Domain location=149-171; Score =13.0; E_value=1.1; Accession=PF00560.23; Description=Leucine Rich Repeat
  Pfam annotation: Domain name=LRR_1; Domain location=198-221; Score =0.7; E_value=2.1e+02; Accession=PF00560.23; Description=Leucine Rich Repeat
  Pfam annotation: Domain name=LRR_1; Domain location=223-246; Score =5.4; E_value=28; Accession=PF00560.23; Description=Leucine Rich Repeat
  Pfam annotation: Domain name=LRR_1; Domain location=248-270; Score =13.5; E_value=0.79; Accession=PF00560.23; Description=Leucine Rich Repeat
  Pfam annotation: Domain name=LRR_1; Domain location=272-294; Score =7.2; E_value=13; Accession=PF00560.23; Description=Leucine Rich Repeat
  Pfam annotation: Domain name=LRR_1; Domain location=320-342; Score =8.2; E_value=8.3; Accession=PF00560.23; Description=Leucine Rich Repeat
  Pfam annotation: Domain name=LRR_1; Domain location=344-366; Score =13.7; E_value=0.68; Accession=PF00560.23; Description=Leucine Rich Repeat
  Pfam annotation: Domain name=LRR_1; Domain location=368-391; Score =9.0; E_value=6; Accession=PF00560.23; Description=Leucine Rich Repeat
  Pfam annotation: Domain name=LRR_1; Domain location=393-415; Score =11.6; E_value=1.9; Accession=PF00560.23; Description=Leucine Rich Repeat
  Pfam annotation: Domain name=LRR_1; Domain location=417-439; Score =9.9; E_value=3.9; Accession=PF00560.23; Description=Leucine Rich Repeat
  Pfam annotation: Domain name=LRR_1; Domain location=441-463; Score =11.8; E_value=1.8; Accession=PF00560.23; Description=Leucine Rich Repeat
  Pfam annotation: Domain name=LRR_1; Domain location=465-487; Score =13.6; E_value=0.7; Accession=PF00560.23; Description=Leucine Rich Repeat
  Pfam annotation: Domain name=LRR_1; Domain location=489-511; Score =8.5; E_value=7.3; Accession=PF00560.23; Description=Leucine Rich Repeat
  Pfam annotation: Domain name=LRR_1; Domain location=513-535; Score =4.2; E_value=47; Accession=PF00560.23; Description=Leucine Rich Repeat
  Pfam annotation: Domain name=LRR_1; Domain location=538-557; Score =14.5; E_value=0.4; Accession=PF00560.23; Description=Leucine Rich Repeat
  Pfam annotation: Domain name=LRR_1; Domain location=562-584; Score =10.0; E_value=3.8; Accession=PF00560.23; Description=Leucine Rich Repeat
  Pfam annotation: Domain name=LRR_1; Domain location=586-608; Score =15.5; E_value=0.19; Accession=PF00560.23; Description=Leucine Rich Repeat
  Pfam annotation: Domain name=LRR_1; Domain location=610-632; Score =7.3; E_value=12; Accession=PF00560.23; Description=Leucine Rich Repeat
  Pfam annotation: Domain name=LRR_1; Domain location=634-656; Score =13.2; E_value=0.97; Accession=PF00560.23; Description=Leucine Rich Repeat
  Pfam annotation: Domain name=LRR_1; Domain location=658-680; Score =10.8; E_value=2.7; Accession=PF00560.23; Description=Leucine Rich Repeat
  Pfam annotation: Domain name=LRR_1; Domain location=682-704; Score =6.7; E_value=16; Accession=PF00560.23; Description=Leucine Rich Repeat
  Pfam annotation: Domain name=LRR_1; Domain location=706-728; Score =17.1; E_value=0.062; Accession=PF00560.23; Description=Leucine Rich Repeat
  Pfam annotation: Domain name=LRR_1; Domain location=730-752; Score =16.4; E_value=0.1; Accession=PF00560.23; Description=Leucine Rich Repeat
  Pfam annotation: Domain name=LRR_1; Domain location=76-99; Score=6.4; E_value=18; Accession=PF00560.23; Description=Leucine Rich Repeat
  Pfam annotation: Domain name=LRR_1; Domain location=779-801; Score =19.9; E_value=0.0089; Accession=PF00560.23; Description=Leucine Rich Repeat
  Pfam annotation: Domain name=LRR_1; Domain location=803-826; Score =12.3; E_value=1.4; Accession=PF00560.23; Description=Leucine Rich Repeat
  Pfam annotation: Domain name=Pkinase; Domain location=930-1204; Score= 114.7; E_value=2.7e-31; Accession=PF00069.15; Description=Protein kinase domain
  Pfam annotation: Domain name=Pkinase_Tyr; Domain location=930-1204; Score=112.4; E_value=1.3e-30; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::Pkinase::Pkinase_Tyr; Domain location=28-71::101-123::125 -147::149-171::198-221::223-246::248-270::272-294::320-342::344 -366::368-391::393-415::...
  Pfam module annotation: Domain location=417-439::441-463::465 -487::489-511::513-535::538-557::562-584::586-608::610-632::634 -656::658-680::682-704::706-728::730-752::76-99::779-801::803 -826::930-1204::930-1204
MTTFQKVHALLFHILLLSLLPLKITSSPTTEAEALIKWKNSLSPPLPPSLNSSWSLTNLGNLCNWDAIVCDNTNTTVSQINLSDANLTGTLTALDFSSLPNLTQLNLNANHFGGSIPSAIDKLSKLTLLDFGNNLFEGTLPYELGQLRELQYLSFYNNNLNGTIPYQLMNLPKVWYMDLGSNYFIPPPDWSQYSCMPSLTRLALHLNPTLTSEFPSFILGCHNLTYLDISQNQWKGTIPESMYNNLVKLEYLNLSSSGLEGKLSSNLSKLSNLKDLRIGNNIFNGSVPTEIGLISGLQILELNNISAHGNIPSSLGLLRELWHLDLSKNFFNSSIPSELGQCTNLSFLSLAENNLTDPLPMSLVNLAKISELGLSDNFLSGQLSASLISNWIRLISLQLQNNKFTGRIPTQIGLLKKINILFMRNNLFSGPIPVEIGNLKEMTKLDLSLNGFSGPIPSTLWNLTNIRVVNLYFNELSGTIPMDIGNLTSLETFDVDNNKLYGELPETVAQLPALSHFSVFTNNFTGSIPREFGKNNPSLTHVYLSHNSFSGELPPDLCSDGKLVILAVNNNSFSGPVPKSLRNCSSLTRLQLHDNQLTGDITDSFGVLPNLDFISLSRNWLVGELSPEWGECISLTRMDMGSNNLSGKIPSELGKLSQLGYLSLHSNDFTGNIPPEIGNLGLLFMFNLSSNHLSGEIPKSYGRLAQLNFLDLSNNKFSGSIPRELSDCNRLLSLNLSQNNLSGEIPFELGNLFSLQIMVDLSRNSLSGAIPPSLGKLASLEVLNVSHNHLTGTIPQSLSSMISLQSIDFSYNNLSGSIPIGRVFQTATAEAYVGNSGLCGEVKGLTCANVFSPHKSRGVNKKVLFGVIIPVCVLFIGMIGVGILLCRRHSKKIIEEESKRIEKSDQPISMVWGRDGKFSFSDLVKATDDFDDKYCIGNGGFGSVYRAQLLTGQVVAVKRLNISDSDDIPAVNRHSFQNEIESLTGVRHRNIIKLYGFCSCRGQMFLVYEHVDRGSLAKVLYAEEGKSELSWARRLKIVQGIAHAISYLHSDCSPPIVHRDVTLNNILLDSDLEPRVADFGTAKLLSSNTSTWTSAAGSFGYMAPELAQTMRVTDKCDVYSFGVVVLEIMMGKHPGELLTTMSSNKYLPSMEEPQVLLKDVLDQRLPPPRGRLAEAVVLIVTIALACTRLSPESRPVMRSVAQELSLATTQACLAEPFGMITLSKLAGFHKYCVM

SEQ ID NO: 143168 - protein, 40 aa, Glycine max
  Coding DNA Sequence Number=SeqID_26390
MPRVSYVHPTCNVVLSPITSSIISLEENAETVHSAQIKTT

SEQ ID NO: 143169 - protein, 44 aa, Glycine max
  Coding DNA Sequence Number=SeqID_26391
  Homolog annotation: Hit_ID=Q9FWL4; Match level="QueryCoverage=87%, HitCoverage=6%, E-value=1e-07, Identity=61%"; Hit description =Putative peptide transport protein
MAVVEEKGLASGREDYTQDGTVDLKGRPVLRSNTGRWRACSFIV

SEQ ID NO: 143170 - protein, 724 aa, Glycine max
  Coding DNA Sequence Number=SeqID_26392
  Gene Ontology: Mol. function=protein serine/threonine kinase activity; Cellular component=integral to membrane; Biological process=protein amino acid phosphorylation
  Homolog annotation: Hit_ID=Q337M0; Match level="QueryCoverage=95%, HitCoverage=64%, E-value=1e-171, Identity=36%"; Hit description =Leucine Rich Repeat family protein, expressed
  Pfam annotation: Domain name=LRRNT_2; Domain location=29-71; Score =22.1; E_value=0.002; Accession=PF08263.3; Description=Leucine rich repeat N-terminal domain
  Pfam annotation: Domain name=LRR_1; Domain location=101-123; Score =20.1; E_value=0.0081; Accession=PF00560.23; Description=Leucine Rich Repeat
  Pfam annotation: Domain name=LRR_1; Domain location=125-147; Score =11.2; E_value=2.3; Accession=PF00560.23; Description=Leucine Rich Repeat
  Pfam annotation: Domain name=LRR_1; Domain location=149-171; Score =13.0; E_value=1.1; Accession=PF00560.23; Description=Leucine Rich Repeat
  Pfam annotation: Domain name=LRR_1; Domain location=198-221; Score =3.6; E_value=61; Accession=PF00560.23; Description=Leucine Rich Repeat
  Pfam annotation: Domain name=LRR_1; Domain location=222-245; Score =7.2; E_value=13; Accession=PF00560.23; Description=Leucine Rich Repeat
  Pfam annotation: Domain name=LRR_1; Domain location=247-269; Score =11.3; E_value=2.2; Accession=PF00560.23; Description=Leucine Rich Repeat
  Pfam annotation: Domain name=LRR_1; Domain location=271-293; Score =9.5; E_value=4.7; Accession=PF00560.23; Description=Leucine Rich Repeat
  Pfam annotation: Domain name=LRR_1; Domain location=319-341; Score =6.2; E_value=20; Accession=PF00560.23; Description=Leucine Rich Repeat
  Pfam annotation: Domain name=LRR_1; Domain location=343-365; Score =11.4; E_value=2.1; Accession=PF00560.23; Description=Leucine Rich Repeat
  Pfam annotation: Domain name=LRR_1; Domain location=367-390; Score =8.2; E_value=8.3; Accession=PF00560.23; Description=Leucine Rich Repeat
  Pfam annotation: Domain name=LRR_1; Domain location=392-414; Score =11.7; E_value=1.8; Accession=PF00560.23; Description=Leucine Rich Repeat
  Pfam annotation: Domain name=LRR_1; Domain location=416-438; Score =13.8; E_value=0.62; Accession=PF00560.23; Description=Leucine Rich Repeat
  Pfam annotation: Domain name=LRR_1; Domain location=440-462; Score =12.8; E_value=1.1; Accession=PF00560.23; Description=Leucine Rich Repeat
  Pfam annotation: Domain name=LRR_1; Domain location=464-486; Score =13.7; E_value=0.69; Accession=PF00560.23; Description=Leucine Rich Repeat
  Pfam annotation: Domain name=LRR_1; Domain location=488-510; Score =6.0; E_value=22; Accession=PF00560.23; Description=Leucine Rich Repeat
  Pfam annotation: Domain name=LRR_1; Domain location=512-534; Score =4.1; E_value=48; Accession=PF00560.23; Description=Leucine Rich Repeat
  Pfam annotation: Domain name=LRR_1; Domain location=537-556; Score =15.5; E_value=0.19; Accession=PF00560.23; Description=Leucine Rich Repeat
  Pfam annotation: Domain name=LRR_1; Domain location=561-583; Score =12.2; E_value=1.5; Accession=PF00560.23; Description=Leucine Rich Repeat
  Pfam annotation: Domain name=LRR_1; Domain location=585-607; Score =11.9; E_value=1.7; Accession=PF00560.23; Description=Leucine Rich Repeat
  Pfam annotation: Domain name=LRR_1; Domain location=609-631; Score =11.6; E_value=2; Accession=PF00560.23; Description=Leucine Rich Repeat
  Pfam annotation: Domain name=LRR_1; Domain location=633-655; Score =13.3; E_value=0.91; Accession=PF00560.23; Description=Leucine Rich Repeat
  Pfam annotation: Domain name=LRR_1; Domain location=657-679; Score =11.4; E_value=2.1; Accession=PF00560.23; Description=Leucine Rich Repeat
  Pfam annotation: Domain name=LRR_1; Domain location=681-703; Score =15.4; E_value=0.21; Accession=PF00560.23; Description=Leucine Rich Repeat
  Pfam annotation: Domain name=LRR_1; Domain location=705-724; Score =12.3; E_value=1.4; Accession=PF00560.23; Description=Leucine Rich Repeat
  Pfam annotation: Domain name=LRR_1; Domain location=76-99; Score=7.5; E_value=11; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1; Domain location=29 -71::101-123::125-147::149-171::198-221::222-245::247-269::271 -293::319-341::343-365::367-390::392-414::416-438::440-462::464 -486::488-510::512-534::...
  Pfam module annotation: Domain location=537-556::561-583::585 -607::609-631::633-655::657-679::681-703::705-724::76-99
  Subcellular localization annotation: CTP_CleavageSite=32; ConfidenceScore=5.06e-01
MTTFQKVHALLFHIFFFISLLPLKITSSPTTEAEALVKWKNSLSLLPPSLNSSWSLTNLGNLCNWDAIACDNTNNTVLEINLSDANITGTLTPLDFASLPNLTKLNLNHNNFEGSIPSAIGNLSKLSLLDLGNNLFEETLPNELGQLRELQYLSFYNNNLNGTIPYQLMNLPKVWYMDLGSNYFITPPDWSQYSGMPSLTRLGLHLNVFTGEFPSFILECQNLSYLDISQNHWTGTIPESMYSNLPKLEYLNLTNTGLIGKLSPNLSMLSNLKELRMGNNMFNGSVPTEIGLISGLQILELNNIFAHGKIPSSLGQLRELWRLDLSINFLNSTIPSELGLCANLSFLSLAVNSLSGPLPLSLANLAKISELGLSDNSFSGQFSASLISNWTQLISLQVQNNSFTGRIPPQIGLLKKINFLYLYNNQFSGPIPVEIGNLKEMIELDLSQNQFSGPIPLTLWNLTNIQVLNLFFNDLSGTIPMDIGNLTSLQIFDVNTNNLHGELPETIAQLTALKKFSVFTNNFTGSLPREFGKSNPSLTHIYLSNNSFSGELPPGLCSDGKLTILAVNNNSFSGPLPKSLRNCSSLIRIRLDDNQFTGNITDSFGVLSNLVFISLSGNQLVGELSPEWGECVNLTEMEMGSNKLSGKIPSELGKLIQLGHLSLHSNEFTGNIPPEIGNLSQLFKLNLSNNHLSGEIPKSYGRLAKLNFLDLSNNNFIGSIPREL

SEQ ID NO: 143171 - protein, 155 aa, Glycine max
  Coding DNA Sequence Number=SeqID_26393
  Gene Ontology: Mol. function=protein-tyrosine kinase activity; Cellular component=intracellular; Biological process=protein amino acid phosphorylation
  Homolog annotation: Hit_ID=Q6L3I5; Match level="QueryCoverage=98%, HitCoverage=51%, E-value=1e-17, Identity=34%"; Hit description =Leucine Rich Repeat family protein
  Pfam annotation: Domain name=LRR_1; Domain location=106-128; Score =0.4; E_value=2.4e+02; Accession=PF00560.23; Description=Leucine Rich Repeat
  Pfam annotation: Domain name=LRR_1; Domain location=130-152; Score =23.6; E_value=0.0007; Accession=PF00560.23; Description=Leucine Rich Repeat
  Pfam annotation: Domain name=LRR_1; Domain location=28-50; Score=6.7; E_value=16; Accession=PF00560.23; Description=Leucine Rich Repeat
  Pfam annotation: Domain name=LRR_1; Domain location=52-79; Score =13.2; E_value=0.95; Accession=PF00560.23; Description=Leucine Rich Repeat
  Pfam annotation: Domain name=LRR_1; Domain location=81-103; Score =3.3; E_value=68; Accession=PF00560.23; Description=Leucine Rich Repeat
  Pfam module annotation: Pfam domain module=LRR_1::LRR_1::LRR_1::LRR _1::LRR_1; Domain location=106-128::130-152::28-50::52-79::81-103
  Subcellular localization annotation: CTP_CleavageSite=11; ConfidenceScore=5.11e-01
MFSSKPSFSLAANKLQGNIPPGLGKLQSLPNLDLSESNLKNIPVELFSSSSKLHKLNLSNNDLSANNLTGPIPKELGNCRKLIFLKLSMNNLDGHMSHELRNLVNLQRLLDLSHNSLTGQIITQLENLISLEVLNLSHNQLSGTIPPSLKGLIGL

SEQ ID NO: 143172 - protein, 374 aa, Glycine max
  Coding DNA Sequence Number=SeqID_26394
  Homolog annotation: Hit_ID=Q10S15; Match level="QueryCoverage=37%, HitCoverage=36%, E-value=3e-16, Identity=40%"; Hit description =Expressed protein
MGCFLHCFGSSKSTKPRRKAHHHHRLARDRLEQCSIQDYSETVVIGTASQEVQAKPLEQINVSPKKKVTFDVNVKTYEPDEVADFQLEKSEEGGEESALVEKLSRTKSYSEESSVTSAGSYTTNHRYHNCTCSDDEDGAMEYWDSDVTDEDEDEDDDGGDSDMGEEYDEVEEDFEDGIVYSRSRNGDNQVVVGEVESPILMHDKDLKSIGLNPNVRDRSVYVLSVMNPVENLTQWKAVKAKRAPPLASQKENLVLNQESRSAFAAETPKKLNREIAVDASLSNWLGSSETTPVSKGLYVGTLERSSSQGSNSVVSHENRPILGALTVEELKHFSASSSPRKSPKDEMPIIGSVGGYAEDSGSANRVRSRRVHLK

SEQ ID NO: 143173 - protein, 431 aa, Glycine max
  Coding DNA Sequence Number=SeqID_26395
  Gene Ontology: Mol. function=protein serine/threonine kinase activity; Cellular component=integral to membrane; Biological process=protein amino acid phosphorylation
  Homolog annotation: Hit_ID=Q337M0; Match level="QueryCoverage=99%, HitCoverage=35%, E-value=1e-148, Identity=60%"; Hit description =Leucine Rich Repeat family protein, expressed
  Pfam annotation: Domain name=Pkinase; Domain location=132-380; Score =122.5; E_value=1.2e-33; Accession=PF00069.15; Description=Protein kinase domain
  Pfam annotation: Domain name=Pkinase_Tyr; Domain location=132-406; Score=115.4; E_value=1.6e-31; Accession=PF07714.7; Description =Protein tyrosine kinase
  Pfam module annotation: Pfam domain module=Pkinase::Pkinase_Tyr; Domain location=132-380::132-406
MISLQSIDFSHNNLSGLIPTGGIFQTATAEAYVGNTGLCGEVKGLTCPKVFSPDNSGGVNKKVLLGVIIPVCVLFIGMIGVGILLCQRLRHANKHLDEESKRIEKSDESTSMVWGRDGKFTFSDLVKATDDFNEKYCIGKGGFGSVYRAKLLTGQVVAVKRLNILDSDDIPAVNRQSFQNEIRSLTGVRHRNIIKLFGFCTWRGQMFLVYEHVDRGSLAKVLYGEEGKLKLSWATRLKIVQGVAHAISYLHTDCSPPIVHRDVTLNNILLDSDLEPRLADFGTAKLLSSNTSTWTSVAGSYGYMAPELAQTMRVTDKCDVYSFGVVVLEILMGKHPGELLTMLSSNKYLSSMEEPQMLLKDVLDQRLRLPTDQLAEAVVFTMTIALACTRAAPESRPMMRAVAQELSATTQACLAEPFGMITMSKLAGFQK

SEQ ID NO: 143174 - protein, 99 aa, Glycine max
  Coding DNA Sequence Number=SeqID_26396
  Subcellular localization annotation: CTP_CleavageSite=47; ConfidenceScore=5.23e-01
MVHRARSNTMCWQLVPHFVIVPVLGPTPRAPVYCPVRVCPRCRVQPSSARVKPLYTNDIKRLYAIIQDKTIANAASIGNKIVTLTLTHRCCHKIGYTCI

SEQ ID NO: 143175 - protein, 48 aa, Glycine max
  Coding DNA Sequence Number=SeqID_26397
MIGIEITEALRLQMEVQKRLHEQLEAKPPKGLQLRRAKEFPQLRWLFQ

SEQ ID NO: 143176 - protein, 41 aa, Glycine max
  Coding DNA Sequence Number=SeqID_26398
MAPDSVGKIENILRLGDSNESLGNSHVLSLLAALGVMRNIT

SEQ ID NO: 143177 - protein, 38 aa, Glycine max
  Coding DNA Sequence Number=SeqID_26399
MSLGPLGIIDFSLISESIGGTWHYRIHEIVKFMMAILW

SEQ ID NO: 143178 - protein, 53 aa, Glycine max
  Coding DNA Sequence Number=SeqID_26400
MVKARQKWGKRGRWLPPSSPNRAGLLPPEGSAFCWNTLEGPNGPRCYLHTPFY

SEQ ID NO: 143179 - protein, 119 aa, Glycine max
  Coding DNA Sequence Number=SeqID_26401
MTLVSACYQAFCLTDSKKVYTDNHSGISARQRDSKVSMTDLVSAEDDAFRLTDCKKVYTDNHSGISARQRDSKVSMTDLVSAEDDIAKKNVYTDNHSCISARQRDSKVSMTDLLSTEDD

SEQ ID NO: 143180 - protein, 163 aa, Glycine max
  Coding DNA Sequence Number=SeqID_26402
MVNVDSATGKVDGPHKKKLRTYLVIVARDKVDVTYDTGRKSLLAEFEIPEASDTDKDGVDDIVCEKYGISKEKWAQFCQTHRDPSWEDVRKKAQVIQKQNTAPHVLSRGGYKYLEQKLMAEKTKKRLEEAAQSGSTESIIDPPSPIRRHVKWKMARTKKTGQM

SEQ ID NO: 143181 - protein, 127 aa, Glycine max
  Coding DNA Sequence Number=SeqID_26403
  Subcellular localization annotation: CTP_CleavageSite=41; ConfidenceScore=5.51e-01
MAEPSKKRKGSSSTATAAAHRRHGPSGAPTAPIPPFLSSPRSSTLFSSDDQRLRLKIQDGIIMSEVHGTSMVIDQSLFFSLTHLPSQGAPFEGTIVDDWKFDYSSHDARRMVCNDQAEMTVDCWPGH

SEQ ID NO: 143182 - protein, 240 aa, Glycine max
  Coding DNA Sequence Number=SeqID_26404
  Gene Ontology: Mol. function=transcription factor activity; Biological process=regulation of transcription, DNA-dependent
  Homolog annotation: Hit_ID=Q3W3V4; Match level="QueryCoverage=69%, HitCoverage=94%, E-value=1e-19, Identity=32%"; Hit description =Regulatory protein, TetR
HPRRRLGVRDHRRVEGLPLADAGAAGPCRAAAVGAPARRAVADRAGRVPDGVGDRHAHPDRDVPGVPVGVPALGRPRRFGEGRLDEGIHDPGHVDGRVDHPLQLETVGRCLDHTGQGVGVERGVSVPGAEPVCDRFAQARAAVEEGDESWDLGVVADHVDERALRLGVVEAARVESVVLVALAQHLGEELLLGSEVVQQGGGGHSDDLGDLLQRGVLVALASDHVEGALAGSPRVAQHPS

SEQ ID NO: 143183 - protein, 135 aa, Glycine max
  Coding DNA Sequence Number=SeqID_26405
  Subcellular localization annotation: CTP_CleavageSite=29; ConfidenceScore=5.53e-01
MTFCRSPHQSSTAVGVINPNSITFLANLRSMKKKTSSRIAQAPANPKPDEGSGAKSNMLQFYTDDAFDLKISPPNWSSIIHGLHHHELADEGVGEKVVIVFDDSYKEYDDKEAWDKMLEVFERWDSSLVYVDVGE

SEQ ID NO: 143184 - protein, 310 aa, Glycine max
  Coding DNA Sequence Number=SeqID_26406
  Gene Ontology: Mol. function=histone-lysine N-methyltransferase activity; Cellular component=nucleus; Biological process=chromatin modification
  Homolog annotation: Hit_ID=Q1S200; Match level="QueryCoverage=95%, HitCoverage=38%, E-value=6e-60, Identity=49%"; Hit description=SET -related region; Pre-SET; Histone H3-K9 methyltransferase
MAPNPRVVAAFMAMSNLGIHESKVKPVLKKLLKLYDKNWALIEEESYRALADAIFEEEENKVNEPDQNIKNKPMTAEMCSGFSNIQDGVVDDVEAHTHEEPVRPLKRLRLRGQEGQSLRPLTSSGPSSAAFPLKMPKLEDGTVPESSSRLQPQSLAALSDGNARIGAHHVPPQDAVVDKGKKPISPQVTPRRRRSLSEPLKESTVEGRAALLANNKMPHPFILIKPKDEPVDDIPDYEIPLAVIPPDSPMGAVEKQDVHDTVVSQCRDEDVEHEDVFPSSNEEATSNVYVALSSMGEVKISLSCSSVLGK

SEQ ID NO: 143185 - protein, 440 aa, Glycine max
  Coding DNA Sequence Number=SeqID_26407
  Homolog annotation: Hit_ID=O22784; Match level="QueryCoverage=59%, HitCoverage=90%, E-value=5e-62, Identity=45%"; Hit description =Expressed protein
  Pfam annotation: Domain name=DUF26; Domain location=185-236; Score =48.5; E_value=2.2e-11; Accession=PF01657.8; Description=Domain of unknown function DUF26
  Pfam annotation: Domain name=DUF26; Domain location=77-133; Score =40.3; E_value=6.5e-09; Accession=PF01657.8; Description=Domain of unknown function DUF26
  Pfam module annotation: Pfam domain module=DUF26::DUF26; Domain location=185-236::77-133
MGILKVKHHIPTLLFLSISFPLFLLTPTSSDNTNLIYKGCADQKLQAQYSQNLKPLLDSLVSASAQKGFAATTQNALTGAYQCRGDLSNSDCYTCVSKIPGMVKRLCGGDDVAAARVQLSGCYLRYEVVGFKVVSATQLLYKVCGARKVVDGGGFEARRDAAFGMAENGVQSSGNLFYTGSYQSLYVLGQCEGSLGNEDCGGCIKSGAEQARDQCGDSISAQVYLQSCFLSYSFYPNGVPTASSSSSGGGGGHPHTERTVALAVGGVAALGFLIVCLLFLKSVLKRRGDDVGDGDSECGWDACDLMMLKTRLALRFGLEWCSGGVVWGEKMVYELRGEGEGCGKGYSSNFQRFGSANINSHPRVTCRGPFQQPRHDSHGRFRSHHYRSRTAPDLTAASCAMEPPTPTSPLYKNGTSSSCFYYPTSLVPIPILDLPPKTAT

SEQ ID NO: 143186 - protein, 518 aa, Glycine max
  Coding DNA Sequence Number=SeqID_26408
  Gene Ontology: Mol. function=transferase activity; Cellular component= intracellular; Biological process=RNA processing
  Homolog annotation: Hit_ID=Q1S205; Match level="QueryCoverage=94%, HitCoverage=57%, E-value=1e-160, Identity=69%"; Hit description =Protein prenyltransferase
MGDSEPVVTEASAAEAYASAGYAETGSNPTPEAGAAVDQSAGEAAQASSTYGYGYSNVGDTNAYAGDPNSVLQQAHFSATGDSKPAGAAADANEASAGVGTTAAESTMVSDYNSSVNGGVVGAVANAVGLENGNALENADGSADEKQLADGYAALSAEEDRLWNIVRANSLDFTAWTSLIEETEKTEDNILKIRRVYDAFLAEFPLCYGYWKKYADHEARLGSIDKVVEVYERAVQGVTYSVDMWLHYCIFAISTYGDPNTVRRLFERGLAYVGTDYLSFPLWDKYIEYEYMQQDWACLAVIYTRILENPNQQLDRYFSSFKELAGNRPLSELRTADEAAAVAGVASEATGQATEGEVHPDGAERSPKSVSAGLTEAEELEKYIAIREEMYKKAKEFDSKIIGFETAIRRPYFHVRPLNVGELENWHNYLDFIEREGDLSKVSSYLSNLLSQARRVPPFIFEGPLCPAKELSSCMRDVSLHAPIIRSIGYAMFCVWKPAEAWILQIMFLLEQPKSLLR

SEQ ID NO: 143187 - protein, 51 aa, Glycine max
  Coding DNA Sequence Number=SeqID_26409
MRKLIKERMENKVANFVGLNKVVLGIKWMNGMEGKNHSFQRGQHTKVVKVL

SEQ ID NO: 143188 - protein, 317 aa, Glycine max
  Coding DNA Sequence Number=SeqID_26410
  Gene Ontology: Mol. function=transferase activity; Cellular component= intracellular; Biological process=RNA processing
  Homolog annotation: Hit_ID=Q1S205; Match level="QueryCoverage=95%, HitCoverage=31%, E-value=1e-124, Identity=76%"; Hit description =Protein prenyltransferase
MGAVIIYIGNQRQPEIHLFCARFKEQTGDIDGARAAYQLVHTETSPGLLEAIIKHANMEYRLGKMEDAFSLYEHAIAIEKGKEHSQTLPMLFAQYSRFVYLASGNAEKARQILVEGLENVLLSKPLLEALLHFEAIQPLPKRVGVDFLESWVVKFIMPNSESAGVASPTEREELSSIFLEDLGVWVSACICACMCGANLDHNDQDRFYLNLILTIHFLNLFGDVQSIKRAEDRHAKLFLPHRSMSELKKRHAEDFLVSDKTKVPRSYSAQSPAQSAMGAYPNAQNQWTNYGVQPQTWPPVTQAQGQQWTAGYTQQVE

SEQ ID NO: 143189 - protein, 154 aa, Glycine max
  Coding DNA Sequence Number=SeqID_26411
  Gene Ontology: Mol. function=binding; Cellular component =intracellular; Biological process=RNA processing
  Homolog annotation: Hit_ID=Q1S208; Match level="QueryCoverage=74%, HitCoverage=33%, E-value=3e-52, Identity=84%"; Hit description =Tetratricopeptide-like helical
  Pfam annotation: Domain name=TPR_2; Domain location=44-78; Score=8.0; E_value=3.9; Accession=PF07719.7; Description=Tetratricopeptide repeat
  Pfam annotation: Domain name=TPR_2; Domain location=9-43; Score=12.2; E_value=1.2; Accession=PF07719.7; Description=Tetratricopeptide repeat
  Pfam module annotation: Pfam domain module=TPR_2::TPR_2; Domain location=44-78::9-43
MVKENPGDPLFLRNYANFLYQYKQDCEGAEEYYSRAILADPDDGEVLSQYGKLVWELHHDQERASSYFERAVQASPEDSHVQAAYASFLWDTEEDEDGSNEPQCLPPHSLQGAIATAATLHGAIKMESEHVPKASLNAREKVLEDLNMNGNLTG

SEQ ID NO: 143190 - protein, 191 aa, Glycine max
  Coding DNA Sequence Number=SeqID_26412
  Gene Ontology: Mol. function=protein dimerization activity; Cellular component=nucleus; Biological process=regulation of transcription
  Homolog annotation: Hit_ID=Q8RW17; Match level="QueryCoverage=57%, HitCoverage=35%, E-value=2e-18, Identity=51%"; Hit description =Aux/IAA protein
  Pfam annotation: Domain name=AUX_IAA; Domain location=1-191; Score= -49.4; E_value=6.4e-06; Accession=PF02309.7; Description=AUXIAA family
MSLKSKESCSPRHSSSCCRYSLTSQLETRAEKPLQCLKMTTLLLRILHLTLNFLSPYAPANSSFTSLPITAPSQVVGWPPLGAYRMNSYNSHAKSPATEVFNSTLDKRASNSAGVRKSADGGSDSSNIISKEKGNLRTSLFVKVKMDGIPIGRKVDLGAHDSYETLAQTLEDMFDESTTVLTHKGDFFLSS

SEQ ID NO: 143191 - protein, 1022 aa, Glycine max
  Coding DNA Sequence Number=SeqID_26413
  Gene Ontology: Mol. function=protein serine/threonine kinase activity; Cellular component=integral to membrane; Biological process=protein amino acid phosphorylation
  Homolog annotation: Hit_ID=Q1S227; Match level="QueryCoverage=99%, HitCoverage=99%, E-value=0.0, Identity=78%"; Hit description=Protein kinase; Actin-binding, actinin-type
  Pfam annotation: Domain name=LRRNT_2; Domain location=28-74; Score =45.7; E_value=1.6e-10; Accession=PF08263.3; Description=Leucine rich repeat N-terminal domain
  Pfam annotation: Domain name=LRR_1; Domain location=102-124; Score =12.2; E_value=1.5; Accession=PF00560.23; Description=Leucine Rich Repeat
  Pfam annotation: Domain name=LRR_1; Domain location=126-148; Score =7.3; E_value=12; Accession=PF00560.23; Description=Leucine Rich Repeat
  Pfam annotation: Domain name=LRR_1; Domain location=150-172; Score =10.1; E_value=3.7; Accession=PF00560.23; Description=Leucine Rich Repeat
  Pfam annotation: Domain name=LRR_1; Domain location=174-196; Score =13.2; E_value=0.97; Accession=PF00560.23; Description=Leucine Rich Repeat
  Pfam annotation: Domain name=LRR_1; Domain location=198-220; Score =16.7; E_value=0.084; Accession=PF00560.23; Description=Leucine Rich Repeat
  Pfam annotation: Domain name=LRR_1; Domain location=222-244; Score =13.4; E_value=0.82; Accession=PF00560.23; Description=Leucine Rich Repeat
  Pfam annotation: Domain name=LRR_1; Domain location=246-268; Score =7.9; E_value=9.4; Accession=PF00560.23; Description=Leucine Rich Repeat
  Pfam annotation: Domain name=LRR_1; Domain location=270-292; Score =3.7; E_value=59; Accession=PF00560.23; Description=Leucine Rich Repeat
  Pfam annotation: Domain name=LRR_1; Domain location=294-316; Score =18.3; E_value=0.027; Accession=PF00560.23; Description=Leucine Rich Repeat
  Pfam annotation: Domain name=LRR_1; Domain location=318-340; Score =14.0; E_value=0.55; Accession=PF00560.23; Description=Leucine Rich Repeat
  Pfam annotation: Domain name=LRR_1; Domain location=342-364; Score =14.7; E_value=0.33; Accession=PF00560.23; Description=Leucine Rich Repeat
  Pfam annotation: Domain name=LRR_1; Domain location=366-385; Score =10.9; E_value=2.6; Accession=PF00560.23; Description=Leucine Rich Repeat
  Pfam annotation: Domain name=LRR_1; Domain location=390-412; Score =12.9; E_value=1.1; Accession=PF00560.23; Description=Leucine Rich Repeat
  Pfam annotation: Domain name=LRR_1; Domain location=414-436; Score =11.2; E_value=2.3; Accession=PF00560.23; Description=Leucine Rich Repeat
  Pfam annotation: Domain name=LRR_1; Domain location=438-460; Score =13.9; E_value=0.61; Accession=PF00560.23; Description=Leucine Rich Repeat
  Pfam annotation: Domain name=LRR_1; Domain location=462-482; Score =5.5; E_value=26; Accession=PF00560.23; Description=Leucine Rich Repeat
  Pfam annotation: Domain name=LRR_1; Domain location=486-508; Score =11.1; E_value=2.4; Accession=PF00560.23; Description=Leucine Rich Repeat
  Pfam annotation: Domain name=LRR_1; Domain location=510-532; Score =17.0; E_value=0.068; Accession=PF00560.23; Description=Leucine Rich Repeat
  Pfam annotation: Domain name=LRR_1; Domain location=534-556; Score =14.3; E_value=0.43; Accession=PF00560.23; Description=Leucine Rich Repeat
  Pfam annotation: Domain name=LRR_1; Domain location=558-580; Score =16.4; E_value=0.1; Accession=PF00560.23; Description=Leucine Rich Repeat
  Pfam annotation: Domain name=LRR_1; Domain location=582-605; Score =8.4; E_value=7.5; Accession=PF00560.23; Description=Leucine Rich Repeat
  Pfam annotation: Domain name=LRR_1; Domain location=78-100; Score =5.3; E_value=29; Accession=PF00560.23; Description=Leucine Rich Repeat
  Pfam annotation: Domain name=Pkinase; Domain location=710-986; Score =147.0; E_value=5.2e-41; Accession=PF00069.15; Description=Protein kinase domain
  Pfam annotation: Domain name=Pkinase_Tyr; Domain location=710-986; Score=97.9; E_value=3e-26; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=28-74::102-124::126-148::150-172::174-196::198-220::222 -244::246-268::270-292::294-316::318-340::342-364::366-385::390 -412::414-436::438-460::...
  Pfam module annotation: Domain location=462-482::486-508::510 -532::534-556::558-580::582-605::78-100::710-986::710-986
MKNKMQMKIQIFIFWYIGCFSYGFAAAVTNEVSALLSIKAGLVDPLNALQDWKLHGKEPGQDASHCNWTGIKCNSAGAVEKLDLSHKNLSGRVSNDIQRLESLTSLNLCCNAFSTPLPKSIANLTTLNSLDVSQNLFIGDFPLGLGRALRLVALNASSNEFSGSLPEDLANASCLEMLDLRGSFFVGSVPKSFSNLHKLKFLGLSGNNLTGKIPGELGQLSSLEHMILGYNEFEGGIPDEFGNLTNLKYLDLAVANLGGEIPGGLGELKLLNTVFLYNNNFDGRIPPAIGNMTSLQLLDLSDNMLSGKIPSEISQLKNLKLLNFMGNKLSGPVPSGFGDLQQLEVLELWNNSLSGPLPSNLGKNSPLQWLDVSSNSLSGEIPETLCSQGNLTKLILFNNAFTGPIPSSLSMCPSLVRVRIQNNFLSGTVPVGLGKLGKLQRLELANNSLSGGIPDDISSSTSLSFIDLSRNKLHSSLPSTVLSIPDLQAFMVSNNNLEGEIPDQFQDCPSLAVLDLSSNHLSGSIPASIASCQKLVNLNLQNNQLTSEIPKALAKMPTLAMLDLSNNSLTGQIPESFGVSPALEALNVSYNKLEGPVPANGILRTINPNDLLGNAGLCGGILPPCDQNSAYSSRHGSLRAKHIITAWITGISSILVIGIAILVARSLYIRWYTDGFCFQERFYKGSKGWPWRLMAFQRLGFTSTDILACVKETNVIGMGATGVVYKAEVPQSNTVVAVKKLWRTGTDIEVGSSDDLVGEVNVLGRLRHRNIVRLLGFLHNDIDVMIVYEFMHNGNLGEALHGRQATRLLVDWVSRYNIALGVAQGLAYLHHDCHPPVIHRDIKTNNILLDANLEARIADFGLAKMMIRKNETVSMVAGSYGYIAPEYGYALKVDEKIDVYSYGVVLLELLTGKRPLDSDFGESIDIVEWIRMKIRDNKSLEEALDPSVGNNRHVLEEMLLVLRIAILCTAKLPKDRPTMRDVVMMLGEAKPRRKSSGNSNDVANNKETPVFSTSPVNDNNLV

SEQ ID NO: 143192 - protein, 824 aa, Glycine max
  Coding DNA Sequence Number=SeqID_26414
  Gene Ontology: Mol. function=identical protein binding; Cellular component=cellulose and pectin-containing cell wall; Biological process=negative regulation of enzyme activity
  Homolog annotation: Hit_ID=Q1S230; Match level="QueryCoverage=93%, HitCoverage=98%, E-value=0.0, Identity=80%"; Hit description =Protease-associated PA; Proteinase inhibitor I9, subtilisin propeptide
  Pfam annotation: Domain name=PA; Domain location=422-519; Score=94.3; E_value=3.7e-25; Accession=PF02225.12; Description=PA domain
  Pfam annotation: Domain name=Peptidase_S8; Domain location=168-658; Score=44.1; E_value=4.8e-10; Accession=PF00082.12; Description =Subtilase family
  Pfam annotation: Domain name=Subtilisin_N; Domain location=83-165; Score=64.3; E_value=3.9e-16; Accession=PF05922.7; Description =Subtilisin N-terminal Region
  Pfam module annotation: Pfam domain module=PA::Peptidase _S8::Subtilisin_N; Domain location=422-519::168-658::83-165
DPRDEELSYFTSFVSRTLTLFSFEFFSTPSNTPPNHPSPNITNQQQQDILVLQQQPMESKSKIQLFFLTLFLFTLTLHAETLGTYIVQLHPHGITSTSFTSRLKWHLSFIQQTISSDEDPSLRLLYSYRSAMDGFAAQLTESELEYLKNLPDVISIRPDRKLQLQTTYSYKFLGLNPARENGWYQSGFGRRTIIGVLDTGVWPESPSFNDQGMPPIPKRWKGVCQAGKAFNSSNCNRKLIGARYFTKGHFSVSPFRIPEYLSPRDSSGHGTHTASTAAGVPVPLASVFGYASGVARGMAPGAHIAVYKVCWFNGCYNSDIMAAMDVAIRDGVDILSLSLGGYSLPLYDDSIAIGSYRAMEHGISVICAAGNNGPMEMSVANEAPWISTIGASTLDRKFPATVHMGNGQMLYGESMYPLNHHPMSSGKEVELVYVSEGDTESQFCLRGSLPKDKVRGKMVVCDRGVNGRAEKGQVVKEAGGVAMILANTEINLGEDSVDVHVLPATLVGFDEAVTLKAYINSTKRPLARIEFGGTVIGKSRAPAVARFSARGPSYTNPSILKPDVIAPGVNIIAAWPQNLGPTGLPEDARRVNFSVMSGTSMACPHVSGIAALIRSAHPRWTPAAVKSAIMTTAEVTDHTGRPILDEDQPAGVFDMGAGHVNPQRALNPGLVYDIRPDDYITHLCSLGYTKSEIFSITHRNVSCNGIIKMNRGFSLNYPSFSVIFKDEVRRKMFSRRLTNVGSANSIYSVEVKAPAGVKVIVKPKRLVFKQVNQSLSYRVWFISRKKVKRGDGLVNHSEGSLTWVHSQNGSYRVRSPVAVTWKSK

SEQ ID NO: 143193 - protein, 661 aa, Glycine max
  Coding DNA Sequence Number=SeqID_26415
  Gene Ontology: Mol. function=transferase activity, transferring glycosyl groups; Cellular component=membrane
  Homolog annotation: Hit_ID=Q1S232; Match level="QueryCoverage=80%, HitCoverage=95%, E-value=0.0, Identity=82%"; Hit description =Exostosin-like
  Pfam annotation: Domain name=Exostosin; Domain location=208-556; Score=573.3; E_value=2.3e-169; Accession=PF03016.6; Description =Exostosin family
MEGVNAFIVWWLELKIVQKLNQEVMPPLHVTAAFGACIETRDGNKQNKRERKRWLVLTLFSDDSVMDSNFKHDSFEYINLDGKNVGATMRLQHRSSKGESKDCCCINIYVNNNVQGVSNSVLHGSETLLSRFPLRILLVPPPLLPLRRPPPPPTNPNPVVPITLQPQQPRKNLGFPEKISQPEKPTFPFDRALRTADNKSDPCGGRYIYVHDLPSRFNEDMLKHCRSLSLWTNMCKFTTNAGLGPPLENVNGVFSDTGWYATNQFTVDVIFSNRMKQYQCLTRDPSVAAAFFVPFYAGFDIARYLWGYNISMRDAASLDLVNWLMNRPEWKIMNGRDHFLVAGRITWDFRRLTEEESDWGNKLLFLPAAKNMSMLVVESSPWNANDFGIPYPTYFHPAKDDDVFTWQERMRRLERKWLFSFAGAPRPDNPKSIRGQIIEQCRRSKVGKLLECDFGESKCHSPSSIMQMFQGSLFCLQPQGDSYTRRSAFDSMLAGCIPVFFHPGSAYTQYTWHLPKNYTKYSVFIPEDDLRKRNVSIEERLSQIPEEEVRIMREEVIGLIPRLVYADPRSKLETLEDAFDVSVQAVIDKVTNLRKDIMEGRTDENFIEENSWKYALLDEGQREVGPHEWDPFFSKPKPGGDSDDLSAEAAKNSWKNEQRNQ

SEQ ID NO: 143194 - protein, 1215 aa, Glycine max
  Coding DNA Sequence Number=SeqID_26416
  Gene Ontology: Mol. function=ATPase activity, coupled to transmembrane movement of substances; Cellular component=integral to membrane; Biological process=transport
  Homolog annotation: Hit_ID=Q7GB25; Match level="QueryCoverage=97%, HitCoverage=97%, E-value=0.0, Identity=66%"; Hit description =Multidrug resistance-associated protein 5
  Pfam annotation: Domain name=ABC_membrane; Domain location=328-600; Score=105.0; E_value=2.2e-28; Accession=PF00664.13; Description=ABC transporter transmembrane region
  Pfam annotation: Domain name=ABC_membrane; Domain location=962-1215; Score=32.3; E_value=1.7e-06; Accession=PF00664.13; Description=ABC transporter transmembrane region
  Pfam annotation: Domain name=ABC_tran; Domain location=675-846; Score= 134.2; E_value=3.6e-37; Accession=PF00005.17; Description=ABC transporter
  Pfam module annotation: Pfam domain module=ABC_membrane::ABC _membrane::ABC_tran; Domain location=328-600::962-1215::675-846
MAVDEIEILSSTLFSSSSSGSFEILWSAILGLPLLELVAICANLTLFILFLVVVSARKVLVCVWGGVRFGKENGTGNASPGCVSVDLETRDIRIETWFKLSVLSCFYVLLVQVLVLGFDGVALIRGRDLDLDLGLALLSVPLVQGLAWVVLSFSALQCKFKACERFPVLLRVWLFVVFVICLCGLYVDGRGVWMEGSKHLRSHVVANFAVTPALAFLCIVAIRGVTGIKVFRSSEEQQPLLVDEDPGCLKVTPYSDAGLFSLAILSWLNPLLSIGAKRPLELKDIPLVAPKDRSKTNYKVLNSNWERLKAENLSGQPSLAWALLKSFWKEAACNAVFAGVTTLVSYVGPYMISYFVDYLVGKEIFPHEGYVLAGVFFVAKLVETFTTRQWYLGVDILGMHVRSALTAMVYRKGLRISSLAKQSHTSGEVVNYMAIDVQRVGDYSWYLHDMWMLPLQIVLALAILYKNVGIASIATLIATIISIAVTVPIARIQENYQDKLMAAKDERMRKTSECLRNMRILKLQAWEDRYRVKLEEMRGVEFKWLRKALYSQAFITFIFWSSPIFVSAVTFGTSILLGGQLTAGGVLSALATFRILQEPLRNFPDLVSTMAQTKVSLDRLSGFLLEEELQEDATIVLPQGITNIAIEIKGGVFCWDPSSSSRPTLSGISMKVERRMRVAVCGMVGSGKSSFLLCILGEIPKISGEVRVCGSSAYVSQSAWIQSGTIEENILFGSPMDKAKYKNVLHACSLKKDLELFSHGDLTIIGDRGINLSGGQKQRVQLARALYQDADIYLLDDPFSAVDAHTGSDLFREYILTALADKTVIYVTHQVEFLPAADLILVLKEGCIIQSGKYDDLLQAGTDFNTLVSAHNEAIEAMDIPTHSEDSDENLSLEACVMTSKKSICSANDIDSLAKEVQEGSSISDQKAIKEKKKAKRSRKKQLVQEEERIRGRVSMKVYLSYMAAAYKGLLIPLIIIAQTLFQFLQIASNWWMAWANPQTEGDLPKVTPSVLLLVYMALAFGSSWFIFVRAVLVATFGLAAAQKLFLKMLRSVFHAPMSFFDSTPAGRILNRVSIDQSVVDLDIPFRLGGFASTTIQLIGIVGVMTEVTWQVLLLVVPMAVACLWMQKYYMASSRELVRIVSIQKSPIIHLFGESIAGASTIRGFGQEKRFMKRNLYLLDALHDHSSAVFLQLSGSACGWSYCQPLYLLSVWYYL

SEQ ID NO: 143195 - protein, 82 aa, Glycine max
  Coding DNA Sequence Number=SeqID_26417
VALHSMLLSLWLDKFANSLCKKYPDSMDELREQAKGYIQMEEMSTFRNEVKQARQKCDKQEANTKTDLHKLNKSDQGRTRIN

SEQ ID NO: 143196 - protein, 453 aa, Glycine max
  Coding DNA Sequence Number=SeqID_26418
  Gene Ontology: Mol. function=RNA-directed DNA polymerase activity; Biological process=RNA-dependent DNA replication
MEIVRRGVWNVFKLLASFAPPGKVEGVYPECWPIVTSSHHFGGKGASSSMEITNPFMKAFSRVILPGPSRMIHAPPPFMLDAPSRLSQNLLDGVVHFDNHFMTLEAGPESSGQVLLSIMEYAAEIYKSKGTPGLGRLKTCGVPMVFLKAMKAYSQRNLDKDASLTFSFSTSWTVGINPPMSDHEAEKLVSAYLKSTFFGVEAHVIFAKVYLFGACSVQISVVGEHSPFAIDLFDHDDIGKLGGIRDFSDEVCIEEFVHLYDIGLAWGQMAMLMAGGVLNEPRTLPRVRFELHLNELFDGFWASVRGVISRIYIEFIIQACLVDDQGSDWRPFIHAHDLSTFSRYGVRLVRLLGGRIGCYLQALCIALSCLLLVCLDGYNLPTQALGELSLTKGGHYVHDISGIALVDENLGHHEVCNDDGDNNKVVLVDRVDTFEVLIHDDASTKLMLMSRIT

SEQ ID NO: 143197 - protein, 61 aa, Glycine max
  Coding DNA Sequence Number=SeqID_26419
ESKKQNLKEEGTEKQNKLTWVVLRIIASLVMTYDGDDSSSYKAARQYREENDKGGGDERQL

SEQ ID NO: 143198 - protein, 48 aa, Glycine max
  Coding DNA Sequence Number=SeqID_26420
MEQVSMGHQNWGEFYKLFAAKFLPWLVFWFVLKVVLNIGWMAFVDNWV

SEQ ID NO: 143199 - protein, 194 aa, Glycine max
  Coding DNA Sequence Number=SeqID_26421
MGDKLHRREGNSPDHQLRPLNDRSVIKEGRTRASSAGRSGSENVGLSNANVGENPMPRKPKGSLRKVRPTEGESGPKIRPKGVVDGQQDARCPCFFRVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 143200 - protein, 132 aa, Glycine max
  Coding DNA Sequence Number=SeqID_26422
YILCGTSRGYIYLGLTENKRGYISYGSVLVEGTSTRFKENKGGPLDPTPTTNHPTTPSSCQQLLQTPPLLGQASSDEAVMFKLKTFVKKMLRELGNYPSGSIVDEFGATILARICVFHSLDLVFLEEGEKNI

SEQ ID NO: 143201 - protein, 81 aa, Glycine max
  Coding DNA Sequence Number=SeqID_26423
MGSKSTLRLMRTRGPSLGSLAQSTWSLLSNALVGKESPVIAVLADAYDTFDRRCEKSSARIVCCTPALYVWLVSHIFRHES

SEQ ID NO: 143202 - protein, 36 aa, Glycine max
  Coding DNA Sequence Number=SeqID_26424
MEKGTSLPMEKGTSLSMEKGFKILLFPIIDSLGNPL

SEQ ID NO: 143203 - protein, 58 aa, Glycine max
  Coding DNA Sequence Number=SeqID_26425
EVCDDIAERLERHLSLGVVTPDSSTYEVIEKCLRLARSVTQDHLVYVRCRRRWRTDQT

SEQ ID NO: 143204 - protein, 112 aa, Glycine max
  Coding DNA Sequence Number=SeqID_26426
MAAHLRASSSSSWWREFEKIFASLPLQIDELPILKLLPPSMPPYKEGIRTRILSGVKYGWRVVKCQRSCTRFADFLSTGGYVENGSRITTMISAPHAEDTILFYYFQRANIE

SEQ ID NO: 143205 - protein, 265 aa, Glycine max
  Coding DNA Sequence Number=SeqID_26427
  Gene Ontology: Mol. function=nucleoside-triphosphatase activity; Cellular component=integral to membrane; Biological process=transport
  Homolog annotation: Hit_ID=Q1M2R7; Match level="QueryCoverage=95%, HitCoverage=21%, E-value=2e-85, Identity=57%"; Hit description=PDR -like ABC-transporter
  Pfam annotation: Domain name=ABC_tran; Domain location=80-253; Score =12.2; E_value=1.4e-08; Accession=PF00005.17; Description=ABC transporter
MHGFFSYSLNGNRVGVDIPTIEVRFEHLNVEADVHLGGRALPTLTNYMVNIVEGLLKSILRSGRQNMNILHDVSGIIKPSWMTLLFGSPSSGKTTLLLALAGKLDPNLKVIIYILTEVCRREKEANIVPDLGIDIYMKSVATEGQNANLLTDYILRILGLEICADIVMRNAMIRGISGGQRKRVTTGEMLVGPSRVLFMDEISTGLDSSTTFQIVKSIKQYVHLLKGTAVISLLQPPPETYNLCDDVILFSDPHIVYQGPCEHVC

SEQ ID NO: 143206 - protein, 1429 aa, Glycine max
  Coding DNA Sequence Number=SeqID_26428
  Gene Ontology: Mol. function=nucleoside-triphosphatase activity; Cellular component=integral to membrane; Biological process=transport
  Homolog annotation: Hit_ID=Q1M2R7; Match level="QueryCoverage=98%, HitCoverage=99%, E-value=0.0, Identity=73%"; Hit description=PDR -like ABC-transporter
  Pfam annotation: Domain name=ABC2_membrane; Domain location=1155 -1368; Score=223.2; E_value=5.6e-64; Accession=PF01061.14; Description=ABC-2 type transporter
  Pfam annotation: Domain name=ABC2_membrane; Domain location=509-722; Score=171.9; E_value=1.6e-48; Accession=PF01061.14; Description=ABC -2 type transporter
  Pfam annotation: Domain name=ABC_tran; Domain location=184-407; Score= 44.7; E_value=1.9e-11; Accession=PF00005.17; Description=ABC transporter
  Pfam annotation: Domain name=ABC_tran; Domain location=868-1058; Score=96.2; E_value=1e-25; Accession=PF00005.17; Description=ABC transporter
  Pfam annotation: Domain name=DUF988; Domain location=529-644; Score= -68.4; E_value=0.084; Accession=PF06177.2; Description=Protein of unknown function (DUF988)
  Pfam annotation: Domain name=Dynamin_N; Domain location=871-1041; Score=-44.3; E_value=0.067; Accession=PF00350.13; Description =Dynamin family
  Pfam annotation: Domain name=PDR_assoc; Domain location=727-791; Score=133.4; E_value=6.3e-37; Accession=PF08370.2; Description=Plant PDR ABC transporter associated
  Pfam module annotation: Pfam domain module=ABC2_membrane::ABC2 _membrane::ABC_tran::ABC_tran::DUF988::Dynamin_N::PDR_assoc; Domain location=1155-1368::509-722::184-407::868-1058::529-644::871 -1041::727-791
MEDGGSVKAGSTTNTMSSFRIGSRSVWSNSGVEIFANSFHQEDDEEALKWAAIQKLPTFARLRTGLMTSPEGVANEVNVHQLGLQERRGLLERLVRVAEEDNEKFMLKLRDRIDRVGITIPTIEVRFENMNIGAEVHVGSRALPTFTNYMVNKVEGLLNFLHVLPSRKQRINILQNVSGIIRPARMTLLLGPPSSGKTTLLLALAGRLDSKLKFTGKVTYNGHGMNEFVPQRTAAYVSQNDLHIGEMTVRETLAFSARVQGVGARYDLLAEVSRREKEANIKPDPDIDVYMKAVATEGQKANFITDYILRILGLEVCADTIVGNAMLRGISGGQRKRVTTGEMLVGPAKAVFMDEISTGLDSSTTFQVVNSLKHFIHSLKGTAVVSLLQPAPETYNLFDDIILLSDGQIVYQGPREHVLEFFASVGFKCPERKGVADFLQEVTSRKDQEQYWVHRDQPYRFVTTEEFVEAFQSFHVGRSLADELATQFDKSKSHPAALATKMYGLGKWELLKACLSREYLLMKRNSFVHIFQLCQLAIVAFIAMTVFFRTEMHPDSVTSGGIYAGALFYGLLVILLDGFADLTMTVSKLPVFYKQRDFLFFPSWVYALPAWILKIPMTFAQVGIWVFLTYYVIGFDPYVGRFFRQFLLLLFVNQMASALFRFIGALGRELTVAFTIGSFVLAILIAMSGFILSKGNMKKWWLWGFWSSPMMYGLNAMINNEFQGKRWRHVLPNSTTPLGVQVLKSRGFFTQSKWYWIGVGALIGYTIVFNIAYILALTYLNPIVQHQAVKSEKSQSNEQDGGSTSARSSSRRKEADRRRGMALPFEPHSITFDDVTYSVDMPQEMKNQGVLEDRLNLLKGVSGTFRPGVLTALMGSTGAGKTTLMDVLAGRKTGGYIGGNITISGYPKKQETFARISGYCEQNDIHSPYVTVYESLLYSAWLRLSAEINSETRKMFIEEVIELVELNPLKHTIVGLPGVNGLSTEQRKRLTISVELVANPSIIFMDEPTSGLDARAAAVVMRAIRKIVDTGRTVVCTIHQPSIDIFESFDELFLMKRGGQEIYVGPLGHHSYHLISYFEGIKGVRTIEDGYNPATWMLEVTTSAKEMELGIDFAELYKNSDLYRRNKELIEELSTPAPGSKDLYFSSKYSRSFITQCMACLWKQHWSYWRNNEYTALRFLFTIAVALLFGSIYWNLGSKIKKQQDLFNAMGSMYAAVLLLGIKNSNSAQPLVAVERTVFYREKAAGMYSALAYAFAQAIELPHVLLQTVVYSAIVYAMIGFEWSVTKFFWYLFFMYFTFLYFTYYGMMSAAMTPNPSLAVIISSGFYEVWNLFSGFIIPRPRMPVWWRWYYWANPVAWTLYGLVTSQFGDIQDHIEFNGRSTTVEDFLRNYFGFKHDFLGVVAAVLIGFAVTFALIFAIAIKMLNFQRR

SEQ ID NO: 143207 - protein, 614 aa, Glycine max
  Coding DNA Sequence Number=SeqID_26429
  Gene Ontology: Mol. function=protein binding; Cellular component =microtubule; Biological process=electron transport
  Homolog annotation: Hit_ID=Q1S7Z2; Match level="QueryCoverage=99%, HitCoverage=100%, E-value=0.0, Identity=88%"; Hit description=WD40 -like
  Pfam annotation: Domain name=WD40; Domain location=137-175; Score =30.0; E_value=8.6e-06; Accession=PF00400.22; Description=WD domain, G-beta repeat
  Pfam annotation: Domain name=WD40; Domain location=186-222; Score =6.9; E_value=5.8; Accession=PF00400.22; Description=WD domain, G -beta repeat
  Pfam annotation: Domain name=WD40; Domain location=238-277; Score =28.4; E_value=2.6e-05; Accession=PF00400.22; Description=WD domain, G-beta repeat
  Pfam annotation: Domain name=WD40; Domain location=288-325; Score =27.2; E_value=5.7e-05; Accession=PF00400.22; Description=WD domain, G-beta repeat
  Pfam annotation: Domain name=WD40; Domain location=333-371; Score =33.0; E_value=1e-06; Accession=PF00400.22; Description=WD domain, G -beta repeat
  Pfam module annotation: Pfam domain module=WD40::WD40::WD40::WD40::WD4 0; Domain location=137-175::186-222::238-277::288-325::333-371
  Subcellular localization annotation: CTP_CleavageSite=51; ConfidenceScore=5.12e-01
MEEEGDIYDGVRAQFPLSFGKQSKPQTPLEAIHNATRRSNSNPKTANDLPSVSSSSRDWLNSLRPPKTPTPPPPLPPPDHDDGPMVGPPPPPPTAADEEEDDDDAEMIGPPPPPPIASESEDDSDQDEVGTRFRIPLSNEIVLKGHTKVVSALAVDHTGSRVLSGSYDYMVRMYDFQGMNARLESFRQLEPFEGHQVRNLSWSPTADRFLCVTGSAQAKIYDRDGLTLGEFVKGDMYIRDLKNTKGHISGLTCGEWHPKTKETILTSSEDGSLRIWDVNDFKSQKQVIKPKLARPGRVPVTTCAWDHDGKCIAGGIGDGSIQIWNIKPGWGSRPDVHIEKSHEDDISGLKFSSDGRILLSRSFDGSLKVWDLRKTKEPLKVFEDLPNHYAQTNIAFSPDERLFLTGTSVERESMTGGLLCFFDRVNLELVSKVGISPTCSVVQCSWHPKLNQIFATTGDKSQGGTHILYDPTVSERGALVCVARAPRKKSIDDFEAKPVIHNPHALPLFRDQPSRKRQREKVLKDPLKSHKPELPMTGPGFGGRVGTSQGSLLTQYLLKKGGMIKETWMEEDPREAILKYADAAAKDPKFIAPAYAETQPEPVFAKSDSEDEEK

SEQ ID NO: 143208 - protein, 115 aa, Glycine max
  Coding DNA Sequence Number=SeqID_26430
  Gene Ontology: Mol. function=two-component response regulator activity; Cellular component=nucleus; Biological process=two -component signal transduction system (phosphorelay)
  Homolog annotation: Hit_ID=Q1S7Z3; Match level="QueryCoverage=87%, HitCoverage=70%, E-value=4e-19, Identity=52%"; Hit description =Response regulator receiver
  Pfam annotation: Domain name=Response_reg; Domain location=12-111; Score=48.9; E_value=1.7e-11; Accession=PF00072.14; Description =Response regulator receiver domain
MKIDAGVWWIPLLRERVGIKDVTAAKNGKEAVDLHRINGQSFDLILMDKDMPIMNGIQATKELRSTGISSKIIGVSSSSREESNVQEFVEAGLDDYYMKPLTEEMLREILDKIKP

SEQ ID NO: 143209 - protein, 82 aa, Glycine max
  Coding DNA Sequence Number=SeqID_26431
  Homolog annotation: Hit_ID=Q6ATR5; Match level="QueryCoverage=60%, HitCoverage=7%, E-value=4e-07, Identity=50%"; Hit description =Expressed protein
MLGLNRIERVLPVGTSLTVVGEVISDEHSWKKSRDLLEKVGRQGDLTGYRVSCLLIGAKDYLTPYPRAVQDSVKVLHINSVS

SEQ ID NO: 143210 - protein, 96 aa, Glycine max
  Coding DNA Sequence Number=SeqID_26432
  Homolog annotation: Hit_ID=Q2V732; Match level="QueryCoverage=34%, HitCoverage=4%, E-value=2e-12, Identity=100%"; Hit description=VHS and GAT domain protein
MVNSMVERATSDMLIGPDWAMNIEICDMLNHDPCPSQRLIGAEQIVAQRGKLCVVSPSSGISVVDVATVPPRILPIWLPEEFEPVVVHILNIFALF

SEQ ID NO: 143211 - protein, 193 aa, Glycine max
  Coding DNA Sequence Number=SeqID_26433
  Gene Ontology: Mol. function=Rho GDP-dissociation inhibitor activity; Cellular component=cytoplasm
  Homolog annotation: Hit_ID=Q705X4; Match level="QueryCoverage=89%, HitCoverage=73%, E-value=6e-54, Identity=64%"; Hit description=Rho GDP dissociation inhibitor 1
  Pfam annotation: Domain name=Rho_GDI; Domain location=24-193; Score= -72.3; E_value=0.0012; Accession=PF02115.7; Description=RHO protein GDP dissociation inhibitor
MESGGNGKRAHEEAGPSSGIDGRKLEMTEKASDDDKEEEEEEEEEEEGAIEDSKNGFFVPGPLLSLKEQIERDKEDESLRRWKEKLLGCLESDIDGQLDPEVKFHSIGILSEDFGEIVTPLPVDENRNGCTLFTLREGSRYQLKLKFSVLHNIVSGLTYSNTVWKGGLQGFNFKNLSNTSNRKSIHASRFWYA

SEQ ID NO: 143212 - protein, 671 aa, Glycine max
  Coding DNA Sequence Number=SeqID_26434
  Gene Ontology: Mol. function=binding; Cellular component=membrane; Biological process=photosynthesis
  Homolog annotation: Hit_ID=Q337L2; Match level="QueryCoverage=99%, HitCoverage=91%, E-value=1e-174, Identity=49%"; Hit description=TPR Domain containing protein, expressed
  Pfam annotation: Domain name=TPR_1; Domain location=528-561; Score =8.2; E_value=0.56; Accession=PF00515.18; Description=Tetratricopeptid e repeat
  Pfam annotation: Domain name=TPR_1; Domain location=562-595; Score =28.0; E_value=3.4e-05; Accession=PF00515.18; Description =Tetratricopeptide repeat
  Pfam annotation: Domain name=TPR_1; Domain location=632-665; Score =4.4; E_value=1.6; Accession=PF00515.18; Description=Tetratricopeptide repeat
  Pfam annotation: Domain name=TPR_1; Domain location=94-127; Score =5.9; E_value=1.1; Accession=PF00515.18; Description=Tetratricopeptide repeat
  Pfam annotation: Domain name=TPR_2; Domain location=27-60; Score=1.8; E_value=21; Accession=PF07719.7; Description=Tetratricopeptide repeat
  Pfam annotation: Domain name=TPR_2; Domain location=279-312; Score =9.5; E_value=2.6; Accession=PF07719.7; Description=Tetratricopeptide repeat
  Pfam annotation: Domain name=TPR_2; Domain location=436-469; Score =6.6; E_value=5.6; Accession=PF07719.7; Description=Tetratricopeptide repeat
  Pfam annotation: Domain name=TPR_2; Domain location=472-505; Score =5.9; E_value=6.8; Accession=PF07719.7; Description=Tetratricopeptide repeat
  Pfam annotation: Domain name=TPR_2; Domain location=528-561; Score =6.9; E_value=5.2; Accession=PF07719.7; Description=Tetratricopeptide repeat
  Pfam annotation: Domain name=TPR_2; Domain location=562-595; Score =29.2; E_value=1.4e-05; Accession=PF07719.7; Description =Tetratricopeptide repeat
  Pfam annotation: Domain name=TPR_2; Domain location=632-665; Score =7.7; E_value=4.2; Accession=PF07719.7; Description=Tetratricopeptide repeat
  Pfam annotation: Domain name=TPR_2; Domain location=94-127; Score =10.6; E_value=1.9; Accession=PF07719.7; Description=Tetratricopeptide repeat
  Pfam module annotation: Pfam domain module=TPR_1::TPR_1::TPR_1::TPR _1::TPR_2::TPR_2::TPR_2::TPR_2::TPR_2::TPR_2::TPR_2::TPR_2; Domain location=528-561::562-595::632-665::94-127::27-60::279-312::436 -469::472-505::528-561:...
  Pfam module annotation: Domain location=:562-595::632-665::94-127
MGSGSGNMDEAELSLRESGIMDIMDNEEARALLGKDEYQEGNIEAALHVYERINISAVTSKMKISLAKSREHRKKHYHYYATPPMSIYTAGLLLEAIFLKAKCLQVLGRFKEAAQTCKVILDIVESSLPEGLPQNFGDEGKLQETLSKVVELLPELWKLADSPRDVILSYRRALLHRRNLDAKTIAKIQKEFVVFLLYSGGEAILSNLRSHMDSSFVPRNNLEEAILLLMILLRKISLNKIEWDPSILDHLSFALSVSGDLTALAHQWEELLPGTINRRERYHALSLCYYGAGNDLVALNLLRKLLSSREDPKHVPSLLMASKICSMNPDLAKDGASLACKVLENLDGRCDQLESLSSCLLGVSLSAHSKIAISNSERVEKQSEALHSLETASKVTRMRNPPVIYYLSLECAEQRKLDVALHYAKCFLNLEAGSNIKGWLLLARILSAQKQFLDAESIVDEALNQTGIWDQGELLRTKAKLQIAQGQLKSAIETYTQLLAILLVQRKTFGSKKKLYKDYIDHARNMEVEIWHDLAYVYISLSRWHDAEVCLSKSKAIKLYSASRCHAIGTMYEAKGLYKEAIKAFRDALSIDPGHVPSLISTAVVLRRCSNQSNPAIRSFLMDALRHDRFNASAWYNLGIFNKDEGTILEAADCFETANFLEESAPVEPFR

SEQ ID NO: 143213 - protein, 77 aa, Glycine max
  Coding DNA Sequence Number=SeqID_26435
  Gene Ontology: Mol. function=Rho GDP-dissociation inhibitor activity; Cellular component=cytoplasm
  Homolog annotation: Hit_ID=Q705X4; Match level="QueryCoverage=52%, HitCoverage=18%, E-value=3e-14, Identity=92%"; Hit description=Rho GDP dissociation inhibitor 1
DQSKGMLGAFAPQKEPYVYALKEDTTPSGALARGVYSAKLKNIRNSVHSFNFRNSVQCASENSYLLLKTLVWLSGRE

SEQ ID NO: 143214 - protein, 99 aa, Glycine max
  Coding DNA Sequence Number=SeqID_26436
MSSKSISCYMASTTSLKSPKWWCLNLSESSKGLPKSIGMKTLDDTLPERYWQNMAFGLKVARLGELSSPKRADNFILKQPCSPKRAGYFIMKLSRWLRG

SEQ ID NO: 143215 - protein, 57 aa, Glycine max
  Coding DNA Sequence Number=SeqID_26437
MASTSGDATPPSPKTARLMAEMIKLGINEALGLNLALGLNPELSLDLKRADYFILQN

SEQ ID NO: 143216 - protein, 38 aa, Glycine max
  Coding DNA Sequence Number=SeqID_26438
MGRVNLGLNVRMVVMTWGKAWAEQMRKMSDKGESKSHF

SEQ ID NO: 143217 - protein, 104 aa, Glycine max
  Coding DNA Sequence Number=SeqID_26439
MDNEEGVQEQMKADLSALKDQMASITEAMLKIQKTIEDNATAAASNTTREAEPVLQPAINLGRDRNATGFNRRLHSPYRSRRFEPSPYLRGAAPSSCRLSSARR

SEQ ID NO: 143218 - protein, 114 aa, Glycine max
  Coding DNA Sequence Number=SeqID_26440
MGIAPTKTLNGPKEVQQALGFPALVTGLCRPYRAPVPPSKDCARKTPSGPEEGQQGLELPALNTGSLSVIGSACRPQQGHQAPLLIKLSSRSTAPPGRRRAKHHSSIGMAGSGQ

SEQ ID NO: 143219 - protein, 60 aa, Glycine max
  Coding DNA Sequence Number=SeqID_26441
MTVVVVTIATTTMIVTMTVVATNMTVVNGDSYVGGDDRVMAAIAEMVVRTLLTDIFTGGI

SEQ ID NO: 143220 - protein, 171 aa, Glycine max
  Coding DNA Sequence Number=SeqID_26442
  Gene Ontology: Mol. function=phosphatidylcholine-sterol O -acyltransferase activity; Biological process=lipid metabolic process
  Homolog annotation: Hit_ID=Q8GZM5; Match level="QueryCoverage=85%, HitCoverage=23%, E-value=1e-76, Identity=89%"; Hit description =Lecithine cholesterol acyltransferase-like protein
MPFSKYCRTDNKYWKHFSGGRQVGPPTYHCDEQEFKTNLSGWPTKIINIEIPSTRAFDAYPSFSEIPEANLSSMECGLPTQLSFSAREISDGTFFKAIEDYDPDSKRLLYLLEKSYLGDPVLNPLTPWDRPPIKNVFCIYGTDSKTKSLCPNALVPKRCQNEYVERKTYMW

SEQ ID NO: 143221 - protein, 282 aa, Glycine max
  Coding DNA Sequence Number=SeqID_26443
  Gene Ontology: Mol. function=phosphatidylcholine-sterol O -acyltransferase activity; Cellular component=endoplasmic reticulum; Biological process=lipid metabolic process
  Homolog annotation: Hit_ID=Q8GZM5; Match level="QueryCoverage=93%, HitCoverage=35%, E-value=1e-112, Identity=76%"; Hit description =Lecithine cholesterol acyltransferase-like protein
  Pfam annotation: Domain name=LACT; Domain location=111-281; Score= -40.1; E_value=8.6e-10; Accession=PF02450.6; Description =Lecithin:cholesterol acyltransferase
MAKNPLLCSIVLLAVLAGATSDDGAELDYSKLSGIIIPGFASTQLRAWSILDCPYSPLDFNPLDLVWLDTTKWGTRTRILSLPPFSLHHQANLISPAVYEISSNELRFKELRVWYLLSAVNCWLKCMVLDPYNQTDHPDCKSRPDSGLSGITELDPGYITGPLSSVWKEWIKWCIEFGIEANAIIAVPYDWRLSPSKLEERDLYFHKLKITFETAYKLRGGPSLVFAHSLGNHVFRYFLEWLKLEIAPKHYIQWLDQHIHAYFAVGMIDLRTFVTPLGILLI

SEQ ID NO: 143222 - protein, 85 aa, Glycine max
  Coding DNA Sequence Number=SeqID_26444
MRAQTIALEPCCLRTRVDGTFQSSNCGDGGARAVHGALYHRRKLRMKAVVGENLRLTAKIDHRNGGGRATALWCGFNEGAVVARV

SEQ ID NO: 143223 - protein, 750 aa, Glycine max
  Coding DNA Sequence Number=SeqID_26445
  Gene Ontology: Mol. function=zinc ion binding; Cellular component =intracellular; Biological process=DNA repair
  Homolog annotation: Hit_ID=Q019Z0; Match level="QueryCoverage=54%, HitCoverage=66%, E-value=8e-19, Identity=25%"; Hit description=[K] KOG1084 Transcription factor TCF20
  Pfam annotation: Domain name=BRCT; Domain location=459-536; Score =29.9; E_value=9.2e-06; Accession=PF00533.16; Description=BRCA1 C Terminus (BRCT) domain
  Pfam annotation: Domain name=BRCT; Domain location=595-699; Score =29.5; E_value=1.2e-05; Accession=PF00533.16; Description=BRCA1 C Terminus (BRCT) domain
  Pfam annotation: Domain name=zf-C3HC4; Domain location=27-77; Score =17.3; E_value=0.0025; Accession=PF00097.15; Description=Zinc finger, C3HC4 type (RING finger)
  Pfam annotation: Domain name=zf-MIZ; Domain location=23-66; Score= -13.6; E_value=0.075; Accession=PF02891.10; Description=MIZ zinc finger
  Pfam module annotation: Pfam domain module=BRCT::BRCT::zf-C3HC4::zf -MIZ; Domain location=459-536::595-699::27-77::23-66
  Subcellular localization annotation: CTP_CleavageSite=78; ConfidenceScore=5.10e-01
MDDSGSKTKLLNPWMLHFQKLALELKCPLCLSLFKRPVLLPCNHLFCKFVSSSSSSSYSFPSCLADCITAGPGCAVCKATYAQTDVRHVPFVENVVAIYRSLDATFCASLFQPCSSGDGRVLEPCQAILNSTSSSLKAAKLPRNLTNSNEVGVGKNFKSKSVVHDKAEEFELSRERGKPNPMQSSHMELGGREECGVMEMDVNQVTQSAPDSPPFCDTKGSDNDFSDQGSEHPLLPGRLENSSLKRAGTGNGNLKERMGQLRSESSASETEGLARDLKRQKNLDFKPGKEPGAPLPKIDMCPTGRICSFCQSSKISEATGPMLHYANGNLVTGDAAMKPNVIPVHRICIDWAPQVYFVGEVVKNLKAEVARGAKLKCSKCNLKGAALGCYVKSCRRTYHVPCAMDISDCRWDHEDFLLLCPVHSNVKFPCEKIRSKKKATQKHPTFSHLPSHHSNRLEASQDASKKLVFCGSALSNEEKVFLINYASKVGATVTKFWTSNVTHVIAATDAHGACSRTLKVLMAILNGRWVLKMDCKLFKDPQWGPGTRGWGCVVGGIKACMQEINPVEEEPYEINLDNQGCQGGPKAGRLRALANEPKLFSGLKFYFSGDYVSTYKEDLEELIEVGGGTVLRIKEELEAHRHECKGDSSKLLVVYNLDPPQGCKLGEEVSILWQRLNDAEDLAANTLQVIGHTWILESIAACAWMYLTLPWHSLSIETLKCQKLFDSVQLNFSVSEKTEFRLQLKMLHTG

SEQ ID NO: 143224 - protein, 615 aa, Glycine max
  Coding DNA Sequence Number=SeqID_26446
  Gene Ontology: Mol. function=transporter activity; Cellular component= membrane; Biological process=oligopeptide transport
  Homolog annotation: Hit_ID=Q9FWL0; Match level="QueryCoverage=94%, HitCoverage=95%, E-value=0.0, Identity=57%"; Hit description =Putative peptide transport protein
  Pfam annotation: Domain name=MFS_1; Domain location=43-531; Score= -2.5; E_value=0.00041; Accession=PF07690.6; Description=Major Facilitator Superfamily
  Pfam annotation: Domain name=PTR2; Domain location=105-515; Score =415.1; E_value=9.8e-122; Accession=PF00854.12; Description=POT family
  Pfam module annotation: Pfam domain module=MFS_1::PTR2; Domain location=43-531::105-515
MAVIEEKGPSSGNEDYTQDGTVDLKGRPVLRSKTGKWKACSFIVGYEVFERMAFYGIQSNLVIYLTNKLHEGTVTASNNVSNWVGAVWMMPLAGAYIADAHLGRYKTFVIASCIYILFSPFEDEYYEVGMCLLTLAVSLPALRPSPCDQGQNCPRASSLQYGIFFLALYIVAIGTGGTKPNISTMGADQFDEFEPKERSHKLSFFNWWFFSIFFGTLFSNTFLVYLQDNKGWAIGYGLPTLGLVISVVVFLVGTPFYRHKLPSGSPVTRMLQVYVAAGSNWKLHVPDDPKELHELSIEEYASNGRNRIDRSSSLSFLDKAAIKTGQTSPWMLCTVTQVEETKQMTKLIPLLLTTIIPSTLVVQASTLFVKQGTTLDRSMGPHFQIPPACLNAFVTISMLITIVVYDRAFVPAIRRYTKNPRGITMLQRLGIGLVMHVFIMIIACFAERRRLKVARENHLFGLHDTIPLTIFILLPQYALGGVADNFVEVAKIEIFYDQAPDGMKSLGTAYFTTTLGIGSFLSSFLLSTVADVTKRHGHNGWILNNLNVSRLDYYYAFMAVLSFLNFLCFLVVAKFFVYNVDVTQTKSGSEINPSSSQEQDNTGISPSIPQPDGKS

SEQ ID NO: 143225 - protein, 192 aa, Glycine max
  Coding DNA Sequence Number=SeqID_26447
MGEIEEGQERRKADMQAMKEKMATMMEAMMSIKRIMEVNAAAVAATSAIVEVDPTPPSSLNQINHLTSDVVGQEGKELGSIGDPHFVQVQNTHAFPPYGLPPNYTTPNVAHTPNENVNNSTTILVESRQPQSNHAHVSQPMGETHEIPHHNLADFEPCIGCATEGQAIGGVPLSNTLEGPRFCPQPQPFYFA

SEQ ID NO: 143226 - protein, 126 aa, Glycine max
  Coding DNA Sequence Number=SeqID_26448
MGRVNLGLNVRMVVMTCGKAWAEQMRKMSDKGLVGSNLRKIGCGQDGFRNLPNCSAKSCQICAAEFLFLCRKCLCIADYGKDFSASALFSWFRVVHDSWNWIAGILWKLGGVDGDPVLRGMRIRAT

SEQ ID NO: 143227 - protein, 295 aa, Glycine max
  Coding DNA Sequence Number=SeqID_26449
  Homolog annotation: Hit_ID=Q2XEI2; Match level="QueryCoverage=18%, HitCoverage=12%, E-value=1e-25, Identity=100%"; Hit description =Aminotransferase, class III
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLNSIGFGRTGEWFGTDYYDLKPDLMTIAKGLTSGYIPMGGVIVRDEVAKVISEGGDFNHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143228 - protein, 49 aa, Glycine max
  Coding DNA Sequence Number=SeqID_26450
VADITTAQLSKIQPQLKDDQLSKTKLDSLKISSKGSSDDDIVGSDDDIV

SEQ ID NO: 143229 - protein, 56 aa, Glycine max
  Coding DNA Sequence Number=SeqID_26451
MFILTPIAINSHLTSKRAHVSFLASSKSKESLAKNLKEVLQMLQQEEEEESSKEGS

SEQ ID NO: 143230 - protein, 323 aa, Glycine max
  Coding DNA Sequence Number=SeqID_26452
  Gene Ontology: Mol. function=RNA-directed DNA polymerase activity; Cellular component=intracellular; Biological process=RNA-dependent DNA replication
  Pfam annotation: Domain name=rve; Domain location=33-189; Score=91.1; E_value=3.5e-24; Accession=PF00665.16; Description=Integrase core domain
MENDCCLHVRKCHKCQTFADNVNAPPIPLNIMATPWPFSIWGINVIGAIEPRASNGHRFISVAIDYFTKWVEAASYSSVTRNLVIRFIKKEIICRYGLSGKIIMDNAINLNNKMMMEMCGDFKIQHHNSTPYKPKMNGAVEAANKNIKKIIQKMIVSYKDWHEMLPFALHGYRTSVRTSTGATPFSLVYEMEVILPFEVEILSLRILAESNLKESEWAQARFDQLNLIEGKRLTTMSHGHLYQRWVKNAFNKKVHPHKFNEGDLVLKKVSQALKDNRGKWAPNYEGPFMVRKAFSRGALVLANMDDIELLSPVNANVVKRYYA

SEQ ID NO: 143231 - protein, 72 aa, Glycine max
  Coding DNA Sequence Number=SeqID_26453
  Homolog annotation: Hit_ID=Q9FLU4; Match level="QueryCoverage=75%, HitCoverage=22%, E-value=4e-09, Identity=45%"; Hit description =Arabidopsis thaliana genomic DNA, chromosome 5, TAC clone:K18P6
MEWRKYYLDVVLVPLGFLITIGYHVWLWHKVRTQPSSTIIGINTHGRRSWVPAMLKASLNMMELIIIPNSTT

SEQ ID NO: 143232 - protein, 32 aa, Glycine max
  Coding DNA Sequence Number=SeqID_26454
MDHGDPFRQLDHPRHRPLYKSSKLYANVEVEN

SEQ ID NO: 143233 - protein, 409 aa, Glycine max
  Coding DNA Sequence Number=SeqID_26455
  Homolog annotation: Hit_ID=Q8KL07; Match level="QueryCoverage=75%, HitCoverage=64%, E-value=4e-14, Identity=34%"; Hit description =Hypothetical conserved protein
MRLAGRLRVRAAGSRSAGLAGASRYEGGRTRIPAARAGAPLAGGTGRHGATRHRLARARALRRPVARAAAGGGCACPALRIATAGALVGPALGLAGRGRRADRRRGLRALFGQNRRARSGGGAGVPAAGRGAGPACRWQDRAVRPAARHAYRRFLPSVGAARLRPGRFVAARRAVCAALPGPGGVDRAAGKTAGGGRRGRHRHHRRAGADRRGTVCALRPGVARRAGLVEQVRTRNLIGVIPGATDEWIVINSHTDGTNGIEDNGPNAIVDMAGYLSRLPRSSLPRGVMIMLSSGHFAGGAGVQDFLARHQGDALASRIAAVVTIEHLGAMEWLPDATGKLAPTGKFEPVGVFMPPIPALVDAAEAMVRQADAGPAFIMPPLNPQGGWRPEQRCLVRRRAVLSGGAAGY

SEQ ID NO: 143234 - protein, 82 aa, Glycine max
  Coding DNA Sequence Number=SeqID_26456
MVGFAPFPPRGFNSTNAEALQKVRKAWEMVQKKNKELRGSNNGAIGGHRRWLKAHMHGLDWLPSLRTTKGVEVEAPKEDEEM

SEQ ID NO: 143235 - protein, 36 aa, Glycine max
  Coding DNA Sequence Number=SeqID_26457
MTKNKRNQGEPPQTWRGSKKLLGISEDDRQKVIPTM

SEQ ID NO: 143236 - protein, 315 aa, Glycine max
  Coding DNA Sequence Number=SeqID_26458
  Gene Ontology: Mol. function=receptor activity; Cellular component =mitochondrion
  Homolog annotation: Hit_ID=Q5Z9P3; Match level="QueryCoverage=89%, HitCoverage=43%, E-value=7e-46, Identity=40%"; Hit description =Receptor-like protein kinase-like
  Pfam annotation: Domain name=DUF668; Domain location=33-118; Score =150.2; E_value=5.4e-42; Accession=PF05003.3; Description=Protein of unknown function (DUF668)
MSCIDLYENLRFVCYLSCRSLAAATKHSDGPERLGEAGLALHYANIISQINMIASRPTALPPNTRDTLYHGLPNNIKAALPSQLQTVADMKELSITQIKAEMEKILQWLAPLATNTVKLKLPAIAYAFVFSFNIPDRAHQGFGWVGEWANTSNDSGDNTSKENNLIRLQTLYYADKRKIDVYIIELLAWLHHLISSVKSRQNTLRPMPTRSPPKGHELQSKMRQLLILSVDSSNKPLGTQISHEDRRLLEDVIARKKNPGLSKSEDLGLAKKRQVKHLQVTKSAGSSPAKEFFGTRLVFNHQNYNVLDIMDGLGY

SEQ ID NO: 143237 - protein, 172 aa, Glycine max
  Coding DNA Sequence Number=SeqID_26459
  Pfam annotation: Domain name=Transposase_23; Domain location=59-129; Score=-7.1; E_value=0.0068; Accession=PF03017.5; Description =TNP1ENSPM transposase
MARTKKTGQMTSEEAKKIADKILQSQGLTLSPKPEVGPSSARVSTKESCVDLSGNDLDRVDFEKCGLYIEENPSRLVALRRLYERSTTVHNIPLRNDQVKVGVEEVRDADVPIPVPTQKVQLVGQTLNTFVGWLTHLVKGLLEQRAVGLAKHVDRSDHDVDDPLYLMTLTIS

SEQ ID NO: 143238 - protein, 56 aa, Glycine max
  Coding DNA Sequence Number=SeqID_26460
MSRNLMDYATVPSLASEILRIFTDCALTLPFDSRHVAEFHGLPNDGYQVPRSGQVK

SEQ ID NO: 143239 - protein, 178 aa, Glycine max
  Coding DNA Sequence Number=SeqID_26461
RDSKVSMTDLVSAEDDGAEDDGSLCVLLGFSSYRQQKVCTDNHSGISARQRDSKVNMTDLVSAEDDQKVYTDNHSGISARQRDSKVSMTDLVSAEDDGAEDDVSLCVLSGFSSYRQQKVYTDNHSGISARQRDSKVRVTDLVSAEDDQKVYTDNHSDISARQRDSKVSITDLVSAEDD

SEQ ID NO: 143240 - protein, 71 aa, Glycine max
  Coding DNA Sequence Number=SeqID_26462
MELSNILSGFPIQFYELKQSETKGQVRVQGHMPQLSKKNNFLSVHNITPKKTFFFGQGFVKQKAKWKFSSI

SEQ ID NO: 143241 - protein, 115 aa, Glycine max
  Coding DNA Sequence Number=SeqID_26463
MAWHIFANRHRKFVKGGPPRRRHKTQWRVYMAEFQPSAINNTTYSCVKAVLSMADGKLWQPAENPPYVKRTEVKGKNVEGWLSQRETRASLRELETGRHRRSSSPEIPIISYDHR

SEQ ID NO: 143242 - protein, 320 aa, Glycine max
  Coding DNA Sequence Number=SeqID_26464
  Homolog annotation: Hit_ID=Q10E61; Match level="QueryCoverage=22%, HitCoverage=15%, E-value=3e-12, Identity=56%"; Hit description =Expressed protein
MEKSVKSLYRSYDDTNNCLLVLFKHLQEKLLLTESKLKESQYQLTPWRSDMNHANVATQSQPHSIGAPLTTSNKNGLELVPQHMYSQVKPQVSVDAQAGTEPDLLGRHQNGLSGGVATSVDADDLGRFSPLASRYSSAPDASTHLVVTQGDNHPAHYGDEMTNKQVTFRDPMINNEVDDPDGDGTHSTRETSTNWSSGNPPYTTTVDDPSSSYSPYLPPVLEEPSSSFSEAADEDPLPAIEGLQISGEAFPGRELQACGYSINGTTSCNFEGQSNQPTLSTPMMLVHYLPLKSNLWITGSARYFFPLAMMAVLHMYAKNE

SEQ ID NO: 143243 - protein, 137 aa, Glycine max
  Coding DNA Sequence Number=SeqID_26465
MENGHDGKLADKFSGLNINQHAQQHVHDQSNLSSNNNDNLYQVMKAVEAAEATIKQQVVLWIQHVLRYNGHGSSPFLLPWEIADKCGRCCHSCGCVNALSCSGSFMLVEENSRLRSELLSKIQELEKYVGIANWNLF

SEQ ID NO: 143244 - protein, 416 aa, Glycine max
  Coding DNA Sequence Number=SeqID_26466
  Gene Ontology: Mol. function=unfolded protein binding; Cellular component=cytoskeleton; Biological process=cellular protein metabolic process
  Homolog annotation: Hit_ID=Q6K3R8; Match level="QueryCoverage=97%, HitCoverage=72%, E-value=0.0, Identity=84%"; Hit description =Putative chaperonin containing TCP1, subunit 3
  Pfam annotation: Domain name=Cpn60_TCP1; Domain location=2-386; Score= 207.6; E_value=2.9e-59; Accession=PF00118.14; Description=TCP-1cpn60 chaperonin family
MNKTAGGTMLGIVKSCIGTKFTSQFGDLVADLAIDATTTVDIDLGLGLRDVDIKNYIKVEKVPGGQLEDSRVLKGVMINKDVVAPGKMKRKIVNPRIILLDCPLEYKKGENQTNAEMLKEEDWSLLLRMEEEYIEELCMQILKFKPDLVITEKGLNDLACHFLSKHGVSAIRRLRKTDNNRIAKACGAVIVNRPDELQESDVGTGAGLFEVKKIGDEFFAFIVECKDPKACTVLLRGASKDLLNEVERNLQDAMSVARNIIKNSKLVPGGGATELTISATLKQKSSSVQGIQKWPYEAAAIAFEAIPRTLAQNCGVNVIRTMTALQGKHANGENAWMGINGNTGDITDMKECKIWDAYNVKAQTFKTAIEAACMLLRIDDVVSGIKKRQAPGAGQARSKPKVETEVDADSEQILPD

SEQ ID NO: 143245 - protein, 108 aa, Glycine max
  Coding DNA Sequence Number=SeqID_26467
  Gene Ontology: Mol. function=unfolded protein binding; Cellular component=cytoskeleton; Biological process=cellular protein metabolic process
  Homolog annotation: Hit_ID=Q6K3R8; Match level="QueryCoverage=66%, HitCoverage=12%, E-value=1e-28, Identity=83%"; Hit description =Putative chaperonin containing TCP1, subunit 3
MAFFLCIDFLRFNCCLSMIELSRTQDEEVGDGTTSVIILAGEMLHVAEALIDKNYHPTVICRAYDKALEDAIAVLDKIAMPVDANDQIYNELSLFNNILCWFVAKVSK

SEQ ID NO: 143246 - protein, 55 aa, Glycine max
  Coding DNA Sequence Number=SeqID_26468
MGPFCYDRALDSAIGNYENLEGENGIPAGTKQGSGAFLGCELGTKARPTGQALGP

SEQ ID NO: 143247 - protein, 319 aa, Glycine max
  Coding DNA Sequence Number=SeqID_26469
MRAPTILRSLPMRQLQPRAPAVVSPLPEKSRFDWELTAELDTLRSQGELGLAQLLDAAITTQKIASDSLVNVSYKDYADRGAVDKYLEDNVEMLDACNYLMDKMDHINKYVDSLRVVVHLVDKGGGAAKPITRALELLESCQSMEKRCKSMENFYRGSCLKKMLRQKLCHETELSEVMCGSKAMALLCCRFLELGLSFDPKRGLPLMKFSQHMMSSSWLRLLQELVNQAEKKKVQRRRCWSSLLMQTVAAARELKEQMKGKREKEMKYSVERLKICCRELEHGVEIVEERVKILYKSLIDFRMTLLGILSQPTTVFRSD

SEQ ID NO: 143248 - protein, 96 aa, Glycine max
  Coding DNA Sequence Number=SeqID_26470
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=58%, HitCoverage=25%, E-value=5e-16, Identity=59%"; Hit description =Protein ULTRAPETALA2
MMLPLPLYFNGCKMNWVKKNDKEKSRCMYNLSVQILGLLITCDDDEERSSLKASRGCSRSSTCQGCSTCYCEGCIKCRFEDCNCQECRDFMLYAKP

SEQ ID NO: 143249 - protein, 258 aa, Glycine max
  Coding DNA Sequence Number=SeqID_26471
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=8e-44, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLNALAFRGIRVLAFRGLHTLAFRGLHVLAFRGLHVLAFRGLHVFIFRGLHVLSFRGLHVLAIRGLHVLALRGLHVLAFRGLHVLAFRGLHVLVFRGLHTLAFRGLHALAFRVLHVLAFKGLHALAFKGLHILAFRGLHALAFRGLHILAFRGLHALAFKGLHALAFRGLHVLTFRGLHAFAFRGPHVLAFRGLHALTFRGLHVLAFRELHALTFRGLHALTFKGLHILAFRGLHVLTFRGLCSRPTSAPDRTSSIKQ

SEQ ID NO: 143250 - protein, 282 aa, Glycine max
  Coding DNA Sequence Number=SeqID_26472
  Pfam annotation: Domain name=Transposase_23; Domain location=80-147; Score=-10.5; E_value=0.016; Accession=PF03017.5; Description =TNP1ENSPM transposase
MEDKKKKRLEEAAQSRSIDTVIDPTSPIRQQMKRKMTLTKKHGQMTFEATKEIADRIDSLEEQASQGSFFSHGGPRHCESEKYELYVDENPPRLVALGRLYEGSTTVYNIPLGNDQVKVGVKEVRDADTHILVPTQEVQLVGQTLNTFLAWPTHLVKCLSEHGAEVPTQPVDRLDPDVDPLYLMTLIIPQLFLKPLQVSWDVTVFGMYNDNFPLYIKHEDLSKIEHGGQYLSISVIQLWILNMTETSMRVGNVDVYGFLEPQPIQRFGQLQFESKTYIKNWM

SEQ ID NO: 143251 - protein, 303 aa, Glycine max
  Coding DNA Sequence Number=SeqID_26473
  Homolog annotation: Hit_ID=Q01AC6; Match level="QueryCoverage=88%, HitCoverage=75%, E-value=5e-40, Identity=33%"; Hit description=[S] KOG4843 Uncharacterized conserved protein
MATFITVMPTAPNTLLKLIYLQLNNYFIGILYIHLSSYIKCILLKLHLDNLMMVIMYVISGYISTLRNNVRSRAWGAAIGCSYRVERCCIVKKGGGTIDLEPCLTHTSTIEPTLAPVTVERTMTTRAAASNALRQQRFVREVTIQYNLCNEPWIKYSISTVADKGLKKPLYTSARLKKGEVLYLETHLSRYELCFTGEKMLKVTPAAPLHDPATEKSQNHHPHSANGEKNDCENVMIDAFRWSRCKKPLPQKLMRTIGIPLPLEHIEVLEENLDWEDVQWSQAGVWIAGKEYTLARVHFLSMN

SEQ ID NO: 143252 - protein, 95 aa, Glycine max
  Coding DNA Sequence Number=SeqID_26474
  Gene Ontology: Mol. function=aminoacyl-tRNA ligase activity; Cellular component=cytoplasm; Biological process=tRNA aminoacylation for protein translation
  Homolog annotation: Hit_ID=Q45NM7; Match level="QueryCoverage=54%, HitCoverage=29%, E-value=2e-17, Identity=86%"; Hit description =Histidyl-tRNA synthetase
MVGSIATGGRYDNLIEMFGSKKFTAVGVSLGIERVFEIMEQRQKDQNQMARPTKAYNLKHFEYENKSRIPWMVLGEREVKVQLKHLEGSNTCKHS

SEQ ID NO: 143253 - protein, 622 aa, Glycine max
  Coding DNA Sequence Number=SeqID_26475
  Gene Ontology: Mol. function=nucleic acid binding
  Homolog annotation: Hit_ID=A0E4N3; Match level="QueryCoverage=82%, HitCoverage=54%, E-value=4e-09, Identity=21%"; Hit description =Chromosome undetermined scaffold_78, whole genome shotgun sequence
  Pfam annotation: Domain name=MAP7; Domain location=267-441; Score= -78.6; E_value=0.046; Accession=PF05672.2; Description=MAP7 (E-MAP -115) family
MSGAPKRSHEESVHSSSKHSNEDSGTYSKLVSLPVSNEYHMPYDISQDSRVAKVPRTEFRDADRRSPLNPVYRMSSPLNDSRADNPIGPENRIESRDSKDSRDPRFENRDTKTEKELYGEARRDPPNAKSEKDMRVEGRGDDNKDVWHDRDSHNDPKGDTKTEKDGYNVASSHLNWKDSKEYHRGKRYSDAPGGSLDTWHMLRGNTQGSVEVGKESSAAGERDYVEAHEAVSENKVDPKGDDRSKEKDRKRKDVKHREWGDREKERSDRRNSPQVSNSTGDCKESTKEDRDVERLEREKKDLPEEKENIKEREKDQMKRESWNGMEKEVSINEKEPVDASAKLPEQEPVLPEQKKQKEVDSWKNVDREAREKRKERDADLEGDRSDKHSKCLDKESNDGCADGEGMMEKEREVYNYSSQHRKRIQRSRGSPQVPNREPRFRSRAQDNDGSQGMLSFYFTGLIECKVEVSSVVYKVGESMQELIKLWKEYESSQSQMEKNGESSNNGPTLEIRIPSEHITATNRQDALRHQYPYSANYLVPLDLFKSSASSIVPPPSYTSVLQHVFYIEQLKENQEGIDYLFFNLILGSRYEGKPWHNGKGVGSNPDTNRSVCGDKATYIYPP

SEQ ID NO: 143254 - protein, 115 aa, Glycine max
  Coding DNA Sequence Number=SeqID_26476
  Gene Ontology: Cellular component=nucleus
  Homolog annotation: Hit_ID=Q8L4K4; Match level="QueryCoverage=94%, HitCoverage=22%, E-value=1e-24, Identity=53%"; Hit description=SET domain-containing protein-like
MASRRLRAFKRWMKSKGLEWSDALEFVDTPEEGVEVRALCQLKEGDVVAKMPKEACLTTKTSGARKIIEEAGLDGHLGLAFAIMYERSLDGDSPFAGYLQLLPHQECVPIVWTLG

SEQ ID NO: 143255 - protein, 211 aa, Glycine max
  Coding DNA Sequence Number=SeqID_26477
  Gene Ontology: Mol. function=oxidoreductase activity, acting on single donors with incorporation of molecular oxygen, incorporation of two atoms of oxygen; Biological process=aromatic compound metabolic process
  Homolog annotation: Hit_ID=Q1SMG9; Match level="QueryCoverage=99%, HitCoverage=100%, E-value=7e-66, Identity=51%"; Hit description =Extradiol ring-cleavage dioxygenase, class III enzyme, subunit B
  Pfam annotation: Domain name=LigB; Domain location=5-207; Score =100.3; E_value=5.7e-27; Accession=PF02900.8; Description=Catalytic LigB subunit of aromatic ring-opening dioxygenase
MALKDTFFISHGSSTISIDDSIPAWEFLTSWKEVLPQRFSSILVISGHWDTDVPTVNVVDHNKTIYDYYGFPKVMYKCASSQFHHRDGTYHYNLGKVLAPLKDQDVLIIRSGSALHNLRAIGPRNSPTAPWALAFDSWLKNSLIEGRYEEVNKFDEKAPYAKLAHPWPDHFFPLHVAMGAAGENSKAKIVHHSWDAGSISCASFGFTAATS

SEQ ID NO: 143256 - protein, 200 aa, Glycine max
  Coding DNA Sequence Number=SeqID_26478
  Gene Ontology: Mol. function=DNA binding; Cellular component=nucleus; Biological process=regulation of transcription
  Homolog annotation: Hit_ID=Q6YXH5; Match level="QueryCoverage=89%, HitCoverage=80%, E-value=5e-46, Identity=45%"; Hit description =Putative ZF-HD homeobox protein
  Pfam annotation: Domain name=Homeobox; Domain location=134-194; Score= -8.3; E_value=0.037; Accession=PF00046.19; Description=Homeobox domain
  Pfam annotation: Domain name=ZF-HD_dimer; Domain location=15-74; Score=135.4; E_value=1.6e-37; Accession=PF04770.3; Description=ZF-HD protein dimerisation region
  Pfam module annotation: Pfam domain module=Homeobox::ZF-HD_dimer; Domain location=134-194::15-74
MESSNFHADKMEDKKIIIRYKECLKNHAAAIGGNATDGCGEFMAAGEEGTLEALKCSACNCHRNFHRKEIESSDSNAIPLMIIPDTTQIIRPILAHLSPNKSGSISPSDLSDEKENEDGMMIKEVENPNEKVKKRFRTKFTQEQKEKMLAFAERAGWRIQKLDESLVQKFCQEIGIKRRVLKVWMHNNKNTFAKRNPSTS

SEQ ID NO: 143257 - protein, 395 aa, Glycine max
  Coding DNA Sequence Number=SeqID_26479
  Gene Ontology: Mol. function=identical protein binding; Cellular component=nucleus; Biological process=phospholipid metabolic process
  Homolog annotation: Hit_ID=Q8L4K4; Match level="QueryCoverage=93%, HitCoverage=73%, E-value=7e-82, Identity=46%"; Hit description=SET domain-containing protein-like
MCSTFHEHFLISYNFRQTVQEDKALIYDDWKENILPLLDLAPLKLNPKFFGVEQYFAAKSLISSRSFEIDDYHGFGMVPLADLFNHKTGAEDVHFTAMSSNDESDTDVDGCNDDEGIVKEETLAQNSSIDMTVLNNGNCNVSDSDSSSVSDGDTSMLEMIMIKDVSSGTEVFNTYGLLGNAALLHRYGFTEQDNSYDIVNIDMELVLQWCTSVFSDRHSRARVSLWRKLGYSACGSQNSEYFEISFDGEPQIELLVLLHIMLLPDNAYHKLDLSVAGNCDESSGTTFLNGNIFPSKAFNMSKKSLLPKKVCDVLSSLADMRESLYGLKSIEDDIEALGRCSLVRERKLYHSLMLRINERKILQRLRNYASQPFKNKITNHSSPRKKLKRTTKKTS

SEQ ID NO: 143258 - protein, 327 aa, Glycine max
  Coding DNA Sequence Number=SeqID_26480
  Gene Ontology: Mol. function=oxidoreductase activity; Cellular component=vacuole; Biological process=response to oxidative stress
  Homolog annotation: Hit_ID=Q9SZB9; Match level="QueryCoverage=96%, HitCoverage=100%, E-value=1e-116, Identity=66%"; Hit description =Peroxidase 47 precursor
  Pfam annotation: Domain name=peroxidase; Domain location=55-291; Score=427.0; E_value=2.6e-125; Accession=PF00141.13; Description =Peroxidase
MLYKSSVRPLKVVMANLLTVFLLIEVFAYGYSYGQYGLNTNYYLMSSCPFVEPVVKNIVNRALQDDPTLAAGLIRMHFHDCFIEGCDGSVLIDSTKDNTAEKDSPGNLSLRGFEVIDAIKEELERQCPGVVSCADILAMAARDAVFFAGGPVYDIPKGRKDGRRSKIEDTINLPFPTFNASELIKSFGQRGFSAQEMVALSGAHTLGVARCASFKNRLKQVDPTLDAQFAKTLARTCSSGDNAPQPFDATSNDFDNVYFNALLRRNGVLTSDQTLYNSPRTRNFVNAYAFNQAMFFFDFQQAMVKMGLLDVKDNSNGEVRENCRKIN

SEQ ID NO: 143259 - protein, 68 aa, Glycine max
  Coding DNA Sequence Number=SeqID_26481
MEAETGAWGEISKEKVFGKRKRGEKKYSFWAIARKQTLFWKIGREREFQGSEILAVKTDFTAIIGHAY

SEQ ID NO: 143260 - protein, 707 aa, Glycine max
  Coding DNA Sequence Number=SeqID_26482
  Gene Ontology: Mol. function=zinc ion binding
  Homolog annotation: Hit_ID=Q8LJG8; Match level="QueryCoverage=95%, HitCoverage=96%, E-value=1e-177, Identity=49%"; Hit description =Putative male sterility 1 protein
  Pfam annotation: Domain name=PHD; Domain location=624-672; Score =38.0; E_value=3.3e-08; Accession=PF00628.19; Description=PHD-finger
MVVSGGKGLKRAAKKRVTADFYDFLTFPTPALAESENFAGGPFRSNVRAFLTKHALLPPPSALFPHLLTWQIVFRVGELTEGPDAPAVCLDVVEEDVARSRSVYCDQCRVFGWSGHPVCGKRYHFIIKADGSSIGGYHKPCMCCGDILHLSESKCKSCNHVTTTDDVEDWVYHQLENTTHLLHGVVHANGYGHLLRVNGREGGSRFLSGIHIMDFWDRLCKTLGVRKVSVMDVSKKYGIEYRMLHAIMKGHPWYGDWGYKFGSGSYCLTHEAYKSAVESLSNLPLSTFSHGRMPNSRVEDMIKYYQSLSEHELVNIRDLFCFIMGLIGDAHKTASNVDETTCKKRCFNASGLSMSWDKSGIERVEQAMIRVLCAVSESKWVSWRALRGAASKLGSPELLDYCLGELGGKMVYGGMVVNSQCNPQTGVYEFRLEAATGACYGILAKNNSLGSKYPSEENLLQCLRYLYDSLLHPQMMVNYEAGTRTLAMNSAQKLFDCKQFVKDYNPEMWPLSDSQMFRLSCHVELVDEFEDSEAITPPELVVLPLNATVAELKNQAANAFQDVYLRFRRLQVDGLHGYSGVDDSTQVKLLLGSRDVVCVRGRCIGKNGLSKFRMERGLERWTVDCSCGAKDDDGERMLACDICGVWRHTRCSDIHDTDPVPARFVCLKCQNCESKLKCSGHCKDETVTNVSGSSCFRNGLPVPSDVI

SEQ ID NO: 143261 - protein, 335 aa, Glycine max
  Coding DNA Sequence Number=SeqID_26483
  Gene Ontology: Mol. function=nucleoside-triphosphatase activity; Cellular component=intracellular; Biological process=protein transport
  Homolog annotation: Hit_ID=Q1T499; Match level="QueryCoverage=68%, HitCoverage=36%, E-value=1e-66, Identity=59%"; Hit description=ClpX, ATPase regulatory subunit
  Pfam annotation: Domain name=AAA; Domain location=161-321; Score= -28.0; E_value=0.028; Accession=PF00004.19; Description=ATPase family associated with various cellular activities (AAA)
  Pfam annotation: Domain name=AAA_2; Domain location=157-304; Score =56.8; E_value=7.2e-14; Accession=PF07724.4; Description=ATPase family associated with various
  Pfam annotation: Domain name=ABC_tran; Domain location=159-330; Score= -62.5; E_value=0.058; Accession=PF00005.17; Description=ABC transporter
  Pfam annotation: Domain name=DUF1805; Domain location=198-272; Score=- 20.5; E_value=0.0037; Accession=PF08827.1; Description=Domain of unknown function (DUF1805)
  Pfam module annotation: Pfam domain module=AAA::AAA_2::ABC _tran::DUF1805; Domain location=161-321::157-304::159-330::198-272
  Subcellular localization annotation: CTP_CleavageSite=34; ConfidenceScore=5.14e-01
MSRIFSAWNKKKLHLHLNLIPTIFSSSHTHFDALAAANSGLLRPSLRLYSSSSSSSNGEPPEDWPHDHYAATQTPISVNFIRASGPRDGWVGGSNLGRDFPTPKEICKGLDKFVIGQHRAKKVLSVAVYNHYQRIYQGSEADEGLSQGLDDGDDVELEKSNVLLMGPTGSGKTLLAKTLARFVNVPFVIADATTLTQANNLHVDVWKLVIVLLKLLINCDKGLSMAAEFNVQAAQQGIVYIDEVDKITKKAESLNISRDVSGEGVQQALLKMLEGTVTNLSVMGGQLEKYTVAMINPVLLDPAVVSIAKEVFSDLGIISLSFRKWYLSGSCCFFM

SEQ ID NO: 143262 - protein, 407 aa, Glycine max
  Coding DNA Sequence Number=SeqID_26484
  Gene Ontology: Mol. function=hydrolase activity; Biological process =aromatic compound metabolic process
  Homolog annotation: Hit_ID=Q9FFW9; Match level="QueryCoverage=78%, HitCoverage=84%, E-value=1e-121, Identity=65%"; Hit description =Arabidopsis thaliana genomic DNA, chromosome 5, P1 clone:MBB18
  Pfam annotation: Domain name=Abhydrolase_1; Domain location=161-398; Score=64.6; E_value=3.1e-16; Accession=PF00561.10; Description =alphabeta hydrolase fold
  Pfam annotation: Domain name=Ndr; Domain location=89-404; Score= -113.4; E_value=0.031; Accession=PF03096.5; Description=Ndr family
  Pfam module annotation: Pfam domain module=Abhydrolase_1::Ndr; Domain location=161-398::89-404
MEVTSAVHLHSVGFLHLQTHVERLNGRAFFLSTRPRKVKVHLPCHHHHHLNHLSNTNGIGACSDRTSVILNSTSVTSTTSSAAGSLSEVEKIKQKCLTWQWKGQYSINYFVSSDSPQQLHGSHPPLLLVHGFGASIPHWRRYYLSLLITFIWNISTLAQNYTVYAIDLLGFGASDKPPGFQYTMETWAQLILDFLNEVVQKPTVLIGNSVGSLACVIAASDSSQTLVRGIVLLNCAGGMNNKAIVDDWRIKLLLPLLWLIDFLLKQKGIASAIFGRVKQRENLRNVLSSVYGNKESVDEELVEIIREPANAPGALDAFVSIVTGPPGPNPVLLMPKISLPVLLLWGDNDPFTPIDGPVGKYFSSLPSQKENVKLFLLEGVGHCPHDDRPDLVHEKLLPWLASISNSE

SEQ ID NO: 143263 - protein, 212 aa, Glycine max
  Coding DNA Sequence Number=SeqID_26485
  Gene Ontology: Mol. function=peptide deformylase activity; Cellular component=endoplasmic reticulum; Biological process=response to oxidative stress
  Homolog annotation: Hit_ID=P30236; Match level="QueryCoverage=78%, HitCoverage=86%, E-value=2e-87, Identity=94%"; Hit description=22.0 kDa class IV heat shock protein precursor
  Pfam annotation: Domain name=CS; Domain location=67-159; Score=14.3; E_value=0.00087; Accession=PF04969.6; Description=CS domain
  Pfam annotation: Domain name=HSP20; Domain location=70-174; Score =175.2; E_value=1.6e-49; Accession=PF00011.11; Description=Hsp20alpha crystallin family
  Pfam module annotation: Pfam domain module=CS::HSP20; Domain location= 67-159::70-174
MRLQQLNLFFLLLCVAKANGSLLPFMDPPITLLADLWSDRFPDPFRVLEHIPFGVDKDEASMAMSPARVDWKETPEGHVIMLDVPGLKREEIKVEVEENRVLRVSGERKKEEEKKGDHWHRVERSYGKFWRQFRLPQNVDLDSVKAKLENGVLTLTLDKLSPGKIKGPRVVSIAGEDHQQVLFSYGAKGQNPELTSSHHVSAISQYKTWQKK

SEQ ID NO: 143264 - protein, 1033 aa, Glycine max
  Coding DNA Sequence Number=SeqID_26486
  Gene Ontology: Mol. function=DNA binding; Cellular component=oxygen evolving complex; Biological process=DNA integration
  Homolog annotation: Hit_ID=Q1S1E0; Match level="QueryCoverage=98%, HitCoverage=98%, E-value=0.0, Identity=36%"; Hit description =Integrase, catalytic region
  Pfam annotation: Domain name=zf-CCHC; Domain location=149-166; Score =3.9; E_value=0.22; Accession=PF00098.13; Description=Zinc knuckle
  Pfam annotation: Domain name=zf-CCHC; Domain location=187-204; Score =13.9; E_value=0.005; Accession=PF00098.13; Description=Zinc knuckle
  Pfam module annotation: Pfam domain module=RVT_2::zf-CCHC::zf-CCHC; Domain location=601-788::149-166::187-204
MNELTPNTESYLYLHPSENPAVALVSPTLDSSSYHSWSRSMVTALSAKNKVEFINGNAPEPLKTDRTYGAWSRCNNMVEASSMKQGTLSVTEYFTKLRIIWDEIENFKPDPTCSCTIKSQQERQLSSTNPLPNFNLESKENASINAVKIVYEFCGRIGHTESVCYKKHDVPSSYEGRSKSYNTRNGKTCTHCGKVGHTIDVCYKKHGFPPGYKFGNGKVIENNIVAVEGKATSDQMQRHESQDLVRFSLEQYQALLALIQQPSSGSSASTQSLVASISSCSNNTLPGTLLSFETADSISWILDSGATDHVSSSLTNFHSYHQVSPIMVKLPNGHHVHATHSGTVHLTPSIILNDDTNTKAKIGTVEGIIHQTTCVETPEQNGIVEPYLINCIPTPFLNNKSPYEKLYAHPCDISNLRVFSCLCYMSTLKSHRQKLDPRAHPCIFIGFKPHTKGYLVYDLHSHSITTSRNIVFYEDHFPLFPDNQTLPTLHTSISPIPFSSNPDKFDSPIPPSVNPSSPHTTYPPLRRSTKPKQAPTYLQDYHRALTSQADITASNVQYPLHSVLSYSRLSRSHRQFVMSISVNTEPNSYAEASKFDCWIKAMQAEIQALQQNQTWTLTPLPPHKIAIGCRWVYKIKYKADGTVERYKARLVAKGYTQLEGLDFLDTFSPVAKLTTVRLLLALVALHNWHLKQLDVNNAFLHGDLDEEVYMTLPPGLVVPDSNLADHSLFLHFHNNDITIVLVYADDIILAVARTSQGIHLSQHKYVLDILSDSGMLASRPASTPMDYSTRLTASMGTPLSETSSSSYQRLIGRLIYLTNTRPDITHDVQQLSQYMAHPTFAHSQATFRILRYLKGSPGSGIFLVAHGTLQLKAFSDSDWAGCRDTRRSITRFSVYFGPSFIPWRSKKQPTVSRSSYEAKYRALASTTCELQWLTYLLHDFRVSFIQPATLYCDNQSTIQIGSNPVFHERTKHIEIDCHIVRDKVNQGLLELLPISSHMQLADILMKPLSSSLFQGLCSKLGMMNIHSQLEGGS

SEQ ID NO: 143265 - protein, 224 aa, Glycine max
  Coding DNA Sequence Number=SeqID_26487
  Gene Ontology: Mol. function=nucleoside-triphosphatase activity
MGYLPFSRISSPERSSIAVSHSLYKSLQDLLSSYSYFEIPKFNDYCGVDLKDLYLNATNYSPVAACRRLTLPLAVAELHLLHRCVEPHRPRCLPRPLHHVDAPHGNCAGLARGEAQLHTPPHKAPPPCARLAIPHVRDLMRRGVRACLASEGSSPTTLLLLAAPNWVGFRPLPSPVPLQNPSPQAKNQDRERERKRQEKKFMSFVLPDKEKTRLCTHIPLRRFS

SEQ ID NO: 143266 - protein, 152 aa, Glycine max
  Coding DNA Sequence Number=SeqID_26488
MHIMVRTRGLGWALDKVIGRTLGREVSRDSNEAPHWRRPTASAHRQQEAAPVGKDVQHVDDAADEVHEQPEELVADEHLELKLLSHGRKVEKFGRPTPKIEGLVAAIVSQPTLRREGDARAQRCVFHGWKMRGVATNVYSRKMLEKLKRCGL

SEQ ID NO: 143267 - protein, 175 aa, Glycine max
  Coding DNA Sequence Number=SeqID_26489
  Homolog annotation: Hit_ID=Q1SXD5; Match level="QueryCoverage=70%, HitCoverage=85%, E-value=2e-17, Identity=41%"; Hit description=Cupin, RmlC-type
  Pfam annotation: Domain name=Cupin_3; Domain location=99-172; Score =76.7; E_value=7.5e-20; Accession=PF05899.3; Description=Protein of unknown function (DUF861)
  Subcellular localization annotation: CTP_CleavageSite=23; ConfidenceScore=5.68e-01
MASSFVGTLLPNHFTQTKHSAVPASRSGAPRRRRVHLATTRAETMTTVIEKLGIKIERNPPESKLTQLAVTVATATTATATDTGVLIWKGGSWTRWNELGKLGLRVAVSETVSLGFPWTYEAKETCYLLEGKVKVFPSGSNESVEIAAGDLVVFPKGMSCTWDVSVGVDKHYNFE

SEQ ID NO: 143268 - protein, 550 aa, Glycine max
  Coding DNA Sequence Number=SeqID_26490
  Gene Ontology: Mol. function=reticuline oxidase activity; Cellular component=membrane; Biological process=electron transport
  Homolog annotation: Hit_ID=Q84PV5; Match level="QueryCoverage=91%, HitCoverage=89%, E-value=1e-144, Identity=51%"; Hit description =Putative berberine bridge enzyme
  Pfam annotation: Domain name=BBE; Domain location=473-536; Score =100.5; E_value=4.9e-27; Accession=PF08031.2; Description=Berberine and berberine like
  Pfam annotation: Domain name=FAD_binding_4; Domain location=80-221; Score=126.8; E_value=6e-35; Accession=PF01565.13; Description=FAD binding domain
  Pfam module annotation: Pfam domain module=BBE::FAD_binding_4; Domain location=473-536::80-221
MFYFLKRLCLLCFLLLSFAVSLFSCASLRGLASCLDNHNIKNFTTFPYKEHDHSSAYSYFKILNFSIQNLRFAEPVIPKPIAIVLPESLEQLQKSVACCREGSMEIRVRCGGHSYEGTSYVADDGTPFVIIDMMNLNHVWVDMETETAWVEGGATLGETYYAISQESNEHGFSGGSCPTVGVGGHIGGGGFGLLSRKYGLAADNVVDALLVDANGKLFDRETMGEDVFWAIRGGGGGLWGIIYAWKIQVLKVPQVVTSFTVSRTGTKSHVANLVHKWQYVAPNLEDDFYLSCLVGAGLPQAKTTGLSTTFNGFYLGPRASATSILNQAFPELSIAEEECIEMSWIQSIVFFSGLSDGASVSDLKNRYLQEKEYFKAKSDYVKKNVPLVGIETALDILEKEPKGYVVLDPYGGMMHNISSESIAFPHRRGNLFTIQYLIYWKEADNDKSSDYVDWIRGFYAAMTPFVSWGPRAAYINYMDFDLGVMEGIGNGANMKDAVEHARVWGEKYFLSNYDRLVRAKTLIDPNNVFTNDQGIPPISLTSPYAKAQSK

SEQ ID NO: 143269 - protein, 410 aa, Glycine max
  Coding DNA Sequence Number=SeqID_26491
  Gene Ontology: Mol. function=nucleoside-triphosphatase activity; Cellular component=membrane; Biological process=proteolysis
  Homolog annotation: Hit_ID=Q31QL2; Match level="QueryCoverage=73%, HitCoverage=51%, E-value=1e-104, Identity=63%"; Hit description =Single-stranded nucleic acid binding R3H
  Pfam annotation: Domain name=AAA; Domain location=180-375; Score= -35.0; E_value=0.094; Accession=PF00004.19; Description=ATPase family associated with various cellular activities (AAA)
  Subcellular localization annotation: CTP_CleavageSite=31; ConfidenceScore=5.38e-01
MVVASCWCSSSSSWLPLSLPLHSNLKAASTSLSPKWKYHAFSEASSSSCSLVHNNQDDDLQALLQILPSDLHHNLLNQPNRPQLLEVILDLGRFPEARYLGKHGGHSLRNTEVTVKELEYAEQAVGEFGKDNRAGIEGTLHRISAIRSRNGHIVGLTCRVGRAVTGQIDMVYDLLQYGKSILFVGRPGVGKTTVMREIARVLSDELHKRVVIVDTSNEIGGDGNIPHAAIGGARRMQVPEPSMQHRVMIEAVENHMPEVIVVDEIGTEAEAHACRSIAERGIMLIGTAHGQQLENIIKNPTLSDLIGGIESVTLGDAEARARNSQKTILERKAPPTFDFLIEMRDRHYWLTHQTDKSVDMLLRGISPQVEKYRFAPGLFFSSLVSSPVRKRDEKCKVVIEKSKAYDKCQI

SEQ ID NO: 143270 - protein, 273 aa, Glycine max
  Coding DNA Sequence Number=SeqID_26492
  Gene Ontology: Mol. function=hydrolase activity
  Homolog annotation: Hit_ID=Q38ZY7; Match level="QueryCoverage=97%, HitCoverage=94%, E-value=2e-42, Identity=33%"; Hit description=Beta -lactamase-like
  Pfam annotation: Domain name=Lactamase_B; Domain location=45-217; Score=50.1; E_value=7.4e-12; Accession=PF00753.17; Description =Metallo-beta-lactamase superfamily
MTLHIGECSIDKVIEQTSSLPFAALFPAHRETMGDTLAQQPAEISIHSWVVRTARDTIVIDTATGNGRNRDNKPLFHQLQTAWPQRLAEAGVDPDEVTLVLMTHIHTDHVGWNTCWRAGRWQPMFRHARYICSARELAQCRSTPSMQALYHDSLAPLLASGQLETIDVQRSPLFAGVLRYMPTPGHSVDHASIVLQSAAAHAVFSGDVMHHPVQFAHPQWNSVFCEDLPRAVTSRQLLIDWCIRHQALWCSSHFAGSSCGRVSPERQWIPVET

SEQ ID NO: 143271 - protein, 132 aa, Glycine max
  Coding DNA Sequence Number=SeqID_26493
MAKRIKDGLFIKGKEGENHKELNWSTLKIVEQPPGLSASSIVSKSDSDPPSPRSTKLMALLAKQMDKLQRNVERGMGERFNDIQRSTQELSGRMEDIERRRHHRSPYSSQGSDDGYEEGRRHRHRRNMDGME

SEQ ID NO: 143272 - protein, 107 aa, Glycine max
  Coding DNA Sequence Number=SeqID_26494
  Gene Ontology: Mol. function=DNA-directed RNA polymerase activity; Biological process=transcription
  Homolog annotation: Hit_ID=P38420; Match level="QueryCoverage=83%, HitCoverage=7%, E-value=1e-28, Identity=71%"; Hit description=DNA -directed RNA polymerase II 135 kDa polypeptide
MDLKEFLASNRLARNWQITQEHVWTVISAYFEEKGFVCQQLDSFHHFIIQTIMQEIVDDSAYIEIRPKNQHNPAHKSDPVEAAYKFRFGKIYLSEPMMTESDGKTAR

SEQ ID NO: 143273 - protein, 65 aa, Glycine max
  Coding DNA Sequence Number=SeqID_26495
  Homolog annotation: Hit_ID=Q5NAM1; Match level="QueryCoverage=94%, HitCoverage=29%, E-value=6e-16, Identity=72%"; Hit description =Phosphoglycerate mutase-like
MVDILYEISGKLQKIVGRKCCCHLFRSIDINNGGICVFNFNVRGEAMLDALNTTAHMYSDHVYPG

SEQ ID NO: 143274 - protein, 957 aa, Glycine max
  Coding DNA Sequence Number=SeqID_26496
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9ZT82; Match level="QueryCoverage=94%, HitCoverage=50%, E-value=0.0, Identity=58%"; Hit description =Putative glucan synthase component
  Subcellular localization annotation: CTP_CleavageSite=30; ConfidenceScore=5.35e-01
MPSKTVWIATNRLTLNVVVSVTMNLTQRPVAQRGGASNLPRPPPPPLNSVFNIIPVHDLLTDHPSLRYPEVRAAAAALRTVGDLPKHQFMRWEPEMDLLDWLRLLFGFQLDNARNQREHLVLHLANSQMRLEPPPAIVDALDAGVLRRFRRKLLHNYTAWCSFLGLKSNVLLSRRRDPTDLRRELLYVSLYLLVWGEAGNLRFTPECLCYIYHFMAKELNHVIDEHIDPDTGRPYMPTVSGELGFLKSVIMPIYNTIKVEVDSSRNGKAPHSAWRNYDDINEYFWSRRCLKRLGWPLNFECNFFGTTPKEKRVGKTGFVEQRSFWNVYKSFDRLWVMLILFFQAAVIVAWEGTTYPWQALERRDVQVKMLTVFITWSALRLLQSVLDAGTQYSLVTRETTWLGVRMTLKSMVAITWTVLFSVFYGMIWIEKGSRPIWSDAANQRIYTFLKVVLFFLIPELLALVLFVVPWLRNVIEESDWRIVYMLMWWFHNRIFVGRGVRQALVDNVKYTVFWVAVLASKFSFSYFVQIKPLVAPTKALLNLKSIPSKWHEFFSNTNRVAVVLLWLPVVLVYFMDLQIWYSIFSAFYGAAIGLFSHLGEIRNVTQLRLRFQFFASAMQFNLMPEEKLLSQQATLLKKLRDAIHRLKLRYGLGQPFNKIESSQVDATRFALIWNEIMITFREEDIISDRELELLKLPPNCWNIRVIRWPCSLLCNELLLAVSQAKELENESDQSLWLKICKNEYRRCAVFEAYDSVKYLFPKVLKAEKEEHFIMINIFKVIDSYIQMGKLTEAFKMSRLPQIHAKVSEFVQLLIQPERDMNKAVNLLQALYELFVREFPKAKKTIIQLREEGLARRSSTADEGLIFENAVKFPDAGDAIFTEQLRRLHTILTSRDSMHNVPLNLEARRRIAFFTNSLFMNIPRAPYVEKMMAFSVLTPYYDEEVLYSKEALRKENED

SEQ ID NO: 143275 - protein, 330 aa, Glycine max
  Coding DNA Sequence Number=SeqID_26497
MVNVQFPPLNAKGGESLTGTIESTRQKSDPYYFDPLQLSSYSIYRNQADASIWRMDFELIMVLVSNTLAFITLGHMIPLILNFEALFMANHSVQNTFLGSGGWLEVNEVVVRMVTMVAFLLELRLVQLTWSSRQGEGSHPGLWDSEKKALYITLPLYIGGGLTAWLVHISKTSHQKRFRPFRLSRHKFSLPREHFYRPPSLWEDFKSYAGLLLDGFLLPQILLNIIFNSETKALASSFYVGTTIVRILPHAYDLYRAHSSAWYLDLSYIYANHRMDFYSTAWDIIIPSGGILFALLVYFQQRFGSRCILPKRFRESTAYEKVPVIGNDDL

SEQ ID NO: 143276 - protein, 101 aa, Glycine max
  Coding DNA Sequence Number=SeqID_26498
  Subcellular localization annotation: CTP_CleavageSite=45; ConfidenceScore=5.15e-01
MGTPSSNPLFIFFLFFFLFYSSVSLNPSDLAFESTYARLCNHHVPAPASRSDEGTVPGIADELRFQSGYFAGGDHFFNRSVTTKNHASFRVTSVRRSASDG

SEQ ID NO: 143277 - protein, 80 aa, Glycine max
  Coding DNA Sequence Number=SeqID_26499
MVTQSHFQSRSGKEKLTVKAKAVVVAGTGDNVRIETLMVVTQREEAKKEEDGSTMQCVGRGRGEGELFKILNEGQFHHFI

SEQ ID NO: 143278 - protein, 52 aa, Glycine max
  Coding DNA Sequence Number=SeqID_26500
MASGIACPVGGARWLEWLAGRCGVRSPYVVTRAPHVYPSNLPNKWYQSLHYC

SEQ ID NO: 143279 - protein, 51 aa, Glycine max
  Coding DNA Sequence Number=SeqID_26501
MEVKEPWLGLWLPLSYRVDMGSSLAYDNGIWDFVVDLGMAFVDKWVVGKEE

SEQ ID NO: 143280 - protein, 66 aa, Glycine max
  Coding DNA Sequence Number=SeqID_26502
MLLKLGHCVLTQPSLGEIGYEVVALPDRPFWPWMNRESERERTRWKGWKGSLQRRCYHNHHIAGAS

SEQ ID NO: 143281 - protein, 387 aa, Glycine max
  Coding DNA Sequence Number=SeqID_26503
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=Q9SMW1; Match level="QueryCoverage=94%, HitCoverage=84%, E-value=2e-60, Identity=42%"; Hit description =Lipoxygenase
  Pfam annotation: Domain name=Lipoxygenase; Domain location=11-364; Score=-75.2; E_value=3.3e-12; Accession=PF00305.9; Description =Lipoxygenase
MEPKLSNPVALNWLKHFNVGDERSTYKVEFEIDSDLGFSGAITVTNKYDKEIFLEGFSIEGACCGYCLQFLDSTLKVHPEERIFFSNKQIAKAHVCFNDAGVHQLVHHWLRIHACMEPFIIAAHRHLSVMHPVFKLLKPHLKHTLQINALALINEGGIIESDFSAGKHSTEIISAAYKDWWRFDMEAILADLIRRFVYLDTYMNHVILVVEIQQLTITREELFNLVRTYVNYYYRDGNMVRSDSELQAWYSEVINVGHADHANVSWWPTLSTPNDHTHMGCFGSAFSGEFWAITSWWHSPDEECIGQRKDLSDWTGDTEIIQAFYEFSMDIKIIEKEIDKRNKDPTRRNRCGAGIPPYESLIASSGPGVTVAHSQFGPGVTYRGRGA

SEQ ID NO: 143282 - protein, 570 aa, Glycine max
  Coding DNA Sequence Number=SeqID_26504
  Homolog annotation: Hit_ID=Q5XWK4; Match level="QueryCoverage=54%, HitCoverage=76%, E-value=2e-67, Identity=46%"; Hit description =Expressed protein-like
  Pfam annotation: Domain name=DUF616; Domain location=188-502; Score =696.4; E_value=2e-206; Accession=PF04765.4; Description=Protein of unknown function (DUF616)
MSGGSLGIRSGSYGSLEKQQLQLQNNGVSLIQSARKPPKTLKEKDRFFHWIFKFTGRKKVGMLFLFTISAAVFIWVLYVGKGEDSQEGNSVHNTSVNGNMSIGDSPSLIARANIMGFTTISVLPPPPPSYFLGYTLPSGHPCNSFTLPPPPADKKRTGPRPCPVCYLPMDEAIALVPKFPSPSPVLKNLTFIYEETLIRDGEFGGSDFGGFPTLRQRNESFDIRESMSVHCGFVRGTKPGRNTGFDMDEDDLLEMEQCHGVVVASAIFGNFDEINEPTNISDYSKETVCFLMFVDEETEKYLRSSGRLGTSKKIGLWRIIVAHNLPYTDARRTGKIPKLLLHRMVPNARYSIWLDGKLELVVDPYQILERFLWRKNATFAISKHYRRFDVFVEAEANKAAGKYGNASIDFQIDFYKNEGLTPYTEAKLPLISDVPEGCVIVREHVPISNLFTCLWFNEVDRFTSRDQISFSTVRDKLLSRVDFHFLMFLDCERRNFVVQKYHRDILERLAAPVDVALSPPPPVETLPEKVVRRGPGRRGRDRRPGSRRHRKVVAGGRDINMEANYTVLFV

SEQ ID NO: 143283 - protein, 239 aa, Glycine max
  Coding DNA Sequence Number=SeqID_26505
  Homolog annotation: Hit_ID=Q9LJR0; Match level="QueryCoverage=59%, HitCoverage=100%, E-value=4e-47, Identity=63%"; Hit description =Arabidopsis thaliana genomic DNA, chromosome 3, TAC clone: K7L4
EEEERGKLIILLPPRVNKEENPRKGQEKIANSLAEPIQGEILDLAFEVDPPHGHEEVEKRATLGEEDLKVTIFNKRHHEEEEANGDEEQAGEGIGGLDEKLVVRRGSQELGGGLHTVAEGVDLLHVEHHQGPTCHCYHRVQDADHHKCRRCHSPSHFISKTLITPSSCLLLSGYTKQKPPHPKIILFLIKTIKLLRFHNYDVSEGHAKIRIPWDPPSLTPLSSQDTLVPRFFQLEGHMK

SEQ ID NO: 143284 - protein, 384 aa, Glycine max
  Coding DNA Sequence Number=SeqID_26506
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=94%, HitCoverage=50%, E-value=2e-83, Identity=46%"; Hit description =Receptor protein kinase like protein
  Pfam annotation: Domain name=Lectin_legB; Domain location=22-258; Score=350.6; E_value=2.6e-102; Accession=PF00139.10; Description =Legume lectin domain
MIRHKHTHPLLLLILLLFNSACAIDFVFNGFNSSEVLLFGNATIDSRILTLTHQQSFSVGRALYKEKIPAKKPNSSYVYPFSISFIFAMAPFEDTLPGHGLVFIFTPITGIHGTSSAQHLGLFNLTNNGNSSNHVFGVEFDVFQNQEFDDINANHVGIDINSLKSYVSHDAGYWPDGGDKSFKELALNSGENYQVWIDYEDSWVNVTMAPVGMKRPSRPLFNVSLNLSQVFEDEMFVGFTSATGQLVESHKILGWSFSNENFSLSDELITIGLPSFVLPKDSIFKSKGLVAGFTVGVFFVVCLLVLLALFLIQRKRVKERKRLEMEDWELEYWPHRMAYEEIEAATKGFSEENVIGVGGNGKVYKGVLRGGVEVAVKRISHEND

SEQ ID NO: 143285 - protein, 509 aa, Glycine max
  Coding DNA Sequence Number=SeqID_26507
  Gene Ontology: Mol. function=acyltransferase activity; Cellular component=integral to membrane; Biological process=biosynthetic process
  Homolog annotation: Hit_ID=Q8VWP9; Match level="QueryCoverage=98%, HitCoverage=97%, E-value=1e-166, Identity=56%"; Hit description =Fiddlehead-like protein
  Pfam annotation: Domain name=ACP_syn_III_C; Domain location=408-492; Score=8.2; E_value=2e-06; Accession=PF08541.1; Description=3-Oxoacyl- [acyl-carrier-protein (ACP)
  Pfam annotation: Domain name=Chal_sti_synt_C; Domain location=352 -494; Score=-5.7; E_value=0.0053; Accession=PF02797.6; Description =Chalcone and stilbene synthases, C-te
  Pfam annotation: Domain name=Chal_sti_synt_N; Domain location=101 -313; Score=-80.1; E_value=0.02; Accession=PF00195.10; Description =Chalcone and stilbene synthases, N-te
  Pfam annotation: Domain name=FAE1_CUT1_RppA; Domain location=108-397; Score=584.3; E_value=1.1e-172; Accession=PF08392.2; Description =FAE1Type III polyketide synthase-lik
  Pfam module annotation: Pfam domain module=ACP_syn_III_C::Chal_sti _synt_C::Chal_sti_synt_N::FAE1_CUT1_RppA; Domain location=408 -492::352-494::101-313::108-397
MSKESEEFSTEIVQRGVENSGPNAGSLSFSVKVRPRLPDFLSSVNLKYVKLGYGYLISHRLYLLLAPPLLAVFIARIGKFTWQDLYEKYGLIEVLFISALLCLMLYFYADLTPGSTYLLDFSCFLPSNEYKISKAEFIQLAKKSRNFNETAIEFQERVLKKSGIGDETYLPKGVFRPGYRNSLNDGRQEVSMVMFGAIKDLLAATKVKPKDIRILIVNCGILNTTPSLSSMIVNHFKLRHDIHSFNLGGMGCAAGITAIDLAKDLLDAYPRTYALVVSTEAVSSTWYSGNDIDMLLPNCFFRMGAAAIMLSNFCLDRWRAKYELKQLVRTHKGMDNRSYKSIHQKEDSEGRKGISVSKDVIEVGGHALKANITTLGPLVLPVSEQLHFFTNLIFKKKKTKPYIPDYKLAFEHMCILATSKKVLDEIQKNLELTEEYMEASRKTLERFGNTSSSSIWYELAYLELYSRIKRGDRVCQIALGAGFMCNSVVWKALRNVGRPKQSPWIEDEC

SEQ ID NO: 143286 - protein, 297 aa, Glycine max
  Coding DNA Sequence Number=SeqID_26508
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=82%, HitCoverage=37%, E-value=5e-72, Identity=55%"; Hit description =Receptor protein kinase like protein
  Pfam annotation: Domain name=Pkinase; Domain location=1-193; Score= -23.3; E_value=3.6e-07; Accession=PF00069.15; Description=Protein kinase domain
  Pfam annotation: Domain name=Pkinase_Tyr; Domain location=10-193; Score=-68.5; E_value=2.9e-08; Accession=PF07714.7; Description =Protein tyrosine kinase
  Pfam module annotation: Pfam domain module=Pkinase::Pkinase_Tyr; Domain location=1-193::10-193
MENRSLDKWVFDCDESKMLSYEDRIRILKDVAFAVLYLHEGWEAKVVHRDIKASNVLLDKDMNGRLGDFGLARMHSHDQVASTTKLVGTVGYMAPEVIKTGRASTQTDVYMFGILILEVLCGRRPLEEGKSPLVEWIWQLMVQGQVECALDERLRAKGDFNVQEMERVMHLGLLCAYPEPKARPTMRQVVNVLEGKNEVDDSEIENMDTYLLQQLKSRDILSEYSQYFSYTSHPTFQDIRHSSSMSLTWSEVEGRWELAAAAESAPNKQSYILTSPRNEWHFHLQECSDLSTSWWRP

SEQ ID NO: 143287 - protein, 334 aa, Glycine max
  Coding DNA Sequence Number=SeqID_26509
  Homolog annotation: Hit_ID=Q9SIH9; Match level="QueryCoverage=43%, HitCoverage=51%, E-value=6e-24, Identity=33%"; Hit description =Expressed protein
  Pfam annotation: Domain name=DUF506; Domain location=61-287; Score =291.3; E_value=1.8e-84; Accession=PF04720.3; Description=Protein of unknown function (DUF506)
MWAPHNSSSGIKPSDKHDPNVCESDKPTTTLIIIMGGTSVAAGRRVTRFLASHHRDVTCVVADVEFDFLDDIGETLLAQSASSDEMDRFDEDEDHRDTVEENRTFWDNQHQLLQTSICRTSSLESRIRHATKEALQEIQSAETVCGCGRQMAVTSCRNCLMREVSWRLQKAGYNSAICKTKWRSSPDIPSGEHNFLDVIDSTKKGKVRVIVELNFRGEFEMARGSEDYNRLVRRLPEVFVGKVERLSNLIKILCMGAKRCMKEKKMHMGPWRKHRYMQAKWLGPCERNTSTASLSVGYSERILPMAKPRPKASMLTVDLLEKLPNMHCNAVEVV

SEQ ID NO: 143288 - protein, 89 aa, Glycine max
  Coding DNA Sequence Number=SeqID_26510
RAPRTTICSVNSTQSRSRNPLLVVDPVLEQPNMRCGSPAIMLRHGGTVDGGVEGVGYGGSGEGCWVRILNGRTEREREKSCNTCPSLID

SEQ ID NO: 143289 - protein, 37 aa, Glycine max
  Coding DNA Sequence Number=SeqID_26511
MLTVTTLKRRCKSWNSRPKRLMPGFEEEIRWGGEGCQ

SEQ ID NO: 143290 - protein, 180 aa, Glycine max
  Coding DNA Sequence Number=SeqID_26512
  Gene Ontology: Mol. function=transcription regulator activity; Cellular component=nucleus; Biological process=regulation of transcription
  Homolog annotation: Hit_ID=Q1S0Z9; Match level="QueryCoverage=88%, HitCoverage=86%, E-value=3e-08, Identity=27%"; Hit description=Helix- loop-helix DNA-binding
  Pfam annotation: Domain name=HLH; Domain location=8-60; Score=44.2; E_ value=4.3e-10; Accession=PF00010.16; Description=Helix-loop-helix DNA- binding domain
MENNPSSSRVERKIIERNRRNQMKALFRELNSLVPHQSSKEAISLPDQLEEATNYIKKLQINLEKMKDKKNMLLGIERPNVRMNNGGRTVRLNSPRIEIQQMGSALEVVLITGFDCQFMFSETIRVLHEEGVDVVNASYKVIEGAVFHSIHCQDRESANGAARISERLKNFIYDSSYSAF

SEQ ID NO: 143291 - protein, 276 aa, Glycine max
  Coding DNA Sequence Number=SeqID_26513
  Gene Ontology: Mol. function=nucleic acid binding; Cellular component= chromatin; Biological process=DNA integration
  Homolog annotation: Hit_ID=Q1RSI0; Match level="QueryCoverage=98%, HitCoverage=31%, E-value=7e-54, Identity=41%"; Hit description=IMP dehydrogenase/GMP reductase
MNVEIKALKLNHTWILTDLPKHKTTIGCRWVYKMKHESDGSIERNKARLVAKGYTQIEGHDYLDTFSPVAKLTTLRLLLALAAINRWPLKQLYVNNAFLHGDLNQEVYMNLLEGLQVDKPGQNKIRLFLGFEVARTPAGINLCQRKYALDILNDSGMLGSKSVSIPFDYTTKLHKHLGSFLSTDDTSLYRRLIGRLIYLTNTRPDITYVVQHMSQFVAQPTSAHQQAASRILRYIKGSLGAGIFLPVDSNIHLKGFSDSDWTDCLDTRRSITGYAI

SEQ ID NO: 143292 - protein, 202 aa, Glycine max
  Coding DNA Sequence Number=SeqID_26514
  Homolog annotation: Hit_ID=Q1SS72; Match level="QueryCoverage=32%, HitCoverage=4%, E-value=6e-11, Identity=44%"; Hit description =Integrase, catalytic region
MSTNRSHQDQSLNIHNPFYLHPRENPVIALVSPVTDSSNYNSWSLSMLIALSTKNKVEFVDRSIKRYASNHALHTVMMDPLPSIAKVFSYVVQQERQINNSDLMGNTSLINAAGSLSSKSCTYCGKMVFLQIILLEEEEVANEALIKGVLMGNEARYPPGHKLYRPQGSNVNNVNVVKEKGDGLVLERSQEVQNDEVKLTSQ

SEQ ID NO: 143293 - protein, 79 aa, Glycine max
  Coding DNA Sequence Number=SeqID_26515
MMSLERRNSRMQKERTLRRSLAAKMMIFCYSEEEEESEIKVEERKLGCIFHSFREKTRKNSKAMEISSGGEIVRKEDRV

SEQ ID NO: 143294 - protein, 172 aa, Glycine max
  Coding DNA Sequence Number=SeqID_26516
  Gene Ontology: Mol. function=sequence-specific DNA binding; Cellular component=nucleus; Biological process=regulation of transcription
  Homolog annotation: Hit_ID=Q2HTS9; Match level="QueryCoverage=83%, HitCoverage=68%, E-value=1e-42, Identity=70%"; Hit description=DNA -binding WRKY; VQ
  Subcellular localization annotation: CTP_CleavageSite=43; ConfidenceScore=5.01e-01
MPIFISSLGIFPSFRKTSDRSIGGGSGRSCGEEREQAGLRFVSGRRVKEETFLFDGFVFSFGIDGGVGSVERVGNERRDGAENECGEVEDAGGEDVGFSGGISVVVREKRGEGVDVLEFEGFEEPPAAACFAVSEEPVSIWTTCLKEDVSAWTNVVGYGFAGSDLVIMAFAV

SEQ ID NO: 143295 - protein, 87 aa, Glycine max
  Coding DNA Sequence Number=SeqID_26517
MEEDEKDLDQSIGRECLAEARGKVGDSKGLKLEVDETSFDFETSMRLNVRVESLLEEFLKEKREKLRVRKHFLKEKREKMRVRKRFS

SEQ ID NO: 143296 - protein, 72 aa, Glycine max; identical to SEQ ID NO: 130055
  Coding DNA Sequence Number=SeqID_26518

SEQ ID NO: 143297 - protein, 243 aa, Glycine max
  Coding DNA Sequence Number=SeqID_26519
  Homolog annotation: Hit_ID=Q2HTS2; Match level="QueryCoverage=83%, HitCoverage=27%, E-value=3e-38, Identity=49%"; Hit description =Lissencephaly type-1-like homology motif; WD40-like
  Subcellular localization annotation: CTP_CleavageSite=31; ConfidenceScore=5.25e-01
MDSCMNGGLFSMRYLPLGKGRTKRPGKGPLVPMMTQNARNDAPPKIPQISMSEHRTPQFQVNSSFNNMMTQPAVCVIPSIMYNKEERLGYLPENVEPSLHDVINSNLTFLSGTSSNYPLQDVVGKQAQKQVFKDSGIGMSVERDIPRDPLDVMQKSMLPLDGLHETKANEALNIVPLNGWPINNQVLTSSLQPPNCRQKCQMLKTQNQDAILAQAIADDKPNDYNCRTSTPAGSTNSGAIPEC

SEQ ID NO: 143298 - protein, 107 aa, Glycine max
  Coding DNA Sequence Number=SeqID_26520
MGPTYSDMGCKLALEDKKRVAFRRRQRHEHVDATRHAKPCNCSSLASQQQKACVCCFIKLPCRICHQALRCARKWACYVSYPNFVRGPLLDDVRPFFGPREVLGTHH

SEQ ID NO: 143299 - protein, 101 aa, Glycine max
  Coding DNA Sequence Number=SeqID_26521
  Gene Ontology: Mol. function=catalytic activity; Biological process =metabolic process
  Homolog annotation: Hit_ID=Q8S8F9; Match level="QueryCoverage=74%, HitCoverage=31%, E-value=3e-13, Identity=46%"; Hit description =Expressed protein
MVSSNNIVEQLREEIPVKQQSLTLSGDIKTGLILVDVVNGFCSIGAGNLAPKEPDERISQMVKESVRLSKAFSLRESCQFLLSLIPITPTNPNPLIHLTVL

SEQ ID NO: 143300 - protein, 313 aa, Glycine max
  Coding DNA Sequence Number=SeqID_26522
  Gene Ontology: Mol. function=zinc ion binding; Biological process =regulation of transcription
  Homolog annotation: Hit_ID=Q1S7N0; Match level="QueryCoverage=86%, HitCoverage=92%, E-value=1e-44, Identity=40%"; Hit description=Zinc finger, Dof-type
  Pfam annotation: Domain name=zf-Dof; Domain location=34-96; Score =136.4; E_value=7.9e-38; Accession=PF02701.6; Description=Dof domain, zinc finger
MEQGVEEGGGMNKIPRDSRVKEIRQGDAQIQVQAPQQPQKCPRCDSLNTKFCYYNNYSLSQPRYFCKTCRRYWTQGGTLRNVPVGAGCRKGKRAKSSNSSSSENMNSSSRSLPQQQQQPQGVVVQTQAPPLTTVVKAKDPSSVVASTFYQSGGYLSSLAAMHSLNSSSHPFDHSLNFAGSDTLRSSNLGLLSGFNVQRPIGPIRPPHLYHQMGSGEREMVSLYEQGLVNPSSSSMANTDTNSSGVSQHDWPMSFINNNNNNASNRASDASLWSTISTTVGGNAERTSPSGVGAGSSSFVKNQWPNLPGYGPPP

SEQ ID NO: 143301 - protein, 172 aa, Glycine max
  Coding DNA Sequence Number=SeqID_26523
  Gene Ontology: Cellular component=cytoplasm
  Homolog annotation: Hit_ID=Q9SPJ6; Match level="QueryCoverage=76%, HitCoverage=89%, E-value=6e-51, Identity=69%"; Hit description =Maturation protein pPM32
MWRSAEEEEGRRDGRTDWIYDSAEADEMTERAKETMIEGYDRAKDQEREAKDRTKEYTHDAKDKTEEYAYDTKESDKDDAGKVVDRSREGAERTKEKTEEVAVSAGETLRNVGEKAKQGMQGAWETAKDTTQKIKETVVGKDDDDDGRGVLKDEDVVEMKRRVGKSYGEKGY

SEQ ID NO: 143302 - protein, 101 aa, Glycine max
  Coding DNA Sequence Number=SeqID_26524
  Homolog annotation: Hit_ID=Q6L3K2; Match level="QueryCoverage=33%, HitCoverage=13%, E-value=5e-07, Identity=61%"; Hit description=Dof domain, zinc finger family protein
MNYKQPQDLRVKERCNMGMQRILSNPKNVPAAITTTIAVTASLVVIFANHAGGTGLKWNHKEQMQLKEMSERAKITMSESMDRAKGQAQEVKESIKMMLWS

SEQ ID NO: 143303 - protein, 139 aa, Glycine max
  Coding DNA Sequence Number=SeqID_26525
MRVDANTWLHKYAPLRVPEPYPYSRGYVKSVGEATVNLEKDNTFFSKLDQESKPVIRDDTEEISAERIVDRVVSKFERVEGIDLSKDKEALVCITKEARNAIRNLSFLTCAPIRTAVENILKKAKLQVGDDYAVELRSV

SEQ ID NO: 143304 - protein, 50 aa, Glycine max
  Coding DNA Sequence Number=SeqID_26526
MSSYAGKSMEPIDRASEFFFSFMNEIDPQHQLRVAMTIWRGNEMLWEGKN

SEQ ID NO: 143305 - protein, 54 aa, Glycine max
  Coding DNA Sequence Number=SeqID_26527
VEGEKVIFNKNKIKKSLSIYDLCKCAGRAKQQQSTLVAHSMSQVDHNKDIHVYE

SEQ ID NO: 143306 - protein, 68 aa, Glycine max
  Coding DNA Sequence Number=SeqID_26528
MIEVLLPDATMAGGVDVVTRSEGETRRRYCNTKVLWWWLEVLTPTKVTRDEWAMAERKKIDRSRGGSF

SEQ ID NO: 143307 - protein, 165 aa, Glycine max
  Coding DNA Sequence Number=SeqID_26529
MIHPPFQKFNGCYKQADKHRRSGSSEKDVLADAHMIYSQDTEFMSKCSKRTKVSASGNYSSSSNPETPVEVKECDTSSPMSRPIGQKAAKRKSKGKESRNTLDLFGIESVMKDKNMNTSKLIQLKKAHEWRMEYEILMKDTSNMSEQQCKDHEKYCDHIRKKLGY

SEQ ID NO: 143308 - protein, 178 aa, Glycine max
  Coding DNA Sequence Number=SeqID_26530
MDPTINLDEVLDQMIDEELEDNTDEEIIRLILESQQQLHGNTTRHSQRRRVVHHNREEGHDRLFNDYFSKNPVYTEIQFQRRFLEFLERFVLGICTIFGNEYLRRPNNKGTERLLQMGAARGFPSMLGSIDCMHWEWKNCPVAWKDHLNATRRKAKLICITTRIGKKGCRTGVWTICI

SEQ ID NO: 143309 - protein, 84 aa, Glycine max
  Coding DNA Sequence Number=SeqID_26531
EKREVVATQLAQASSPHPSEVGCFHQKAPPSVETPWKIVQQCFFSTSGMSWNFTDYLTVGVKYLKAVKRRLDATKQWSLDEIRV

SEQ ID NO: 143310 - protein, 204 aa, Glycine max
  Coding DNA Sequence Number=SeqID_26532
MVKDLMPFFSLFKVLENPPGVFKAKHQRISKGAWTFSMQNRGWQVSSYLLSQDILVCIEQDHLRELKMLNIYAFQDWLLGNLLYLWHLLPNGGWGESYLSSQSKGDLYERDGIVLDKSKRDKSRVSNPLMKRALLTTTAEDKMQKYGRSKVGSRVVPYHEDQSEDSVLVSFVSKDLQRNGKESEDSEAAVKSTQSTVVAGRKVG

SEQ ID NO: 143311 - protein, 166 aa, Glycine max
  Coding DNA Sequence Number=SeqID_26533
  Gene Ontology: Mol. function=ribonuclease H activity; Cellular component=mitochondrion; Biological process=DNA integration
MKADMEAMKEHMTMMMETMMNMNKMIKKLCEDFKIQHHNLIPYWPNMNAAVEDANKNIKKIIQKMSDIQRLARDVVVCIAWTTPFSLVYGMEVVLPFEVEIPSLRVLLEAKLEEVEWVQAHFDQLNIIEEKRLVAMSHGQLYHRRMKNAFDKRVCPCKFNEGDLVL

SEQ ID NO: 143312 - protein, 46 aa, Glycine max
  Coding DNA Sequence Number=SeqID_26534
MVLIVNSGDIEENARNEQIHGLPVAMHHKKGKTLDETSLSSSELEI

SEQ ID NO: 143313 - protein, 44 aa, Glycine max
  Coding DNA Sequence Number=SeqID_26535
MYRGPRGSFGVEGQSKVGPSGCDHTSTNAPDPIRTPQLSVLGRE

SEQ ID NO: 143314 - protein, 97 aa, Glycine max
  Coding DNA Sequence Number=SeqID_26536
  Gene Ontology: Mol. function=shikimate 5-dehydrogenase activity; Cellular component=cytoplasm; Biological process=aromatic amino acid family biosynthetic process, shikimate pathway
  Homolog annotation: Hit_ID=P0A6X1; Match level="QueryCoverage=92%, HitCoverage=21%, E-value=1e-38, Identity=82%"; Hit description =Glutamyl-tRNA reductase
  Pfam annotation: Domain name=GlutR_N; Domain location=6-96; Score =42.2; E_value=3.3e-11; Accession=PF05201.5; Description=Glutamyl -tRNAGlu reductase, N-terminal domain
MTLLALGINHKTAPVALRERVSFTPDTLDQALNSLLSQPMVQSGVVLSTCNRTELYLSVEQQTDLQEQLVRWLCEYHDLREEDVRNSLYWHGCLGGS

SEQ ID NO: 143315 - protein, 103 aa, Glycine max
  Coding DNA Sequence Number=SeqID_26537
  Gene Ontology: Mol. function=protein transporter activity; Cellular component=cell outer membrane; Biological process=protein transport
  Homolog annotation: Hit_ID=UPI00005EF5A4; Match level="QueryCoverage =76%, HitCoverage=35%, E-value=3e-27, Identity=73%"; Hit description =COG3017: Outer membrane lipoprotein involved in outer membrane biogenesis
MHLPPRQLLRLLPLASVLLAACSINKPQQGPGPSTTSPQWQQHQQAVAKITQYQTRGAFAYLSDKQKVYARFNWQQTAADRYRLLLTNPLGSTELQLDAQGSV

SEQ ID NO: 143316 - protein, 442 aa, Glycine max
  Coding DNA Sequence Number=SeqID_26538
  Gene Ontology: Mol. function=oxidoreductase activity; Cellular component=periplasmic space; Biological process=electron transport
  Homolog annotation: Hit_ID=Q74RZ7; Match level="QueryCoverage=99%, HitCoverage=62%, E-value=0.0, Identity=76%"; Hit description =Putative biotin sulfoxide reductas2
MHRQHVAIARGAADVVALQRTGDRQHDIRHFGRRRPPDILYDHRIRLLPAFHQPVQLLMVMERVAAGPVHQVDIRVLPRLAAKLIGFAGVQQHVADARHRDRQPGRVFPYRHGRRGGVHARVADAVHRAVAEREAAARQAHLAQHRRQRDHHPIGLLAAVRALYGVGTGDKTAHADQLPRQQGDARRRNAGNGAGPGRRFRHAVAHAVQRQHQRHVGIRPDRDPLRVDEPGAVVAHRADVDNRRALVRQLLQPGFERMLRRTAGRDLGIFQRQPAKRHKQLAMLHHAWPTGDAPGQRRESADHIRQEKLRRAPAVVALLIDPAAAAEIEPSHQRARMMQAPGRRPAIRAGKQPGGAVAIAHPAILLRHQIERQFPVHFDEIFPAAQRAVAALALLQPRAAHRRLADTFVRVNHRYDGIEQRRRVGIVGEGFTADKPAVFNHG

SEQ ID NO: 143317 - protein, 147 aa, Glycine max
  Coding DNA Sequence Number=SeqID_26539
MTEGCGEGFCLANLPGDAFSLWGNFFEAKKQMMADAKFAGLLGLGKPLVEILPPGSTSWFLPVVGLARVGGAGLWPRAKFRIGWPPPPPREGRIKATRAESQWIVAARPLCHLQYPVAYLSRLQRILPAARWELRFKASRRANPPHE

SEQ ID NO: 143318 - protein, 41 aa, Glycine max
  Coding DNA Sequence Number=SeqID_26540
MAEINQGMEANGGWGDHPDRSLSLPGARQAENVAAWQPSIL

SEQ ID NO: 143319 - protein, 82 aa, Glycine max
  Coding DNA Sequence Number=SeqID_26541
MGLRKRGREWRIALSNHYAWLQTRGWRTQELKCNSWGSEKRLRMENFTKQSLRMTPNSWVEDAWRKMQFMGLRKRVENGELH

SEQ ID NO: 143320 - protein, 101 aa, Glycine max
  Coding DNA Sequence Number=SeqID_26542
  Gene Ontology: Mol. function=protein kinase activity; Biological process=protein amino acid phosphorylation
  Homolog annotation: Hit_ID=Q5VR06; Match level="QueryCoverage=90%, HitCoverage=6%, E-value=5e-15, Identity=42%"; Hit description =Helicase-like protein
  Pfam annotation: Domain name=DUF889; Domain location=1-101; Score= -99.6; E_value=9.8e-05; Accession=PF05970.5; Description=Eukaryotic protein of unknown function (DUF889)
MCLQGNAQLIDDQETNKFAKWILDIGDGVIGNQNDGYATVEIPEYLLITEYNDPIDAIVKSTFPNLYQHQSNPDFFKSRAILASTNETVEEVNDYILSLIP

SEQ ID NO: 143321 - protein, 92 aa, Glycine max
  Coding DNA Sequence Number=SeqID_26543
MTEGCGEGFCLANLPVFPCAGGRFWPVARSWQALVEILPPVNFVVLPVVGLARVGGAGLWPRAKFRIGWPPPPPRDQFCCQDFANFGLRPVG

SEQ ID NO: 143322 - protein, 301 aa, Glycine max
  Coding DNA Sequence Number=SeqID_26544
MASRKRKSIGTRPTSQYDTRRFSSLDAWTRYTDNVLGRNILPERKVELYHTELDDFKAELERHNFHKHLTNLADGSIDLALVKEFYANLYSFEDHPPKQSRVRDHLVKIDADSLNTFLETPVITESHPGKILRKDLTTLAQVWSVLSYSNLAPISHTSNLKVDGARLIFGLVSHLDMNIGALISDQMTSIAQSNTSRLGFPALITALCRAREVVSDSLTFERLSPVINLAYIRKNCWNPEDLTVSIRGARRARERQAELPSTSAAPTLASTSAAPSVPAQTNYQRFEAMLQSIHQGQIILL

SEQ ID NO: 143323 - protein, 381 aa, Glycine max
  Coding DNA Sequence Number=SeqID_26545
  Gene Ontology: Mol. function=hydrolase activity
  Homolog annotation: Hit_ID=Q2L2Q0; Match level="QueryCoverage=57%, HitCoverage=92%, E-value=9e-78, Identity=68%"; Hit description =Putative hydrolase
LRILDENLAGHNGIEAAGWQVPARLSTRLEAVAQQVIKVAQHAGRGAPDEVPAIRHAVIVTHPAVLQPRLVQTVIGRIHQERQRHFEHLGDFERVRRQLEAGRNQRHDRDDGESSGGQVRGHAAQHLDVVGRQSGFLLRLAQRRGDRRRIAGLDTAARKTDLAGMVVQVRGALGQHDVHAIVARHQRNQHGRGHRGAFAAGIAQVIVARQLERPGGRLAERAAQQVGRQQAGRHRRQGIVGDHPGLRRRVEPGTRQRPARPRRRRGIRHSAFQKEKGTLAGAFLTRKPVPNENAGWRVRPTLVGPCADKRSSRRGLLADQLFLDTRRLARAVAQVVQLGAAHVAAALDFDAGDLRRVQLERTFHGFTRRNLAHGERGVQAA

SEQ ID NO: 143324 - protein, 436 aa, Glycine max
  Coding DNA Sequence Number=SeqID_26546
  Subcellular localization annotation: CTP_CleavageSite=65; ConfidenceScore=5.69e-01
MINGIGPGSFSQLHLSSASARVTSSTASNATRQNSLTADASAKVTFSEATDTISAVYQMTPARVTASTPLSPDMQTQAMGALRSSGVSMNGIGSALLSALTQQRDDVTISVPASGGAQTDTQSAMALEITTQSGVSLTLQMTRQQDGRGSCAENHSRFDSNQLASVDLKTDLRRSGEVMQSLNLHADPSSRWLGFHNADASFKLTTDMRSLAQASNAGQQQSALAQWSAKFDQAASRGHGDRAALALFKQGFETLNSTSAAAGVAMRTPQAITVGAHAAQAGAISGLADFSASYHQTARSSNPLKPEEEDTFALDVAQRSSQQKNGDTQRMTQETLFKLNASFHTALSASSPLALNETKESQNYHYHQIHDETRSTTEVTQDAQGNLTARFAQQLTQQETVKTYQLAKLIDSTSTPHSEKSESTRHYSPAMYLAQA

SEQ ID NO: 143325 - protein, 295 aa, Glycine max
  Coding DNA Sequence Number=SeqID_26547
  Gene Ontology: Mol. function=hydrolase activity
  Homolog annotation: Hit_ID=Q79AX3; Match level="QueryCoverage=85%, HitCoverage=86%, E-value=1e-73, Identity=53%"; Hit description=IroE
  Pfam annotation: Domain name=Esterase; Domain location=44-283; Score=- 20.3; E_value=0.00024; Accession=PF00756.11; Description=Putative esterase
MIFRLIIPLFTLLSLLLSPAVGFARPDMTPLGPNIADKGSAWYRFTVNTFDSADGQRHYKVWTAVPRKPAPAIGYAALYMLDGNAVMNHLSEALLQKLAAGNPPVLVAVGYQTPLPFDLAARTLDYTPPQQVQDRRGRPAGGSAAFRQLLEQTIAPRAEQHLPINAQQRALWGHSYGGLFVLDSYLTSGFFQRYFAASPSLRGDATLLQQMAAVTPASFKQKQLVLMEGNGESRPGVSDVLSRIRTTLDGMHEKGLAARFQLFPGLSHGQMFPASLESALSAMAEDGAPSRAPDE

SEQ ID NO: 143326 - protein, 181 aa, Glycine max
  Coding DNA Sequence Number=SeqID_26548
  Gene Ontology: Mol. function=oxidoreductase activity, acting on the CH-CH group of donors; Biological process=electron transport
  Homolog annotation: Hit_ID=Q4IS96; Match level="QueryCoverage=80%, HitCoverage=34%, E-value=8e-39, Identity=55%"; Hit description=Acyl -CoA dehydrogenase, C-terminal
  Pfam annotation: Domain name=Acyl-CoA_dh_N; Domain location=17-125; Score=3.5; E_value=0.00018; Accession=PF02771.7; Description=Acyl -CoA dehydrogenase, N-terminal domain
MTQIRAQQLQRAAVITSDAAAIDAARHLAEQARAGAAERDQQRIYPRELLDQFTQLGLGSISVPRQFGGGGLSFGTVAEVFRLISASDPSLGQIPQNHFGLIQFILGEGSVQQQQRLLSAVVQGQRLGNGGPEKNSKHTRDVQAQLVSGPEGLRLSGEKFYSTGALFADILVTTAQQEGQP

SEQ ID NO: 143327 - protein, 80 aa, Glycine max
  Coding DNA Sequence Number=SeqID_26549
MWEYKTMHPDVNSNLSQMKQMRLLPIYYKLVDMCRNLPFGRRATRGLTGASSKKGKCAESPPTFIRGKRPKNRKDVVYEL

SEQ ID NO: 143328 - protein, 135 aa, Glycine max
  Coding DNA Sequence Number=SeqID_26550
MRLDEVVFPEPIVPVIHETVEAGESQLRQEAATPERTTQTPEDPPSPGMELSFAQQVADPPTPVHERPADPFTPILEIPKYPPSATPELQFSNEEGGRITTPPGTPSLVEVLILSHPLSQFSCLASHPLSAAVHG

SEQ ID NO: 143329 - protein, 85 aa, Glycine max
  Coding DNA Sequence Number=SeqID_26551
MSWKRAHYFSMPHQENHDYEGVATYPSAGGRRGAHGCVFQGRKMHEVTTNVYLRKTSEKPERCGLRTLIVKGSGVVFMHGEGEKR

SEQ ID NO: 143330 - protein, 52 aa, Glycine max
  Coding DNA Sequence Number=SeqID_26552
MTNECAYFGCLEMIVAKEKNKEEKAEKMFVSQRKSKAEDIRAIVEEFLLKVY

SEQ ID NO: 143331 - protein, 103 aa, Glycine max
  Coding DNA Sequence Number=SeqID_26553
  Homolog annotation: Hit_ID=Q652L2; Match level="QueryCoverage=77%, HitCoverage=8%, E-value=9e-15, Identity=51%"; Hit description =Putative HIRA
  Subcellular localization annotation: CTP_CleavageSite=25; ConfidenceScore=5.65e-01
MASVSSLSPPTPFVTASSSLGNFVRVFNVNSNTTIATLKAPPSEVEVSQMHFDPKREITVQETEIVCSKGPQTLWSARISGKVTILAGNGNFWAVGCEDGCLQ

SEQ ID NO: 143332 - protein, 226 aa, Glycine max
  Coding DNA Sequence Number=SeqID_26554
  Homolog annotation: Hit_ID=UPI0000612421; Match level="QueryCoverage =40%, HitCoverage=36%, E-value=6e-12, Identity=48%"; Hit description =UPI0000612421 related cluster
MSLLVSYVYPVLLGYAKANIIFYFKNREVGDIAKPLNKQSIPLTFDDGSPISKSEIYASVFSSIFKLIDIYDGFGVVRIAIRAHFEENIPGPLQPLKEELLEEALSECIKPSSGEIDISNLPVKSLSSTSRKYPKNITVPRKSGNISLRPFLVADTETIINKNSQHVPYAVGVMVVNPGIPVSRRERIDTYFSEDYSSRIFPTFEERSCQMLKSFIFRVAAITRQN

SEQ ID NO: 143333 - protein, 75 aa, Glycine max
  Coding DNA Sequence Number=SeqID_26555
  Subcellular localization annotation: CTP_CleavageSite=41; ConfidenceScore=5.03e-01
MDAQRNSQQRMYLVMDFSSCTSPILNTPSKKSRVLGRALSRQVYVDEDVENVDNVVDEPHEEPQDPITEDVGGDS

SEQ ID NO: 143334 - protein, 316 aa, Glycine max
  Coding DNA Sequence Number=SeqID_26556
  Gene Ontology: Mol. function=oxidoreductase activity; Cellular component=periplasmic space; Biological process=catecholamine metabolic process
  Homolog annotation: Hit_ID=P49250; Match level="QueryCoverage=64%, HitCoverage=27%, E-value=2e-85, Identity=74%"; Hit description =Copper amine oxidase precursor
  Pfam annotation: Domain name=Cu_amine_oxidN1; Domain location=142 -229; Score=107.4; E_value=4.1e-29; Accession=PF07833.2; Description =Copper amine oxidase N-terminal domai
  Pfam annotation: Domain name=Cu_amine_oxidN2; Domain location=234 -315; Score=82.1; E_value=1.7e-21; Accession=PF02727.6; Description =Copper amine oxidase, N2 domain
  Pfam module annotation: Pfam domain module=Cu_amine_oxidN1::Cu_amine _oxidN2; Domain location=142-229::234-315
MSHLSDIKPVMITNDAKATATVTNGEIYLRVRGNIYAFTAVGCRQTLFSWACQDKAITTQYTLNNSSGRKAARERIPGSVHKYVTGVSECSQRTCNLKYDGYKHNKMRSTMGSNSSFSARRTALAMAVALCCAWQSPVFAHGSEAHMVPMDKTLQDFGADVQWDDYAQMFTIAKDGAFVKVKPGAKTAIVNGKTLKLEVPVVMKGKKAFISDSFINDVFQSGLDQTFQVEKSPHPLNALTADEIKQAVEIVKSSADFKPNTRFNQIAIAEPEKAKVWDFVLHGTPVDAPRQATIVMLDGKHVIESVVDLKDKRILR

SEQ ID NO: 143335 - protein, 360 aa, Glycine max
  Coding DNA Sequence Number=SeqID_26557
  Homolog annotation: Hit_ID=O49218; Match level="QueryCoverage=14%, HitCoverage=10%, E-value=1e-12, Identity=72%"; Hit description =Methylmalonate semi-aldehyde dehydrogenase
  Subcellular localization annotation: CTP_CleavageSite=71; ConfidenceScore=5.57e-01
VGINVPVPVPLPFSSNGSKSSFAGDSFSGKAGVQFYTQIKTVVHQWKDFPRQALFPATCPSERDSPRQLSQAMPVESESDSPTYEVQVAITDVDIPNTTMSSASTSTDKDHRSQDVSLLLPSASERDMSDRDISLVLSPALQSNLPSQGVSVATSQSSERMYVSETSQWNENSPATSKRSEIILPTSERSLVSASQMNGNLFIPHTTDTATALKPEGIYMCTSHKTDSIAQASQESSDNITPGSHRMDTTVHSNSDKAYILAASHLNKSVGQTFERTDPMFPTSERIYMPSTSSHMNDQIGSTSQRTDIPTTERIYIPAASHINKSISPACQLDDDTLAPTSERVFMPPIVPEYTTNFRE

SEQ ID NO: 143336 - protein, 98 aa, Glycine max
  Coding DNA Sequence Number=SeqID_26558
  Gene Ontology: Mol. function=methylmalonate-semialdehyde dehydrogenase (acylating) activity; Cellular component =mitochondrion; Biological process=valine metabolic process
  Homolog annotation: Hit_ID=Q1SFW2; Match level="QueryCoverage=86%, HitCoverage=25%, E-value=2e-25, Identity=63%"; Hit description =Aldehyde dehydrogenase
MEDIVNYICNDEDIKAVSFVGPITAGIYATASARGKRVQSNAGGTNHVLVMPDAGLDATLDALVPAGFGAAGERCMTSSIAIFVGGTKGVEPIPTVQY

SEQ ID NO: 143337 - protein, 98 aa, Glycine max
  Coding DNA Sequence Number=SeqID_26559
MDDNNEDVGNVLGYGRVGVATSMLKAHPETDDASVQRLMGVCWLDLDRLGEGESKIVFSIFAQFEQSPVAVGKVVGKCKTSHQKDNDQKGPPRIIGPQ

SEQ ID NO: 143338 - protein, 102 aa, Glycine max
  Coding DNA Sequence Number=SeqID_26560
MLGGSSLCEGMEEGHCMQFYPSKGKEVVSRFESIGKNPSPTLARDKANIKYLSRRQPSPYELALGVELGPNPHSKRTHDQPVTKTQFYRCARTRPHKHDLNP

SEQ ID NO: 143339 - protein, 490 aa, Glycine max
  Coding DNA Sequence Number=SeqID_26561
  Homolog annotation: Hit_ID=Q0WM29; Match level="QueryCoverage=34%, HitCoverage=27%, E-value=4e-59, Identity=68%"; Hit description =Methylmalonate-semialdehyde dehydrogenase [acylating], mitochondrial precursor
  Pfam annotation: Domain name=Aldedh; Domain location=147-489; Score= -177.9; E_value=4.6e-08; Accession=PF00171.12; Description=Aldehyde dehydrogenase family
METQNQSDPAGLKRMLPPPPGSFQDREDLIKHVRDFGANQGYVVTIKKSRKDRRVILGCDRGGKKEDDAWVLTVKNGDHNHEPLKDMSEHPYSRRFTEEEVRQIKQMTEAGIKPRQVLKALKHSNPELQSTPRHLYNLKAKIRQGNLSDSQGSVIIDVINPATQEVVSQVHLTIYEEFKAAVSAAKQAFPSWKNTPITTRQRIMFKLQELIRRDIDKLAMNITIEQGKTLKGAKRDVLYGLEVVEHVCGMANLQMGEFVPNAYNGIDTYCIREPLGVCAGICAFNFPATIPLWKQETKLALDGSWKEAFVKHHSCKTDIFWRLIPIPRTRTTRRECGEVEAISWTRKGSSDGDRLQFLKSEIRSKEEGKLMVEMQPRLIVFKTQISEKAYYNETIITVGSRFDMNVGGTSMVLDSRNSNLLGEPLWLNFDVSVVDSMTMEPREKEGGATHLWRDQFFEIGHLAGKTLGCALDEAFGGSIGRSKYSDKIKT

SEQ ID NO: 143340 - protein, 165 aa, Glycine max
  Coding DNA Sequence Number=SeqID_26562
MSLAKISWAFFQKERHVLNDLRISKTSGSIDCHKTAELIIQLFPHREGEHRSRRSHFHSKNTNPSGENGRRTRSTRSKCQNWKMKAGMGSEGSDESNGVGVAGVRRREGGAWRPRARTSGGRRRRVNGRLTTRIVGLGYASRGTPNPVVVGEKRRRTGGADSDAG

SEQ ID NO: 143341 - protein, 52 aa, Glycine max
  Coding DNA Sequence Number=SeqID_26563
  Gene Ontology: Mol. function=nucleic acid binding; Cellular component= ribonucleoprotein complex
  Homolog annotation: Hit_ID=Q41498; Match level="QueryCoverage=66%, HitCoverage=13%, E-value=8e-11, Identity=85%"; Hit description =U1snRNP-specific protein, U1A
MESRDHKTGNMGLESWHPTVCIATVDCISSPYSTKAIPGFVSTILTSLNPGY

SEQ ID NO: 143342 - protein, 98 aa, Glycine max
  Coding DNA Sequence Number=SeqID_26564
MDIGKILPSSSTLGWHNLKVKGKVQVKKGLWWIPRHPKMRKGIVGKRQLGELKYLSNCRNLPFGGRATRGSRVRLPWEENARSRHQRLFEENVGKTEK

SEQ ID NO: 143343 - protein, 229 aa, Glycine max
  Coding DNA Sequence Number=SeqID_26565
  Homolog annotation: Hit_ID=Q47522; Match level="QueryCoverage=24%, HitCoverage=75%, E-value=2e-15, Identity=68%"; Hit description=LacZ protein
VPPVQLLTGWCVTAKAPPDISAGKCSGHAARRVPFAIQAAQLLGRAIGAGLFAITPAGERGMCCKAIKLGIRWIGVEADHRPAPLLREVPTHRLAHHAETDECDCLDAHDLPCLCFHPGRIKQAAALRCKRMFAKPTARRTGDDRRRQRRELQSAINSRQIPIKLIDTVDLEGGPVGKPVVPAALMNRPTRGERRFAYWALAECILAYYVGTDEGVSEVLHVAGEKRLH

SEQ ID NO: 143344 - protein, 169 aa, Glycine max
  Coding DNA Sequence Number=SeqID_26566
MEQYTWSSEGSWSDPPPEWVRPEAQTRLEGCWSLEDCRGVSETSRPTYVPRGFASYLLGLNRTTYELSGVGNEETTIVCPVCEAKNAPNWQKKLAEALAKHLTSCDYNSSLQGYAQFYCKPHFKATTRHESYSWTGQDFLRTQHCTCKEPFAEREREKEKAKECSNILE

SEQ ID NO: 143345 - protein, 521 aa, Glycine max
  Coding DNA Sequence Number=SeqID_26567
  Gene Ontology: Mol. function=thiamin pyrophosphate binding; Cellular component=chloroplast; Biological process=aromatic compound catabolic process
  Homolog annotation: Hit_ID=UPI0000383B72; Match level="QueryCoverage =99%, HitCoverage=91%, E-value=1e-163, Identity=57%"; Hit description= COG0028: Thiamine pyrophosphate-requiring enzymes [acetolactate synthase, ...
  Homolog annotation: Hit description=pyruvate dehydrogenase (cytochrome), glyoxylate carboligase, phosphonopyruvate decarboxylase]
  Pfam annotation: Domain name=TPP_enzyme_C; Domain location=365-516; Score=84.3; E_value=3.7e-22; Accession=PF02775.11; Description =Thiamine pyrophosphate enzyme, C-term
  Pfam annotation: Domain name=TPP_enzyme_M; Domain location=152-294; Score=44.6; E_value=3.3e-10; Accession=PF00205.12; Description =Thiamine pyrophosphate enzyme, centra
  Pfam annotation: Domain name=TPP_enzyme_N; Domain location=3-141; Score=28.9; E_value=1.7e-10; Accession=PF02776.8; Description =Thiamine pyrophosphate enzyme, N-term
  Pfam module annotation: Pfam domain module=TPP_enzyme_C::TPP_enzyme _M::TPP_enzyme_N; Domain location=365-516::152-294::3-141
MVALLRNPDINYVLALQEASAVVMPDGYAQAAGKPGFLNLHTAGGLGHGMGNLHTAVCSQTPLVVTAGQQDLRHSITDPLLLGDLVSMGKIFSKWSKEVTSVDQLPILVRRAFHDADAAPKGPVFLSLPMDVMEAMSAVNIGAPSNVDRKAVAGSLPLLAKKLAAFTPGKVAIIPGDEIHQSGAAAEVVALAELLAADVYGSTWPNRIPYPTAHPLWRGNLSTQATDIAKALDQYDGIFALGGKSLITILYTEGRAVPEHCKVFQLSADAGDLGRTYRSELSTLGDIKLSLAVLLPELKEATAHNRPDYQRRFAAAAAQFEQTKENLLQSVQEQQSATKITPLIAAFEAARAIGPDITIVDEAIATSQSLRRSLSSNRADQYAFMRGGGLGWGMPAAVGYSLGLGKAPVVCFVGDGAAMYSPQSLWTAAHEQLPVTFIVMNNTEYNVLKNFMRSKEDYTSAQTNRFIAMDLVDPVIDYQALGTALGLKTRKIEVASQIAAAVEEAIASGKPSLIEIVIAKN

SEQ ID NO: 143346 - protein, 164 aa, Glycine max
  Coding DNA Sequence Number=SeqID_26568
  Gene Ontology: Mol. function=transcription factor activity; Biological process=regulation of transcription, DNA-dependent
  Homolog annotation: Hit_ID=Q4IVE6; Match level="QueryCoverage=89%, HitCoverage=47%, E-value=5e-26, Identity=39%"; Hit description =Regulatory protein, LysR:LysR substrate binding domain
  Pfam annotation: Domain name=LysR_substrate; Domain location=2-164; Score=23.1; E_value=2.4e-05; Accession=PF03466.10; Description=LysR substrate binding domain
MGLSKLGATMYASYSVVPQLVMKHRMNYPSIDLQFQEMIPTGLNAALEDGRLDVAISFSEVTSSAINSLVLLREPLIVALPADHPQANVENFTLETLANDPFIIVPRPMSPLLYDRIFNQCLKAGFSPHIGVEVSVQQTIVNFVAHGLGRWNTLLTNAVPSQRS

SEQ ID NO: 143347 - protein, 212 aa, Glycine max
  Coding DNA Sequence Number=SeqID_26569
  Gene Ontology: Mol. function=RNA methyltransferase activity; Biological process=RNA processing
  Homolog annotation: Hit_ID=Q9AUK9; Match level="QueryCoverage=60%, HitCoverage=39%, E-value=8e-27, Identity=51%"; Hit description =Putative RNA methyltransferases
  Pfam annotation: Domain name=SpoU_methylase; Domain location=75-205; Score=58.3; E_value=2.5e-14; Accession=PF00588.9; Description=SpoU rRNA Methylase family
  Subcellular localization annotation: CTP_CleavageSite=49; ConfidenceScore=5.00e-01
MMLTNGTNNRRLGNLSSHGKVFKGLYSSISSLNMTQACIVWVQKKELVSREHENRRGNKGKTTIVGGSIKEHLWKEQVAAEEDGVFLLPGCCDPFNEKALRASRGASFQLPVVSGSWNHLESLKKEFQMRFLAGHPEHEGLVKPVSSLSPSFCDSLSDTPLCLVLGSEGSGLSEKSLQTCELVSIAMTGEYESLNVSVAGGIFLYMLQPKNT

SEQ ID NO: 143348 - protein, 94 aa, Glycine max
  Coding DNA Sequence Number=SeqID_26570
  Gene Ontology: Mol. function=RNA-directed DNA polymerase activity; Cellular component=intracellular; Biological process=RNA-dependent DNA replication
MPGLSSDIVQHKLPLNPECSLVMQKLRRMKLEMSLKIKEEVKKQFDAGFLAIAQYPEWVANIVLIPKKDGKIKMASEDMEKATFITLWGTFCYK

SEQ ID NO: 143349 - protein, 53 aa, Glycine max
  Coding DNA Sequence Number=SeqID_26571
MRPYRGSTHNNSRSMRATIRRGIAKFEAVLHKWVRNTGYRLRFFFVRGVMRPD

SEQ ID NO: 143350 - protein, 55 aa, Glycine max
  Coding DNA Sequence Number=SeqID_26572
MGRWKAERSTGDRRSPVEHGFLLFLSQEEPSCPRWSTGILVILVHCSDQPWPSDG

SEQ ID NO: 143351 - protein, 64 aa, Glycine max
  Coding DNA Sequence Number=SeqID_26573
MELMVSFELLKGDLEVADELMHIPCPCAKYLWMKDEGIVYQHLLSQTALRKQKSLCRHGYECCL

SEQ ID NO: 143352 - protein, 36 aa, Glycine max
  Coding DNA Sequence Number=SeqID_26574
MEVLKGTIIAPNKIGLKIAKKYKEGMDSFQAHKRLT

SEQ ID NO: 143353 - protein, 44 aa, Glycine max
  Coding DNA Sequence Number=SeqID_26575
  Homolog annotation: Hit_ID=Q1S6L5; Match level="QueryCoverage=71%, HitCoverage=6%, E-value=4e-09, Identity=93%"; Hit description=Cell division protein FtsZ
MDVNTAAEVIYDLVDPTANLIFGAVIDPSLSGQDIDVLNGDNMG

SEQ ID NO: 143354 - protein, 261 aa, Glycine max
  Coding DNA Sequence Number=SeqID_26576
  Gene Ontology: Mol. function=RNA-directed DNA polymerase activity; Biological process=RNA-dependent DNA replication
MASLWHIMLRLITSMSDGCQENGSVFLCRTSTMRTLPGFVSKLQLDEFFNKLWASIESVIAQIYIEYVVQACLAFNVAMSCLGLICLDSHDLSCQGGELHLQARCGDDGSELVERFLANHKVNIASGLYSFSCEAKEWTDLRLDDVDGAALVDDDLGHHEVGDYNGDNHGIVDVNVPDGVEVMLARVARMPFVRESTHNGVDYTYVFLGGLSFPFLVVSLSSSIFCFVSSSIDIVVSVVILLVSSASRSCCMIVWPLHELG

SEQ ID NO: 143355 - protein, 167 aa, Glycine max
  Coding DNA Sequence Number=SeqID_26577
  Gene Ontology: Mol. function=ribonuclease H activity; Cellular component=mitochondrion; Biological process=RNA-dependent DNA replication
MKGNEEGIILEGLDSVALEQALKLNFKASNNQVEYKALIVGLKLTKEFRAKKLRCYTDSQIVQLQVAYRYHTKKTILLKYYHIAKTLIDDFKCFEMYYISRERNTRVVLLSKLTNTKKTGHLKTIMQETLQSPTIDIEEVMAGEEEESDWMTLQEFPNSWGIATKLE

SEQ ID NO: 143356 - protein, 228 aa, Glycine max
  Coding DNA Sequence Number=SeqID_26578
  Gene Ontology: Mol. function=RNA-directed DNA polymerase activity; Cellular component=intracellular; Biological process=RNA-dependent DNA replication
MCTNYTNLTKTCPKDAYPLPNINRLVDGASRFQVLSFLDAYSGYNQILMHAPDEEITTFITEDANFCYRVMPFGLKKVYVDNMFVKSHSIAQHVIGLEEVFREICKYDMLLNPKKCTFRVGGGKFFGFMITHRGIEVNPDKCTTILEMYNPTNIQEVLNLNGRLASLSRFLPKLAKKAKSFYKLLKKTESFPWDENCEQAFLAFKKTIATPPVLSDLGQEYPYSYLSR

SEQ ID NO: 143357 - protein, 114 aa, Glycine max
  Coding DNA Sequence Number=SeqID_26579
MQFWSCWRMSISIMVVGGGLESLKGISRLRLDCMLTMGEKGKLRGMFYRGPTVDTKCTYQSSELAHVRVDVAKESMSEHEKNMREPGTYSVEWKLRVLVCKGCYSDITTLADSF

SEQ ID NO: 143358 - protein, 41 aa, Glycine max
  Coding DNA Sequence Number=SeqID_26580
MTRSRMNDDEAIHAIPISFCIPDNYYIDWDDDIDSPTKEAN

SEQ ID NO: 143359 - protein, 146 aa, Glycine max
  Coding DNA Sequence Number=SeqID_26581
  Homolog annotation: Hit_ID=Q84VH5; Match level="QueryCoverage=93%, HitCoverage=29%, E-value=2e-20, Identity=79%"; Hit description =Envelope-like protein
MVDIDVSEHQIAKEITAKQVQHWPKKGKLSAGKLSVKYASLREDWSCKLGSHQSYFHCCHRENLLYPCITNCLRGTHVPDIVSTSGKAAASGAVSKDALIAELKDTCKVLEATIKAPTEKKMELERLIKRLSDNGVDFSPTPRGRS

SEQ ID NO: 143360 - protein, 94 aa, Glycine max
  Coding DNA Sequence Number=SeqID_26582
  Subcellular localization annotation: CTP_CleavageSite=62; ConfidenceScore=5.09e-01
MTSRDQVWSFCTLVSSRGGGPDDTRKYPSETDIVFCTFCSSGNNKSFTCGNFMVARDSRQPRGAKLVSYTDFRGPLLDDMRPFFGPCEVLGTHH

SEQ ID NO: 143361 - protein, 52 aa, Glycine max
  Coding DNA Sequence Number=SeqID_26583
MSKSFEFGMTGSLDESISCFLIRMDPRVLVPWSSENYTPRQQRVARPHLKRT

SEQ ID NO: 143362 - protein, 110 aa, Glycine max
  Coding DNA Sequence Number=SeqID_26584
  Subcellular localization annotation: CTP_CleavageSite=53; ConfidenceScore=5.48e-01
AFSLQKLPQQHIATTTKTLSSSQTQIPPHQHDATPTMSSSSTMPLSSDPLFLCADEAAIVGLLDVEPHHMPEKDYLRRCRDRSINATAVGKGSAFAPGLFAVKVVSPKNS

SEQ ID NO: 143363 - protein, 142 aa, Glycine max
  Coding DNA Sequence Number=SeqID_26585
  Gene Ontology: Mol. function=Rab GTPase activator activity; Cellular component=intracellular; Biological process=regulation of Rab GTPase activity
  Homolog annotation: Hit_ID=Q2V9A9; Match level="QueryCoverage=99%, HitCoverage=36%, E-value=4e-66, Identity=85%"; Hit description =RabGAP/TBC domain-containing protein-like
MDQFFQDTEIIEQIDRDVKRTHPDIDFFSGDSHFAKSNQEALKTILIIFAKLNSGIRYVQGMNEVLAPLFYVFKNDPDEENAAFAEADTFFCFVELLSGFQDNFCQQLDNSICGIRSTITRLSQLLKEHDEELWRHLEVTTE

SEQ ID NO: 143364 - protein, 166 aa, Glycine max
  Coding DNA Sequence Number=SeqID_26586
  Subcellular localization annotation: CTP_CleavageSite=33; ConfidenceScore=5.52e-01
MNVGALISGQITSMAQSNSSTLGFPALITTLCRSRGVASNSLVFERLSPVINLAYIRKNCWIPTDLAVTIRGARRARARPAKALSTSATPPLARTSAAPSTPSSTDFQRLEAMCHTQISSGDYYLMTCNLWLAALRYLASFVAQKMKSRDVSEIKRKQAYAIREIP

SEQ ID NO: 143365 - protein, 92 aa, Glycine max
  Coding DNA Sequence Number=SeqID_26587
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=99%, HitCoverage=20%, E-value=1e-39, Identity=66%"; Hit description=DNA -directed RNA polymerase beta' chain
MAVHVPLSLEAQAEARLLMFSHTNLLSPAIGDPISVPTQDMLIGLYILTSGNRRAYQQKRINFDSPLWLRWRLDQRIISSREVPIEVHYESL

SEQ ID NO: 143366 - protein, 180 aa, Glycine max
  Coding DNA Sequence Number=SeqID_26588
  Gene Ontology: Mol. function=pyridoxal phosphate binding; Biological process=carboxylic acid metabolic process
  Homolog annotation: Hit_ID=Q6D4Z6; Match level="QueryCoverage=97%, HitCoverage=34%, E-value=3e-87, Identity=89%"; Hit description=L-2,4- diaminobutyrate decarboxylase
MTAMSKLNPILASSAHSAEAYRQAIAQSSEAVVQWLQQPEMYQGKSVAELRERIKLDFTPQGLGNQAAIDRAIEYFLKDSLSVHHPQCVAHLHCPSLVISQAAEVLINATNQSMDSWDQSPSATLIEMKLIEWLRAQVGYQPGDAGVFTSGGTQSNLMGLMLARDAFFARQGHSVQQDGL

SEQ ID NO: 143367 - protein, 86 aa, Glycine max
  Coding DNA Sequence Number=SeqID_26589
MKEVAESLKEFVEVTKKKMENRKKMEIKEAQEVVHEVVSELDNIPNFNGALRHRAIDWLTENPIKFAIIKALPLDEKEDYILSFMP

SEQ ID NO: 143368 - protein, 440 aa, Glycine max
  Coding DNA Sequence Number=SeqID_26590
  Gene Ontology: Mol. function=nucleic acid binding; Cellular component= intracellular; Biological process=DNA integration
NGVVERWNCTLKDMVRVPSKAVPKTPYELWTGRKPNLRHLHVWGCLTKVKVHNPHERKLDARTVSGFFIGYLEKSKGYIFYCPNHITRIVESGNVSFIDNDNEQVTNEQEIEEAQEIAPRRFERKKRPAISSDYVVYSLEHECELSIDEDPVSFRQAMEGDYFEKWLNAMKEKLKSMDDNKVWDLVEFPEDCIDYKETFSLVSKKDFLRIILALVAHYDLKLHQMDVKTTFLNGDLQEKVYINQPKGSGAMESAKQSVIVTSTMEVEFVACFEANIQALWLQNFTSGFGIIDSIARPLRIYCDNSTIVFFSKDDKYSKGAKYVDLKYLSIKKEVQKHKVLIEHIGTNLMIANPLTKGLPPKIFVGHVERMGVVDKSLLTISFIFLQQLLSKSFVLSLATAFAGNLRTCLAAGGGFCCRWWFLVTASVVSGDCIGKEEEKE

SEQ ID NO: 143369 - protein, 242 aa, Glycine max
  Coding DNA Sequence Number=SeqID_26591
MGEVEEVQEQMKANTEALKEQMATMMEAMMSIKEVNVAAIASTSTIAEVGLSALSGLNQMNHPTSDMVGKDLGSTGGPHDVKIQNEHAFSPYGLPPNYTPSNVAYTPSEDVNNSTPILIESQQPQSDHAHVSQPMGETHEMPHHNLADFEPCLGYATEGQAVDGVPRQNTLEGPQYHPQPHPLHYTLGKNPHAMAEMGELDHLEERLRDIEGGEDYAFANLEELFLVPNIITPPKFTVLDFD

SEQ ID NO: 143370 - protein, 123 aa, Glycine max
  Coding DNA Sequence Number=SeqID_26592
  Gene Ontology: Mol. function=unspecific monooxygenase activity
  Homolog annotation: Hit_ID=O04892; Match level="QueryCoverage=62%, HitCoverage=24%, E-value=3e-14, Identity=51%"; Hit description =Cytochrome P450 like_TBP
GPAAGRAPHVAWCPVRPRRPLKIRRTECLPRPVVLITASGLQGEQPLVDGTIPEPVGCRWTARAASAARAGRRVPVGGRIGNGPFGASSPGVEQSTQNCALNVKVKKFNQARVNGGSNYDSLK

SEQ ID NO: 143371 - protein, 261 aa, Glycine max
  Coding DNA Sequence Number=SeqID_26593
  Gene Ontology: Mol. function=site-specific DNA-methyltransferase (adenine-specific) activity; Cellular component=mitochondrion; Biological process=DNA methylation
  Homolog annotation: Hit_ID=Q5PES3; Match level="QueryCoverage=92%, HitCoverage=85%, E-value=1e-80, Identity=61%"; Hit description=DNA adenine methylase
  Pfam annotation: Domain name=MethyltransfD12; Domain location=24-260; Score=238.4; E_value=1.5e-68; Accession=PF02086.6; Description=D12 class N6 adenine-specific DNA methyltransferase
MQGSWRTEKRPLQRGRPMKTILKWPGSKAGVMTELAAHLPAGDRLVEPFAGSCAVMMNTDYPEYLVADINPDLINLYQQVKEHARPFIVLAASLFNQNTSEESYYRLRDEFNNSASMPLLERAAHFLYLNRHGYRGICRYNRRGGFNVPYGNYAKPYFPLAEIEAFAVKAQRATFICAGYQETLTMIKGGDVVYCDPPYYGTFADYHTAGFDDDDQCSLVCYLLGIADRNPVVLSNSDTLFTRSILRDFTITRINTARSMA

SEQ ID NO: 143372 - protein, 212 aa, Glycine max
  Coding DNA Sequence Number=SeqID_26594
  Gene Ontology: Mol. function=transmembrane receptor activity; Cellular component=integral to membrane; Biological process=signal transduction
  Homolog annotation: Hit_ID=Q02755; Match level="QueryCoverage=91%, HitCoverage=35%, E-value=4e-45, Identity=50%"; Hit description =Methyl-accepting chemotaxis citrate transducer
  Pfam annotation: Domain name=TarH; Domain location=44-181; Score =103.2; E_value=7.9e-28; Accession=PF02203.6; Description=Tar ligand binding domain homologue
MLKNLHVITGIIFALTIFCLLQVVTGGLFYSAVSNDRHNFQNSGVLNAQQENLSDSVNTLVKTRVTVTRVAIRYLKNQRDPASLAAINKLLDTASNSLAKAETYNKQWQALPQVNGQNAALTDEMLKSWNQMHEVMRLSIEYLRADNYQAYGDLDAQQAQDAMKAVYNRWRAENNTLLKAATEENQSSFTQMQWTLAAIFLAVIAALVVIWQ

SEQ ID NO: 143373 - protein, 85 aa, Glycine max
  Coding DNA Sequence Number=SeqID_26595
MRIKRSFKVVMGPRTRLVVSFKTRKGKQGSKGLSKELIQGKSIWLEAYKNKIASIISKYACELGRINKNQAKAIVQAINGAKHTK

SEQ ID NO: 143374 - protein, 235 aa, Glycine max
  Coding DNA Sequence Number=SeqID_26596
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=1e-25, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=59; ConfidenceScore=5.43e-01
MSSPSEEYTSSPSEDYTYSPQRTSRPHLQRTTRPRLQRATRPRLQRTTCPHLQRSTCTRLQRATRRRLQRTTRPDLQRTTHLAIRGLHVLTFRGLHVLSFRELHGLAFRGLHVLTLRGLHVPTIRGLHILNFRGLHIHDFRGLHILTFRGLHALTFEGLHILTFRGLHVLTFRGLHALAFKGLHILGIKGRIPSPSEGCTHSPSDDYTSSSLEGSSSSPSEDYTSSPSEGYTPSP

SEQ ID NO: 143375 - protein, 71 aa, Glycine max
  Coding DNA Sequence Number=SeqID_26597
MSELREIPFAPYLSLFPQKRKTVSVKLQSREKNESHEDSTNGDFNLFSVSLTFGNSIRAVGGKTERILGNR

SEQ ID NO: 143376 - protein, 92 aa, Glycine max
  Coding DNA Sequence Number=SeqID_26598
MVHDIFVKVKLEVTRTSTILNMFGSRRSSDVTQFIFAPICRTKWVYDPNIVGSWCLTHATKKENARMSKHENKWYAILQIKKFVERICMMMP

SEQ ID NO: 143377 - protein, 88 aa, Glycine max
  Coding DNA Sequence Number=SeqID_26599
MMHAPDLNSQMQCGTYRIQYQGNSPKRVYTTPHLGNHEVFVEATQSSTVTPPLGDQPGPTRSSLPGDTPPSTKYILPQCILFPMSYEV

SEQ ID NO: 143378 - protein, 192 aa, Glycine max
  Coding DNA Sequence Number=SeqID_26600
MTRTSLTASSEMKNPMIGPPLIIQFIAAFNNDKNTIQLPAFYHTQWAPQYPEFVHMRYNGAIYEIRVRQHKEKVYLADGLENFRKDLKIYESTTINFFACDHHFVFDIHFIPPLERQTCGRQRHSSRKHIWTLRLTQQMLDSPEPLKRPRCTEVPLKACGNHMTLLRRHGPPLQWKVETLNPAIGGKGVLQP

SEQ ID NO: 143379 - protein, 483 aa, Glycine max
  Coding DNA Sequence Number=SeqID_26601
  Gene Ontology: Cellular component=membrane
  Homolog annotation: Hit_ID=UPI00005F87AB; Match level="QueryCoverage =99%, HitCoverage=90%, E-value=1e-146, Identity=56%"; Hit description= COG3515: Uncharacterized protein conserved in bacteria
  Pfam annotation: Domain name=ImpA-rel_N; Domain location=17-78; Score= 95.1; E_value=2.1e-25; Accession=PF06812.2; Description=ImpA-related N-terminal
MISQRIREEVNKLSGIDTGLICTLAEKLLTTTAKDIRIATCYCWARLHQDGETGFAEGLELLAGLLQRYSAQLHPQRERSRKPALEWLAGSRVLDSLSLWPEVVREDALRTAGALLLICDSLETEPEASRPEMTALYSALVSRLMKAGGVDAVVPQNAGHRVQSQTSHTTGPDAPVLSRITSGQDLLAQARTLTEYLREQPDGWLAAHRLMKSLRHDTLRAIPAPDAEGKTRIAPPRADERAMLKRLYLQQSWLEILEQADSTFSRGANHLWLDLQWYIHQALVKLGQDVLADIITADLKGLLRRLTGLETLAFNDGTPFADEVTLNWINQSVLDDMSGWRDEPVCAGNGEDNDILTLEPEALEKADTDGLDAALHWLQTRPGTDATKDKWLLRLLMARIAEQKGKNELALHLLGELDSTAQSITLTQWTPALLFEVKSRRLRLLRMKASRSETDRSRLQPEMDLLLSGLIALDPASSAVLCG

SEQ ID NO: 143380 - protein, 77 aa, Glycine max
  Coding DNA Sequence Number=SeqID_26602
GISACYQTLESDGKNETFSRSRPEDADIFGKGADDDVRITIRYLCMSSDSSSLDDKGADDDVSICVSDAILPRNRMS

SEQ ID NO: 143381 - protein, 334 aa, Glycine max
  Coding DNA Sequence Number=SeqID_26603
  Gene Ontology: Mol. function=siderophore-iron transporter activity; Cellular component=membrane; Biological process=siderophore transport
  Homolog annotation: Hit_ID=Q0JY22; Match level="QueryCoverage=92%, HitCoverage=42%, E-value=1e-125, Identity=71%"; Hit description =Outer membrane receptor for Fe(III)-dicitrate precursor
  Pfam annotation: Domain name=TonB_dep_Rec; Domain location=59-210; Score=51.5; E_value=2.8e-12; Accession=PF00593.14; Description=TonB dependent receptor
YQYRTGGTTAHAVYIDDTINVGNWTITPGVRYEFIDSFLNDKSNPAARTHTSIKSEEPLPSLSVVYHVSEQWSVFANAGQSFGPLQYFQIASTTNGLHPEKATTYEVGTHFNGGGWKGELTLFNIDFDDELQLRGGTNGGSDAWTNLGATRHRGLETGLSYDLGELSTALSGLSLYGTYTYTQATYKAGVFEGRDLPFYSRNVASLGARYTRNQWTFNVDTFPAVQAAVARRARSRRPLPDRGKRQRRLRRHPGLRHGARARRLRLRQTDAQPEHRAGGEEPVRQALLHALHRQQRGQVRGHAAHGVPAGVAGVLIGRRRVRRPFGACAGGTAG

SEQ ID NO: 143382 - protein, 174 aa, Glycine max
  Coding DNA Sequence Number=SeqID_26604
  Homolog annotation: Hit_ID=Q6K8X6; Match level="QueryCoverage=41%, HitCoverage=9%, E-value=5e-09, Identity=46%"; Hit description =Putative response regulator 9
  Subcellular localization annotation: CTP_CleavageSite=41; ConfidenceScore=5.42e-01
MYALKLGLSTTTYNVVNKMIRPPLVRLRRFAASLALAKMLRAFTTKRGLENKVRIFKIEAFGSPRFDLCTRTLFSHLGMLLLPLLAQYGCGKPKGRWDCDHFPMGMHVLAVDDNSICLKVLENLLCKCQYHSFKIKKTKIDDVEMPVLMWLVTRRDDVTLCLSHHHLTDADGRY

SEQ ID NO: 143383 - protein, 35 aa, Glycine max
  Coding DNA Sequence Number=SeqID_26605
MSNGLLAISVVAAHTLDKNMVEANSPSNRAMVFVY

SEQ ID NO: 143384 - protein, 137 aa, Glycine max
  Coding DNA Sequence Number=SeqID_26606
MPQHAYLIRAGNFDTLVIMVIARDVTDKALQGVNRVNDITVQAPHDQAAGQGCGQDSNSDKAIAIQPVLADVLDAGFVGDVADKMRTQAVVVATKGKDDKDQQHAQGHHQFGEYQTQCLPVLLRSGVVRTGSACPAH

SEQ ID NO: 143385 - protein, 296 aa, Glycine max
  Coding DNA Sequence Number=SeqID_26607
  Gene Ontology: Mol. function=signal transducer activity; Cellular component=membrane; Biological process=signal transduction
  Homolog annotation: Hit_ID=Q1LL52; Match level="QueryCoverage=97%, HitCoverage=66%, E-value=5e-29, Identity=28%"; Hit description =Diguanylate cyclase
  Pfam annotation: Domain name=GGDEF; Domain location=195-296; Score =31.3; E_value=2.2e-09; Accession=PF00990.12; Description=GGDEF domain
  Pfam annotation: Domain name=HAMP; Domain location=106-176; Score =53.7; E_value=6.1e-13; Accession=PF00672.15; Description=HAMP domain
  Pfam module annotation: Pfam domain module=GGDEF::HAMP; Domain location=195-296::106-176
MNVVANSIGPAVMFGEVSSAAKTLEPLTDNQNIRSIIILNQQQKPLQSLHPEHPRAPAVSQWLYPYFHDMEVETPIIVNEKTVGTLHATVKQEQIVDVLIGFAWSNAIAVLAAALTGCLIMWRLNRNIVDPIHALQSFVSNITRNHHYDQRVKITSADEIGMLGHDINNMLESIRQRDTQLQTELEHRKIIEEKLQFLAHYDKNTQLLNRHAFEEAITRKITATPDDRKHVYLLLLDLDRFKIVNDSFGHGTGDKLLQQVAHRLRGNLSQKDAIFRLGGDEFAILLDASGRPAIEQ

SEQ ID NO: 143386 - protein, 65 aa, Glycine max
  Coding DNA Sequence Number=SeqID_26608
QGVPFESTLVNDWKYVYSSHDTRKMVCIDHADMIGRLLARCTNLAQASEEDLLLLWALQTDRPIN

SEQ ID NO: 143387 - protein, 90 aa, Glycine max
  Coding DNA Sequence Number=SeqID_26609
  Subcellular localization annotation: CTP_CleavageSite=52; ConfidenceScore=5.33e-01
MDHFKVQRLKRPPSKLRESLDSPFRKNYIGLISSSMKVFLTFSTNKRWWRLRAFSSFGRCTREPRLARPQKDRLRQLATPLGTVCELGLF

SEQ ID NO: 143388 - protein, 410 aa, Glycine max
  Coding DNA Sequence Number=SeqID_26610
  Gene Ontology: Mol. function=extracellular ligand-gated ion channel activity; Cellular component=membrane; Biological process=transport
MNHSKSNDTSIDIEPSNRRVSFAENHPNEQEPPHHHQPYNNSIPLLLQPSYARSKSIIFDELRNFRISLKWCALDHSSFIGRLISYVTFIFFTIVVPLFTSIFVEVPASAPEDDPISFNKLVQLPESGLAIVAFFTLSSFFKRYGLRQLLFLDALQEDTTYVRRGYTRELEKAFRYLTYIILPSFFMELAHKIIFFSAVKISAPHISPGFPLNSIVFVLVLVSWVYRTGVFLLVCVLFRLTCELQKLRFEGVHKLFEGCGSEAGVIFKEHVRIRRQLWVTSHRYRFFIIGCVVTITVSQLGALLLVLASKSDKTFFNSGDLVICSAVQLSGFFLCILGAARITHRAQGIVAIATRWHMLVTTASAESEHCEAQVSEGLASDDDSDSDDSSNIHVSVIPPQLSSFQTRQTL

SEQ ID NO: 143389 - protein, 87 aa, Glycine max
  Coding DNA Sequence Number=SeqID_26611
MVVYTICRRLNVCQPRLLKSPLFIQREASPLTSKDQHGRLHPLSKTQCLSTETTEVSPHHPKASELIDTQRPTWLSAPFVEDSMSVE

SEQ ID NO: 143390 - protein, 92 aa, Glycine max
  Coding DNA Sequence Number=SeqID_26612
MAKFDPEIVMEFYANAWPTKEGGQQCKYNQRKREVSSFDEENIAQLLYIPGQDFAQTTAGRRVPRILLGKPLKVFKSLPKSQETHPPWKMQP

SEQ ID NO: 143391 - protein, 214 aa, Glycine max
  Coding DNA Sequence Number=SeqID_26613
  Homolog annotation: Hit_ID=P49351; Match level="QueryCoverage=31%, HitCoverage=19%, E-value=2e-27, Identity=83%"; Hit description =Farnesyl pyrophosphate synthetase 1 (FPP synthetase 1) (FPS 1) (Farnesyl diphosphate ...
  Homolog annotation: Hit description=synthetase 1) [Includes: Dimethylallyltranstransferase (EC 2.5.1.1); Geranyltranstransferase (EC 2.5.1.10)]
  Pfam annotation: Domain name=Mlo; Domain location=6-212; Score= -367.2; E_value=0.047; Accession=PF03094.6; Description=Mlo family
  Pfam annotation: Domain name=polyprenyl_synt; Domain location=1-163; Score=-100.8; E_value=0.0067; Accession=PF00348.8; Description =Polyprenyl synthetase
  Pfam module annotation: Pfam domain module=Mlo::polyprenyl_synt; Domain location=6-212::1-163
MSGGGEEGATLEFTTTWVVAAFCIVIVAISLTAERLLHYGGMFLKARDQKPLYIALCQWKHWEDSIAKQNYETDRDKPDLSRCSLKYKAFGYLDCFGDPQTIGKIGTDIEDFKCSWLIAKALELSNEQQKKVVQENYGKPDPENVAKVKALYNELNLQICLTYCSVGPKLPNVRRRPNESGVCSSYSRTRGDTSPPKKFSYMHIKVVGVGDNIL

SEQ ID NO: 143392 - protein, 160 aa, Glycine max
  Coding DNA Sequence Number=SeqID_26614
MGEVEEVQEQMKADTEALKEKMATMMEAMMSIKEIMEVDMEAMKEQMATMMEAIMSMKKIMEANAVAVAATSAVAKVNPMPPSGLNQMNHPTSARVGKDLESTGGPHYAQIQNKQAFPPYGWPPNYTPPNVAYTLSEDVNNSTPITIESQQPQTDHAHVS

SEQ ID NO: 143393 - protein, 40 aa, Glycine max
  Coding DNA Sequence Number=SeqID_26615
MASIIVAIFSFKASVSAFICSCTSSTSPITLALAQVRTWG

SEQ ID NO: 143394 - protein, 155 aa, Glycine max
  Coding DNA Sequence Number=SeqID_26616
MDNHSWCYPACAQCHRKTDIQTGPFTCGCGKDKISLYRVEVMVTQNNENSKFLLWDRECAELIGETVDDVNRVKIEDGDLDLNASPQALDKLLGHVLAFKVRIQSKFKNAVVLRYSKDLDLINVVLKMLPYSETCSKIDPSNVDCNDATQVERVS

SEQ ID NO: 143395 - protein, 69 aa, Glycine max
  Coding DNA Sequence Number=SeqID_26617
MVDDNESAMQSIRGAPDLMVLVEDARTARQSICGAPDSMVEDIRFIGGGCTNSARQSIRGAPDSMVEDA

SEQ ID NO: 143396 - protein, 41 aa, Glycine max
  Coding DNA Sequence Number=SeqID_26618
MGFPLPAVIYPAENLSGIQVLAFVIRSPLRRFYCLFLRGKG

SEQ ID NO: 143397 - protein, 142 aa, Glycine max
  Coding DNA Sequence Number=SeqID_26619
KKRENGARLDAQKQAHILLLEKARAAQHEVERLTKEAKEGSFEVKACDDNISSWEATITDLLSQVDDIRQKIVTEQAKRKELQEKAANSIQKLVAEKGREGLKAFSASQAVADEARVMESADQVLTKEMATLKKLYEDLVMH

SEQ ID NO: 143398 - protein, 123 aa, Glycine max
  Coding DNA Sequence Number=SeqID_26620
  Subcellular localization annotation: CTP_CleavageSite=62; ConfidenceScore=5.05e-01
MMLPVHNKVTSTLAAEVLMVVCWIPNKAKKKRKMVISQRFLTPSSPKLAPSSHRLKILQITRLSELVPSALSKQLAWAGFPSTKWLFLLNRHAGEEKKESSSLKPQRKTQKEKKNWKSGAEAL

SEQ ID NO: 143399 - protein, 33 aa, Glycine max
  Coding DNA Sequence Number=SeqID_26621
MWLKGVKTPVVLSRNRDERAKRAYERAKQTMSH

SEQ ID NO: 143400 - protein, 407 aa, Glycine max
  Coding DNA Sequence Number=SeqID_26622
  Gene Ontology: Mol. function=DNA binding
  Homolog annotation: Hit_ID=Q1S0F5; Match level="QueryCoverage=53%, HitCoverage=42%, E-value=8e-25, Identity=34%"; Hit description=IMP dehydrogenase/GMP reductase
MDVLALLVFEIVLFPNVDRLVDLAAIDAFLAYHHSKESSVIAVLANAYDTFDLRCEKSSAIIVCCTPDLYVWLISHVFNHGSRSVYPLQGHHMCSRKDKANWEELLAGMTGASISWFPRWKEGGAGVLCSCEGFLNVPLMGTRGFINNNPVLAIRQLGYPMRGVPSEETITPFIARGFNKANTKILQKICKAWNKVGRKDKELRGRSNGVIGGYHKWLKSRTQGITWLKKLKGLNGEVAEVPEESEEVQALNDELKKTKVANENLKVAVTRVRKEYDKLKDINITAAEALEREMKKARKEEWCRNKFRGALLGNSNELKLRKAERDKSRMENVMLEDKLRNCQRSKGSLKEQLSKTEENMLIIIDKYKEKVNQAASHGQMLRDEQAKMSALRVEREAREEVIELLHK

SEQ ID NO: 143401 - protein, 63 aa, Glycine max
  Coding DNA Sequence Number=SeqID_26623
MDDQTIKCACALSAVLTQNTHVQLDGKWIKWIRAKPQVCTFSELACDNCIPLKLHCTKQLPSS

SEQ ID NO: 143402 - protein, 79 aa, Glycine max
  Coding DNA Sequence Number=SeqID_26624
MTSKAAKEIADKIDSLENQASQGSFIAHGRQDVLTAAIGRPKHPGHVCAIGAVSQSRTSCTSSSMAPEDLEQLTQQIKE

SEQ ID NO: 143403 - protein, 166 aa, Glycine max
  Coding DNA Sequence Number=SeqID_26625
MFQGSSKSSDMPPSTSIFPHEKLQEYPTWSLNPPCTYTTYIHHNDIISSQCHHQHQHHLIPISLSTPTLYHINIIINIISSQCHQHHKKSTSTYIYTNSCLRFIFPNDVVPCGAYRPWIFFINGVFCFLKINDSEWRRKKDDWRRHFKEKMRQEQAHHHKKLWIRA

SEQ ID NO: 143404 - protein, 101 aa, Glycine max
  Coding DNA Sequence Number=SeqID_26626
MPLSRDVHKEDEHSTTWMNLLSAGMLAKRVCINKRRSINEVGNLLRSKMLSEDWMQNARLKLEDAMHEFQKEEVAGKLLKYLGLRGIGLSANGSRLTQLNQ

SEQ ID NO: 143405 - protein, 145 aa, Glycine max
  Coding DNA Sequence Number=SeqID_26627
  Gene Ontology: Mol. function=peptidase activity; Cellular component =integral to membrane; Biological process=proteolysis
  Homolog annotation: Hit_ID=Q1H1P5; Match level="QueryCoverage=89%, HitCoverage=41%, E-value=5e-49, Identity=72%"; Hit description =Peptidase S49
  Pfam annotation: Domain name=Peptidase_S49; Domain location=1-109; Score=-0.1; E_value=3.1e-06; Accession=PF01343.9; Description =Peptidase family S49
MDGYGFTEVMKKVGVERRLMTAGSNKGMLDPFSPVNPKQQAFAQSMLDQIHQQFITVVREGRGARLKENEETFSGLFWNGEESIKLGLADAQGSAEYVAREVIKQADIVDFTYQDTVVDRFAKKLGASMAQELGLNAKSWLPTLR

SEQ ID NO: 143406 - protein, 199 aa, Glycine max
  Coding DNA Sequence Number=SeqID_26628
  Gene Ontology: Mol. function=molecular_function; Cellular component =cellular_component; Biological process=biological_process
  Homolog annotation: Hit_ID=Q04118; Match level="QueryCoverage=83%, HitCoverage=86%, E-value=6e-13, Identity=33%"; Hit description=Basic salivary proline-rich protein 3 precursor
MVIMRLLSSRGGKPDDMRETNYEAAGPMTCGEPFGPTLFHLLSSRGGGPDDMREPFGLALFHLLSSRGGGPDDMREPFGPALFTLLLSRGGGPDDMQKPFGGGPDDMREPFGPALFHLLSSRGGGPDDMREPFGPALFHLLSSRGGGPDDMREPLCPALFHLLSSRGGVPDDMREPFGPALLYLLSSRGGGPDGMRGTI

SEQ ID NO: 143407 - protein, 203 aa, Glycine max
  Coding DNA Sequence Number=SeqID_26629
MSRGSGELGDIRRAPGSQQIKGTKTTKQGGLWGLASCEFCVICGLWPLRDGSLVIDYQIVMAAQLIRDRVEMECLEGAWETLEGNTRCRFRGTIRFTATSLVHPDEPARTLQRTVELILPTPTPYRLVEPVQVIEVTSSEEDPEEDLAELPPEPAVDALDFLEGDEDPLLEVDSPEEVMSASEADSTEDGGPGEMAISGGSSS

SEQ ID NO: 143408 - protein, 248 aa, Glycine max
  Coding DNA Sequence Number=SeqID_26630
  Gene Ontology: Mol. function=electron carrier activity; Cellular component=periplasmic space; Biological process=electron transport
  Homolog annotation: Hit_ID=Q7VXZ1; Match level="QueryCoverage=68%, HitCoverage=71%, E-value=1e-63, Identity=66%"; Hit description =Probable cytochrome C
  Subcellular localization annotation: CTP_CleavageSite=12; ConfidenceScore=5.04e-01
MASPFATVPACVASGSAARGDCRHQAQRAGRTLVFTPQAQLFGEVGGGLARQAWEMIAHPDAAGAVALVAGGYVSVPGATNGEPGAHVGGLGRLLRGGGQAVGVQGGGQRGVEPRHGLALRRLQCLGDGCHDGTDARAVGDGLKLFLQIGRASACQSRKAGDRIAFSLGAVAEHTGGRAVGAPGADEQCVRRAMNRAGHYGKHTGEEDRHARPSGAGQKAGGHEEERCRRFWLDYISKDDDIEPLCTK

SEQ ID NO: 143409 - protein, 148 aa, Glycine max
  Coding DNA Sequence Number=SeqID_26631
MDALEIYLNEVERQLDRKWSTVPRDVEIKEVRVQVPLACASSSKVIAPLVVVPNNNEEEQHNNESMIHHKPIVEEPQEVALRRSQRERRPAILNDYVNCQRAVSELVVSRSSRLNVNFMVTLNVTRLDLLLRNLLRKIDYKEAFSPVL

SEQ ID NO: 143410 - protein, 151 aa, Glycine max
  Coding DNA Sequence Number=SeqID_26632
MGEIHEIPHHNLADFEPRLRYVTEGQAVGGVPLPSTLEGPQFHPQPQPLHFAVGRVPPAMVERKKLDHIEERLWAIEGGKDYVFVNMEKLLLVPNMAIPRKFKTLDFDKYKGTTCPKNHLKMYCWKMGVCAKDEKLLMHFFQESLTGAIIT

SEQ ID NO: 143411 - protein, 102 aa, Glycine max
  Coding DNA Sequence Number=SeqID_26633
  Gene Ontology: Mol. function=transferase activity; Biological process= DNA integration
  Homolog annotation: Hit_ID=Q1T010; Match level="QueryCoverage=99%, HitCoverage=7%, E-value=4e-28, Identity=56%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAACQAQWLDNIFGELKMKEKGAITLMVDNKSAINLAKHPVAHGRSKHIETRFHFLREQVTKGKLSVKYCPITVQVADIFTKPLKIDQFKELRSRLGVIKMQ

SEQ ID NO: 143412 - protein, 277 aa, Glycine max
  Coding DNA Sequence Number=SeqID_26634
  Gene Ontology: Mol. function=transferase activity; Cellular component= nucleus; Biological process=flavonoid biosynthetic process
  Homolog annotation: Hit_ID=Q94CD1; Match level="QueryCoverage=99%, HitCoverage=60%, E-value=3e-99, Identity=64%"; Hit description =Putative N-hydroxycinnamoyl/benzoyltransferase
  Pfam annotation: Domain name=Transferase; Domain location=1-277; Score=12.1; E_value=1.5e-11; Accession=PF02458.6; Description =Transferase family
FKCGGFVLGVNVNHCMVDGISAMQFVNAWGETARGMDLSISPVLDRTILRTRNPPKIEYPHHEFDEIEDVSNVTKVYEEEILYESFCFDPDKLELLKKMATSEDGVVKKCSTFEALTAFVWRARSEALGMHMDPNQQTKLLFAVDGRSKFVPPIPKGYFGNAIVFSNALCKVEELVNNPLSFSVGLVGKAIDMVTDSYMRSAIDYFEVKRSRPSLTATLLITTWTRIPFRSADFGWGKPFFFGPVTLPGKEVILFLSHNEESKSINVLLGLPASAMK

SEQ ID NO: 143413 - protein, 183 aa, Glycine max
  Coding DNA Sequence Number=SeqID_26635
MMITKDDDKGDEKKLNDQSKNNSSKSIRIQDSRRKFRVKNQDSRFKISRIKIKIQESREGLIKIRYILCGTSRGYIYLGLTENKREYISCGSVLVEGTSTRVSKRTREEGKRLTAMSHGRLHQRRVKNAFDKKVCLCKFNKGDLALKKGHQALKDNRRKWAPNYEGSFVVKKFFRRSPGARQH

SEQ ID NO: 143414 - protein, 80 aa, Glycine max
  Coding DNA Sequence Number=SeqID_26636
  Subcellular localization annotation: CTP_CleavageSite=66; ConfidenceScore=5.85e-01
MTSGTRHKSVMSVNGKSPNPSTTFNLSSRRSSFSLLFAAGGGPATDRSMGCTGRATLVGCGGCPSKAAGGVGGVKLGGKP

SEQ ID NO: 143415 - protein, 151 aa, Glycine max
  Coding DNA Sequence Number=SeqID_26637
MTRHGKRHEGLHRGRDAKNKVTFSELHNGNKTDGREITTFCTEINRPNSQKKSSVESPTVTTYPSAGRQRGAHGFVFQGRRTCGVATNVYLRKTLEKTKVWSTNLKCKRFRSCIYAWGRCRNLPFGGRATRDSRDACSTKGIRAESPPTFI

SEQ ID NO: 143416 - protein, 414 aa, Glycine max
  Coding DNA Sequence Number=SeqID_26638
MGSSQTPPLKKRFYQVRIKSLEVTSLQELGGLMGRLQQQAFRKAYDFQLVPTVKEFKEILGCPLEGRKPYIFSGFYPSMPRIDKTVRILAQELDRVKQNRNGVISIPRKYLEERAKALAAINTFLAFHHNKESPVVTILADIYDTFDWRGALLVESLTPFITRGFSDPNARVLQGVCKAWEVVQRKDRELRGSSNGTVSSYHRWLRAYTQGLDWLPKLRAAKEEEVEALEESEEVQALKAELEKAQVNEELRDINSATTKALEQETKRARKEEHDRNKFRRALWGNNNELKLQREERNQSRVEGMILKDELKTCLRSKRSLSQQLSETEENMLAIISKYKEELELATAHEHKVADEYAQVYAEKEARGRADMSALKDQMASMLGMKRLMESNAATAAAASIAAEVDPVFHPPQA

SEQ ID NO: 143417 - protein, 73 aa, Glycine max
  Coding DNA Sequence Number=SeqID_26639
  Gene Ontology: Mol. function=helicase activity
  Homolog annotation: Hit_ID=Q1SN45; Match level="QueryCoverage=74%, HitCoverage=3%, E-value=8e-15, Identity=69%"; Hit description=AAA ATPase
MYDAFRDAWTISERLTLGTTGTGMANLECVVLPPGNNNEAIPLEATVKTMPPLEHTADDKVFHINVLPIPPYP

SEQ ID NO: 143418 - protein, 185 aa, Glycine max
  Coding DNA Sequence Number=SeqID_26640
  Gene Ontology: Mol. function=helicase activity; Biological process =viral genome replication
  Homolog annotation: Hit_ID=Q1SN45; Match level="QueryCoverage=99%, HitCoverage=10%, E-value=1e-41, Identity=45%"; Hit description=AAA ATPase
  Pfam annotation: Domain name=DUF889; Domain location=1-185; Score =163.0; E_value=7.6e-46; Accession=PF05970.5; Description=Eukaryotic protein of unknown function (DUF889)
MRLQSNPSNHSSTHELIQFSDWLLDIGDGKLGQPNNVHCEITIPDEFLIMVFEDPIQAIVDATYPDLLQNYNNADFLQKRAILASTKDVVDKINDYVLSLIPGDEKEYCSADSVDKSDELLNPTFGVLTPEFLNTLKTSGIPNHKLRIKIGTPIILLQNLDQADGLCNGTRLIVTKLGTNVVEAE

SEQ ID NO: 143419 - protein, 73 aa, Glycine max
  Coding DNA Sequence Number=SeqID_26641
MGSMGVDALIILSLNLLCYAMCSLIGGLPIGNGAFCLCRAIEILGNNSRYRATNIKELWIGDDSEDFNCQTGD

SEQ ID NO: 143420 - protein, 326 aa, Glycine max
  Coding DNA Sequence Number=SeqID_26642
  Homolog annotation: Hit_ID=P45468; Match level="QueryCoverage=60%, HitCoverage=57%, E-value=9e-71, Identity=66%"; Hit description =Hypothetical protein yraQ
MTTGQQQRVELGRADMVNILVDFDFGFALFSLHGFARLHLNSDHFMARFGEGLGRQVWTLSAETQASRRRRDWLNSGDRSSLSVTTLAHGHNLNNTVGSASRPPRGIRYSVEYGTGHDPIRLTCTSGPLRLVETAAVPRRGAYRPVVRKMAALLWQSLHGRRNPFHRPLYSCQCRRFAVARRAGLRHGLFSRGVESRGARCGAGLAGTGADSAPLAAAPDGQQPAGGHAGRHRFWPAGHDVQLLCRAGDRRPAPGAGFKRRGDGVLAGESAAQSGNAGVYGLCARLAVCRHSAGGGWGDGAGDCHAGAAQRAGNRRCRAAVAARKP

SEQ ID NO: 143421 - protein, 45 aa, Glycine max
  Coding DNA Sequence Number=SeqID_26643
MSENFQGRLLSHTSRLRFLDNAAIVEENNIEQKDSQWRSATVTER

SEQ ID NO: 143422 - protein, 249 aa, Glycine max
  Coding DNA Sequence Number=SeqID_26644
MYFNGRVYKENDGVIFEGSKKAIQIKREISFNALKKKIGDKVKLENNEIICAIGCRFLVSGKYVALQICDDKVVEIMLESFQQQDQMSVLELYIEKDVAGGSMFHSANSLTSFGNNLSNNEAQPPRNVSDLHGDEDDDDDDYLVSNSYVEESLDEDDSIDGISDTDDEVTDMIQPVRIVHPAKGVQGIQNPFWNDALHYNNINRSHPDEEDICGLEMPSSFNVGQELYVGMDFNSKDAVNNAVKQYVMK

SEQ ID NO: 143423 - protein, 122 aa, Glycine max
  Coding DNA Sequence Number=SeqID_26645
MAIIHTGLTILREERRAARFTYSSNLGLPLNQLLQFFEIALFDSRHVEEKYSPPPPLDGTLNPILAPASSKREKRPYRGVEEGHGENSLQKKETPQEMVFEYGLEHLTLLKQLLWLMTKQLS

SEQ ID NO: 143424 - protein, 272 aa, Glycine max
  Coding DNA Sequence Number=SeqID_26646
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=1e-34, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MYLHLQRTTRPRLQRVMYLQLQRTTLPRLQRVIGLHALAIKGPHVFTFVGLHALTFRGPHVLTFRGLHALAIRGPHVLTIRGLHALAIRGLHVLTFRGLHALAIRELHVLTFVRLHALTFRGPHVLTFRGLHALAIRGSHVLTFVGLHALTFRGPHILTFRGLHALAIRGPHVLTFRGLHALTFRGPHILTFRGLHALAIKGLHVLTFVGLHALTFRGLHVLANRGLHALTFRGLHVLANRGLHALTLRGLHVLIFSVLHICTLREFKVLCP

SEQ ID NO: 143425 - protein, 212 aa, Glycine max
  Coding DNA Sequence Number=SeqID_26647
  Gene Ontology: Mol. function=transcription factor activity; Cellular component=nucleus; Biological process=regulation of transcription, DNA-dependent
  Homolog annotation: Hit_ID=Q1SCX0; Match level="QueryCoverage=77%, HitCoverage=75%, E-value=2e-29, Identity=47%"; Hit description =Pathogenesis-related transcriptional factor and ERF
  Pfam annotation: Domain name=AP2; Domain location=68-133; Score =148.0; E_value=2.6e-41; Accession=PF00847.10; Description=AP2 domain
MSSPFFQHADWGMLKEPNSDILFESFSSKGVDHDPFHDCLSFDMIDNSRDPQEESHHQVIEEAMKTKKKSYIGVRRRPWGRFAAEIRDTTRKGIRVWLGTFDSAEEAALAYDQAAFSMRGSSAVLNFPVKRVKESLQEMNYSGCSRGCSPALELKERHNIRRKLSSSSKAKTSKRKQDLEESSVVVLEDLGADYLEALLSTSADQSATSSTC

SEQ ID NO: 143426 - protein, 239 aa, Glycine max
  Coding DNA Sequence Number=SeqID_26648
  Homolog annotation: Hit_ID=Q9ZQR0; Match level="QueryCoverage=34%, HitCoverage=6%, E-value=5e-12, Identity=41%"; Hit description =Putative helicase
  Pfam annotation: Domain name=DUF889; Domain location=1-159; Score= -84.2; E_value=8.8e-06; Accession=PF05970.5; Description=Eukaryotic protein of unknown function (DUF889)
MLPNNEELKQFSHWLLDIGDGKIGQYNDGFSEITIPDEFLIKNYDDPIHAIVEATYPSLIDNYSDTNYLQKRVVLASKKEIVDKITTFSKFLSPITDNGCATTPNMFYSTMMARYISLGRAHNLNESVILRLVAGDKNTTFTVHIDGPAHHHSSLKPIIYRRRYIFIVDITDDMLQQNLPLTLPAAASKFVYGSKKSITIHHGLSKSTKWPLTIQHDIPAITQPWFNLIHEKNLRPGDE

SEQ ID NO: 143427 - protein, 101 aa, Glycine max
  Coding DNA Sequence Number=SeqID_26649
MTQMQFMNTGARETASFLDTTSWGSKVPNWKNGMQRVCSVPLFKGPIWERAKKVLVIIPKVVISLLMVSRGIILFKEHTAVVGTTSNNMFSKRKTLDEGSL

SEQ ID NO: 143428 - protein, 55 aa, Glycine max
  Coding DNA Sequence Number=SeqID_26650
MPQVAEWNLVNEDGVMKLRQSWTVKTFAKGLEFFRIVAVLAKNEGIPGSKVTIPP

SEQ ID NO: 143429 - protein, 233 aa, Glycine max
  Coding DNA Sequence Number=SeqID_26651
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=25%, E-value=1e-126, Identity=83%"; Hit description=DNA -directed RNA polymerase beta chain
  Pfam annotation: Domain name=RNA_pol_Rpb2_6; Domain location=1-233; Score=205.0; E_value=1.8e-58; Accession=PF00562.18; Description=RNA polymerase Rpb2, domain 6
MPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGDSF

SEQ ID NO: 143430 - protein, 96 aa, Glycine max
  Coding DNA Sequence Number=SeqID_26652
MVPSGVANYRNLPFGGGAKRPPSWAKAFVSKGENEWSRHQRLFKENVRKTKNMKQRESLRPWTLKQSFDFFEKRRESLRHWTLKRSQVIFDKKKRL

SEQ ID NO: 143431 - protein, 59 aa, Glycine max
  Coding DNA Sequence Number=SeqID_26653
MFDIPFRGLNSARKRTVFSGKCDELAKRACCAKRVHQYSLYSRAKPCFPRPSAIGCSIH

SEQ ID NO: 143432 - protein, 33 aa, Glycine max
  Coding DNA Sequence Number=SeqID_26654
MPKYNQTRLLQETFKVKQIEIASRLIQGQANKI

SEQ ID NO: 143433 - protein, 76 aa, Glycine max
  Coding DNA Sequence Number=SeqID_26655
MTYDRSNDGPVFTTTTLCTSLPFGLYFTAASHEKGASLIQFARDPTEHIIAFLAKPCHHGSVVGPAPDIQTKHFTP

SEQ ID NO: 143434 - protein, 593 aa, Glycine max
  Coding DNA Sequence Number=SeqID_26656
  Gene Ontology: Mol. function=structural constituent of ribosome; Cellular component=intracellular; Biological process=translation
  Homolog annotation: Hit_ID=Q9FN19; Match level="QueryCoverage=59%, HitCoverage=46%, E-value=2e-24, Identity=48%"; Hit description =Arabidopsis thaliana genomic DNA, chromosome 5, TAC clone:K8K14
MQALTNPKSDEGFGARSNMLNLIVVCAHEVEMRRELALELMLSLELKLALQGGGVHELHHHGLARRGRRGLRFMRGGVGPIVEKPGSHSTDRVSPIGTWWHNQANLAIGPAMHLARDDLIKPDHFLVNPTTQLVFKTHTRLFMLKKAQKQHCFESTLKKNLSLNHFSSSHSTLLFIFMLVVMPPHLKLSRHPPQAHRTKLVAPLHQVYDLPAAVTPESHFWPILLPLLSFLVRNRSRFSENMASISSAELNYLVYRYLQESEESYRLGHSSEFGKLHEKSLYSLHLNCFTGYLCYVTTAGFTHAAFTFGYEAGINKCSIDGNLVPSGALVTFVQKGLQYFEMEANLSNCDADLEEDFSFLQPLDLITKDVHELRQMISERRKKLQKERKKEFEKEHEGERVRVREKDRREREKEVEKERREREKEVEKDRREREKEVEKDRREREKEVEKDRREKEKEVEKDRREKEKEVEKDRREREKEVVKDRKKIENDKEREQQHGDQTVREMFVDHEDRVPVKLEENGAVGVASVHTIVPCPKMLLIGVFQGPEPMDISTTSTSQLCGIPSSDVTILEGHTSEVCACAWSPTGSLLASG

SEQ ID NO: 143435 - protein, 172 aa, Glycine max
  Coding DNA Sequence Number=SeqID_26657
MVRFDQVISGQMHGRSNSQIGLIMPPSPDWTDPIGRVTLVARAHGGEAHGLRLPSTGPSRRRDLEAEGIVGVELQHVASSAKAFVGFWVRQCLHERREREKEKERERGGGGGPGGNAREGENNGVERGQTSKRVEVARKKKNNEMLSSEMSPTTMDSGVHDGVLFEEDGGVS

SEQ ID NO: 143436 - protein, 49 aa, Glycine max
  Coding DNA Sequence Number=SeqID_26658
MDTWQHVIGDPMNGVQRLLMNPMTIIVGVGVTNHSLRIHLLSVVVGRPR

SEQ ID NO: 143437 - protein, 47 aa, Glycine max
  Coding DNA Sequence Number=SeqID_26659
MHGQILRSIHIGQQLIMENMHKLSLHMQMDPPLITLEAYLCLGIKKK

SEQ ID NO: 143438 - protein, 105 aa, Glycine max
  Coding DNA Sequence Number=SeqID_26660
  Gene Ontology: Mol. function=RNA binding; Cellular component=signal recognition particle, endoplasmic reticulum targeting; Biological process=negative regulation of translational elongation
  Homolog annotation: Hit_ID=Q9SMU7; Match level="QueryCoverage=52%, HitCoverage=54%, E-value=1e-20, Identity=85%"; Hit description =Signal recognition particle 9 kDa protein
  Pfam annotation: Domain name=SRP9; Domain location=32-80; Score=3.1; E_value=7.6e-05; Accession=PF05486.2; Description=Signal recognition particle 9 kDa protein (SRP9)
MSGLWKIMMETMKVWMGMLQSAEDVGDPPNMENLDDEVVNLSWYKYMSYCLKYKTDQAQEAKKMEKLNNIFFTLMARGPEVDPSEVTGKEPMDTQTTKRGRGRKQ

SEQ ID NO: 143439 - protein, 119 aa, Glycine max
  Coding DNA Sequence Number=SeqID_26661
  Gene Ontology: Mol. function=triacylglycerol lipase activity; Biological process=lipid metabolic process
  Homolog annotation: Hit_ID=O82274; Match level="QueryCoverage=55%, HitCoverage=18%, E-value=4e-07, Identity=47%"; Hit description =Putative lipase
MQWYLQEVVLGKARKSLVTDEYSWQSDQSNSNSINSSYHGKGERFVLESGRDPALVNKGCDFLKDHYLIPPNWRQDANTGMIRSNIDGRWMQPERPKLEDHPEDMHHHLTLLGLASSDI

SEQ ID NO: 143440 - protein, 308 aa, Glycine max
  Coding DNA Sequence Number=SeqID_26662
  Gene Ontology: Mol. function=metal ion binding; Cellular component =integral to membrane
  Homolog annotation: Hit_ID=Q10GD6; Match level="QueryCoverage=87%, HitCoverage=51%, E-value=1e-27, Identity=34%"; Hit description=Zinc finger, C3HC4 type family protein, expressed
  Subcellular localization annotation: CTP_CleavageSite=67; ConfidenceScore=5.58e-01
MTNWPDNILQDLRNKIFPFKKRKEKAPVSVSSVLLPARRKERSLSSLVVSTPRVCTQSTMTGRRTKPARKASGLQGSSLSIEKFIKKEEELLEDHQDNLCSPDTSNKSAKNGGQSLSPCKNSQSICNREPQNGAEPQEAKWDLWKTLNYLAEAASRSKPFKSNVQASDAKLESMKMTDSDAKVLKAKIKEKKRKAKVEEEKISTDHASSDTSKPNKLRRVRQKKEPVFGESRISPQAVLDATDRNLLWNDSIWFSLAASENQEGDAPLPQIPSNYTLLELVDTLGACLDTRLQVLLRASLLEKALYFK

SEQ ID NO: 143441 - protein, 361 aa, Glycine max
  Coding DNA Sequence Number=SeqID_26663
  Homolog annotation: Hit_ID=Q338C3; Match level="QueryCoverage=35%, HitCoverage=27%, E-value=2e-28, Identity=52%"; Hit description =Transmembrane amino acid transporter protein, expressed
MNNVISGVVRKEERLKMKWKAGERIQFSKQNNSICRATTNNRNQTSIRNFQFIHVQILGVPKRRMQRHRRRREEQRHHNVEPDAGKDKPGDGDGGERREDEAVVKLAAEHDDGAIAEKVEEEPRGEDGEEDDEGDREPEEAKEHEEEHDHGVVHAEVAEVALHTERGLAEGVNGRHCVEVRSPNSLTLTLTRSAKMGVGVPSMSIGNECRFDVITAFVTVTKSSLKCSNSTKSFLISAIMNLTAPMQPKIATIENQVAIKIFNGRIKRPSLELLAVLPALRYAKTGNTKSKGVNPIAPQIDTKSPKKGIAAAIRVTRTMKMEVKISCAGRFLRGKGKWLVDLLDLEPLVSSKQAYVGLQYI

SEQ ID NO: 143442 - protein, 72 aa, Glycine max
  Coding DNA Sequence Number=SeqID_26664
MREREITEKSEKVEPVRDEDERSDDGEKEEREDENPLAATDVAHWRRSSSALNFSDSDPGEDKIVSPEGTRA

SEQ ID NO: 143443 - protein, 194 aa, Glycine max
  Coding DNA Sequence Number=SeqID_26665
  Gene Ontology: Mol. function=transferase activity, transferring hexosyl groups; Biological process=carbohydrate biosynthetic process
MSLWICYHLQMLRLILCVSVTGVSGRGEFLEDLYRATYRGDTLKLNAVEQEGAEGLEEPNQVVYTEKDFSSTISYFSEKNNDFKESRIAGYRTTTLERNGFNPDKRQHQGAQQNELSFMAQGRNIHDSQRMSEKNIEVTNKKVQEIKDQIILAKAYLKIAPPSSNLRLRDLEQLTREMELAVGEAARDSDLSMR

SEQ ID NO: 143444 - protein, 393 aa, Glycine max
  Coding DNA Sequence Number=SeqID_26666
  Gene Ontology: Mol. function=transferase activity, transferring hexosyl groups; Cellular component=integral to membrane; Biological process=carbohydrate biosynthetic process
  Homolog annotation: Hit_ID=Q2R1U9; Match level="QueryCoverage=88%, HitCoverage=64%, E-value=1e-110, Identity=53%"; Hit description =Glycosyl transferase family 8 protein, expressed
  Pfam annotation: Domain name=Glyco_transf_8; Domain location=57-345; Score=257.6; E_value=2.5e-74; Accession=PF01501.10; Description =Glycosyl transferase family 8
MEASLSKVYRAFPDCSAMGAKLHMMQRQAEEQVRSQRHQATYLVHIAARTAPKGLHCLSMRLTAEYFSLRPEERKLPNENKIHHPDLYHYAVFSDNVLACAAVVNSTISTAKEQEKLVFHVLTKSLNLPSISMWFLINPPGKATVHILSIDNFEWSSKYNTYQENNSSDPRYTSELNYLRFYLPDIFPALNKIVLLDHDVVVQRDLSELWNINMKGKVIGAIGTCQEGKIPFHRIDMFINLSDPLIGKRFDVNACTWAFGMNLFDLQQWRRHNLTVVYQNYLQMGLWNIGSLPLGWLTFYNKTELLDRQWHVLGLGYSSNVDRNEIEQAAVIHYDGLRKPWLDIAMGRYKMQSPGIVQNSKFPLPDMTGILQLFKVLHISDLPKISMHFFLET

SEQ ID NO: 143445 - protein, 617 aa, Glycine max
  Coding DNA Sequence Number=SeqID_26667
  Gene Ontology: Mol. function=protein binding
  Homolog annotation: Hit_ID=Q10GD4; Match level="QueryCoverage=85%, HitCoverage=93%, E-value=1e-129, Identity=48%"; Hit description =Leucine Rich Repeat family protein, expressed
  Pfam annotation: Domain name=F-box; Domain location=156-203; Score =29.0; E_value=1.7e-05; Accession=PF00646.23; Description=F-box domain
  Pfam annotation: Domain name=LRR_1; Domain location=280-305; Score =6.3; E_value=19; Accession=PF00560.23; Description=Leucine Rich Repeat
  Pfam annotation: Domain name=LRR_1; Domain location=399-422; Score =9.3; E_value=5.1; Accession=PF00560.23; Description=Leucine Rich Repeat
  Pfam annotation: Domain name=LRR_1; Domain location=425-450; Score =2.7; E_value=90; Accession=PF00560.23; Description=Leucine Rich Repeat
  Pfam annotation: Domain name=LRR_1; Domain location=499-521; Score =4.7; E_value=38; Accession=PF00560.23; Description=Leucine Rich Repeat
  Pfam module annotation: Pfam domain module=F-box::LRR_1::LRR_1::LRR _1::LRR_1; Domain location=156-203::280-305::399-422::425-450::499-521
MKSPKKARQLSRAVLIFALAHPPFSTLSPFSHTMDRPPIPAALPPAHGGDAADAAKHGKKRGSYNCGRCGLPKKGHNCTVKTLASTADATPDSSLSVVSVPSAAAPSLRKPSSNLRRALSFDDLDERLPVVDRSEPDEEVDSDVFDETDPDLDLDADACGLPARLLWEVMRRLPPPGLLSAAKVCKGWRDTAKRMWRAAEELKIRVPANVPVGFVASMLQKCPGIVRLSLRMESDFDSTMLACIAFSCPNLECMEILTFDTATIRINGDELGRFVADKKSLKSLKMEGCSNLGGFVLCSSSLSTLWLSDLHSLSKMLREVSLEFSCQENDSTDLKTMIEGLGRSCLRLQNIHIASIWLSHSAVLALTAAQLRGLRMLSLVLGSEITDASVAAIASSYPNLELLDLSGSGISDSGISMICNVFPDTLTRLLLALCPNVTSSGIQFATFQLPHLEIMDCGMTICDPNMQNPTADENNCKLQKTSASNVHFTNQKLIIKHSRLKKLSLWGCTGLDALYLNCPRLIDLNLNSCSNLHPGRLLLQCPNLENVHASGCQDMLIGAIQSQVHDASADMENHSPSKRLPDGSKRIRVPHLLSEESPEPEKKRRRIERQLCNVLLD

SEQ ID NO: 143446 - protein, 222 aa, Glycine max
  Coding DNA Sequence Number=SeqID_26668
  Gene Ontology: Mol. function=glutathione-disulfide reductase activity; Cellular component=chloroplast; Biological process =glutathione metabolic process
  Homolog annotation: Hit_ID=P48640; Match level="QueryCoverage=77%, HitCoverage=28%, E-value=5e-68, Identity=80%"; Hit description =Glutathione reductase, chloroplast precursor
  Pfam annotation: Domain name=Pyr_redox_dim; Domain location=135-222; Score=78.2; E_value=2.6e-20; Accession=PF02852.12; Description =Pyridine nucleotide-disulphide oxidored
MDHPPIPAALPPAHGRDAADAAKCGKKRGSYNCGRCGLPKKGHNCTNIGLESVGVKLAKDGAIEVDEYSQTSVSSIWAVGDVTNRINLTPVALMEGEALVKTLFQDNPKNLIIGLHPVFNNTETVEKVSNCVATVPSAVFSQPPIGQVGLTEEQAVQQYGDIDIFTANFRPLKATLSGLPDRVFMKLVVCAKTNEVLGLHMCGEDAPEIVQIFVLLFFDDKL

SEQ ID NO: 143447 - protein, 499 aa, Glycine max
  Coding DNA Sequence Number=SeqID_26669
  Gene Ontology: Mol. function=triacylglycerol lipase activity; Biological process=lipid metabolic process
  Homolog annotation: Hit_ID=Q6I5X8; Match level="QueryCoverage=69%, HitCoverage=74%, E-value=1e-124, Identity=64%"; Hit description ='putative lipase class 3 family protein, PF01764'
  Pfam annotation: Domain name=Lipase_3; Domain location=215-375; Score= 189.1; E_value=1e-53; Accession=PF01764.16; Description=Lipase (class 3)
  Subcellular localization annotation: CTP_CleavageSite=66; ConfidenceScore=5.57e-01
MAASSSSSISNMLIIPFSKTHEPISFSFQLPHSKFPTSSPLTRTQQKSMKLVTRDNSSPTIGELVREQEQTTTHHNYKPKLEEHLERLPEEWRQIHGESDWAGLLEPMDPLLRSEVIRYGEMAQACYDAFDFDPFSKYCGSCRFTRRSFFSSLEMPHHLGYAVTRYLYATANINLPNFFKHSRWSKMWSKHANWAGYVAVSDDATTKLLGRRDITIAFRGTVTRLEWVADLMDFLKPISSNGIPCPDHTVKVESGFLDLYTDKEESCGYAKYSAREQVLSEVKRLLEIYNKEEVSVTITGHSLGSALAILSAYDIVETGVNVMRDSRGVAVTVMSFSGPRVGNVRFKERLEGLGVKVLRVVNVHDVVPKAPGVVFNEHLPAAVMKVAEGLPWSYWHVGVELALDHKKSPFLNPNADAVSAHNLEALLHLLDGDPALVNKGCDFLKDHYLIPPNWRQDANKGMIRSNNGRWMQPERPKLEDHPEDMHHHLTLLGLASSDI

SEQ ID NO: 143448 - protein, 58 aa, Glycine max
  Coding DNA Sequence Number=SeqID_26670
MVKQQLWFKLAQRYFFAQPYIASRKIPLPYLKVRKIVKLNGASQIGFGSSLNFKIDFD

SEQ ID NO: 143449 - protein, 60 aa, Glycine max
  Coding DNA Sequence Number=SeqID_26671
MLFERAHDPVPQSIMFREHFNLTLLQLLSQLGTANDDGADFGLVTTSLAPVLAFLHGSWC

SEQ ID NO: 143450 - protein, 105 aa, Glycine max
  Coding DNA Sequence Number=SeqID_26672
MGGANSNYQIWALLEDSVHFLEATQAATTAPILLKKWLLGHPVFSMQDCFCRKQPSSPGRAGRQPPPFFPINRQKGAVLRVPDPLGYAFQLFLVKKNCFREENPS

SEQ ID NO: 143451 - protein, 63 aa, Glycine max
  Coding DNA Sequence Number=SeqID_26673
MVKQVISLIPFSRIDPNVVLRGKGGGKWDPRVTEPCGSNPIPCAPLQGTPPTSPSIPTQHPLF

SEQ ID NO: 143452 - protein, 93 aa, Glycine max
  Coding DNA Sequence Number=SeqID_26674
  Gene Ontology: Mol. function=protein dimerization activity; Cellular component=endoplasmic reticulum; Biological process=proteolysis
  Homolog annotation: Hit_ID=Q0GXX4; Match level="QueryCoverage=77%, HitCoverage=16%, E-value=5e-28, Identity=83%"; Hit description=Auxin conjugate hydrolase
MVRIRRKIHENPELGYEEFETSKLIREELDKLRIPYKHPVAITGVIGFIGTKRSPFVAIRADMDALPMQEIVDRCDYHCSCGDPKSLNLQLKL

SEQ ID NO: 143453 - protein, 54 aa, Glycine max
  Coding DNA Sequence Number=SeqID_26675
MAHHRPIGDQVQSQSHSRTHLVAHDPRYLNKTSTSSEGSENTLDMHVARYIGYA

SEQ ID NO: 143454 - protein, 92 aa, Glycine max
  Coding DNA Sequence Number=SeqID_26676
MDEDQWMYDSIMSEEVEMNVENEEDADVKVDCSDAFNTYEEWEYRPKKHNLVRTCTGSRKCGCPFKLRAKPVSGGDDEMDEKIVVADMTKSM

SEQ ID NO: 143455 - protein, 146 aa, Glycine max
  Coding DNA Sequence Number=SeqID_26677
  Homolog annotation: Hit_ID=Q6CQF3; Match level="QueryCoverage=38%, HitCoverage=59%, E-value=2e-08, Identity=72%"; Hit description =Kluyveromyces lactis strain NRRL Y-1140 chromosome D of strain NRRL Y- 1140 of Kluyveromyces lactis
RCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGPSASHARVVLITASGLQGEPASGRWNN

SEQ ID NO: 143456 - protein, 85 aa, Glycine max
  Coding DNA Sequence Number=SeqID_26678
MEEEKAAAYYDELTRKGERAARFKQGLGFSSSAPNDDVGKPSSSFLSKFVKASFESKKEAQLQSIHDRLKEKPSFKSYFLLVPQI

SEQ ID NO: 143457 - protein, 150 aa, Glycine max
  Coding DNA Sequence Number=SeqID_26679
  Gene Ontology: Mol. function=DNA binding; Cellular component=nucleus; Biological process=regulation of transcription, DNA-dependent
  Homolog annotation: Hit_ID=Q8S8I2; Match level="QueryCoverage=92%, HitCoverage=57%, E-value=4e-30, Identity=48%"; Hit description =Protein ULTRAPETALA2
MILDFKRGEDYIEVVCGATNKKYGDYVGRLKINNEGQYFITCECCPDCPLVNATLEAFDKHALREGSGRWKRNIWVHCEEEDKVPLWKTPLIKYYTHQANVANWKDSAMRKQNFHRDEFLRCTRCGKECRFHLKSRPDIKNYHDALTNKR

SEQ ID NO: 143458 - protein, 131 aa, Glycine max
  Coding DNA Sequence Number=SeqID_26680
MRRCPLLPPVVPEEENEEPSRAAKGVIEGAAQGAAAGVQYGPINVVEGAARVGNKGAPAEGQTQEKGYCGHDTTVNEKVQKLAPKRKAPKTREKIKGCQLPTIEKKIKLGIGLVATQTKPDASIKDTDRQK

SEQ ID NO: 143459 - protein, 78 aa, Glycine max
  Coding DNA Sequence Number=SeqID_26681
MACSPLRLRMCSPLKARMSSPLKLRAYSPLIARTCIPLKPSDGEDMQPSEGEDVQPSDGQDVQPSDGEDVQLSEGEDV

SEQ ID NO: 143460 - protein, 212 aa, Glycine max
  Coding DNA Sequence Number=SeqID_26682
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=9e-29, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MKGLHVLTFRGIHVLAIRGLHAYTFRGLHVLAIRGLHAVTFRGLHVLAIRGLHALTFKGLHFLPIKGLQALTFRGLHVLAIRRLHALTFRRQHFLAIRGLYALTFRGLHVLAIRGLHDLTIRGLHVLAIRGSHALTFRGLHVLTIRELHVFTIRWLHVLATRGLHTLNFRGLEILAFREPHVIAIRGLHALTFRGQHVITIRGLHALTSRGL

SEQ ID NO: 143461 - protein, 260 aa, Glycine max
  Coding DNA Sequence Number=SeqID_26683
  Homolog annotation: Hit_ID=Q1SBR5; Match level="QueryCoverage=77%, HitCoverage=24%, E-value=9e-11, Identity=25%"; Hit description =Glutamic acid-rich protein cNBL1500
MAEPSKKRKGTSTRSQRHSGSQEAPIPPSIPSGSLFSSEEQHIRYTNLFSSRSIVDPKFIDMEFFSNENFECFQAFENSNLIPFMSLKLHVYYELVKAFYSNLEIHECVLMSEIYGIKMVIDQSLFFDLTKLPSEGVPFEGALIDEWKFDFSVHDARRLVCTNQADMTGRLIAGSLAFESRILHCLIVRILLPRSSNLAQVSEEDLIVMWAFHKALQIDWAYLVRYRMHKALRLNAPLPYPHLVTLFLQHFNIPLDSELY

SEQ ID NO: 143462 - protein, 97 aa, Glycine max
  Coding DNA Sequence Number=SeqID_26684
MRTRVNRAVSKSENESMKVIARMRVQERERELKMIARARVRARTVWSCRRGECVRVRVRTRARNDWKDIMVKLGKITIQFFLILEGHIGDIFPDLHF

SEQ ID NO: 143463 - protein, 187 aa, Glycine max
  Coding DNA Sequence Number=SeqID_26685
MTLLFNWLCEHERSKVVKSEKKIIEDRIAKLKQSVDNLCVDLHKSILTKDNSNVELPKAKKHIIIDNWEGLWKFIHQAHVLALGVGIDLFNVDKDIKNDELVRESQMFEEEEEEESEVDSNGLDSTFEKHEDSNLAFEKCDGLDSAFKKYEGSDSAFEKCDSSNSDFEKCETRLLRNVMSWTRPLRC

SEQ ID NO: 143464 - protein, 155 aa, Glycine max
  Coding DNA Sequence Number=SeqID_26686
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RYZ6; Match level="QueryCoverage=85%, HitCoverage=26%, E-value=2e-52, Identity=69%"; Hit description =Glycoside hydrolase, family 1
  Pfam annotation: Domain name=Glyco_hydro_1; Domain location=1-148; Score=-271.4; E_value=4.4e-05; Accession=PF00232.9; Description =Glycosyl hydrolase family 1
MSFIFVIVVVRDGKPIGLNVASNWLYVYPRGFRDLLLYTKEKYNNPLIYITENGINEYDDSSLSLEESLLDIYRVDYHYRHLFYLRESIKNGVNVKGYFAWSLLDNFEWHLGYTVRFGMNFVDYKNGLERYPKLSALWFKDFLKIEIKLHEDSMQ

SEQ ID NO: 143465 - protein, 117 aa, Glycine max
  Coding DNA Sequence Number=SeqID_26687
  Subcellular localization annotation: CTP_CleavageSite=29; ConfidenceScore=5.52e-01
MLPVVSGLVCATCSANHPFTPGMASKKKRASSSRPQESYDSSRFVSKEAWDRVLSLLPYLPRPPGHSGQAMHSRAGIYAKCGRSPLQVAEKGPNYLGSDLECHILLQPSPHLLYLRP

SEQ ID NO: 143466 - protein, 109 aa, Glycine max
  Coding DNA Sequence Number=SeqID_26688
  Gene Ontology: Mol. function=DNA binding; Biological process=DNA integration
  Homolog annotation: Hit_ID=Q1SKC8; Match level="QueryCoverage=98%, HitCoverage=25%, E-value=3e-30, Identity=56%"; Hit description =Integrase, catalytic region
MRLNAYDSSKLYKQEMKAYHDKKLLKKSFQLGQQVLLFNSKLRLFLGKLKSKWSGPFTIKEVKPYGVGELMDPSSDDSKRSWVVNGQRLKLYHGGNIERITTILNLQDP

SEQ ID NO: 143467 - protein, 181 aa, Glycine max
  Coding DNA Sequence Number=SeqID_26689
MLRRLTPFWRPPWFWSQGRDIQLTPGSVALTQILRSSPPDFGAPWKLLRKDLTTLAQTWNVLSYSNFAPTNYTSDLNMDRARRTTGTRMIPRSLFRGPASLGLGDPLMPPLLLQPLQYPQRPSPWLMPGGGEASTTQEPQPESEATLEEKSEDMSAAIPMEVTKEGDGTADTNYVADMTTA

SEQ ID NO: 143468 - protein, 968 aa, Glycine max
  Coding DNA Sequence Number=SeqID_26690
  Gene Ontology: Mol. function=translation initiation factor activity; Cellular component=cytoplasm; Biological process=stem cell maintenance
  Homolog annotation: Hit_ID=Q9C793; Match level="QueryCoverage=84%, HitCoverage=81%, E-value=1e-145, Identity=37%"; Hit description =Pinhead-like protein
  Pfam annotation: Domain name=DUF1785; Domain location=263-316; Score =55.2; E_value=2.1e-13; Accession=PF08699.1; Description=Domain of unknown function (DUF1785)
  Pfam annotation: Domain name=PAZ; Domain location=317-455; Score =110.8; E_value=3.9e-30; Accession=PF02170.12; Description=PAZ domain
  Pfam annotation: Domain name=Piwi; Domain location=619-918; Score =342.3; E_value=7.9e-100; Accession=PF02171.8; Description=Piwi domain
  Pfam module annotation: Pfam domain module=DUF1785::PAZ::Piwi; Domain location=263-316::317-455::619-918
MERGAYRGRGRNGNGGRNSYGGGRGSYGGGRDGNGDHNSYGGGRGGRSSYGDRSSPSQSQWQPRSNPSFSSPKPNNSHSQVQTQTQAHPDIGSSKIPEKKMDTITPVRRPDNGGTVAVRKCYLRVNHFPVSFNPQSIIMHYNVEVKAKAPPLKNNRPPKKISKYDLSLIRDKLFSDNSLPASAYDGEKNIFSAVPLPEETFTVDVSKGEDERPVSYLVSLTLVSRLELRKLRDYLSGSVLSIPRDVLHGLDLVVKENPSKQCVSLGRCFFPMNPPLRKKDLNHGIIAIGGFQQSLKSTSQGLSLCLDYSVLSFRKKLLVLDFLHEHIRDFNLREFGRFRRQVEHVLIGLKVNVKHRKTKQKYTITRLTPKVTRHITFPILDPEGRNPPKEATLVGYFLEKYGVNIEYKDIPALDFGGNKTNFVPMELCELVEGQRYPKENLDKYAAKDLKDMSVAPPRVRQSTIQAMRQRPHKISFDRGGVIKNFGMSVNTSMTNVTGRVIQPPQLKLGNPNGQTVSMTLEVEKCQWNLVGRSMVEGKPVECWGILDFTSQESGWRKLNSKQFIENLMGKYRKLGIGMKEPVWREQSSMWSLGDYNSLCKLLENIEDKVQKRYRRKLQFLLCVMSDKHQGYKCLKWIAETKVGIVTQCCLSGIANEGKDQYLTNLALKINAKIGGSNVELINRLPHFEGEGHVMFIGADVNHPASRDINSPSIAAVVATVNWPAANRYAARVCAQGHRVEKILNFGRICYELVSYYDRLNKVRPEKIVVFRDGVSESQFHMVLTEELQDLKSVFSDANYFPTITIIVAQKRHQTRFFPVGPKDGIQNGNVFPGTVVDTKVVHPFEFDFYLCSHYGSLGTSKPTHYHVLWDEHKFNSDDLQKLIYDMCFTFARCTKPVSLVPPVYYADLTAYRGRLYYEAMNQMQSPGSAVSSSSSQITSLSISSTGSSLNDPGYYKLHADVENIMFFV

SEQ ID NO: 143469 - protein, 132 aa, Glycine max
  Coding DNA Sequence Number=SeqID_26691
  Pfam annotation: Domain name=PAZ; Domain location=26-111; Score=7.9; E_value=0.00029; Accession=PF02170.12; Description=PAZ domain
MAIGGFQQSLSLLLRDCPCAWTIRFCPFGRSCRRQVEHVLIGLKVNVKHRKTKQKYTITRLTPKDIPALDFGGNKTNFVPMELCELVEGQRYPKENLDKYAAKDLKGMSVAPPRVRQSTIQAMVNSEDGPCG

SEQ ID NO: 143470 - protein, 103 aa, Glycine max
  Coding DNA Sequence Number=SeqID_26692
MEMIHWWEKFLEGVQWKWSRSFRGGLTNIVTDSEGFVFLASPIGVGGSSKEPPDGNGGAGVKNRLSFNGKNLKHVGGENSKILGMKITTPMKLWRVFVGVPIN

SEQ ID NO: 143471 - protein, 986 aa, Glycine max
  Coding DNA Sequence Number=SeqID_26693
  Gene Ontology: Mol. function=binding; Cellular component=ubiquitin ligase complex; Biological process=protein ubiquitination
  Homolog annotation: Hit_ID=Q6H6D6; Match level="QueryCoverage=88%, HitCoverage=91%, E-value=0.0, Identity=42%"; Hit description =Transducin-like
  Pfam annotation: Domain name=Arm; Domain location=510-551; Score=9.8; E_value=0.74; Accession=PF00514.13; Description=Armadillobeta-catenin- like repeat
  Pfam annotation: Domain name=Arm; Domain location=782-824; Score =11.1; E_value=0.5; Accession=PF00514.13; Description=Armadillobeta -catenin-like repeat
  Pfam module annotation: Pfam domain module=Arm::Arm; Domain location =510-551::782-824
MTSLRELLTDEGFYQTTPNNNNPLKPKLKLSPPTPEIILNSLPLHLCNDRKSFVDCSNKSIDKSMTRKGSWPFHSNTQRVVVGSVSETSLVSPPPRTVVGPPMDEVATRAVVAILSGYIGRYVKDDSFRKMVRDKCNSYLVRRRRNGSGSSSEEENEVLVNMKLGMENIDKLVQDQGTKKDMKIKSLRNSIELLTIVASLNSKIRTTSRESGSTCGIPNSHISACAQLYLAIVYKLQKNNRICARHLLQVFCDSPFLARTYLLPDLWEHVFLPHLLHLKIWYAEELDAVSASSECQGEKDKKMKTLSKVYGNKVDTGTAMFALYYKQWLKVGANEPPLPIVSLPSRPSCRSSRKMSSDSFVLHSSINTNLYKEVFGPKLEMKPTPLAEQNGLLTIRWSSRNHEYSCSSLQKEETIYLGRSSRSIDKSYAEIRLGSQRLDNFQCFSCRSMQAESLVNSSYTSCNASFRNETTVLSSEFVGALTTICSSDILSECEFSIRVIAKAWLNSHADPLIEEALSQSSVVEAILEVLFASSEDEILELAISVLAELVGRNDAIRQIMLNSDPRLEIFVRLLRRTGLFQKAAVLLYLLKPQAKQMLSPEWVPLVLRVLEFGDKVLTLFTVQCNPQVAAIYFLDQLLTGFDEDRNLENARQVVSLGGLTLLMKRIEEGEIHERNNAAFIIYSCIHAEESCRSFLADNIKKSSLLELIVLGNSKNCSGCAFSVLAELLYLDRTTKILNFLRGLKDGWGGLNTMHILFIYLQRAPPEECPLVAVVLLLFDIMEDPFKESLYRAEAIEAIVAALNCQVCNDKIQEQSARALLLLAGHFSYTGESLMERTLLQQAGFQENCLEDSSYGKEIVVYDSAHKNEEDDEAESWRRTAANVLLKSGNKNLLSVLSDSAANGVPSLARASLVTISWMSSYLHLVDDRKLPPMALSILMPLLLKYLNYDKDVEARVLASYSLLCLVKISGMNSETFAIFRIMPKLS

SEQ ID NO: 143472 - protein, 72 aa, Glycine max
  Coding DNA Sequence Number=SeqID_26694
MRESGRNLMFSYGGEIESAGNLNSEGDVIKYGRVPKKNHSIILARKRKFEEETNNSYVGAESSTHDPSNDVH

SEQ ID NO: 143473 - protein, 833 aa, Glycine max
  Coding DNA Sequence Number=SeqID_26695
  Gene Ontology: Mol. function=binding; Cellular component =intracellular; Biological process=protein amino acid phosphorylation
  Homolog annotation: Hit_ID=Q60DN6; Match level="QueryCoverage=61%, HitCoverage=83%, E-value=1e-156, Identity=52%"; Hit description=PPR repeat containing protein
  Pfam annotation: Domain name=PPR; Domain location=365-399; Score =35.5; E_value=1.8e-07; Accession=PF01535.11; Description=PPR repeat
  Pfam annotation: Domain name=PPR; Domain location=465-499; Score =40.4; E_value=6.2e-09; Accession=PF01535.11; Description=PPR repeat
  Pfam annotation: Domain name=PPR; Domain location=566-600; Score =40.5; E_value=5.7e-09; Accession=PF01535.11; Description=PPR repeat
  Pfam annotation: Domain name=PPR; Domain location=667-701; Score =46.7; E_value=7.7e-11; Accession=PF01535.11; Description=PPR repeat
  Pfam annotation: Domain name=PPR; Domain location=768-802; Score =40.4; E_value=6.2e-09; Accession=PF01535.11; Description=PPR repeat
  Pfam module annotation: Pfam domain module=PPR::PPR::PPR::PPR::PPR; Domain location=365-399::465-499::566-600::667-701::768-802
  Subcellular localization annotation: CTP_CleavageSite=42; ConfidenceScore=5.52e-01
MELRTAILQSSSSLPPRFHTLKPTPDFAFPFSLFVSNPLRLSCFTFVSKGDDPNSCYANLFLGQADQQHSFPVTARDTRAVLNCISEGLSCTGASSGDCSCDDKRDDDEDAMGFLNNYEMIIRDCDKLIEAFMVDERNWRRLLVFNKKWNNIRPHFFRHCQDKADTEDNPVTKNKLLWLGKKLKEIDQELQGHNELIEMIKGNPSKICEIVSSSRKDFTKEFFMHLHTIAESYGYNLERQNDLLKLWNTCLAAVKVYDAATESIEALNAAELNFQDIIKSPPDAFCWKIDNLAEKSQCFNPELVAHWLRLCYNMEEVGRVHTIVLKFFIHPVTYVDNNLICSYLRLGKLAQARRVFDGMSRKNTVTWTAIIDGYLKFNLDDEAFKLFQDCVKHGVPANSKMFVCIMNLCGRRVDLELGKQIHARILKSRWRNLIVDNAVVHFYAKCGNISSAFRAFDCMAERDVICWTTMITACSQQGFGHEALSMLSQMLSDGFYPNEYTICSALKACGENKALKFGTQLHGAIIKKICKSDVFIGTSLVDMYAKCGVMVDSKVVFDRMRIRNTATWTSIISGYARNGFGEEATSFFRLMKMKRIHVNKLTVLSVLMACGTIKSLLFGREVHAQIIKSNIHTNIYVGSTLVWFYCKCKEYSYAFKVLQYMPFRDVVSWTAIISGCARLGLEHEALEFLQEMMEEGVLPNSYTYSSALKACAELEAPIQGKLIHSYASKTPASSNVFVNSALIYMYSKCGYVADAFQVFDNMPERNVVSWESMILAYARNGHAREALKLMHRMQAEGFVVDDYIHTTVISACGGVEHGDIHQDSEYSSHYLHS

SEQ ID NO: 143474 - protein, 142 aa, Glycine max
  Coding DNA Sequence Number=SeqID_26696
MNPTQRQAFHKAYGKNWDFSMIEVSVEDIASLAQYYDQSLRICLTKGENVNHACFDDIEKKSLDCHHKKGEECECMMMPKKNQTRPLQRISICFKINSRLLQQTKPCFKIHKRLSLASKQRVSKSCKALVIDYQKGRMKKNC

SEQ ID NO: 143475 - protein, 115 aa, Glycine max
  Coding DNA Sequence Number=SeqID_26697
  Gene Ontology: Mol. function=protein binding; Cellular component =nucleus; Biological process=multicellular organismal development
  Homolog annotation: Hit_ID=Q6VG98; Match level="QueryCoverage=56%, HitCoverage=37%, E-value=4e-23, Identity=81%"; Hit description=TFL1a
  Subcellular localization annotation: CTP_CleavageSite=35; ConfidenceScore=5.16e-01
MELALPFSVGFILTIVFLPSLAPLPLLSSSLFLPLTMARMPLEPLIVGRVIGEVLDSCTTSTKMIVSYNKNQVYNGHELFPSTVNTKPKVEIKGGDMRSFFHCQQSFLGKKRGKT

SEQ ID NO: 143476 - protein, 182 aa, Glycine max
  Coding DNA Sequence Number=SeqID_26698
MGTCQSTRKVSTTLYAKSTTLARRSGPNFHVRKKAQAIQKQNIAPYVLSRGGYEYLENKLMDEKRKKKLKEAAQSGSTDAVIDPPSPIKRHVKWKMARTKKTRQMTSETVKEIANKIDSLKDQASQGSFVAHGRHDVLIAAIGRPEHPSHVCTAGVGVTIKQYFGPALRTSRTSSFMALEDL

SEQ ID NO: 143477 - protein, 58 aa, Glycine max
  Coding DNA Sequence Number=SeqID_26699
  Subcellular localization annotation: CTP_CleavageSite=32; ConfidenceScore=5.22e-01
MVNRLSRSEASKTLRPRNQTYKALRKRVTSTRANYTRTKAITIKGRGNVSAGTTEDRE

SEQ ID NO: 143478 - protein, 183 aa, Glycine max
  Coding DNA Sequence Number=SeqID_26700
  Gene Ontology: Mol. function=histone-lysine N-methyltransferase activity; Cellular component=nucleus; Biological process =multicellular organismal development
  Homolog annotation: Hit_ID=Q9SHE9; Match level="QueryCoverage=99%, HitCoverage=98%, E-value=4e-54, Identity=59%"; Hit description=LOB domain-containing protein 4
  Pfam annotation: Domain name=DUF260; Domain location=13-137; Score =216.2; E_value=7.4e-62; Accession=PF03195.5; Description=Protein of unknown function DUF260
MKDGGRKQGAPSPCAACKLLRRRCAQDCVFAPYFPADEPQKFANVHKVFGASNVNKMLQGKAAYNIPPPYLRIAKSLRAMGYEDLPEHQRGDAVSSMVYEANARVRDPVYGCVGAISSLQQQIDVLQTQLAVAQAEAVHLRVRQAASLYSPTSPTNSGSPSQAKPIFDMDMVVDQTPYGDSIW

SEQ ID NO: 143479 - protein, 545 aa, Glycine max
  Coding DNA Sequence Number=SeqID_26701
  Gene Ontology: Mol. function=protein kinase binding; Cellular component=nucleus; Biological process=regulation of cyclin-dependent protein kinase activity
  Homolog annotation: Hit_ID=Q9FKE6; Match level="QueryCoverage=97%, HitCoverage=94%, E-value=1e-132, Identity=49%"; Hit description =Similarity to cyclin
  Pfam annotation: Domain name=Cyclin_N; Domain location=31-147; Score=- 4.0; E_value=0.00033; Accession=PF00134.13; Description=Cyclin, N -terminal domain
MTGLMPGELPHHGTPDGNSGKSSQDKQEESLGRWYMSRKEIEEHSPSRKDGIDLKKETYLRKSYCTFLQDLGMRLKTIATVCMFLAGKVEETPRPLKDVILVSYEIIHKKDPAAAQRIKQKEVYEQQKELILLGERVVLATLGFDLNVQHPYKPLVEAIKKFNVAKNALAQVAWNFVNDGLRTSLCLQFKPHHIAAGAIFLAAKFLKVKLPSDGEKVWWQEFDVTPRQLEEVSNQMLELYEQNRLPPAQGSEVEGSAGGTRAASKAPSANEEQASKQISSQAPQHSSVERTAVPQRGTENQSNDGSAEMGSDITDHNLDIRESHNSEQLTHQDNKREVSNRSKSGTERDQDRIVGTKEGAEVGRRDESALNNSGSNVGRNLERREVPLGHSPNEAIKIDKDKLKALAAMGKKRKEQRGEMALKKDVMDEDDLIERELEDGIELAVEDEKNKRERRQNWSKPDGEDHHGGENHEETRDGRYMNMKVQFQKDMDEDNAEEGEMIDDASSSLNNRKRRMGSPPGRQPEMKKHLDSRKTQGMGSKIIVE

SEQ ID NO: 143480 - protein, 214 aa, Glycine max
  Coding DNA Sequence Number=SeqID_26702
  Gene Ontology: Mol. function=protein kinase activity; Biological process=protein amino acid phosphorylation
  Homolog annotation: Hit_ID=Q2QZ78; Match level="QueryCoverage=92%, HitCoverage=35%, E-value=8e-51, Identity=49%"; Hit description=AT hook motif-containing protein, putative
MNLVLLEVEQLLQANQRSLKDYPSRSYPENANLLTHADNDLILSELNFNNEELRSEFLNLFSQMTDQQAKIYNQIIQAVNKNEGGMFFLYGYGGTGKTFIWKTLAASLRADNKIVIMVASSNIASLLLPGGKTTHSKLKILVPIFEDSTCNIHQGTQLAELLNETSLIIWDEAPTAHKFCFEALDRSLRDVIKAKSSSDKIFGGKVMVFGGDFR

SEQ ID NO: 143481 - protein, 282 aa, Glycine max
  Coding DNA Sequence Number=SeqID_26703
  Gene Ontology: Mol. function=metal ion binding
  Homolog annotation: Hit_ID=Q9FHE4; Match level="QueryCoverage=74%, HitCoverage=69%, E-value=1e-38, Identity=47%"; Hit description =Arabidopsis thaliana genomic DNA, chromosome 5, TAC clone:K17O22
MAVEAPPHNMNLFPSQLLTAREMMKPNLGFYTAQQTEAAATPLLQSTALPFLHQSDSGLTCHVTTTAPTRKRSRDSITTVPNALLPLPQKNKLSSSSSSSPPPSILDQELLFHFQNQQSEIDRFIVQHTEKVRMEMAEQRVRQSRMLITAIQEAVAKKLKEKDEEIQRVGKLNWVLQERVKSICVENQIWKELAQTNEATANNLRNNLEQVLAHVSEDHHNHNHHAVEAAESSCASNNNNNHHHHREEEEVCGGYERNDGVLGKRMCNQCGSCWNLLLLESV

SEQ ID NO: 143482 - protein, 67 aa, Glycine max
  Coding DNA Sequence Number=SeqID_26704
  Gene Ontology: Cellular component=integral to membrane; Biological process=intracellular protein transport
  Homolog annotation: Hit_ID=Q6AT61; Match level="QueryCoverage=79%, HitCoverage=22%, E-value=3e-15, Identity=70%"; Hit description =Putative vesicle transport protein
MGFLKTLTGHVDWKSAHREALDILNTVGISNSVLRLIERRNRVDQWIKYAGMLLTVIFLFGFDTWRH

SEQ ID NO: 143483 - protein, 421 aa, Glycine max
  Coding DNA Sequence Number=SeqID_26705
  Gene Ontology: Mol. function=RNA-directed DNA polymerase activity; Biological process=RNA-dependent DNA replication
  Homolog annotation: Hit_ID=Q1SQP0; Match level="QueryCoverage=53%, HitCoverage=40%, E-value=3e-22, Identity=35%"; Hit description=RNA -directed DNA polymerase
MVSAWRCNQHVIVLEDYYAFGMRKNMGGKWCKSDNCKHLLALEYNSEKKSVGTNLTAKKCNYGGAMGESSPSTNQMELPKVDWIECLYLQNENKKLKWEINKLEVEARTTWIKEGDYNSWFFHMTVNWKRRSNTIKDENEVRDAVWECGSEKSLEPDGFLESTSISILANGRPKAEFIPQRDLRQWDPLAPFLFNIVAGGLTDDIVFFGSAMMENVKAIKGAEEGDGQDGKATEEARGMGIRDLSKFNYALLGKWHWNLFHRQGGLWAQVLNSKYGGWRNLDETRRFNREFIRWRDLSFIFNLTKEGSWFNRNIKWKIGSGSKVLFWEDAWKEDEVSLKEKYPRLYQISQQQVQQMGITTNTGWEWQLQWRRFLLEAEIAAAANFMEDIQSLEVQMQQQDLDLGRGFKWEVFSGKCLYASQ

SEQ ID NO: 143484 - protein, 70 aa, Glycine max
  Coding DNA Sequence Number=SeqID_26706
MSNDLIIVSPLYSSKVFNMQPRGHSMCWGIPLHVWDLENIKKIVVAVGEVVDFDDNVEDPNNQPQCAGVH

SEQ ID NO: 143485 - protein, 540 aa, Glycine max
  Coding DNA Sequence Number=SeqID_26707
  Gene Ontology: Mol. function=protein serine/threonine kinase activity; Cellular component=cell surface; Biological process =protein amino acid phosphorylation
  Homolog annotation: Hit_ID=Q7XIH7; Match level="QueryCoverage=85%, HitCoverage=69%, E-value=2e-89, Identity=40%"; Hit description =Putative lectin-like protein kinase
  Pfam annotation: Domain name=Lectin_legB; Domain location=2-111; Score=-78.6; E_value=4.5e-05; Accession=PF00139.10; Description =Legume lectin domain
  Pfam annotation: Domain name=Pkinase; Domain location=188-451; Score =186.3; E_value=7.4e-53; Accession=PF00069.15; Description=Protein kinase domain
  Pfam annotation: Domain name=Pkinase_Tyr; Domain location=188-451; Score=116.8; E_value=6.2e-32; Accession=PF07714.7; Description =Protein tyrosine kinase
  Pfam module annotation: Pfam domain module=Lectin_legB::Pkinase::Pkina se_Tyr; Domain location=2-111::188-451::188-451
MDTFMNEFDLDGNHIGIVTTSITNPLASESLNSSGIDLKSGRDIEVRVDYDGWSKMIFVSVGYTESQLKSVLNHSINLPDIVPSSIYVGFTASTGNNTFPESHQVLNWVFTSVPLPILSVELTKVGTIKTILVVVMVCLFPCIWIAASLRRTYVRAKKKGDIESLTKKAADIPKVFTYKQLSRATCKFSQENLLGKGAFGSVYRGIILDSGKTVAVKKISATSKQGEREFLAEICTIGRLRHKNLVKLQGWCSEGENLLLVYDYMQNGSLDHFIGKGSLNWQTRHKILTGLASALLYLHEECGNPFVHRDVKPNNVMLDSNHNAHLGDFGLARLLKNEGSVTTNLNGTLGYLAPELSFTGRATPESDVYSFGMVVLEVICGKRLNWLKQGNSFVDSVWNLHAQNALLECVDQRLENKFDEEEAKRALMVGLACLHPDSMFRPRMRKAVNIFQSPNEPLMELPGVRPTGVYVSVSSSSSLASNSSSRVIIVYDYLPARFLEPLRTKFQLHLSTIFQIIKDRDETTTSSVTAIHHQVVNWGR

SEQ ID NO: 143486 - protein, 143 aa, Glycine max
  Coding DNA Sequence Number=SeqID_26708
  Gene Ontology: Mol. function=calcium ion binding
  Homolog annotation: Hit_ID=Q9FQ12; Match level="QueryCoverage=78%, HitCoverage=39%, E-value=4e-12, Identity=39%"; Hit description =Lectin-related protein
  Subcellular localization annotation: CTP_CleavageSite=47; ConfidenceScore=5.36e-01
MFIIMLLLLSNLMIQPQSGASTVVDPNTFSFVTFTPESCTNGELLCMGSATAGNGYLSLTPEPQQSGNLSLSLSNTTNSVGRVLYPHPVKVWPAIISTTFTVRITPFSENSTNAGDGMALVFAQDNRPSPNGSYLGMFDQSTQ

SEQ ID NO: 143487 - protein, 324 aa, Glycine max
  Coding DNA Sequence Number=SeqID_26709
  Gene Ontology: Mol. function=oxidoreductase activity; Cellular component=peroxisome; Biological process=purine base metabolic process
  Homolog annotation: Hit_ID=P04670; Match level="QueryCoverage=86%, HitCoverage=91%, E-value=1e-160, Identity=99%"; Hit description =Uricase-2 isozyme 1
  Pfam annotation: Domain name=Uricase; Domain location=13-142; Score =178.2; E_value=2e-50; Accession=PF01014.9; Description=Uricase
  Pfam annotation: Domain name=Uricase; Domain location=148-294; Score =183.1; E_value=6.6e-52; Accession=PF01014.9; Description=Uricase
  Pfam module annotation: Pfam domain module=Uricase::Uricase; Domain location=13-142::148-294
MAKQEVVEGFKFEQRHGKERVRVARVWKTRQGQHFIVEWRVGITLFSDCVNSYLRDDNSDIVATDTMKNTVYAKAKECSDILSAEEFAILLAKHFVSFYQKVTGAIVNIVEKPWERVTVDGQPHEHGFKLGSEKHTTEAIVQKSGSLQLTSGIEGLSVLKTTQSGFVNFIRDKYTALPDTRERMVATEVTALWRYSYESLYSLPQKPLYFTEKYQEVKKVLADTFFGPPKGGVYSPSVQNTLYLMAKATLNRFPDIAYVSLKLPNLHFIPVNISNQDGPIVKSWAYGHNCSCRMDKFNLTFYQWFVMTLGKTYSNMSCIYCVLF

SEQ ID NO: 143488 - protein, 95 aa, Glycine max
  Coding DNA Sequence Number=SeqID_26710
MPKPLHLPITIFLLLIRSWVLKVPGLLQIANVIHQVESPFSLMEVILNKNMFKPRILVLCLQAQRRCSLNLAWLWELFLQAHKRFNLNLAWSWNM

SEQ ID NO: 143489 - protein, 95 aa, Glycine max
  Coding DNA Sequence Number=SeqID_26711
  Subcellular localization annotation: CTP_CleavageSite=20; ConfidenceScore=5.16e-01
MNRFFRKVPGRRFPEVFRKKCSSGRRLVTSGRTLLPETFRKRGVRETNLVREEEEDDVRACLAGEEEAVRGEEEAVRGRNEQQQKSFFRRGGGFL

SEQ ID NO: 143490 - protein, 262 aa, Glycine max
  Coding DNA Sequence Number=SeqID_26712
  Gene Ontology: Mol. function=glutamyl-tRNA reductase activity; Biological process=tetrapyrrole biosynthetic process
  Homolog annotation: Hit_ID=Q2QM36; Match level="QueryCoverage=87%, HitCoverage=77%, E-value=3e-50, Identity=48%"; Hit description =Expressed protein
  Subcellular localization annotation: CTP_CleavageSite=38; ConfidenceScore=5.27e-01
MTSSAISINGVRHSGANFLAKRMSSGETSGAVYRCGCPSQHPVQLTRVRVNPAKLVPEKNVTHHHARVAASENEELRPHAEGGEGDFWEHRVFATRGVAVEEVGFVRKNLNEAFVWVFEEEVVSELKGVERDTVLGEEGEVVVEGVVEEGGGEEAAGGGDEGGGGAGGWFRGDEVVEDAAGDGDVFGGVGVDVDVEEAVAVVIGGRRREELLPERGEGEIGVGEEEEGDFRGGGEVGGCVGGGGAAEEGEVVGVGRGQNMRR

SEQ ID NO: 143491 - protein, 348 aa, Glycine max
  Coding DNA Sequence Number=SeqID_26713
  Gene Ontology: Mol. function=nucleic acid binding; Biological process= DNA modification
  Homolog annotation: Hit_ID=Q31HV9; Match level="QueryCoverage=98%, HitCoverage=41%, E-value=4e-52, Identity=35%"; Hit description =Primase
MSENYGDVLQQLQSAGLLITELDTTGRMVRCRVEGSRERRGWYALHELNTSAGEVLVVGTYGVWHGNENGATKVDLRKRDKTFSDEQREALRNRLAEDRRRAESARQTQAKRAAERASSAWAKANAVGEADYLVSKGVQGFGLRYGNTGAALVPLLDVNGQVHGLQVLRSAKLAAAGRKPAKEYWPAGMVKKGHFHLIGGSPQWILLVAEGYATAATLHMATGYPVAVAFDAGNMLAVASALAKRYRGIKMLLCADDDVLQKCRHCKSRLVLADHPQFCPSCAQPHGASNAGLLGAEAAALDVGGAMLHPVFADESGRRERFIDSGRKISDFNDLHAQEGLHVGRRYR

SEQ ID NO: 143492 - protein, 137 aa, Glycine max
  Coding DNA Sequence Number=SeqID_26714
MASYGEAKESIDEQDPRSTSSNGAYIIDDPIVTFRGPRKAKGKRSEAPSTSAPSEAPTPSSSTTPPFSSTQIPVIPPAPSQMPFLGPVKKRLSFEFQKVVVGLSSAVGLSAYPLLSAASACLVKRRIWQSINIKAVR

SEQ ID NO: 143493 - protein, 227 aa, Glycine max
  Coding DNA Sequence Number=SeqID_26715
HACPLESHRSCTEKGRVNWDQLLASKEGASVNRFPRWKEGRIEVLISCGGFPNVPLMGTRGCISYNPVLATNVETLQKVRKAWEGLDWLPSLRATKREEDEAPEEDEGCRTELKQAQTVKERFKFAALKIRKENAELRDGKNIAGNKFRGALWARLCETETSMLAIISKYQEELSLAMAHEHRVADEYAQVYAEKETRGRVIDSLHQEATMWMDLFALTLSGSQELP

SEQ ID NO: 143494 - protein, 96 aa, Glycine max
  Coding DNA Sequence Number=SeqID_26716
MERSMIDTASGGALGDMTPAEARNLIEKMASNSQQFSARNDVIVLRGVHEVAMAVARVCGLCSSADHHSDLCPSLQQSGVNEQHEAYAANIYNRPP

SEQ ID NO: 143495 - protein, 146 aa, Glycine max
  Coding DNA Sequence Number=SeqID_26717
MGEAEEVQEKMKADMEAMKEQMATMMEAMMSMKRIMEANVVAVAATSTVAKVNPMPPSDLNQMNHPISDMVGKDLGSTDGPMMCKFKTSTPSRHTACLPTIHHPMWHTLPMRMSITPLPYSLRADNLILYMSLNPWGRYMKFPTII

SEQ ID NO: 143496 - protein, 379 aa, Glycine max
  Coding DNA Sequence Number=SeqID_26718
  Gene Ontology: Mol. function=helicase activity; Biological process =viral genome replication
  Homolog annotation: Hit_ID=Q9LW42; Match level="QueryCoverage=98%, HitCoverage=23%, E-value=1e-93, Identity=48%"; Hit description =Helicase-like protein
MPGKEPKFAQLYIFDTENEVQNRINAISSPHNQIQEHIVSQLSEMLDEFNVHAKTFRMVRDRLRDVQVDNIKLKLIANCEKDGRTYNVPTVPEVAALIVGDFDANSKRDIIIETQHGQLQRIHELHSSYLALQYLLLFPYGEDGYRPDIIQSSRSDGKKRKRNHLTMREWFSYRLQCRSNESKTLLNSRRLFQQFFVDGYTMVESERLSYIRNNKKKLRVDKFCSLQQSLDDGSRKGLNKGKRVILPSTFVGSPRYMDQLYFDGMVICSHVGFPNLFITLTCNPNWPKIHRLLNPLNLKAADRLDIISRVFKLKYEQMLMDLTKNHMLGKVIVYMYIIEFQKRGLPHVHLLLFLHPDNKYPSLDEIDQIISAEIPFTAR

SEQ ID NO: 143497 - protein, 97 aa, Glycine max
  Coding DNA Sequence Number=SeqID_26719
MTGDSSKFTHISPKKSGHVTYGDNNKGRILGVGKIEQMHIHGQDSKGKGEGSNEDPPYVISVCFCLDHVDACFVRIIQQWKLFWSSSVQQEEFEDDA

SEQ ID NO: 143498 - protein, 195 aa, Glycine max
  Coding DNA Sequence Number=SeqID_26720
METTKSTQRALQSVKIQVGELAEAVTQFMSRQEKYFVEIEAQDKIPIKEHESREKDEEKDEEQAQQQREKYSTIENQQENILQINNLPHQMIVKKGRQGEHEEIATAILSLITNTFLEIIGNVLLDYMKFMEFLAKRRNFKEDVFYVTFIPFAKRKSCVKRISVHALSCESQALSAQPLHLRLIWSAKLAKVELS

SEQ ID NO: 143499 - protein, 231 aa, Glycine max
  Coding DNA Sequence Number=SeqID_26721
  Homolog annotation: Hit_ID=Q47522; Match level="QueryCoverage=21%, HitCoverage=62%, E-value=9e-22, Identity=94%"; Hit description=LacZ protein
YDGVFEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIEVSRDEGHILPRVGLQDASVKFNKVTKYNALMKDSSTFIVIVSKGKGKEIFGISPLGSNDAQLIDEIKLIDTVDLEGGPEAVCVLALAECILAYYVGTDEGVSEVLHVAGEKGCT

SEQ ID NO: 143500 - protein, 118 aa, Glycine max
  Coding DNA Sequence Number=SeqID_26722
MTGYDWPLDFLFPTDRYIGTDASGDRVTTDRSLPLPGAKQAENVAARQPSSSGQTLTHKEGGDMVNVPLKKKLAVEDLNEKALGLCCILKQWGMPHCPHSLAIYVQTCAHQVLGEMPQ

SEQ ID NO: 143501 - protein, 299 aa, Glycine max
  Coding DNA Sequence Number=SeqID_26723
  Homolog annotation: Hit_ID=Q47522; Match level="QueryCoverage=14%, HitCoverage=53%, E-value=9e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSISASSCRPNWRTCIISYIHSSSQIQIIFLITCIIRSPSRSTIDGDLMISSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143502 - protein, 326 aa, Glycine max
  Coding DNA Sequence Number=SeqID_26724
  Homolog annotation: Hit_ID=Q9AVH2; Match level="QueryCoverage=66%, HitCoverage=99%, E-value=2e-57, Identity=48%"; Hit description =Putative senescence-associated protein
PGRQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANHGSSRTRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 143503 - protein, 121 aa, Glycine max
  Coding DNA Sequence Number=SeqID_26725
MWAFHIGRKINWAHLFRSFLIGVVVVASFGYCKERDGSWVKKGAQPNDDEGHLPVERDSSLLQSILDRFDGLQTYVGERFNSLERQVDTQFEEMNSRITKVEEDVTIIHNYLDLPPPPPPV

SEQ ID NO: 143504 - protein, 153 aa, Glycine max
  Coding DNA Sequence Number=SeqID_26726
  Gene Ontology: Mol. function=nucleic acid binding; Cellular component= mitochondrion; Biological process=DNA integration
  Pfam annotation: Domain name=zf-CCHC; Domain location=18-35; Score =14.9; E_value=0.0034; Accession=PF00098.13; Description=Zinc knuckle
MKKKKGKGGKKRKDDPKDICNYYKEPGHWKRDYPKKANKDYVSALVQNDSLSQINLVMAVGEQLQQHFEQWVLDSSCSYHIYAYKHWFVTYEKNSYGNILMSNDDPYRFVGIAYVQLRMHDGAIKTLTKVCHVPGLKKILVSLGAMDSNGFSY

SEQ ID NO: 143505 - protein, 64 aa, Glycine max
  Coding DNA Sequence Number=SeqID_26727
WCLQSSFFLLHSTAIDLQEAKESIDEEDPRLISSTWSYITLSDVATHRCDAHKIEEVPPCDFQV

SEQ ID NO: 143506 - protein, 82 aa, Glycine max
  Coding DNA Sequence Number=SeqID_26728
MTETSMRAGNADVYGFLEPQSIQRSGQSQFESESYTKNWMQNSKRDVYLGVYLNGPNNYLKEIINKSVLFFNTFCISISREH

SEQ ID NO: 143507 - protein, 83 aa, Glycine max
  Coding DNA Sequence Number=SeqID_26729
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=98%, HitCoverage=14%, E-value=8e-37, Identity=98%"; Hit description =Photosystem I P700 chlorophyll a apoprotein A1
MGGSVISYGHRHPSLMFLFSGRGYWQELIESIVWAHNKLKVAPATQPRALSIVQGRAVGVTHYLLGGIATTWAFFLARIIAVG

SEQ ID NO: 143508 - protein, 212 aa, Glycine max
  Coding DNA Sequence Number=SeqID_26730
  Gene Ontology: Mol. function=DNA binding
  Homolog annotation: Hit_ID=Q1SP03; Match level="QueryCoverage=69%, HitCoverage=31%, E-value=1e-12, Identity=30%"; Hit description=IMP dehydrogenase/GMP reductase
MGTNQNGKRFYQVKVKSLDVTSLKELGRLMGPLQRQAFCKVYGKILDLAAAKVFTEVVVSLAQYYDQPLRCFTFGDFQMVPTIEEFEEILGCPLGGRKPYLFSGFLPSLSKIAAARQGIWASQEKWGPFADILAFLIFGVVLFPNVDGLICLTPLSGGVRKTVHGLSVVYPLSVCGGFHTYSDKPRDTRVRFKAIAHAPKKEELIGTNIWLG

SEQ ID NO: 143509 - protein, 93 aa, Glycine max
  Coding DNA Sequence Number=SeqID_26731
NRAFIQEVLRPRQAQGRNTTAALGWSASGKQTAPPPPLEFTSAHPQKRLERCPTTHGRPAGYQVQSQSRTHLVAHDPGNLNKTSASSEGRKIP

SEQ ID NO: 143510 - protein, 165 aa, Glycine max
  Coding DNA Sequence Number=SeqID_26732
MVRAFKILCPFFNIRPCTSVFLFFFQMKLIGKIGWVSLKNMSKKLFEFDSNVFCHFKDRFIKILATDVVTDGIMCDFAWRPDILVKQAKLTGGTMPSSAVVALAAGEGGQPTAKVGLGAAEIAPSAPSSVLAKRKWDDSVRTSGHKKSRASMSLCALRQAARLTL

SEQ ID NO: 143511 - protein, 95 aa, Glycine max
  Coding DNA Sequence Number=SeqID_26733
MIKENQCSLCKESEESIGHLFFECKITKSIWEQILKWIEVTHEPKTWDVELKWAIRETGKKGWKAKLLKLALTETLYEMLARSHEIAMYLSDFLN

SEQ ID NO: 143512 - protein, 352 aa, Glycine max
  Coding DNA Sequence Number=SeqID_26734
  Gene Ontology: Mol. function=nucleic acid binding; Cellular component= mitochondrion; Biological process=DNA integration
  Homolog annotation: Hit_ID=Q1SRN1; Match level="QueryCoverage=99%, HitCoverage=23%, E-value=1e-112, Identity=55%"; Hit description =Integrase, catalytic region
MTPRCTKDALQNPQWLAVMKAEYMALMQNNTWDLVPLPPHRKAIGSKWIYRLKYNADGFVARHKARLVAQGFSQRPGLDCNETFSPVIKPATIRIVLSIWTSTMLFLNGTIQEEVYMQQPEGFTSANSHLVCKLKKSIYGLKQAPRAWFSKLASSLISFGFKPTRCDTSLFVHATPKFITYILVYVDDIIITGSSTFAVQSVISKLHSLYPLKDLGTLHFFLGIEANYTTTGALLLSQSKYMIDLLAKVNMHNAKPIKTPLAPGSKLHMDGTNSFFDPTLFRSVVGALQYATITRLDIAYAVNKLCQFMHSPLESHWKATKRVLRYLNGTVDHGLAFYPSQHLFITGYSDSD

SEQ ID NO: 143513 - protein, 45 aa, Glycine max
  Coding DNA Sequence Number=SeqID_26735
MGSGMGVMGAASVGAGGLIGLMVAIEGGRPRNMHGVDRNSSLVLV

SEQ ID NO: 143514 - protein, 147 aa, Glycine max
  Coding DNA Sequence Number=SeqID_26736
  Gene Ontology: Mol. function=transcriptional repressor activity; Biological process=negative regulation of transcription
  Homolog annotation: Hit_ID=P21323; Match level="QueryCoverage=89%, HitCoverage=69%, E-value=1e-26, Identity=44%"; Hit description =Hypothetical 21.9 kDa protein
  Pfam annotation: Domain name=Phage_CI_repr; Domain location=24-88; Score=130.0; E_value=6.4e-36; Accession=PF07022.3; Description =Bacteriophage CI repressor helix-turn-h
MSNTIKTPNDESTHLYPSQGGGKEAIARIMEAYKFSTRQALCNHLGVSQSTMANRWMRDTFPHDWLIACHLDTGVSLLWLATGQGELMDSASPSSESRMRYKKISNGQFTEEILVAYDSRLLPPAISNPLLVEFDGTTYLIEESKIE

SEQ ID NO: 143515 - protein, 45 aa, Glycine max
  Coding DNA Sequence Number=SeqID_26737
MYRGPRGSFGVEGRSKVGPSGQAEGIYTKAPDPIRTPQLSVLGRE

SEQ ID NO: 143516 - protein, 68 aa, Glycine max
  Coding DNA Sequence Number=SeqID_26738
MAEEAPPKLPLRHTLGNYIATIEINGIMEDSIKMRLFPFSLREDKGASLGKTLSNKFISYYFLHSSFI

SEQ ID NO: 143517 - protein, 109 aa, Glycine max
  Coding DNA Sequence Number=SeqID_26739
MRCKASGWLVKFYSNNSVGQYLGDLFSWVQEFYTQIMKREPTTFACDTRLFTDQSDSDTETRHITAGDIRDNERTRCKAERGARGEQGGGSGTQQWGPRWGCVDWDNGM

SEQ ID NO: 143518 - protein, 71 aa, Glycine max
  Coding DNA Sequence Number=SeqID_26740
MANNIIAKQKHGGKITGKGITTAVTRGRTVEGKTKMNRKIQEKHSLCKVEEKAYTLLACLVRCLKTELTMN

SEQ ID NO: 143519 - protein, 68 aa, Glycine max
  Coding DNA Sequence Number=SeqID_26741
  Gene Ontology: Mol. function=protein dimerization activity; Cellular component=nucleus; Biological process=regulation of transcription, DNA-dependent
  Homolog annotation: Hit_ID=O24542; Match level="QueryCoverage=86%, HitCoverage=31%, E-value=1e-28, Identity=95%"; Hit description=Auxin- induced protein 22D
  Pfam annotation: Domain name=AUX_IAA; Domain location=1-68; Score= -24.2; E_value=1e-07; Accession=PF02309.7; Description=AUXIAA family
MKNKVVNACDPGQYSEREGYNGSEYAPTYEDKDGDWMLVGDVPWNMFVSSCKRLRIMKGSEAKGLGCF

SEQ ID NO: 143520 - protein, 102 aa, Glycine max
  Coding DNA Sequence Number=SeqID_26742
MPQYSFQALPTSNVFEGISQSFGASFNTLSYAYNPPPSSSCYRPSLPTQIHDMGHEDEEEDDDNNNTNINDDGNNDDVHGGDDVPQQQQRITRDHPRTKEER

SEQ ID NO: 143521 - protein, 89 aa, Glycine max
  Coding DNA Sequence Number=SeqID_26743
  Gene Ontology: Mol. function=transcription regulator activity; Cellular component=nucleus; Biological process=regulation of transcription
  Homolog annotation: Hit_ID=Q8L9U3; Match level="QueryCoverage=94%, HitCoverage=27%, E-value=1e-15, Identity=55%"; Hit description =Putative lipoamide dehydrogenase
  Pfam annotation: Domain name=HLH; Domain location=32-81; Score=35.9; E_value=1.4e-07; Accession=PF00010.16; Description=Helix-loop-helix DNA-binding domain
  Subcellular localization annotation: CTP_CleavageSite=26; ConfidenceScore=5.22e-01
MVFDGQPMPTTVPTAPHLPAVRPRVRARRGQATDPHSIAERLRRERIAERIRALQELVPSVNKTDRAAMLDEIVDYVKFLRLQVKVNAL

SEQ ID NO: 143522 - protein, 107 aa, Glycine max
  Coding DNA Sequence Number=SeqID_26744
MAPHQNLIPCTLLLSFCSHEQVSVKATLSHKATPLPPHPHGDQPESQGSSKPSDTPPSTSIPPHKELQGHPTRSMHHPHDHTQHTTYGRRSLKYMTMDELKCLSIPS

SEQ ID NO: 143523 - protein, 68 aa, Glycine max
  Coding DNA Sequence Number=SeqID_26745
MELLQNGHKNLVSIKPSELPLLNGAALTLLNSLSETHEYYGNIDPSRVFVTKVKRIIVKVKENIDASQ

SEQ ID NO: 143524 - protein, 107 aa, Glycine max
  Coding DNA Sequence Number=SeqID_26746
  Homolog annotation: Hit_ID=Q10C30; Match level="QueryCoverage=44%, HitCoverage=7%, E-value=4e-17, Identity=87%"; Hit description =Guanylate-binding family protein, putative, expressed
MDKRIDIKDDFKARIPSMDWIKDLIREADISRLSFAVELAEEFYGRVKGQDVAFEPAKLLWLIQRDFLHEITSNKNIVARGKGPDNWTLCTILILHDNISITLICIN

SEQ ID NO: 143525 - protein, 73 aa, Glycine max
  Coding DNA Sequence Number=SeqID_26747
MRNKNLEKQYPHKEGFGQLIPEIDRGKADEANGTGSASIQDLGWWCMNFMLWCACKVVMGCGSDFGGGVTGRG

SEQ ID NO: 143526 - protein, 301 aa, Glycine max
  Coding DNA Sequence Number=SeqID_26748
  Gene Ontology: Mol. function=GTPase activity; Biological process =immune response
  Homolog annotation: Hit_ID=Q10C30; Match level="QueryCoverage=77%, HitCoverage=48%, E-value=3e-85, Identity=69%"; Hit description =Guanylate-binding family protein, putative, expressed
MKDVELDQLYVKRREQLKKLVASIITPKIVQGKTLNGKEFVSFLEQILEALNKGEIPSTGSLVEVFNKNILEKCLKLYSEKMAKLVLPLPEKSLQGAHDRSRDEVTKVFDQQHFGRHHAKKSFMQLDEEIQQVYKNVVLQNEYQSSRLCEALYTRCEDKMDQLQVLKLPSLAKFNADDGEVSVSVYKGVQSQALQLVGGLLPGYESLYYNPVWHFIVATWETVVYSPILDLDRTSRRQWAMLGFSYGEIFLSLGATAALIGPKDLPIICRTAGRLAGRAIGCVQLARGQFDTVMQQSQARR

SEQ ID NO: 143527 - protein, 379 aa, Glycine max
  Coding DNA Sequence Number=SeqID_26749
  Homolog annotation: Hit_ID=Q9LIJ8; Match level="QueryCoverage=74%, HitCoverage=77%, E-value=1e-68, Identity=50%"; Hit description =Arabidopsis thaliana genomic DNA, chromosome 3, BAC clone:F5N5
  Pfam annotation: Domain name=DUF506; Domain location=88-305; Score =372.0; E_value=9.1e-109; Accession=PF04720.3; Description=Protein of unknown function (DUF506)
MARIEKCDTAELQSSRIRNGKDEQPIDSQVLAEGTQLELAKPVVKSRLKRLLERQFSGVLRNSAPEKIAGDDETLNGSNDFEPSSACLAKMVQSFIEESHEKHSASHHRNRCNCFNRNYDDSSDEDSNSFGGSGDSNFSSGEACETLKGLVACASVRERNLLADTAKIVEKNKICKRKDNFCRKILTDELLTLGYDASICKSRWEKSPSYPAGEYEYIDVMMGKERILIDIDFRSEFEIARSTKAYKTILQNLPYIFVGTCERLQSIVALVSEAAKQSLKKKGMHVPPWRRAEYVKAKWLSPYTRTTNSANDIKEEKKKEEQQQQLLKENLFAAESESSGEDNTAVVEWKPPELKPKGSLSGVKVVTGLAVAFHNDNNP

SEQ ID NO: 143528 - protein, 105 aa, Glycine max
  Coding DNA Sequence Number=SeqID_26750
  Gene Ontology: Mol. function=GTPase activity; Cellular component =intracellular; Biological process=immune response
  Homolog annotation: Hit_ID=Q8S8C8; Match level="QueryCoverage=93%, HitCoverage=45%, E-value=2e-46, Identity=88%"; Hit description =Putative guanylate binding protein
MSTLHDPSILVIGPYRSGKSFLLNQLLSLSCYEGFGVGHMRDTKTKGIWVWGTPIDLDINGVRTSVFYLDTEGFESVGKSNVYDDRIFALATVLSTVLIYNLPET

SEQ ID NO: 143529 - protein, 75 aa, Glycine max
  Coding DNA Sequence Number=SeqID_26751
MGRRRNESATCDPTWRNTRSVMVKFVISAEGGNCRKCPRDADAFRKQAHESRQWRGQFQNHFQFRAWAGFNAVLV

SEQ ID NO: 143530 - protein, 717 aa, Glycine max
  Coding DNA Sequence Number=SeqID_26752
  Gene Ontology: Mol. function=protein serine/threonine kinase activity; Cellular component=cell surface; Biological process =protein amino acid phosphorylation
  Homolog annotation: Hit_ID=Q6UY58; Match level="QueryCoverage=92%, HitCoverage=97%, E-value=0.0, Identity=62%"; Hit description=Lectin -like receptor kinase 7;3
  Pfam annotation: Domain name=Lectin_legB; Domain location=25-264; Score=349.1; E_value=7.5e-102; Accession=PF00139.10; Description =Legume lectin domain
  Pfam annotation: Domain name=Pkinase; Domain location=345-615; Score =158.7; E_value=1.5e-44; Accession=PF00069.15; Description=Protein kinase domain
  Pfam annotation: Domain name=Pkinase_Tyr; Domain location=345-615; Score=119.5; E_value=9.9e-33; Accession=PF07714.7; Description =Protein tyrosine kinase
  Pfam module annotation: Pfam domain module=Lectin_legB::Pkinase::Pkina se_Tyr; Domain location=25-264::345-615::345-615
MANLNMLLQQFLHVLLFLLIPVSSQPNQLFYDGFLGSNIMSLRGVAEIESNGILKLTDDSSRVVGQAFYPTGLRFKNSSDGKAFSFSSSFALIIFPEYEKLGGHGLAFTIASSKNLKALPSQYLGLLNSTSTGNSSNHLFAVEFDTAQDFEFGDIDDNHVGIDINSLVSIASAPVGYYTGGDDNSTKQNLTLTSGEPIIAWVDYDASQSVVNVTISESSTKPKRPLLSHHVDLSPIFEDLMFVGFSASTGLLASSHYILGWSFKINGPAPPLELSSLPQLPGPKKKHTSLITGVSISGFLALCGFLFGIYMYRRYKNADVIEAWELEIGPHRYSYQELKKATKGFKDKELLGQGGFGSVYKGTLPNSNTQVAVKRISHDSKQGLREFVSEIASIGRLRHRNLVPLLGWCRRRGDLLLVYDFMENGSLDKYLFDGPKTILSWEQRFKVIKDVASALLYLHEGYEQVVIHRDVKASNVLLDGGLNGRLGDFGLARLYEHGANPSTTRVVGTFGYMAPEVPRTGKSTPNSDVFAFGALLLEVACGLRPLEPKALPEDVVLVDCVWNKYKQGRILDLVDPKLNGAFNEREVLMVLKLGILCSNAAPAARPSMRQVVRFLDGEVGLPDELRKPEEVGYQEGFDEFMNSLEPSSFYQMSTSSYAIKTDMDARFPFIDTSLYTLHARGETSLKGILPGKLKNVAIVIAVVAIATVVMQMAVVVA

SEQ ID NO: 143531 - protein, 682 aa, Glycine max
  Coding DNA Sequence Number=SeqID_26753
  Gene Ontology: Mol. function=glutamate-5-semialdehyde dehydrogenase activity; Cellular component=cytoplasm; Biological process=amino acid biosynthetic process
  Homolog annotation: Hit_ID=Q9AYM4; Match level="QueryCoverage=99%, HitCoverage=92%, E-value=0.0, Identity=82%"; Hit description=VuP5CS protein
  Pfam annotation: Domain name=AA_kinase; Domain location=1-240; Score =180.2; E_value=5e-51; Accession=PF00696.18; Description=Amino acid kinase family
  Pfam annotation: Domain name=Aldedh; Domain location=247-638; Score= -279.6; E_value=0.0011; Accession=PF00171.12; Description=Aldehyde dehydrogenase family
  Pfam module annotation: Pfam domain module=AA_kinase::Aldedh; Domain location=1-240::247-638
VGTAVVTRSDGRLALGRIGALCEQLKELSSQGYEVILVTSGAVGLGRQRLRYRKLANSSFSDLQKPQGELDGKACAAVGQSSLMALYDTMFSQLDVTSSQLLVNDGFFRDSGFRKQLSDTVNSLLDLRVIPIFNENDAVSTRKAPYEDSSGIFWDNDSLAGLLALELKADLLVLLSDVEGLYSGPPSDPNSKLIHTYVKEKHQGEITFGDKSRLGRGGMTAKVNAAVCAAHAGIPVIITSGYATNNIIRVLQGERIGTVFHKDAHLWTNIKEMSAREMAVAAREGSRQLQILKSEDRRKILLAIADALEKNESMIRHENEADVADAVISSLAKSVRLLADMEEPIGQILKRTELVDKLILEKTSCPLGVLLVIFESRPDALVQIAALAIRSGNGLLLKGGKEARRSNAILHKVITSVMPDTVGDKLIGLVTSRDEIPDLLKLDDVIDLVVPRGSNKLVSQIKESTKIPVLGHADGICHVYVDKSANFDMAKQIVRDAKTDYPAACNAMETLLIHKDLSNNGGLNELVLELQREGVKMFGGPRASGLLNIAETNTFHHEYSSLACTVEIVEDVFAAIDHINQHGRHVGAHTECIVTEDSEVAETFLSQVDSAAVFHNASTRFCDGARFGLGAEVGISTSRIHARGPVGVEGLLTNRWILRGSGHVVDGDQGIDYTYKELPLKA

SEQ ID NO: 143532 - protein, 155 aa, Glycine max
  Coding DNA Sequence Number=SeqID_26754
  Gene Ontology: Mol. function=chitin binding; Cellular component =extracellular region; Biological process=chitin metabolic process
  Homolog annotation: Hit_ID=Q86AI8; Match level="QueryCoverage=96%, HitCoverage=33%, E-value=1e-14, Identity=36%"; Hit description =Similar to Homo sapiens (Human). Mucin 2
MTGPLNESISCFLKRVDPWVLVPSPSEDYTSSPLEGCTSSPSEGCTPSPSEDYTSSPSEDYMPSEGCTPSEDCMSLPSEGRTPSPSEDYTSSPLEDYTSSPLEGCTPSPSEGYVSSPSEGYMHALRGLRVLTFRGLHALAFRGLHALTFRVLHAL

SEQ ID NO: 143533 - protein, 91 aa, Glycine max
  Coding DNA Sequence Number=SeqID_26755
MTHDNHVKIFACHIIIRRTFEALGEGNKWWSVMKKLKFESGVQWKKGKTMVHGRVNVCGVDLTDGDPVGKEPSLLPANIVQVRPMNILPMP

SEQ ID NO: 143534 - protein, 104 aa, Glycine max
  Coding DNA Sequence Number=SeqID_26756
MVIRTFRQLGANELVDAQRLTSSSAPFVIQGQRVRWQVEIPYGRPHLSSTKANEFDGFYSRCPETFKPDDARHSSLLGGDDQVRWCVEMTWLSHFNAFKTLKFC

SEQ ID NO: 143535 - protein, 70 aa, Glycine max
  Coding DNA Sequence Number=SeqID_26757
MIHAPDSTLRCNVVRTNNQIPGNSLSASTRHSHLGNHAEFVETTRLCTMAKSSAKDHGPIKVPKHPLRNT

SEQ ID NO: 143536 - protein, 178 aa, Glycine max
  Coding DNA Sequence Number=SeqID_26758
MESRKRDRMEDIPSSSIPAPLLVTVGQDVQSSLTLVPMLQSLFRGQFIIMHSLQELAHNRPIISMEHFLEQVAWPEAQLPLVRPNEVAPPEPTPVQVNSEPANPQSPVVNPPSSPELEAVPPSPPLIVIYDASSDEATALLDSPTVETADPPVSPIGGIANLSDSSSGEVVALTDSPV

SEQ ID NO: 143537 - protein, 183 aa, Glycine max
  Coding DNA Sequence Number=SeqID_26759
  Gene Ontology: Mol. function=transferase activity, transferring glycosyl groups; Cellular component=nucleus; Biological process =nucleoside metabolic process
  Homolog annotation: Hit_ID=P93394; Match level="QueryCoverage=58%, HitCoverage=47%, E-value=1e-48, Identity=86%"; Hit description =Uracil phosphoribosyltransferase
  Pfam annotation: Domain name=Pribosyltran; Domain location=15-136; Score=9.6; E_value=0.00087; Accession=PF00156.17; Description =Phosphoribosyl transferase domain
MAELGRLLMYEASRDWLPTVSGEIQSPMGVASVEFIDPREPVAVIPILRAGLALAEHASSILPATKTYHLGISRDGETLQPTIYLNKLPGKFPEGSKVFVVDPMLATALKQHVICSAVIIAYIWDLNVGVLFFYIKLSFVSSFSWLHEYERAIIYKLELYMDWVACWLWNLLGSNCKGVGFGT

SEQ ID NO: 143538 - protein, 60 aa, Glycine max
  Coding DNA Sequence Number=SeqID_26760
MWDENYSQSVSQVEQHSTNLEITPIPNGENVPTPSHETIFVPPPMSTVFRPPPLRPRAPI

SEQ ID NO: 143539 - protein, 86 aa, Glycine max
  Coding DNA Sequence Number=SeqID_26761
  Subcellular localization annotation: CTP_CleavageSite=52; ConfidenceScore=5.37e-01
SLLYNKEKNKMKDCKNTSGEDVSFTSRIPQPLTNSSQALRTASSSSSGGLVRAHALSTILDRLAHISEFRLSACFSRLADGLKRCA

SEQ ID NO: 143540 - protein, 54 aa, Glycine max
  Coding DNA Sequence Number=SeqID_26762
MRVKMPVFEGEDSLGWIVYAEKFFAAALIKCYGDTGRGDVYECLIALRQMGDFD

SEQ ID NO: 143541 - protein, 131 aa, Glycine max
  Coding DNA Sequence Number=SeqID_26763
MRTDGSTASSRIQYNGAPHFIKLRKNGQQYYLADGLKDFRRNFNIHEGVLLLPTEAIDFVDASRPCMTVQHTSGVRHIWTISMHNGEQYVDDPWHRFLTDNDLMGGNEVVFYYRPNEHVWEPIWDEHDEST

SEQ ID NO: 143542 - protein, 275 aa, Glycine max
  Coding DNA Sequence Number=SeqID_26764
  Gene Ontology: Mol. function=RNA-directed DNA polymerase activity; Cellular component=nucleus; Biological process=RNA-dependent DNA replication
  Homolog annotation: Hit_ID=Q2HRL2; Match level="QueryCoverage=91%, HitCoverage=84%, E-value=3e-29, Identity=38%"; Hit description=RNA -directed DNA polymerase
MEVVKKLTEDVIRWNSMEDNYMMQKAKLDWLKMGDDNSAFFHAYVKTKSKTKSMRMVQTSDGTLLSTRAKIEQEVLEFYGNLMGKANHSLNHIDIGVMRKGRQVNMEQRKHLVSKVTVKEIEYALHGIGDLKAPGEDGYSAKFFEVCWSFIKKDVIAANDDAKCVKDYRPIAGCTAFYKIISKILTARALEDVMQEIGLPRTFTNWIMTTVKTVSYSFNINGQMTEDMQACRGIRQGDPISPLLFVIMMEYFNRMGDSKSVDMMLDTVQNFSDAT

SEQ ID NO: 143543 - protein, 56 aa, Glycine max
  Coding DNA Sequence Number=SeqID_26765
  Gene Ontology: Mol. function=transferase activity, transferring glycosyl groups; Biological process=nucleoside metabolic process
  Homolog annotation: Hit_ID=P93394; Match level="QueryCoverage=71%, HitCoverage=18%, E-value=1e-10, Identity=80%"; Hit description =Uracil phosphoribosyltransferase
MTSLHNPTVVDHSGRGTIVAAVSLLKERGVGNKQIKVISAVSAPPALQKLSEQFPG

SEQ ID NO: 143544 - protein, 45 aa, Glycine max
  Coding DNA Sequence Number=SeqID_26766
MSVKNLVRRPEVHDKTNHTLGDPGETSQGPLFYENAPTIWDQHML

SEQ ID NO: 143545 - protein, 623 aa, Glycine max
  Coding DNA Sequence Number=SeqID_26767
  Gene Ontology: Mol. function=transferase activity; Cellular component= mitochondrion; Biological process=metabolic process
  Homolog annotation: Hit_ID=Q1SQX3; Match level="QueryCoverage=99%, HitCoverage=100%, E-value=0.0, Identity=66%"; Hit description=IMP dehydrogenase/GMP reductase
  Pfam annotation: Domain name=PPR; Domain location=147-181; Score =30.1; E_value=8e-06; Accession=PF01535.11; Description=PPR repeat
  Pfam annotation: Domain name=PPR; Domain location=182-216; Score =16.2; E_value=0.09; Accession=PF01535.11; Description=PPR repeat
  Pfam annotation: Domain name=PPR; Domain location=217-251; Score =46.2; E_value=1.1e-10; Accession=PF01535.11; Description=PPR repeat
  Pfam annotation: Domain name=PPR; Domain location=252-286; Score =45.3; E_value=2e-10; Accession=PF01535.11; Description=PPR repeat
  Pfam annotation: Domain name=PPR; Domain location=287-321; Score =48.2; E_value=2.9e-11; Accession=PF01535.11; Description=PPR repeat
  Pfam annotation: Domain name=PPR; Domain location=322-356; Score =48.1; E_value=3e-11; Accession=PF01535.11; Description=PPR repeat
  Pfam annotation: Domain name=PPR; Domain location=357-391; Score =39.6; E_value=1.1e-08; Accession=PF01535.11; Description=PPR repeat
  Pfam annotation: Domain name=PPR; Domain location=392-426; Score =49.7; E_value=1e-11; Accession=PF01535.11; Description=PPR repeat
  Pfam annotation: Domain name=PPR; Domain location=427-461; Score =38.7; E_value=2e-08; Accession=PF01535.11; Description=PPR repeat
  Pfam annotation: Domain name=PPR; Domain location=462-496; Score =43.3; E_value=8.5e-10; Accession=PF01535.11; Description=PPR repeat
  Pfam annotation: Domain name=PPR; Domain location=497-531; Score =64.1; E_value=4.4e-16; Accession=PF01535.11; Description=PPR repeat
  Pfam annotation: Domain name=PPR; Domain location=532-566; Score =43.4; E_value=7.9e-10; Accession=PF01535.11; Description=PPR repeat
  Pfam annotation: Domain name=PPR; Domain location=567-601; Score =49.6; E_value=1e-11; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=147-181::182 -216::217-251::252-286::287-321::322-356::357-391::392-426::427 -461::462-496::497-531::532-566::567-601
  Subcellular localization annotation: CTP_CleavageSite=40; ConfidenceScore=5.20e-01
MKFLKIFNSKPFKLRTFNSLSHSQTPPFSIPTTLTESTLLHSIESSQWHFIEQVAPHLTPSLLSSTLTTLRHNPQLVLHLLSHLQNHPHSLDLATSSLAICVLYRLPSPKPSINLIQRLILSPTCTNRTIFDELALARDRVDAKTTLIFDLLVRAYCELKKPNEALECFYLIKEKGFVPNIETCNQMLSLFLKLNRTQMAWVLYAEMFRMNIRSSLYTFNIMINVLCKEGKLKKAKEFIGHMETLGVKPNVVTYNTIIHGHCLRGKFQRARVIFQTMKDKGLEPDCYTYNSFISGLCKEGRLEEASGLICKMLEGGLVPNAVTYNALIDGYCNKGDLDKAYAYRDEMISKGIMASLVTYNLFIHALFMEGRMGDADNMIKEMREKGMMPDAVTHNILINGYCRCGDAKRAFGLLDEMVGKGIQPTLVTYTSLIYVLGKRNRMKEADALFSKIQQEGLLPDIIVFNALIDGHCANGNIDRAFQLLKEMDNMKVLPDEITYNTLMQGYCREGKVEEARQLLDEMKRRGIKPDHISYNTLISGYSKRGDMKDAFRVRDEMMTTGFDPTILTYNALIQGLCKNQEGEHAEELLKEMVSKGITPDDSTYLSIIEAMETVDDLEGNDDK

SEQ ID NO: 143546 - protein, 91 aa, Glycine max
  Coding DNA Sequence Number=SeqID_26768
MSAMLREKVLPRKPLLSEAKEGSERNQEEEKETQKKKENTNIKRDTSNGTMSEATVFLRTSRNEQQQNQDVLYFLQAFWLQYVLYISPRDM

SEQ ID NO: 143547 - protein, 759 aa, Glycine max
  Coding DNA Sequence Number=SeqID_26769
  Pfam annotation: Domain name=WD40; Domain location=1-37; Score=20.5; E_value=0.0059; Accession=PF00400.22; Description=WD domain, G-beta repeat
  Pfam annotation: Domain name=WD40; Domain location=111-149; Score =24.7; E_value=0.00033; Accession=PF00400.22; Description=WD domain, G-beta repeat
  Pfam annotation: Domain name=WD40; Domain location=153-190; Score =34.9; E_value=2.7e-07; Accession=PF00400.22; Description=WD domain, G-beta repeat
  Pfam annotation: Domain name=WD40; Domain location=200-238; Score =16.4; E_value=0.1; Accession=PF00400.22; Description=WD domain, G -beta repeat
  Pfam annotation: Domain name=WD40; Domain location=245-281; Score =30.6; E_value=5.6e-06; Accession=PF00400.22; Description=WD domain, G-beta repeat
  Pfam annotation: Domain name=WD40; Domain location=288-339; Score =31.9; E_value=2.3e-06; Accession=PF00400.22; Description=WD domain, G-beta repeat
  Pfam annotation: Domain name=WD40; Domain location=39-75; Score=14.7; E_value=0.34; Accession=PF00400.22; Description=WD domain, G-beta repeat
  Pfam module annotation: Pfam domain module=WD40::WD40::WD40::WD40::WD4 0::WD40::WD40; Domain location=1-37::111-149::153-190::200-238::245 -281::288-339::39-75
NGLIGSLVRKEGHIYSLAVSGNLLYTGSDSKNIRVWKDLKDFTGFKSSSGLVKTIVISGGKIFTGHQDGKIRVWKVSSKNPSNHKRIGSLPTFKEYVKSSMNPKNYVEVRRHRNAVKVKHFDAVSSLSLDEEEGLLYSGSWDKTLKVWRVADSKCLESISAHDDAVNAVAAAFGGCVLTGSADGTVKMWRRENQGKKFKHVLDRVLLKRENAVTALAVNRLATVVYCGSSDGLVNFWERDQKGGFLHGGVLRGHKLAVLCLAAAGNLVFSGSADKNVCVWKRDENGFHTCHSVLTGHSGPVKCIAVEEAEPPPEGRCEKGNLRWIVYTGSLDKSVKVWCVSEHAPDASVFQSWATPYHSSSSAAGFSYSSPGKISVNSSPAWSYSSPRRIGVSSVSAGFNYSSPTSFGLNSSSSPAGGMIYSSPRKINVSNNSGNSNRNGDSTQSFDNDDDDDDRCIFNGNGTNNRSSSTKSGDNGIGSNNRDSVKSSGNGENNRNNGSSKSGDNGSNNVNRDNAKSGGNDSNNRISDSSKSGGDGSNSRDSDSAYGSGNNIRNKDGAKSNGIAYTIVIVLKTIPVMVMMLMATRTTIIMLKAMGIAMTIATAIVLKAVALATASETVIVLKAIAMSMAITTAAARVMVLKAITITLATVRVPVAITAKPVRTLKAMPMAITIAAARVMVLVAMERAITTATVMVLKAMPLEMTTKIVVLKAVTMAMKRSIATVAAMLKQCDERVKAREMKIENEVELTRVVIVTGGCA

SEQ ID NO: 143548 - protein, 280 aa, Glycine max
  Coding DNA Sequence Number=SeqID_26770
  Homolog annotation: Hit_ID=Q1S2M5; Match level="QueryCoverage=34%, HitCoverage=25%, E-value=2e-09, Identity=36%"; Hit description =Transcriptional factor B3; Cupredoxin
  Pfam annotation: Domain name=B3; Domain location=10-106; Score=64.1; E_value=4.5e-16; Accession=PF02362.12; Description=B3 DNA binding domain
MSTGAQRYPDFFKVFLPERHSERMLIPNAFVRLPQLQGRIPEDVILRNASGRVWHVKTRYVGEKLYFDDGWRAFHQENCLGQADFLVFKLERRNEFVVLILQLSTQCQKPLVKMEEEQAATQLVEEPDSSSDDDDEESGEEFSAGFNLQSHHRRACKRETASSSNPNAEDPLPEYVFDPQMCIHPENHFFKAKLYRTRPNELHIPGNAIQEFSLTLPEKITLICCQPCQRKDIPMNELGDYHHNLTPIRIKYQEVTGRDLFFFELKLLWERLSENLINFI

SEQ ID NO: 143549 - protein, 99 aa, Glycine max
  Coding DNA Sequence Number=SeqID_26771
  Gene Ontology: Mol. function=molecular_function; Cellular component =cellular_component; Biological process=biological_process
  Homolog annotation: Hit_ID=Q1SQX4; Match level="QueryCoverage=84%, HitCoverage=97%, E-value=1e-36, Identity=86%"; Hit description=Zinc finger, DHP-type
  Pfam annotation: Domain name=zf-CSL; Domain location=4-58; Score =113.3; E_value=7e-31; Accession=PF05207.4; Description=CSL zinc finger
MSYDDVEIEDMEWNEELQAYTYPCPCGDLFQITKEDLMLGEEIARCPSCSLYITVIYNLEDFLADSDQNRRNKGLQPSKQQPLTGASANSAGVCVWLRS

SEQ ID NO: 143550 - protein, 842 aa, Glycine max
  Coding DNA Sequence Number=SeqID_26772
  Gene Ontology: Mol. function=signal transducer activity; Biological process=G-protein coupled receptor protein signaling pathway
  Homolog annotation: Hit_ID=O81225; Match level="QueryCoverage=82%, HitCoverage=77%, E-value=0.0, Identity=52%"; Hit description=Extra -large G-protein
  Pfam annotation: Domain name=G-alpha; Domain location=403-791; Score=- 23.4; E_value=3.6e-16; Accession=PF00503.10; Description=G-protein alpha subunit
MIYMASLLKNLRPGVPSVHDDGSHHYSYEYSFAEEYKGPPLNYSIPEILPFNVNQIPLAHVADHSPPHHLSLPVIQPFTKINAELDSRTDSISSEPLSCREEEDHHDDHDGPLSPKHVKRPSVVTFRDPTTNEIVEDEELVESVRGKSNSSSSSSSSRVRPHAVRGGKKGSCYRCLKGNRFTEREVCIVCSAKYCGNCVIRAMGSMPEGRKCVTCIGYRIDESKRGKLGKPSRMLKKLLSEWGMKQIMKDEMFCKANQIPAENVMVNGEPLDWDKLTLLLTCSNPPKGLKPGFYWYDKASGFWGKEGQRPSQIISPQLEVGGHLERNASNGKTNVTVNGREITKEELWLLKWAGVPCEGTTEFWVSHDGSYMEVGQKNVKGNIWKKSTVKLASLVLSLPVPSSTLNLTAEEENGISEHNLQQKTLHKFLLVGSVKSGTCTIFKQAKLLYNVPFSENERQNIKLVIQSNLYRYLGIILEAREIFEESLRQKTNGRHFDESTSSGITGEIVDTTYSIGPRLKAFSDWLLKYMVSGNLDAIFPAAAREYAPLVEELWRDAAIQATYNRINEIKNLPRSASYFLERAIEISRIDYEPLDTDILYAEGITLSNGLSSMEFSYTVTGHEDSLDPEYQHDPSLRYQLTRVNPKSLGENCKWLDMFEDTDVALFSVALTDYDEYIVDSNGVAINKILAAKHLFESIITHRVFSNKKFLLLLTKFDLLEEKIEQVPLTQCEWFCDFDPVISHNHKTDSIRKHSNHPPLAQRAFQYIGTKFKRLFNSHTGRKLFVSLVTGLEPGTVDEALRYAREVLVWEKWDPTLRNEKSEITSTTFEASSDEKYNNYHPS

SEQ ID NO: 143551 - protein, 131 aa, Glycine max
  Coding DNA Sequence Number=SeqID_26773
  Homolog annotation: Hit_ID=Q2HPL4; Match level="QueryCoverage=59%, HitCoverage=32%, E-value=6e-21, Identity=61%"; Hit description=Expp1 protein precursor
MGMDEFFAMSKMRKADLVKRVVVIAVMAMFVADAADTNDVYSPCLDAKVQRGDGFTFGIAFSDKQFFSQGNGPQLSPCDKRLDLANKGAQLSVFRPTVDEVSLLTINRSTSNPEMLSARFMRMICLYLTLV

SEQ ID NO: 143552 - protein, 276 aa, Glycine max
  Coding DNA Sequence Number=SeqID_26774
  Gene Ontology: Mol. function=DNA binding; Biological process =regulation of transcription, DNA-dependent
  Homolog annotation: Hit_ID=Q1SQW9; Match level="QueryCoverage=92%, HitCoverage=53%, E-value=3e-75, Identity=58%"; Hit description =Transcriptional factor B3; Cupredoxin
  Pfam annotation: Domain name=B3; Domain location=36-126; Score=56.5; E_value=8.5e-14; Accession=PF02362.12; Description=B3 DNA binding domain
MPHPSFHKLLLPSTVQPNQQLWNAPSSVCITNNYQYLESNLTCELQRLPDNFMRKYGGELLPIVTLSVPDGSVWRVGLKKADNKYWFLDGWKEFVKHYSISIGYLLVFKYEGKSSFSVHIFNLATSEINYQSATRSSNEGLHFTNRLKLFEEIEDEDSIEISDSSPSHLAPSSLQNQALTGSVDKMMPGKSYTPPALQNLFNGSKLNSINWGEGGNAHSSRIANSLDNRLTRDIGLQFNAVEFKRSTEELKLRASMEERMKKTTRKKRKSGLSSIF

SEQ ID NO: 143553 - protein, 94 aa, Glycine max
  Coding DNA Sequence Number=SeqID_26775
MSWNFTDFLTMGVKYLKVAKRRSHPTKQMAKKLWDHKVPPHVIGPAAWMTKGEKKRGTKWFLACHRARCLWMTKGEKSAAPYGSPHVIRPAASG

SEQ ID NO: 143554 - protein, 58 aa, Glycine max
  Coding DNA Sequence Number=SeqID_26776
MGSSLAMGCSSRFDVCVCGSCEGGVKGDEGWFCWSKEVGELDWKVRLGELVTRVRWEG

SEQ ID NO: 143555 - protein, 190 aa, Glycine max
  Coding DNA Sequence Number=SeqID_26777
MESNAAPAAVVSSAAEADLTLSTAAHHPIPNKVGREKSTPGHVGNPHLGYNRGAYPYGLPPNYTPPVIRDDAGHVPPPILEGEPPRHPDVVHEDHREHAQGDIDSYSPFSTEGLAPNALPQPNITGEPRSHPTQPIFLSVGGPPLAAEGTGKLDLIEERLRVVEGFGDYLFVDMTDLCLVPDVVIPPKFK

SEQ ID NO: 143556 - protein, 158 aa, Glycine max
  Coding DNA Sequence Number=SeqID_26778
DVPHGRSHLRAWRSGFLLPRCLPASSSSASAENACRKSTPNKSPVLELGHDIAVKGSLWAMKNELVFPQHHRTIAGLQKYQCDDPEKDIDTSGSDTQQMFVACNTFHGHAPPFVGNILPLQQCPFFCLSPEFQYLTEVCETVVQEIDALMRDHVTLAQ

SEQ ID NO: 143557 - protein, 330 aa, Glycine max
  Coding DNA Sequence Number=SeqID_26779
  Gene Ontology: Mol. function=pyridoxal phosphate binding; Cellular component=cytoplasm; Biological process=polyamine metabolic process
  Homolog annotation: Hit_ID=Q1SQV7; Match level="QueryCoverage=99%, HitCoverage=57%, E-value=1e-164, Identity=87%"; Hit description =Orn/Lys/Arg decarboxylase, major region
  Pfam annotation: Domain name=OKR_DC_1; Domain location=1-231; Score= -120.4; E_value=3e-05; Accession=PF01276.10; Description=OrnLysArg decarboxylase, major domain
  Pfam annotation: Domain name=OKR_DC_1_C; Domain location=222-318; Score=-33.1; E_value=2.7e-05; Accession=PF03711.5; Description =OrnLysArg decarboxylase, C-terminal domain
  Pfam module annotation: Pfam domain module=OKR_DC_1::OKR_DC_1_C; Domain location=1-231::222-318
MEGKKAAAVFITSPTYHGICSNLSEISELCHSHKIPLLVDEAHGAHFGFHTELPNSALQQGADLTVQSTHKVLCSLTQSSMLHMSGNIVDKEKISRCLQTLQSTSPSYLLLASLDAARAQLSESPDVVFNQAMALAYEAKCMLKRIPGISVLENSSFPTFPAIDPLRLTVGFWKVGLSGYEADEILYGDYGVVCELVGNKSITYAFNLGTCRDHVQRLLSGIKHLAATYVTIQQPEERVLTVHAPFDDKITSLIPRDAFFASKRKVTIKESIGEISGELICPYPPGIPVLIPGEVITKKAVDYLLHVRSKGGDITGASDPLLSSIVVCNV

SEQ ID NO: 143558 - protein, 246 aa, Glycine max
  Coding DNA Sequence Number=SeqID_26780
  Subcellular localization annotation: CTP_CleavageSite=49; ConfidenceScore=5.73e-01
MVMASKSNSLTFGAACFTTCPFSRTKTCCIHFLAIPNAKSRATFSLGPTLSKRMSLGILSSPIETTPTHLITPISALNSGLEASITDSNDISAILANAKIVVDSEDENKIQLRVDLTGDQTQKVFDRILTNLGRTAPPVPGFRMQKGVFLEDNLIRKCMQIPKDFLVQMLGEERVTKFSIQEILNSTMADYVKKASDFYPFICGCHGYKLISTFDDTIPGKLGCKGPEDKHYPNARTTQKIIQARK

SEQ ID NO: 143559 - protein, 243 aa, Glycine max
  Coding DNA Sequence Number=SeqID_26781
  Gene Ontology: Mol. function=pyridoxal phosphate binding; Cellular component=cytoplasm; Biological process=polyamine metabolic process
  Homolog annotation: Hit_ID=Q1SQV7; Match level="QueryCoverage=85%, HitCoverage=35%, E-value=2e-83, Identity=74%"; Hit description =Orn/Lys/Arg decarboxylase, major region
  Subcellular localization annotation: CTP_CleavageSite=31; ConfidenceScore=5.16e-01
MSPTFSLSCMSNWLCPLHFPDFANTSTFRLHCSQERSLAPPSVTSVGQDESIGRIAIRNDHVLRNNSPVLQQNGLPPLVSALKASAEQNVASFHFPGHNRGRAAPASLTRLIGTRPFVHDLPELPELDNLFCPQGPILEAQTEAAKLFGSSQTWFLVGGTTCGIQAAIMATCSPGEFLILPRNSHISAISALVLSGAVPKYIVPDYENDWDIAGGVTPLQVVWLCPISYYAYLHGKFTDENKK

SEQ ID NO: 143560 - protein, 84 aa, Glycine max
  Coding DNA Sequence Number=SeqID_26782
MAKHAELEGVASDTSEIHHTGMPSMQMAMVYLACAAGGTLQLSMLLAICNGGTLMSSVPLTTSMEEQTPLAKALGSCVTEISIS

SEQ ID NO: 143561 - protein, 280 aa, Glycine max
  Coding DNA Sequence Number=SeqID_26783
  Gene Ontology: Mol. function=chitinase activity; Cellular component =vacuole; Biological process=cell wall catabolic process
  Homolog annotation: Hit_ID=Q6RV28; Match level="QueryCoverage=88%, HitCoverage=90%, E-value=1e-100, Identity=65%"; Hit description =Class IV chitinase precursor
  Pfam annotation: Domain name=Chitin_bind_1; Domain location=34-67; Score=48.4; E_value=2.4e-11; Accession=PF00187.9; Description=Chitin recognition protein
  Pfam annotation: Domain name=Glyco_hydro_19; Domain location=82-280; Score=366.7; E_value=3.8e-107; Accession=PF00182.9; Description =Chitinase class I
  Pfam module annotation: Pfam domain module=Chitin_bind_1::Glyco_hydro_ 19; Domain location=34-67::82-280
MMMMGNNVHSIGVIGVMVSGLVLMMVSKGVSVRAQNCGCEAELCCSKYGYCGSGDDYCGKGCKEGPCYGTATPNDDVSVADIVTSEFFNAIIDQAEDHCAGKNFYSRDAFLDALIAYDQFAKTGSVDDSKREIAAAFAHFTYQSRHFCYIEEIEGASKDYCDKTNRHYPCAHNKGYYGRGPIQLSWNFNYGPAGENNGFDGLNAPETVASDPVISFKTALWYWTQNVSPVMKHGFGATIRAINGHLECDGANPETVQARVNYYTEYCSQLDVAPGDNLTC

SEQ ID NO: 143562 - protein, 97 aa, Glycine max
  Coding DNA Sequence Number=SeqID_26784
  Gene Ontology: Cellular component=chloroplast
  Homolog annotation: Hit_ID=Q1SQV4; Match level="QueryCoverage=98%, HitCoverage=25%, E-value=1e-28, Identity=72%"; Hit description =PspA/IM30; Prefoldin
MESQAEALGQLTSDDLEGKDQRIQTQVYCILGKFALLEGSSVDDDLANLKKELSGASKQKGDLPPGRSTTSANTGIPFRDAEIELELDQLRQRAKEF

SEQ ID NO: 143563 - protein, 89 aa, Glycine max
  Coding DNA Sequence Number=SeqID_26785
MVQAQGFSSLASFNNMVDHDVVESIGNKANAPSWFAVTFATVGVACSCLSFIILHHAMIQKLEKLLVNVHSQPPQSSLEIVTVEAVLML

SEQ ID NO: 143564 - protein, 189 aa, Glycine max
  Coding DNA Sequence Number=SeqID_26786
  Gene Ontology: Mol. function=hydrogen ion transporting ATP synthase activity, rotational mechanism; Cellular component=chloroplast; Biological process=ATP synthesis coupled proton transport
  Homolog annotation: Hit_ID=Q03943; Match level="QueryCoverage=85%, HitCoverage=48%, E-value=9e-68, Identity=82%"; Hit description =Membrane-associated 30 kDa protein, chloroplast precursor
  Pfam annotation: Domain name=PspA_IM30; Domain location=66-188; Score= -18.6; E_value=0.00026; Accession=PF04012.3; Description=PspAIM30 family
  Subcellular localization annotation: CTP_CleavageSite=47; ConfidenceScore=5.79e-01
MAAKLQIFTGLPPAPFQSSSSSTLCVLKKPLTTSFFGTARVEVLKLRVMRIVKPTRGGGALGARMNLFDRFARVVKSYANAVLSSFEDPEKILEQAVLEMNDDLTKMRQATAQVLASQKRLENKYKAAQQASEEWYRKAQLALQKGEEDLAREALKRRKSYAVLKRAANLWSVNESNEVVDFFSLSHGC

SEQ ID NO: 143565 - protein, 539 aa, Glycine max
  Coding DNA Sequence Number=SeqID_26787
  Gene Ontology: Mol. function=receptor activity; Cellular component =nucleus
  Homolog annotation: Hit_ID=Q0KIN6; Match level="QueryCoverage=91%, HitCoverage=100%, E-value=1e-149, Identity=53%"; Hit description=WD domain containing protein, putative
  Pfam annotation: Domain name=WD40; Domain location=206-245; Score =13.3; E_value=0.87; Accession=PF00400.22; Description=WD domain, G -beta repeat
  Pfam annotation: Domain name=WD40; Domain location=262-299; Score =3.6; E_value=14; Accession=PF00400.22; Description=WD domain, G-beta repeat
  Pfam annotation: Domain name=WD40; Domain location=377-416; Score =11.6; E_value=1.6; Accession=PF00400.22; Description=WD domain, G -beta repeat
  Pfam annotation: Domain name=WD40; Domain location=420-458; Score =14.7; E_value=0.34; Accession=PF00400.22; Description=WD domain, G -beta repeat
  Pfam annotation: Domain name=WD40; Domain location=51-89; Score=36.4; E_value=9.8e-08; Accession=PF00400.22; Description=WD domain, G-beta repeat
  Pfam annotation: Domain name=WD40; Domain location=93-134; Score=7.7; E_value=4.6; Accession=PF00400.22; Description=WD domain, G-beta repeat
  Pfam module annotation: Pfam domain module=WD40::WD40::WD40::WD40::WD4 0::WD40; Domain location=206-245::262-299::377-416::420-458::51 -89::93-134
MENLHSHRGITNATTSPPHGFTDIFRRELGLSHPNSFARRFSASEVLVKSLDLYGKLDGHEGCVNAVEFNSTGDILVSGSDDRQIMFWNWESKTKLFAYPSGHTDNIFQTKIMPFTDDCRIVTSAGDGQLNIFIMLEEHQMEGSSLAEWTSLIEHGESRFESLLATRRESSKKLYFVFYVQCIASFPVQVANMPQIRLGLLWEDGRVDTTMLGKHHGCVYKLAVEPGSAHIFYSSGEDGFIQHFDLRSNSATKLFCCSSSIGNNKQTLSKVGLNSIVIDCRNPYYFAIGGSDEYARVYDMRKCQWDSARNSDRPVNTFCPRHLIGSNNVHITGLAYSSFGELLVSYNDELIYLFEKNMHSDSSPSSATSEDSKNIHEAQVYSGHRNAQTIKGVNFFGPNDEYVLSGSDCGHIFIWKKKEAKLVRLMVGDQHVVNQHEAHPHIPILATCGIEKNVKIWAPLGNDIPPLPGNVKEIMETNRQGREDRSQRRQTLAYIERRHNRADIVSDEEDAEGYLLGFLDGDASSEEDYPGNSRDCNIS

SEQ ID NO: 143566 - protein, 1026 aa, Glycine max
  Coding DNA Sequence Number=SeqID_26788
  Gene Ontology: Mol. function=hydrolase activity; Cellular component =membrane; Biological process=proton transport
  Homolog annotation: Hit_ID=Q1SRL3; Match level="QueryCoverage=82%, HitCoverage=97%, E-value=0.0, Identity=79%"; Hit description=V-type ATPase, 116 kDa subunit
  Pfam annotation: Domain name=V_ATPase_I; Domain location=80-985; Score=547.0; E_value=1.9e-161; Accession=PF01496.9; Description=V -type ATPase 116kDa subunit family
MQIGQDHPFDRRSTSGYCVSIGGNLVSWKSKKQNVVARSSAEAEYRAMDGATCELIWIKQLLQELKFGIIQQMKLCCDNQAALHIASNPVFHERTKHIEIDCHFVWEKVLSKEVITEFVKRCGEMSRKLRFFKDQISKAGLMSSSRTELQPDIDLEDLEIQLAEHEHELIEMNSNSDKLRQSYNELLEFKIVLQKACGFLVSNHSRVVLDERELRENVYSNDAYVETVSLLEQEMRPQSSNSSGLRFISGIICKSKVLRFERMLFRATRGNMLFNLAPADEQIMDPVSADMIEKTVFVVFFSGEQARTKILKICEAFGANCYPVPEDISKQRQITREVSSRLTDLEATLEAGIRHRNKALASVADHLAKWMNMVRREKAVYDTLNMLNFDVTKKCLVGEGWCPLFAKTQMQEALQRATFDSNSQVGIILHPMDAVESPPTYFRTNTFTNPYQEIVDAYGVARYQEANPAVYTTVIFPFLFALMFGDWGHGICLLLGALVLIARENKLSTQYGDQIPIFGPSKPPVLVYQRKKRSSNHKGRMVIMVEFVREEQPSRMDRRWQISGERSVEIIASGGNMRQGGREYNQNRHKMCKGILGGFGMGQSSITYLILSLFFHYSVIHLVSVTKLGSFMEMLFGGRYVLLLMALFSIYCGLIYNEFFSVPFHIFGASAYKCRDSSCRDAHTIGLIKYQDPYPFGVDPSWRGSRSELPFLNSLKMKMSILFGVAHMNLGIVLSYFNAHFFRNSLDIRYQFVPQMIFLNSLFGYLSLLIVIKWCTGSQADLYHIVLLLLAVIAVPWMLFPKPFILKKLHTEVPLSPVLCMLIIKEVMIRSLSRLLIYYPDDIVQRFQGRSYGILNTSEVDLEAEPDSARQHHHEEFNFSEVFVHQMIHAIEFVLGSVSNTASYLRLWALSLAHSELSTVFYEKVLLLAWGYDNLVIRLVGLTVFAFATAFILLMMESLSAFLHALRLHWVEFQNKFYHGLLDDILLDIDLATKISCSFPHGFGVVTRSHCRWSWKETEELREGTA

SEQ ID NO: 143567 - protein, 205 aa, Glycine max
  Coding DNA Sequence Number=SeqID_26789
  Gene Ontology: Mol. function=RNA-directed DNA polymerase activity; Biological process=RNA-dependent DNA replication
  Pfam annotation: Domain name=AT_hook; Domain location=111-123; Score =14.9; E_value=0.061; Accession=PF02178.9; Description=AT hook motif
MLCDAKVPIKLKGKFYRTVVRPAILYGTECWAVKSQHENKVGVAEMRMLRWMCGKTRQDKIRNEAIRERVGVAPIVEKMVENRLRWFGHVERRPVDSVVRRVDQMERRQTIRGRGRPKKTIREVIKKDLELNDLDRSMLFKGSHRRDPLPRCLLDSGEHDERGRVNIKHYVPDKYMIPYVANLIDAAEYFFSFLIKQKLLPRYVI

SEQ ID NO: 143568 - protein, 971 aa, Glycine max
  Coding DNA Sequence Number=SeqID_26790
  Gene Ontology: Mol. function=zinc ion binding; Biological process =regulation of transcription
  Homolog annotation: Hit_ID=Q7X9C0; Match level="QueryCoverage=98%, HitCoverage=98%, E-value=0.0, Identity=60%"; Hit description=NIN -like protein 2
  Pfam annotation: Domain name=PB1; Domain location=871-953; Score =84.1; E_value=4.3e-22; Accession=PF00564.15; Description=PB1 domain
  Pfam annotation: Domain name=RWP-RK; Domain location=599-650; Score =114.4; E_value=3.2e-31; Accession=PF02042.6; Description=RWP-RK domain
  Pfam module annotation: Pfam domain module=PB1::RWP-RK; Domain location=871-953::599-650
MEDHVSPEGKEVSCCAPPGAQLEESTSVDGGKKNSSSEDMFSNFSELMNFDTYAGWSNSPSMTDLSVANVFSLFSSAPYPPPDGLNLVEQSNGSFFMTEDSEFHNGMESSPSCVERVIFQQMDIHLGFLDEANDSNNLDSKEKLNGKSQQVNTSDMCNYIISRSPGRSLDDRMLRALSFFMESADEGMLAQVWVPTKHGDEFILSTSQQPYLLDPKLAGYREVSRAFTFSAEGKTRTCPGLPARVFISHVPEWTSNVGYYNKTEYLRLEHAKNHEIRGSIALPISDVHSQVPCAVLELVTTKEKANFDRELEIFSHALQLVNLRTSMPPRLLPQCLSSNKRVALTEIIDVLRAMCHAHRLPLALTWIPCCYSEGIRDETERIRIKEGHTSSNEKCVLCIEESACYVNDGGVGGFVHACIEHHLEEGQGIAGKALQSNHPFFYTDVKTYDIGEYPLVHHARKYNLNAAVAIRLRSTYTNGDDYILEFFLPVNMTGSSEQQLLLDNLSGTMRRICKSLRTVSDAELTGIDGSQGGFPKEKVSGFFPMSRRNSEIAFINGDHDSVQKMSMKTSNMRNNGTEAVHSQAMNGSRKQVEKKRSTVEKNVSLSVLQQYFSGSLKDAAKSIGVCPTTLKRICRQHGISRWPSRKINKVNRSLKKIQTVLDSVQGVEGGLKFDPYTGGFIAGGSIMQEIDAHKYLVFPKKSSVKDPKPATQKTVSVAPAPGSTRENSTIKLNDDESVCLVRNKFVHSRNVLNSNSSKGELKKDNVSSDDCCDDSKSMAMNDGSCQKSCLWTKTQDCPEQTCSISLVTDEVEVGVDRVEGADEHNHPTSSSTTHSSNGSGSMMHGSSSCSQSFEKQKHSKVKSNCVDSGSKMIVKASYRGDTIRFKFDPSSGCFQLYEEVATRFKLQNGSFQLKYLDDEEEWVMLVNDSDLQECTEILGDIGTRFVKFLVRDVPCVFRSRGSNSCFLSDSS

SEQ ID NO: 143569 - protein, 676 aa, Glycine max
  Coding DNA Sequence Number=SeqID_26791
  Homolog annotation: Hit_ID=Q1SQU5; Match level="QueryCoverage=98%, HitCoverage=98%, E-value=1e-175, Identity=54%"; Hit description=IMP dehydrogenase/GMP reductase
MMKFDRADAQSILSHFKRKDKQIKLKSKWLLGIPLTKYKMKKLKNYIKNRYLSESLIREDDMFYESVRTHVEEAFGMHHIEQENHVTVDDIDLIQIPNMKRLISSCLDNLTTKGLYLLAMIVTGGSFKSEITRCKLKKVIKGSLSSVPGSKSDNRLETRKHIFSLLTNPQNFRDRCEPLAALRFQSHHAAVENILRGLQKLPCQALIAMRRKLKGVKASVPQLQPRRHGWTRDHLIKVVKKISMEMLSQLDRESELQEPLAKAMAVADLSQKLNTGCHNIFSKEFFQFSPEVKSLQSDIMNAIWSVKKVVTVPELRNLQLLIEPKAVISNRSIRTAFVNFLIEFLFECSDMDSVPKSLSQTLDVINRGSNSCMNDLLFKKKYIEEEVDCILNMSALTKQIVLDLLPDDELDKDFTDAYSEQLEESDYSSSDDDDNDSQLVEDIQFRNGTSGSMYSFCEGESIGEFVPFEENVSSSPLTTSDKLNSGSEQHQANNCDTVDLDSKVHNTQCNIFTDQCQRESTEIFHTFMACKNNNSSVISPDRELDENVVKRNEFSESDAKVDATDTTDLFCKEKEPMPTKCSECKNQYLAIQDACDKTSMLAYNLIGHLLEEFVMIEGLDLNLSKSLYLTGNNRIEDVEEEQSSSGKHARDFVQVIEELIPSFPDRYLLHSSNMVA

SEQ ID NO: 143570 - protein, 300 aa, Glycine max
  Coding DNA Sequence Number=SeqID_26792
  Homolog annotation: Hit_ID=Q1S2M5; Match level="QueryCoverage=24%, HitCoverage=19%, E-value=5e-07, Identity=37%"; Hit description =Transcriptional factor B3; Cupredoxin
  Pfam annotation: Domain name=B3; Domain location=10-96; Score=42.7; E_ value=1.3e-09; Accession=PF02362.12; Description=B3 DNA binding domain
MAVVDYQSVDLVLSLIPNAFVRLPQLQGRIPEDVILRNASERAWHVKTRYVEEKLYFDDGWRAFHQENCLGQADFLVFKHERRNEFVVLILQLSTQCQKPLVKMEEEQAATQLVEEPDSSSDDDDEESGEEFGAGFNLQSHHRRACKRETASSSNPNAEDPLPQYVFDPEICIHPENHFFKAKLYRTRPNELHIPGNAIQEFSLTLPEKITLICCQPCQRKDIPMNELGDYHHNLTPIRIKYQEVTGIVCRWQDHRIYIKGWASFCRRNKIERNDTCFCEVISGEDQVVKTLRVHVARRR

SEQ ID NO: 143571 - protein, 100 aa, Glycine max
  Coding DNA Sequence Number=SeqID_26793
  Gene Ontology: Mol. function=transporter activity; Cellular component= membrane; Biological process=oligopeptide transport
  Homolog annotation: Hit_ID=Q2HSV0; Match level="QueryCoverage=69%, HitCoverage=13%, E-value=5e-20, Identity=68%"; Hit description=TGF -beta receptor, type I/II extracellular region
MEDTLTCCGEAQNKRGGSTAGISVASAGIIGNLIVYLIREFNIKSIDAAQVANVANGSSSLFPIVAAIMADSFFGSFPVALVSSCVSFLVIINTPVSIYQ

SEQ ID NO: 143572 - protein, 55 aa, Glycine max
  Coding DNA Sequence Number=SeqID_26794
MIDLNFGVERSQFYRLRIDVGDGMEINVAFDGGMSLEGKKTQLGVCRNMLKRLVG

SEQ ID NO: 143573 - protein, 190 aa, Glycine max
  Coding DNA Sequence Number=SeqID_26795
  Gene Ontology: Mol. function=nucleic acid binding; Cellular component= cytosol; Biological process=regulation of transcription, DNA-dependent
  Homolog annotation: Hit_ID=Q9LSS9; Match level="QueryCoverage=83%, HitCoverage=16%, E-value=2e-69, Identity=75%"; Hit description =General negative transcription regulator-like
MCFLVTEFLSRAIMSDEGERTCPLCAEEMDLTDQQLKPCKCGYQICVWCWHHILEMAEKDDTEGRCPACRSPYDKEKIVGMAANCERLVAEVHMEKKVKNQKAKSKSSEARKQLSSVRVIQRNLVYIVGLPLNLADEDFLQQREYFGQYGKVLKVSMSRTTAGVVQQFPNNTCSVIISSSSGSPHSGIAE

SEQ ID NO: 143574 - protein, 238 aa, Glycine max
  Coding DNA Sequence Number=SeqID_26796
  Homolog annotation: Hit_ID=UPI0000DA308A; Match level="QueryCoverage =49%, HitCoverage=26%, E-value=3e-07, Identity=30%"; Hit description =PREDICTED: similar to Programmed cell death protein 7 (ES18)
MGKGNADSLLPKLLLDILAVTSVCTASLSNMKEIAKSKAKEEKKKVEAEIELLLVVEKLQELRSIRIQKLKKQGHFLPEEDDKFLEKVQAAVEEEEREALAAVETDAAKDAIATAEESRKAIQNQGKLSKGSNYDSEVKERKELTVQSVTEEGSGAVDEKKSSKIGQISGGAYDPLANLPIEFYHYYHGSNNDMGTLIEVRRGWDAYIRPGGSRIPGHWVQPPPPANEIWASYLVRPK

SEQ ID NO: 143575 - protein, 268 aa, Glycine max
  Coding DNA Sequence Number=SeqID_26797
  Gene Ontology: Mol. function=DNA binding; Cellular component=nucleus
MANSSGNHEEEQTTHVASSFNGNLAPDASPTALAMKHNPGIALDWTLQEQTILEEGLSLFASEPNLTRYAKIAQNLNNKTVRDVALRVRWMNKKENCKRRKDDFPRKSKDKKVSDPAVRSSHYTAQPNVSPYAPAMTMMDNDDGISHIAIGGPTGELLEQNAQALNKISTNLAALQVFFKYVNEYNSVTVATFSCLSEALEIQLQNTSAGTKLQGNINLFSQTRDNIIKILNDMNDMQEAMKQMPPLPFKINETIFNSILSKTNQHMQ

SEQ ID NO: 143576 - protein, 149 aa, Glycine max
  Coding DNA Sequence Number=SeqID_26798
  Gene Ontology: Mol. function=N-acetyltransferase activity; Cellular component=cytoplasm; Biological process=metabolic process
  Homolog annotation: Hit_ID=UPI00006DBA8D; Match level="QueryCoverage =94%, HitCoverage=38%, E-value=4e-40, Identity=56%"; Hit description =COG1670: Acetyltransferases, including N-acetylases of ribosomal proteins
  Pfam annotation: Domain name=Acetyltransf_1; Domain location=52-136; Score=70.9; E_value=4.1e-18; Accession=PF00583.14; Description =Acetyltransferase (GNAT) family
  Pfam annotation: Domain name=FR47; Domain location=60-144; Score= -4.4; E_value=0.034; Accession=PF08445.1; Description=FR47-like protein
  Pfam module annotation: Pfam domain module=Acetyltransf_1::FR47; Domain location=52-136::60-144
MITIRALRAEDFMPWLALWQGYQRFYQTTIDDNTTGESFRRLLSRAEPMHCLVAEQDGAMVGLVHFLTHRSTWTQGDYCYLQDLYVSEAARGLGAGKALILAVYEQAEKLGCSRVYWLTQASNSHARALYDRLAQQTDFVQYRHLFDQP

SEQ ID NO: 143577 - protein, 135 aa, Glycine max
  Coding DNA Sequence Number=SeqID_26799
MDTSHNPNHRSETLLLFVCVSDTLLLYDSSQLHPYLLTSSKSNASNHKPNPRSYVSYPNFIWRLSFSNILIIASQIELLDTSCRTIQKVFRRFEKEYGKYPKGKGKRVIRKLFLTLGSPRLASGSPGPPNNFMVK

SEQ ID NO: 143578 - protein, 98 aa, Glycine max
  Coding DNA Sequence Number=SeqID_26800
MPLQGEDESRTSSPPKEVMDKSLKVREDELGERKKGERNFEREKRENKGKNSIQGSLLHQGIHPNPPIFKELAKTGGGCAHVCVGMSTMVIYNSRHVR

SEQ ID NO: 143579 - protein, 155 aa, Glycine max
  Coding DNA Sequence Number=SeqID_26801
MPLRGRHFAAYPYQTLWGAFITTHNHNPCRKMGVYTKDEKLLMHFFQESLTRAAITWWKDLAAQVAPPMMEREMITMIVDTLLVFYYEKVVSYMPSSFVDLVFAGERIEVGLEIGKFDYPALMNGKPGENGENEKEGRTHVVTVVPLWPNFPPAQ

SEQ ID NO: 143580 - protein, 88 aa, Glycine max
  Coding DNA Sequence Number=SeqID_26802
MDLEGKASVGFGSSLPLLKVLEGCTHILLKLNVVGGHLLHQLFQGRKSLIFAGGRLKLSLFEWMLLCVVAWQNYQQLVLLPGVWNVTP

SEQ ID NO: 143581 - protein, 361 aa, Glycine max
  Coding DNA Sequence Number=SeqID_26803
  Gene Ontology: Mol. function=sugar porter activity; Cellular component=membrane; Biological process=transport
  Homolog annotation: Hit_ID=Q75I89; Match level="QueryCoverage=95%, HitCoverage=96%, E-value=1e-123, Identity=63%"; Hit description =Expressed protein
  Pfam annotation: Domain name=TPT; Domain location=158-291; Score =95.2; E_value=2e-25; Accession=PF03151.7; Description=Triose -phosphate Transporter family
MAVAMAIMTKQHLLTYIYLLVYISLSSGWVLSTLYFNFPFPITLTMIHMAFSGAVAFFLIRVLKVVSPIKMTFHIYATCVVPISAFFAASLWFGNTAYLYISVAFIQMLKALMPVATFVVAVTCGTEKLRCDVFWNMVLVSVGVVISSYGEIHFNVLGTVYQVTGIVAEALRLGKKHVKPFSSLWDADVDFDLFAFLFIPWYILEKPEMEDPHMQFNFWVFFSNALCAFALNLSTFLVIGRTGAVTIRVAGVLKDWLLITLSTVLFPESKITGLNVIGYAIALSGVVFYNYLKVRDVRTSQLQSIQDESAKELQTEKKADDAMDNKDEASWNDSVSDTHLDEEAPLISSRISHFGVGRKPA

SEQ ID NO: 143582 - protein, 142 aa, Glycine max
  Coding DNA Sequence Number=SeqID_26804
MADQEEIQEQMKADMSTLKEQMASMMDAMLGMRQLMENNVATAATVSLAAKADLTLPATAHHPLPNMVGRERSTLGHISNPHLGHNRVAYPYGLPLNYTPLVMRDDTGHVSSPILKGSFLDSWTRFTRIVESMPKETSISTP

SEQ ID NO: 143583 - protein, 300 aa, Glycine max
  Coding DNA Sequence Number=SeqID_26805
  Gene Ontology: Mol. function=transcription factor activity; Cellular component=intracellular; Biological process=regulation of transcription, DNA-dependent
  Homolog annotation: Hit_ID=Q8G7R2; Match level="QueryCoverage=87%, HitCoverage=75%, E-value=5e-64, Identity=47%"; Hit description=LacI -type transcriptional regulator
  Pfam annotation: Domain name=Peripla_BP_1; Domain location=21-294; Score=70.5; E_value=5.4e-18; Accession=PF00532.11; Description =Periplasmic binding proteins and sugar b
AIEELNYQPNLSARSLRSGRSGVIGLVLPELSLSYFGELADAVIAEAEKHGLVVLIEKTGADREREIAVLTSPRMQLTDGLIFSPLGMGPADAAHFEVDFPVVLLGERIFGGPVDHVTMRNVEAAQAATELLLKAGRRRIALIGAHVDEDVGSAALRTQGYEQALVAAGIEVDPSLVRYTTLWHRSNGAAAVRELLSDGVEFDAVFGLNDALALGAMRALQEAGLRIPDDVAVVGFDDIEEAQYTLPSLSTIDPGREQIAALAVELLLGRIRDGGGRPAEPREVLVDFEVVVRESAVPAG

SEQ ID NO: 143584 - protein, 387 aa, Glycine max
  Coding DNA Sequence Number=SeqID_26806
MRLAKKLLLWVAQELLIVLIFQVQVQCNTRSQKLIKNLESFHGLGPGDIKNTDLYAVQKELYLGSLCQVEDTPSLKPWQFWMVMMKNGNYDTMSGLCPKDGEKTQLNDSIMQGGFYGTYDLDSDCEGSGNGNHSYYEVAWEKKVNVGSWVFKHKLKTSNKYPRLILYLRADATRGFSGGYHYDTRGMLKTLPESPNFRVRLRLDIKKGGGPKSQFYLLDMSSCWKNNGAPCDGDVLTDVTRYGEMIINPKTPAWCSPTDLGNCPPFHITPDNRKIYRNDTENFPNTWSNPQAQEIVQLLPHPIWGAYVGDGWVGDPRTWELDVGGLSSRLYFYQDPGTPPAKRIWTSIDTGTEIFVSAQDEVAEWTLSDFDVILTARVRIQKLVWKY

SEQ ID NO: 143585 - protein, 106 aa, Glycine max
  Coding DNA Sequence Number=SeqID_26807
MLIRIELCLIMQNCFSSIHPQLPGCEQFLSVYFKKFEQKIKCTPTEKRKVLVSNFYSTKQKKNKERKEKHKRIIMSQVAPPMTSVTTPYYFQLNDQAGINILQQTA

SEQ ID NO: 143586 - protein, 375 aa, Glycine max
  Coding DNA Sequence Number=SeqID_26808
  Gene Ontology: Mol. function=potassium channel activity; Cellular component=membrane of vacuole with cell cycle-independent morphology; Biological process=potassium ion transport
  Homolog annotation: Hit_ID=Q9S6Z8; Match level="QueryCoverage=84%, HitCoverage=79%, E-value=1e-116, Identity=68%"; Hit description =Probable calcium-activated outward-rectifying potassium channel 5, chloroplast precursor
  Pfam annotation: Domain name=Ion_trans_2; Domain location=220-295; Score=50.1; E_value=7.2e-12; Accession=PF07885.6; Description=Ion channel
  Pfam annotation: Domain name=Ion_trans_2; Domain location=93-175; Score=68.4; E_value=2.3e-17; Accession=PF07885.6; Description=Ion channel
  Pfam module annotation: Pfam domain module=Ion_trans_2::Ion_trans_2; Domain location=220-295::93-175
MEDEPFLTTTSQPIADCLLPSSKSFNDVTTTRARDVAAAAAEEIQSEQQQPPKKKKLSRCKTAPAMVTMRDLKPKTPQLPKPQSSSIIRQGMWLLAVYLSIGVVIYSFNRDRFSGIETHPVVDALYFCIVTMCTIGYGDIAPLTPFTKIFACAFVLVGFGFIDILLSGLVNFVLDLQENMILTGLQMGASEREGFSARNYIVDVAKGRMRIRLKVGLALGVVVMCIGIGSLVLYFVEGLDWVDSIYLSVMSVTTVGYGDRAFKTLPGRLFAAIWLLFSTLMVARAFLYLAEARIDRRHRRMAKKVLHREITVQDLLAADINNTGFISKSEYVIFMLKEMGKIQEKDVLQICDQFRKLDPSNCGKITLPHLLGGSL

SEQ ID NO: 143587 - protein, 513 aa, Glycine max
  Coding DNA Sequence Number=SeqID_26809
  Gene Ontology: Mol. function=binding; Cellular component=nucleus; Biological process=regulation of transcription
  Homolog annotation: Hit_ID=Q1SUU4; Match level="QueryCoverage=99%, HitCoverage=97%, E-value=0.0, Identity=75%"; Hit description =Tetratricopeptide-like helical
  Pfam annotation: Domain name=PPR; Domain location=171-205; Score =17.6; E_value=0.045; Accession=PF01535.11; Description=PPR repeat
  Pfam annotation: Domain name=PPR; Domain location=234-268; Score =39.5; E_value=1.1e-08; Accession=PF01535.11; Description=PPR repeat
  Pfam annotation: Domain name=PPR; Domain location=269-303; Score=6.4; E_value=1.3; Accession=PF01535.11; Description=PPR repeat
  Pfam annotation: Domain name=PPR; Domain location=335-369; Score =36.8; E_value=7.4e-08; Accession=PF01535.11; Description=PPR repeat
  Pfam annotation: Domain name=PPR; Domain location=370-404; Score=9.6; E_value=0.55; Accession=PF01535.11; Description=PPR repeat
  Pfam annotation: Domain name=PPR; Domain location=406-440; Score =12.9; E_value=0.22; Accession=PF01535.11; Description=PPR repeat
  Pfam annotation: Domain name=PPR; Domain location=472-506; Score=3.5; E_value=2.9; Accession=PF01535.11; Description=PPR repeat
  Pfam annotation: Domain name=PPR; Domain location=7-41; Score=0.1; E _value=7.3; Accession=PF01535.11; Description=PPR repeat
  Pfam annotation: Domain name=PPR; Domain location=70-104; Score=22.8; E_value=0.0012; Accession=PF01535.11; Description=PPR repeat
  Pfam module annotation: Pfam domain module=PPR::PPR::PPR::PPR::PPR::PP R::PPR::PPR::PPR; Domain location=171-205::234-268::269-303::335 -369::370-404::406-440::472-506::7-41::70-104
MCTVTSAKLNYMIDAYIQGNNINNARKLFDENPSSRNLVSWNMMMTGYVKHHQIQYAQYLFDQMPFKDTVSWNIMLSGFHRITNSDGLYRCFLQMGRAGVPPDDYTVSTLLRAVISTELDVLIPQLHARALHLALNLSVFVGSSLIRAYASLRDEEAFKQAFDDILGKDVTSWNALVSGYMEVGSMDDAQTTFDMMMPEKNIISWTTLVNGYIRNKRINKARSVFNKMSERNVVSWTAMISGYVQNKRFMDALNLFLLMFNSGTCPNHFTFSSVLDACAGCSSLLTGMQVHLCVIKSGIPEDVISLTSLVDMYAKCGDMDAAFRVFESIPNKNLVSWNSIIGGCARNGIATRALEEFDRMKKAGVTPDEVTFVNVLSACVHAGLVEEGEKHFTSMLTKYEIQAEMEHYTCMVDLYGRAGQFDEALKSIKNMPFEPDVVLWGALLAACGLHSNLEIGVYAAERIRKLESDHPVSYSILSKIQGEKGIWSSVNELRDMMKERQVKKQKASSKLFL

SEQ ID NO: 143588 - protein, 97 aa, Glycine max
  Coding DNA Sequence Number=SeqID_26810
  Gene Ontology: Mol. function=DNA binding; Cellular component=nucleus; Biological process=regulation of transcription
  Homolog annotation: Hit_ID=Q1SEP7; Match level="QueryCoverage=92%, HitCoverage=97%, E-value=2e-33, Identity=74%"; Hit description =Homeodomain-related
MDDFAKSLCGWSWEENKLFELALAAVDEQHPERWEVVAAMVGGEKSAGDVQEHYVILLEDLLVIESGKLDNTLGEVMPVVLVECKESMCLSHDDTSS

SEQ ID NO: 143589 - protein, 86 aa, Glycine max
  Coding DNA Sequence Number=SeqID_26811
  Homolog annotation: Hit_ID=P92540; Match level="QueryCoverage=30%, HitCoverage=24%, E-value=3e-08, Identity=100%"; Hit description =Hypothetical mitochondrial protein AtMg01060
MLCAPGKEIATLFDGPGTIEKSQTCTKCETKEGSSCWELDPKPPYRDELIDSSDPRSGLTGLEPAASALTGRCSDRLNYNPRKRNK

SEQ ID NO: 143590 - protein, 519 aa, Glycine max
  Coding DNA Sequence Number=SeqID_26812
  Gene Ontology: Mol. function=protein kinase binding; Cellular component=nucleus; Biological process=regulation of cyclin-dependent protein kinase activity
  Homolog annotation: Hit_ID=Q9FKE6; Match level="QueryCoverage=99%, HitCoverage=92%, E-value=1e-125, Identity=48%"; Hit description =Similarity to cyclin
  Pfam annotation: Domain name=Cyclin_N; Domain location=31-147; Score=- 4.0; E_value=0.00033; Accession=PF00134.13; Description=Cyclin, N -terminal domain
MTGLMPGELPHHGTPDGNSGKSSQDKQEESLGRWYMSRKEIEEHSPSRKDGIDLKKETYLRKSYCTFLQDLGMRLKTIATVCMFLAGKVEETPRPLKDVILVSYEIIHKKDPAAAQRIKQKEVYEQQKELILLGERVVLATLGFDLNVQHPYKPLMEAIKKFVAKNALALVAWNFVNDGLRTSLCLQFKPHHIAAGAIFLAAKFLKVKLPSDGEKVWWQEFDVTPRQLEEVCNQMLELYEQSRLPPAQGSEVEGSARGTRAASKAPSANEEQASKQISSQAPQHSSVERTGVPQRGTENQSNDGSAEMGSDITDHNLDIRESHNSEQLTHQDNKREVSNRSKSGTERDQDIIVGTKEGAEVGRRDESALNNSGSNVGRNLERREVPLGHSPNEAIKIDKDKLKALAAMGKKRKEQRGEMALKKDVMDEDDLIERELEDGIELAVEDEKNKRERRQNWSKPDAEDHHGGENHEETRDGWYMNMKAQFQKDMEEDNAEEAEMIDDASSLLNNRKRRMGSPP

SEQ ID NO: 143591 - protein, 592 aa, Glycine max
  Coding DNA Sequence Number=SeqID_26813
  Gene Ontology: Mol. function=nucleoside-triphosphatase activity; Cellular component=microtubule; Biological process=cell division
  Homolog annotation: Hit_ID=Q7XJI8; Match level="QueryCoverage=99%, HitCoverage=100%, E-value=1e-171, Identity=83%"; Hit description =Katanin
  Pfam annotation: Domain name=AAA; Domain location=339-534; Score =264.1; E_value=2.9e-76; Accession=PF00004.19; Description=ATPase family associated with various cellular activities (AAA)
  Pfam annotation: Domain name=AAA_5; Domain location=339-477; Score= -15.7; E_value=0.028; Accession=PF07728.4; Description=ATPase family associated with various
  Pfam annotation: Domain name=Vps4_C; Domain location=548-590; Score =10.6; E_value=6.7e-05; Accession=PF09336.1; Description=Vps4 C terminal oligomerisation domain
  Pfam module annotation: Pfam domain module=AAA::AAA_5::Vps4_C; Domain location=339-534::339-477::548-590
MVGGSLAGLQEHLKLARDYALEGLYDTSIIFFDGALAQINKHLSTVEDPLIRAKWMNVKKALSEETEVVKQLDAERRAFKDNPIGRRPSSPPISVKSSSSFVFQPLDEYPTSSSGPGPVDDPDVWRPPSRDTTSRRPARPGQVGARKSAQDGAWARGATARTGAAGRGAKAGATGRVNSGTRASTTTGKKGGAASSGKASKTDTAAAAVTVGLSILRVSLVEHLQNCFSSDSLCFDAFILKANIGLLILTHNVVWKLAIKVDFGYNGDAEDGKSKKLQYEGPDPELAAMLERDVLETSPGVRWDDVAGLTEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCNSRGASGEHESSRRVKSELLVQVDGVSNSATNEDGSRKIVMVLAATNFPWDIDEALRRRLEKRIYIPLPNFESRKELIRINLKTVEASCVVAPDVNIDEVARRTEGYSGDDLTNVCRDASLNGMRRKIAGKTRDEIKNMSKDDISKDPVAKCDFEEALRKVQRSVSQADIERHEKWFTEFGSA

SEQ ID NO: 143592 - protein, 75 aa, Glycine max
  Coding DNA Sequence Number=SeqID_26814
MRKGPLEEGGTKAIDSVETLRTCLEIISILDAKYEDTFSKSGTERKKKEEILKQAQSNRGAKRASGAKRATNCRR

SEQ ID NO: 143593 - protein, 88 aa, Glycine max
  Coding DNA Sequence Number=SeqID_26815
MENVNISRTNIMKAKSGSTTNEVENGYTDMTEYRQAIVRLLISESVAEGHVMVAKSLRLYLRASLHSFWRQAVSNCILTVHLAVMQRN

SEQ ID NO: 143594 - protein, 148 aa, Glycine max
  Coding DNA Sequence Number=SeqID_26816
MAAALSSESSMILQHRRQCLTQTFSCRCRTAANTGHADVEDISSASNKKVEEKLEESRSKIVTLSLKAHKYWTHRFPMEANLDETVLKLKKYILADLRILAGFEMDNVPVESMVLHSHSTGVELLDHQLLRDCAVSDNHEIDLSVKEP

SEQ ID NO: 143595 - protein, 378 aa, Glycine max
  Coding DNA Sequence Number=SeqID_26817
  Gene Ontology: Mol. function=endonuclease activity; Cellular component=membrane; Biological process=RNA-dependent DNA replication
MMKAQAKLMKCTGHPANTMTCSGIDLKSSKCGREFQLCYCCQRCNGRREAHAKHYGEATTLNGGNHKLLIQLVDYYAFGINNSEVTNTFVGKGFLRVQGVWKDGDKKRLWTEIVNLRNRVKKDRWCIVGDFNSIKYLEERRDNFNVVVGCRDMQEFNNFIHEMEVEGILLMEKRSGNTQYVMERSISDHCSIVLKVTNYDWGPKPFRALDCWFMEHGFKEKVAWMWNSYEVQGRGAYVLKEKIKLLKKDLKQWNKESFGNLQKQSKDLVAKINLLDLKGENGSLLQEEMDSRRFYVGEYWKIARRNESLLPQKSRSRWIKEGDGNTKFFRGVINWKRRKNNIKGISIKGRWEEEPRLVKKEVLEFYQKIFYQEAWMKP

SEQ ID NO: 143596 - protein, 86 aa, Glycine max
  Coding DNA Sequence Number=SeqID_26818
  Gene Ontology: Mol. function=nucleic acid binding; Cellular component= nucleus
  Homolog annotation: Hit_ID=Q6YPG3; Match level="QueryCoverage=88%, HitCoverage=33%, E-value=1e-25, Identity=71%"; Hit description =Pentatricopeptide (PPR) repeat-containing protein-like
MPRYKDESPAVRVYTVCDESRYLIVRNVPELGCGDELLKLFSSYGEVEECKPMDAEDCEKYTDVFWIKFRLVNNARFHSVLCWQMK

SEQ ID NO: 143597 - protein, 115 aa, Glycine max
  Coding DNA Sequence Number=SeqID_26819
  Gene Ontology: Mol. function=nucleic acid binding
  Homolog annotation: Hit_ID=Q6YPG3; Match level="QueryCoverage=98%, HitCoverage=52%, E-value=8e-16, Identity=45%"; Hit description =Pentatricopeptide (PPR) repeat-containing protein-like
MDKLEGRRREVLARLNPRRSKETTASSSKPRITSKTNCSQHLDSNARDVELKGGSHSGNFPIRMVSSNEDYFASNSMNQTVSLVRDKLDKIQSSGENTKAGSASKKQRVDNRKRI

SEQ ID NO: 143598 - protein, 390 aa, Glycine max
  Coding DNA Sequence Number=SeqID_26820
  Gene Ontology: Mol. function=serine-type endopeptidase activity
MDMQLGCFGFYVEWVASVLVYVGSSKFHYQARTSVNVIIKIADDASEIIHNVTRALEDIQENLVDSGISAEVSENLNSTAKKMDNAVDNIVKKTRKNKRTVNRAFKFVFIITIVIISLNLVAVPILSGMSNWYDSHNMLEFSVEQFLEYTCFGGHFTCRFVILCWLMAVICWLIFGLYFFLENFSIDTCTVLCNFEENPYNNSLTSILPCDELRSAKAILPEVGAGISFLITKVNSNLGPMFPNNVDLCNPFSAPPKYLYQPEFCPPNSIQIGDIPKVLKPYTCFGDSDENCGSDHLMNGGEYKVVEAYTSSTQNLLNMYPGMENLIGCKLVKDAFSQILFKHCKALNNFARMAWVAMVFLAVMMVFYVVLSTIKACQDHSSYHPSDDSV

SEQ ID NO: 143599 - protein, 160 aa, Glycine max
  Coding DNA Sequence Number=SeqID_26821
  Gene Ontology: Mol. function=RNA-directed DNA polymerase activity; Cellular component=intracellular; Biological process=RNA-dependent DNA replication
MAIAFLKGVDCHRIQPQISDQWVWKADPSGQYSAKSAYQMLREDISKENQDEAFEELWKLKVSSKIAAFAWRLLKDRLPTRLNLQRRQIEVGDSNCPFCSSMEESAGHLFFHCSKIIQVWWESLSWVNLVGVFPHHPRQHFLQHIHGVTQGMKANRWKWW

SEQ ID NO: 143600 - protein, 50 aa, Glycine max
  Coding DNA Sequence Number=SeqID_26822
MAKGEEEVAPDQVTNQMHLTFFKNAKTALALSSHLCWVCVRAVHKSYESS

SEQ ID NO: 143601 - protein, 839 aa, Glycine max
  Coding DNA Sequence Number=SeqID_26823
  Homolog annotation: Hit_ID=Q2QYH0; Match level="QueryCoverage=97%, HitCoverage=98%, E-value=7e-22, Identity=32%"; Hit description =Expressed protein
  Pfam annotation: Domain name=DUF936; Domain location=1-822; Score =546.8; E_value=2.2e-161; Accession=PF06075.3; Description=Plant protein of unknown function (DUF936)
MANLVPGVLLKLMQHMNTDVKVAGEHRSSLLQVVSIVPALAGGELFPNQGFYLKVSDSLHATYVSLPDEHDDLILSDKIQLGQFVFVDRLEAASPVPILHGVRPVPGRHPCVGTPEDIVATTHSLGFLSNGKANKKSPCSGPLDLERSKSPRKVLSNHHVGEKEKKEKVRLNNEDQLDKKAMLFAKSKSQTTKAAAANVADAKKEPLARWKSLNSRTIPSSPTSCYSLPTSFEKFANGVKQQANIKGVDRLTAKVGVVEIGKGVRGTSPTGKRISVGNPIRNLVQGIELGAKALRKSWEGNMEVKKKDTSKLRAAKCDPKPEVRGSTPRRSTSSEKFPSKEESKMQPQTKSSKEEHKTQTSIKRVIVSGTMEEQEKPSKQRVPVGKKLSEASNNGFPGNLVKVSPNSRKVTDASVPWASLPSSIAKLGRLRVSLGITVRLLPYDLKVTGLTLGNNLFVCGDKAVYIYPPPRPRLIRWEPNTLGCLYEVMKQRDAAQMAATEAIQEAAAAESLLQCLRQKKDGLSVVGARSMLGPSLPKSDWDLAIDVYHPSSSKPILLWAELSNSAKEQNPQPAVEEFLTLHASLNSARMIADLLSKSNPDDSSSDNERSITEEALKLKLDRQRRANSWVQAALSTNLSSFSIYNREPLSSKLSVSTNSQNQKNILGSKPMLVMENSSEDSSKSHGKTRQTANSKTPHKTGDMLANGHKQLVQSPPEWVRGNGLDEVVDLADMLQLRSRDWFLVFVERFLDPDGDTSLSNNGQIAGMLTQLKSVNDWLDEIGSSKNEGEPCQIPAETIDRLRKKIYEYLLTHVESAAAALTGGSQSSPRIQTAEIKAKK

SEQ ID NO: 143602 - protein, 443 aa, Glycine max
  Coding DNA Sequence Number=SeqID_26824
  Gene Ontology: Mol. function=unfolded protein binding; Cellular component=endoplasmic reticulum; Biological process=protein folding
  Homolog annotation: Hit_ID=Q1S678; Match level="QueryCoverage=75%, HitCoverage=79%, E-value=0.0, Identity=85%"; Hit description =Concanavalin A-like lectin/glucanase
  Pfam annotation: Domain name=Calreticulin; Domain location=26-338; Score=492.8; E_value=3.9e-145; Accession=PF00262.8; Description =Calreticulin family
MANGNTSHRFKLLLFLLTLHSSFAEIFFEERFEDGWKSRWVLSDWKRSEGKAGTFKHTAGKWSGDPDDKGLQTYNDAKHFAISAKIPELSNKDRTLVLQYSIRFEQDIECGGGYIKLLSGYVNQKKFGGDTPYSLMFGPDICGSQTKKLHLILSYQGQNYPIRKDLQCETDKLTHFYTFILRPDASYSILVDNRERDSGSMYTDWDILPPRKIKDVKAKKPADWDDREYIEDPNDVKPEGYDSIPAEIPDPKAKKPVEWDDEDDGLWKPPKIPNPAYKGPWKRKKIKNPNYKGKWKIPWIDNPEFEDDPDLYVLKPIKYVGIEVWQVKAGSVYDNILICDDPQYAKQIVDEFMANNREFVGARNHSIKAFSLCVKSQAEKEAFEEAEKERRAREEEEAQRAREEGERRRKERDHKYGNRRHRRRPDPRDMDDYHKLKKWQNMQ

SEQ ID NO: 143603 - protein, 133 aa, Glycine max
  Coding DNA Sequence Number=SeqID_26825
MRTCFSKETKLPTDQSNICFLDEKQCVYRGRRHFISKRPFRGNTGSNKDRKKSLKVYQSHTGIFLLFVFSSEGKDYGELGFWLKACRTAGHDTCGRARARLTGALSKGGKVHGVATNVYLWKTSEKTERNRSK

SEQ ID NO: 143604 - protein, 112 aa, Glycine max
  Coding DNA Sequence Number=SeqID_26826
  Gene Ontology: Mol. function=3-beta-hydroxy-delta5-steroid dehydrogenase activity; Cellular component=endoplasmic reticulum; Biological process=steroid biosynthetic process
  Homolog annotation: Hit_ID=O22856; Match level="QueryCoverage=62%, HitCoverage=12%, E-value=3e-09, Identity=49%"; Hit description =Putative sterol dehydrogenase
MAVEDRFANLNPKTCVVLGGRGFVGRSLVLRLLKLGNWIVRIADSAQSLQLHHSESLLQQALSSSSRASYFHVDLRDKRSIIKGAQFCLCNTLNPRDFLSISFEMKYSVYGK

SEQ ID NO: 143605 - protein, 439 aa, Glycine max
  Coding DNA Sequence Number=SeqID_26827
  Gene Ontology: Mol. function=protein binding
  Homolog annotation: Hit_ID=Q53LS9; Match level="QueryCoverage=90%, HitCoverage=81%, E-value=3e-77, Identity=42%"; Hit description =Expressed protein
  Pfam annotation: Domain name=DUF525; Domain location=322-438; Score =18.7; E_value=4.5e-08; Accession=PF04379.5; Description=Protein of unknown function (DUF525)
  Pfam annotation: Domain name=F-box; Domain location=1-48; Score=28.8; E_value=1.9e-05; Accession=PF00646.23; Description=F-box domain
  Pfam module annotation: Pfam domain module=DUF525::F-box; Domain location=322-438::1-48
MGLESVGDLAINVILKKLGAQDIARVACVSKRFSSSASDDTLWINLCFNELALTQPLDHLGNPLSSFKDVMDVLLQKTVDDRHLAYAKECYLAWRGAFVMYPWSLVKRVKRCWDRIKTWLTNNFPEAEATLCKGATEADIQELENVLKVKLPLPTRILYRFHNGQEFAKADPETSTFGRSLGLIGGYSFYGHLVNVYLLPICQIILETQQTRRRLSFLRRSKYVLVAASSTYSRKLFFLNCTNGQLYVGTRSPLTERDIIPCVPHDLISLHQELNSSEQQDAMLLWLEEHGRRLEHGFIKLHDEGNGKSINLFPEEPHICSTAVTNGVKVRASALVIPELMDLQDDLGEYLFAYSIRLSLEPQGCIINGMSFSSCQLHWRHWIIRANDIVISDVSGKAVIGQLSYAGSGSLLYSLQAVESSLGSTLGVEAGRYLVELMG

SEQ ID NO: 143606 - protein, 943 aa, Glycine max
  Coding DNA Sequence Number=SeqID_26828
  Gene Ontology: Mol. function=nucleic acid binding
  Homolog annotation: Hit_ID=Q52ZH7; Match level="QueryCoverage=71%, HitCoverage=99%, E-value=0.0, Identity=55%"; Hit description=FPA
  Pfam annotation: Domain name=Extensin_2; Domain location=496-893; Score=-140.3; E_value=0.081; Accession=PF04554.4; Description =Extensin-like region
  Pfam annotation: Domain name=RRM_1; Domain location=127-193; Score =25.2; E_value=0.00023; Accession=PF00076.12; Description=RNA recognition motif. (a.k.a. RRM, R
  Pfam annotation: Domain name=RRM_1; Domain location=8-73; Score=71.0; E_value=3.8e-18; Accession=PF00076.12; Description=RNA recognition motif. (a.k.a. RRM, R
  Pfam annotation: Domain name=SPOC; Domain location=413-509; Score =76.9; E_value=6.4e-20; Accession=PF07744.3; Description=SPOC domain
  Pfam module annotation: Pfam domain module=Extensin_2::RRM_1::RRM _1::SPOC; Domain location=496-893::127-193::8-73::413-509
MAKACKQLWVGGISQAVTKEDLEAEFQKFGKIEDFKFFRDRNTACVEFFNLEDATQAMKIMNGKRIGGEHIRVDFLRSQSTKRDQLDYGQFQGKNLGHTDAYSGQKRPLHSQPPMGGKGDSQPSNILWIGYPPAVQIDEQMLHNAMILFGEIERIKSFPLRNYSIVEFRSVDEARRAKEGLQGRLFNDPRITIMYSSSDLVPGSDYPSFFPGSNGPRPDVLLNEHPFRPLQMDVFGHNRPMVLNNFPGQLPPSGIMGLNVPMRPFGNHGGVESVISGPEFNEIDALHKFQDGSSKSNMGPNWKRPSPPAQSTRLPTRSTSGAWDVLDKNHIPRDSKRSRIDGPLPVAEALFPFRNIDDRGLALEQAYGIDPAIDGNGSGPYVNIQGKSHLGPVSSRITAGVHDIVQPDIDHIWRGVIAKGGTPVCRARCVPIGKGIGTELPGVVDCSARTGLDILTKHYADAIGFDIVFFLPDSEDDFASYTEFLRYLSAKNRAGVAKFVDNTTLFLVPPSDFLTRVLKVTGPERLYGVVLKFPPVPSSAPMQQPSHLPVPTTQYMQHIPPSQTEYGLIPVKEEQVLPMDYNRPLHEDSKLPAKPVYPPAGGPPPVHSGPPDYSTNNTVAGSQAGVALTPELIATLASLLPTTTQLPTTDGAKSAVGSSTMKLPFPPMTPNDGNQSHQIADQSTHPPQQLRNMYNVHNAPYQPYPPLSAPAGNPAQVSGSSHIQDTAANMQQQQGAVSSRHMPNFMMPTQSGQVAVSPHASQHYQVEVSPSNQKGFGVVQGTDASALYNSQAFQQPNNNSQAFQQPNNNSQAFQQLNNNSLAFQQPNNNSQAFQQPNNNSQAFQQPNNNSQAFQQPNNSFALSNQTNSANASQQQTAMLYTVDQVNSDTPNQQLPMFGVSQGQTEVEADKNQRYQSTLQFAANLLLQLQQQQQQAPGGHGPGQ

SEQ ID NO: 143607 - protein, 171 aa, Glycine max
  Coding DNA Sequence Number=SeqID_26829
  Gene Ontology: Mol. function=3-beta-hydroxy-delta5-steroid dehydrogenase activity; Cellular component=endoplasmic reticulum; Biological process=steroid biosynthetic process
  Homolog annotation: Hit_ID=O22856; Match level="QueryCoverage=82%, HitCoverage=25%, E-value=2e-40, Identity=55%"; Hit description =Putative sterol dehydrogenase
FIIGTGDNLSDFTFSENVTHAHICAEEALNFQMVSAAGKAFFITNLEPMKFWEFLSLLLEGLEYQRPFIKLPAKLVQYILSVLKWVHKKLGPRYFSYPLLVHFFQLASYTRTFNCMAAQNDIGYSPIVSLEEGVTLTIESFSHLSRDSSFPRCCSFTEQSKADKLLGGGKG

SEQ ID NO: 143608 - protein, 240 aa, Glycine max
  Coding DNA Sequence Number=SeqID_26830
  Gene Ontology: Mol. function=protein dimerization activity; Cellular component=nucleus; Biological process=regulation of transcription, DNA-dependent
  Homolog annotation: Hit_ID=Q8LDZ9; Match level="QueryCoverage=51%, HitCoverage=29%, E-value=8e-51, Identity=82%"; Hit description =Transcriptional activator RF2a, putative
  Pfam annotation: Domain name=bZIP_1; Domain location=45-97; Score =14.0; E_value=0.0046; Accession=PF00170.11; Description=bZIP transcription factor
  Subcellular localization annotation: CTP_CleavageSite=46; ConfidenceScore=5.88e-01
MNPISNNNLYPATTVLFFFFVFSSSTVFLSFFSSFQMFFIWIWANRQSAARSKERKMRYISELERKVQTLQTEATSLSAQLTLLQRDTHGMTAENSELKLRLQTMEQQVHLQDALNDALKEEIQHLKALTGQVMPNGGPVNFASFGGGQQFYPNNQAMHTLLAAQKFQQLQIHSQKQQQHQLQQQQQFQHQLQQQQQFHQQQQQLQLQQQLQQQQQQQQQQQQQQTAATGTVTSTNGGHE

SEQ ID NO: 143609 - protein, 68 aa, Glycine max
  Coding DNA Sequence Number=SeqID_26831
MDNRLQGPLVYYRNKMPSWHRHNNGYAITLVNRKVDRWFLLRRAFHISNLFHKNTSTTPCKVDRNVQQ

SEQ ID NO: 143610 - protein, 273 aa, Glycine max
  Coding DNA Sequence Number=SeqID_26832
  Gene Ontology: Mol. function=nucleotidyltransferase activity
  Homolog annotation: Hit_ID=Q16LC4; Match level="QueryCoverage=52%, HitCoverage=32%, E-value=6e-08, Identity=30%"; Hit description=Sigma DNA polymerase, putative
  Pfam annotation: Domain name=PAP_assoc; Domain location=173-228; Score=16.9; E_value=0.00062; Accession=PF03828.9; Description=PAP25A associated domain
MKSHIVLLSPGEHGNDNQSDTFQLEDLALSKRSQMKFDALKSKSVRLDINFKSPSHTGLQTTEMDCSVTYVECRIGCLPVKWSTYFNNIDEKKCNKNCTSKKLDAIFMQCLNVKGLTEQFPAATPLALVLKQFLADRSLDQSDSGGLSSYCLVLLIIRFLQHEHHLGWPINQNYGSLLMDFLYFFGNVFDPRQMRISVQGSGLYIKRERGCSNNAPEMPVDDKCTFNNNVACAFSEAYSVLENELKFLNSDGGSCSRPPYRLLPKIIPSLDIS

SEQ ID NO: 143611 - protein, 325 aa, Glycine max
  Coding DNA Sequence Number=SeqID_26833
  Gene Ontology: Mol. function=protein serine/threonine kinase activity
  Homolog annotation: Hit_ID=Q337P5; Match level="QueryCoverage=75%, HitCoverage=32%, E-value=6e-42, Identity=38%"; Hit description =Pleckstriny domain-containing protein, putative, expressed
  Pfam annotation: Domain name=DUF1336; Domain location=34-246; Score =327.9; E_value=1.8e-95; Accession=PF07059.3; Description=Protein of unknown function (DUF1336)
MAGPDDPKKSEWIDRIKSEGSIPLLDPDNCSNGWASPPGAAFKIRGPEYLTTKAKIPAGDYLLKPLGFDWIKSSVKMGEILKHSNSRVRKVIDNEFPAGDKPFVWAFNIQLPTKDNYSAVAYFTNKEPIAEGSLMDKFLKGDDAFRNSRLKMIANIVNGPWIVRKAVGEQAICIIGRALFCKYCVAENFIEVDIDIGSSMVATAIVHLAFGYVTTLTVDLAFLIESQTESELPEKLLGAFRFSNLNPASARQIDPSSVLSTGGLQKSLSKRLWKSIGQILLPGSKEDDSTSDIQEELKGTESPFQVVILLTIHFNGRAKGILHKT

SEQ ID NO: 143612 - protein, 374 aa, Glycine max
  Coding DNA Sequence Number=SeqID_26834
  Gene Ontology: Mol. function=DNA-directed RNA polymerase activity; Cellular component=nucleus; Biological process=transcription
  Homolog annotation: Hit_ID=Q1SWK4; Match level="QueryCoverage=80%, HitCoverage=63%, E-value=4e-70, Identity=56%"; Hit description=Zinc finger, PMZ-type
MLCYVIAVRVLELPASIKDRNNHDECWESNSVDNGAESMEEVHELEVIMHDNINGGFEPCEPASGMSFPSKEAVKSFYRQYASRMGFGFKPYEGNDGQSKKNTSMHVNRTIEINHEAKVVMNKTIQSLACDEGGHRNLSFVEGDVKHYVLKERHTIGKEGDGNPPKGIVTGQCKAIQLVFPTTQHRWCLWHVIKKIPEKLKTNTEYNKNIKSAMKSVVYDTFTEAEFEDQWSHFIKGFNLQDNEWLSELYNELSRWVPIFLKKDFWAGMSTTQRGENVHPFFDGYINSTTSLQQFVQLYDIALYDKVEKEFEADLRSFNTTIHCRSNSMIEKLFQSAYTHAKFNEVQAEFRAKIYCSVSLGHVEAFVLMMCWRT

SEQ ID NO: 143613 - protein, 122 aa, Glycine max
  Coding DNA Sequence Number=SeqID_26835
  Gene Ontology: Mol. function=transcriptional elongation regulator activity; Biological process=regulation of transcription, DNA -dependent
  Homolog annotation: Hit_ID=Q2QT42; Match level="QueryCoverage=93%, HitCoverage=30%, E-value=5e-18, Identity=36%"; Hit description =Pentatricopeptide, putative, expressed
  Pfam annotation: Domain name=PPR; Domain location=55-89; Score=25.1; E_value=0.00025; Accession=PF01535.11; Description=PPR repeat
MAVAGVGTTASTYEHLVKGYCNVGDVDSAVLGRVQEALEFVRCAVGKFDLIPMEKSYEALTKGLCFEGRMEEALKVQAEMVGKGFQQNSEMYGAFVDGYIKQGNEEMAEALRKEMLQNQMQK

SEQ ID NO: 143614 - protein, 101 aa, Glycine max
  Coding DNA Sequence Number=SeqID_26836
  Homolog annotation: Hit_ID=Q10EJ2; Match level="QueryCoverage=72%, HitCoverage=47%, E-value=8e-16, Identity=50%"; Hit description =Integral membrane protein, putative, expressed
MGLVIPWSFTLALVDGYSVLVKCPIRQPGILLIIVVGDWVLSTLTLAAACSTASVVDLLLNTHGSFCPPKLCSRSKVHLECNESHAQLHSRYTKSTDKINS

SEQ ID NO: 143615 - protein, 144 aa, Glycine max
  Coding DNA Sequence Number=SeqID_26837
MAVQERKNDNFERVRMAARVWQHEKGDKENTMGSPQRVCESESEKDSARVKRRASENEKNGWVFNKPRLRWTVDPNDVVVAFKVSGIRFSNPVGPTHSNYHPIERAVPSTGLTLWDYPTWMGCLTIGFFRSLTPFFLNAVPKSP

SEQ ID NO: 143616 - protein, 469 aa, Glycine max
  Coding DNA Sequence Number=SeqID_26838
  Gene Ontology: Mol. function=sequence-specific DNA binding; Cellular component=nucleus; Biological process=regulation of transcription, DNA-dependent
  Homolog annotation: Hit_ID=Q9ZSI7; Match level="QueryCoverage=94%, HitCoverage=91%, E-value=3e-62, Identity=38%"; Hit description =Probable WRKY transcription factor 47
  Pfam annotation: Domain name=WRKY; Domain location=226-286; Score =142.9; E_value=8.5e-40; Accession=PF03106.6; Description=WRKY DNA -binding domain
MDNPHHRQLTFFLSHSIDHTDPPSVKEMDFFSTSSAPDHKNNTSTSDTNDDYQKRDDQHDTHDRHGSITADGSPTRATDHHVNTGLNLTCASAGMTKSDNSENPETENVETKIVDPGASTKLDVVNNASVSDEKTDQDVSVYRSNNAEVMSKTHDRDDDPQLTKLNLGKQACPDAAEDVLDRSSSQSWGSSKLEEQPKTAEQLPAEQIPLRKARVSVRARSEAPMISDGCQWRKYGQKMAKGNPCPRAYYRCTMAVGCPVRKQVQRCADDKAVLITTYEGNHNHPLPPAATAMANTTSAAAAMLLSGSAAPSKEALTNSAGYYSSSSIPYASMATLSASAPFPTITLDLTQNPNNAMQLHRVPAGHGATFPLPLHAAAAGPHLLGHPLFFQQKLPPAALMPLLQRQPSSSMVETVSAAIASDPNFTAALMAAISSIIGVPRSSDDNNNGNGAIPGSPQLPQSCTTFSTN

SEQ ID NO: 143617 - protein, 48 aa, Glycine max
  Coding DNA Sequence Number=SeqID_26839
MYEDKPSYTMTYYKKGEVMIQVLQGIVSLRPGMRWSVLLHPRRYTDYV

SEQ ID NO: 143618 - protein, 271 aa, Glycine max
  Coding DNA Sequence Number=SeqID_26840
MWKLPSTERITQLGELLFSTSFLAQPIDPPKPKPISNFVSLRRSNTSVNSKDHTSDTPTKKKTESSNPVIAPSGRTLSVQDRINLFENRQKEYSGGKPSKLQHLFSNVLQRWSSTSDIRINVSSGESKDSDSPLPTPASSISQTKFIKFVKTDQGSSQETGKVSIFYEDKNKGFKDYIGVGVYEATLKKGSSEVVVVGPMLSFGDDDVKFYGGAKSHVFEGGNGLKFRDDSVRVAQSSSNEVEDSSSFPNKEKDSQIQKMKYQKPLPSRNE

SEQ ID NO: 143619 - protein, 72 aa, Glycine max
  Coding DNA Sequence Number=SeqID_26841
MVAVIQWQWKHVTSILYFSLPQPATKDTKKQLELVHERGNPPSSPLHMDSNVTYSRFKINQYLNDLNKRTIV

SEQ ID NO: 143620 - protein, 116 aa, Glycine max
  Coding DNA Sequence Number=SeqID_26842
  Subcellular localization annotation: CTP_CleavageSite=66; ConfidenceScore=5.15e-01
MWMPECILVVGSTTPQRKFTYLDHHPKSINNNTNSKTTTKRINDRVGVGPMQYRLTTKMLGTLRMGVSAVWGWCKGFGFGFGFGARVLDLVSWQNRNFIKVGSLNSKICSGNSCSQ

SEQ ID NO: 143621 - protein, 90 aa, Glycine max
  Coding DNA Sequence Number=SeqID_26843
MNVVRRRLLHTLRGGAAPSETLKRRALELEKKRKTRHSKTKDQFIVTVPESLSFLDTATIPMYFAAIGIALLAKLLMTRFISSHTTCSMK

SEQ ID NO: 143622 - protein, 830 aa, Glycine max
  Coding DNA Sequence Number=SeqID_26844
  Gene Ontology: Mol. function=nucleic acid binding; Cellular component= intracellular; Biological process=DNA integration
  Homolog annotation: Hit_ID=Q1T010; Match level="QueryCoverage=98%, HitCoverage=62%, E-value=1e-180, Identity=39%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=489-644; Score =84.5; E_value=3.3e-22; Accession=PF00665.16; Description=Integrase core domain
  Pfam annotation: Domain name=zf-CCHC; Domain location=275-292; Score =27.1; E_value=3.3e-05; Accession=PF00098.13; Description=Zinc knuckle
  Pfam module annotation: Pfam domain module=rve::zf-CCHC; Domain location=489-644::275-292
MAMLKNNDQIPAKLPIFDGTNYERWTAQMKVVFRYQGVLDIISTDITPLEMNPTKAHRATHREQMKKDDKAIFLIHQCVDSNVLEKIIDYEMTKEAWDVLATTYANDKQTKKVRLMALQRQLGLLQMESNETVAQFVNRLMILANQMKSCGEVVTDSMKVEKVLTNLTPSFDHIVFVIEQSKDLETLKLEQLLGSLEAHELKMKNREGIKKKEKDSEKVLFAKNQKKGGGDSWKNKKGKGKWRYNKQESSGSKSENQKKEGENNGNGKKKSKEHIQCYNCQKYGHYAYECSNPKVPRKRSEEAQFARDSDDEEAVMLMATVNSETGVKEWWYLDTGCSNHMTGHKDWFCKIDETMKRSIKFGDDMSIMAKGIGKVAIRRVDGSKVTISDVLYVPNMESNLLSLGQLLEKGFSMHMEGEHMEVADSNWKCVLKIDVSKNRTFKVGVSTIKHKFLTAQSNASVWKWHKRLGHLNFNNLNKLQKKNMVVGLSSIEVPRQVCGRCCEGKQPRKVYNAVVPTRAKEKLAVIHSDVCGPFEIKSHGVEKQSGCSIKMLRTDGGGEYTSLEFENFCKEEGIIHEVMVPYTPQHNGTAERRNRTLLNMVRCMLREKHLLHDFWAETVSIVAHILNRCPTKRLDSLTPEEAWSGLKPSVKHFKVFGSLCYRHVPEQNRRKLDLRAQTMILVGYHSIGAYKLFDPLSKKIMISNDVIMDKTKELDWNIGMERQTNKTVEVELGEEIQDEVQIDSEQYVNDEQNVNDGPDVIGVVSLRRSLRQISPPVKFQDYDVFPDATINVNGELMNLVLLVEAEPISLEEALASPHWRKAMEEELRSI

SEQ ID NO: 143623 - protein, 95 aa, Glycine max
  Coding DNA Sequence Number=SeqID_26845
  Homolog annotation: Hit_ID=Q9SJD5; Match level="QueryCoverage=55%, HitCoverage=31%, E-value=1e-13, Identity=74%"; Hit description =Expressed protein
MTKILASYGISWNLQNEVQEPKIDSFIKDVLTIKGCDGWWQYDDSRSQELLERKIKNAPRGRGSVKMSHERSGRSIEKSGPGLRLSPRLPALIPK

SEQ ID NO: 143624 - protein, 188 aa, Glycine max
  Coding DNA Sequence Number=SeqID_26846
MIIDESLFFSLTQLPSQGAPFEGTLVDDWKFDYSSHDARHMVYIDQADMTGKLLVGSLTFDCRIMHYIIVRILMSRSFNLAQASEEDLILMWAFLIDHPIDWAHLIHYRMHKALRSGAPLPYPQLVTLFLRHFEIPLDYEPFVQVKCSFAISASAVTSFGYRKDMDGQWLKKDTQPPQDERTPSPLPQ

SEQ ID NO: 143625 - protein, 447 aa, Glycine max
  Coding DNA Sequence Number=SeqID_26847
  Homolog annotation: Hit_ID=Q5JK63; Match level="QueryCoverage=66%, HitCoverage=74%, E-value=4e-94, Identity=56%"; Hit description=Group II intron splicing factor CRS1-like
  Pfam annotation: Domain name=CRS1_YhbY; Domain location=172-256; Score=122.3; E_value=1.4e-33; Accession=PF01985.11; Description=CRS1 YhbY domain
  Subcellular localization annotation: CTP_CleavageSite=39; ConfidenceScore=5.65e-01
MATSLFRSIRRAFFALRFSYSTSFSVSPRSVVGRTQMCVCSPLRHCVPVGEQGYWWGLRNLSYGRVNLVITGGKTKFETHEEEPPKKDKWTTKKRLKMQRKREKEKRRAANRKDPRQLGIKGKKKKQRFACAEERIKYKIEKARIKEALLIERLKRYEVPKAQGPVVKPDDLTGEERFYLKKMAQKRSNYLQIGRRGLFGGVVLNMHMHWKKHETVKVFCKPCKPGQVHEYAQELARLSGGIPLQIIGDDTIIFYRGKNYEQPEVMSPIDTLSKKKALEKSKYEQSLESVRRFIAIAEKELELYCRHVALYGDPNNRNPLSMMDGPSGNSKEKGNHGISDDFSVSLSETEADSTEMELSEIEDSLEDENMSMNESDSEEDSMLDSNGNQERESSYLFLPSEMVSEYIMRPWMDLVRVCYCMCIRIPNIYRDLKIAPLIPIPNASTGY

SEQ ID NO: 143626 - protein, 166 aa, Glycine max
  Coding DNA Sequence Number=SeqID_26848
  Gene Ontology: Mol. function=kinase activity; Cellular component =cytoplasm; Biological process=carbohydrate metabolic process
  Homolog annotation: Hit_ID=Q8H976; Match level="QueryCoverage=79%, HitCoverage=77%, E-value=2e-60, Identity=89%"; Hit description =Fructokinase
MASTNALPPTGNGLIVSFGEMLIDFVPTVSGVSLAEAPGFLKAPGGAPANVAIAVARLGGKAAFVGKLGDDEFGHMLAGILKENDVRSDGINFEKGARTALAFVTLRADGEREFMFYRNPSADMLLTPEDLNLELIRSLVFVFHACGNDGLKSNHSSSTGLFHFDF

SEQ ID NO: 143627 - protein, 35 aa, Glycine max
  Coding DNA Sequence Number=SeqID_26849
FNKQVCGSADFEPLAKPILWLNEQSAKRNSSWLSA

SEQ ID NO: 143628 - protein, 295 aa, Glycine max
  Coding DNA Sequence Number=SeqID_26850
  Gene Ontology: Mol. function=transferase activity; Biological process= DNA integration
  Homolog annotation: Hit_ID=Q1SB55; Match level="QueryCoverage=60%, HitCoverage=75%, E-value=8e-25, Identity=35%"; Hit description=FAR1; tRNA-binding arm
  Pfam annotation: Domain name=FAR1; Domain location=119-279; Score =103.9; E_value=4.7e-28; Accession=PF03101.5; Description=FAR1 family
MNQLFINSIDCCVELEYHLCTENLIPDSFVTAVEVEIDGSVTVETVGNTAMGEVSSIADDNREGGSSVEPNDKQDQHDNMTQDSSGGITIPTAIPTVSVVSVEEPYVGQEFGSEAAAHAFYNAYATDVGFIVRVSKLSRSRRDGTAIGRTLVCNKEGFRMADKREKIVRQRAETRVGCRAMIMVRKLSSGKWVIAKFVKEHTHPLTPGKGRRDFYYEQYPTEQDKIRELSQQLATEKKRSAAYKRHLELIFEQIEEQNENLSKKIQHIVDSVKEMEAKEEHSRQWEGDGSQRRTY

SEQ ID NO: 143629 - protein, 281 aa, Glycine max
  Coding DNA Sequence Number=SeqID_26851
  Gene Ontology: Mol. function=calcium ion binding; Cellular component =flagellin-based flagellum; Biological process=ciliary or flagellar motility
  Homolog annotation: Hit_ID=Q9SCA1; Match level="QueryCoverage=46%, HitCoverage=56%, E-value=6e-51, Identity=76%"; Hit description =Calcium-binding protein
  Pfam annotation: Domain name=HMA; Domain location=125-190; Score =27.7; E_value=4e-05; Accession=PF00403.16; Description=Heavy-metal -associated domain
  Pfam annotation: Domain name=efhand; Domain location=116-144; Score =1.8; E_value=9.5; Accession=PF00036.22; Description=EF hand
  Pfam annotation: Domain name=efhand; Domain location=41-69; Score =28.9; E_value=1.8e-05; Accession=PF00036.22; Description=EF hand
  Pfam annotation: Domain name=efhand; Domain location=5-33; Score =36.4; E_value=9.9e-08; Accession=PF00036.22; Description=EF hand
  Pfam annotation: Domain name=efhand; Domain location=78-106; Score =39.0; E_value=1.7e-08; Accession=PF00036.22; Description=EF hand
  Pfam module annotation: Pfam domain module=HMA::efhand::efhand::efhand ::efhand; Domain location=125-190::116-144::41-69::5-33::78-106
MDPMELKRVFQMFDRNGDGRISLKELSDSLENLGILIPDKDLAQMIERIDVNGDGCVDMDEFGDLYESIMEERDEEEDMREAFNVFDQNRDGFISVEELRRVLASLGLKQGGTLDECKKMITKVDVDGDGMGCAGKVEKQLRKIKGVTDININVKRELVEVKGVEDASILIVALKHALKKKKNLKVDLIEPNSANANESIENVDAQHSEGVHEANDNEVDAQHSEGGHGDDDNEIHVEHSEGDHEARIDVGAQHSIGDGRIYGIVSSLFGWLKVLLFKLKF

SEQ ID NO: 143630 - protein, 43 aa, Glycine max
  Coding DNA Sequence Number=SeqID_26852
MRKLIKERMENKVVNLVGLNKVKWWLDRNIEMAITEATGLQMR

SEQ ID NO: 143631 - protein, 72 aa, Glycine max
  Coding DNA Sequence Number=SeqID_26853
MDAKDRTASSFKITYLCNVAIQWSHSRKEICIATTLSRGVHSVIYLILAFILDRAAHHHRFPFEIGCNDSCG

SEQ ID NO: 143632 - protein, 536 aa, Glycine max
  Coding DNA Sequence Number=SeqID_26854
  Gene Ontology: Mol. function=transferase activity, transferring glycosyl groups; Cellular component=membrane
  Homolog annotation: Hit_ID=Q9FN55; Match level="QueryCoverage=72%, HitCoverage=79%, E-value=1e-149, Identity=66%"; Hit description =Arabidopsis thaliana genomic DNA, chromosome 5, P1 clone:MYC6
  Pfam annotation: Domain name=DUF604; Domain location=267-521; Score =531.9; E_value=7e-157; Accession=PF04646.3; Description=Protein of unknown function, DUF604
IPSFHFYDPNNSQLEGSKSLITWLILITIVLYTLYSSNIILFNNDQQDCPTITTNLNEATQENLRVSTYNNTSSKTIATDDESVEKKKPLVEKRPREDNDDDEEEGEEKNKEEEENKSPVVVRLTPKQMSERQDTELKHVVFGIAGSSNLWHIRKEYIKIWWRPKETRGVVWLDKKVRSQSNEGLPDIYISGDTSKFRYTNRQGQRSALRISRVVTETFKLGMKDVRWFVMGDDDTMFMVDNVVRILSKYDHRHFYYIGSSSESHVQNIHFSYAMAYGGGGFAISYPLAQELAKMQDRCIQRYPALYGSDDRIQACMAELGVPLTREPGFHQYDVYGDLLGLLGAHPVSPLVSLHHLDVVQPIFPRMTRVRALRHLMESVNQDSGSIMQQSICYDKQNFWSISVSWGYVVQILRGVLSPRELEMPSRTFLNWYKRADYTAYAFNTRPVAKHPCQKPFVYYMTNTHYDSTTKQVVGVYSRDKSKSPFCRHRGGIVVEYCHHVRAQILYTYGWAIVKRVKLLNYSIVNPHIVLSSITV

SEQ ID NO: 143633 - protein, 139 aa, Glycine max
  Coding DNA Sequence Number=SeqID_26855
  Homolog annotation: Hit_ID=Q9LX30; Match level="QueryCoverage=67%, HitCoverage=7%, E-value=2e-35, Identity=75%"; Hit description =Probable serine/threonine-protein kinase GCN2
KGNPPTGVGTSLALETIIQNCPVDFKPNRNEASINILVCSRGGGGLLVERMELVAELWEENFKAEFVPTPDPSLTEQYEYANEHGIKCLVIITDTDFSLTGSVKIWGSDENEYGHYKAGGQVDEMVVRSEIAMEDSDNE

SEQ ID NO: 143634 - protein, 917 aa, Glycine max
  Coding DNA Sequence Number=SeqID_26856
  Gene Ontology: Mol. function=protein serine/threonine kinase activity; Cellular component=integral to membrane; Biological process=protein amino acid phosphorylation
  Homolog annotation: Hit_ID=Q948R7; Match level="QueryCoverage=95%, HitCoverage=97%, E-value=0.0, Identity=62%"; Hit description=CR4
  Pfam annotation: Domain name=APH; Domain location=520-701; Score= -14.9; E_value=0.066; Accession=PF01636.13; Description =Phosphotransferase enzyme family
  Pfam annotation: Domain name=Pkinase; Domain location=518-804; Score =137.5; E_value=3.7e-38; Accession=PF00069.15; Description=Protein kinase domain
  Pfam annotation: Domain name=Pkinase_Tyr; Domain location=518-791; Score=107.3; E_value=4.4e-29; Accession=PF07714.7; Description =Protein tyrosine kinase
  Pfam annotation: Domain name=TNFR_c6; Domain location=351-398; Score =14.0; E_value=0.027; Accession=PF00020.9; Description=TNFRNGFR cysteine-rich region
  Pfam module annotation: Pfam domain module=APH::Pkinase::Pkinase _Tyr::TNFR_c6; Domain location=520-701::518-804::518-791::351-398
MGFSLKHRLIYGFNVNQCSTRLLFELVILSHLWLQVTSLGSMSSIAISYGEKGSVFCGLKSDGSHTVTCYGSNSAIIYGTPTHFSFLGLTAGDGFVCGLLMGSNQPYCWGSSAYIEMGVPQPMIKGAQYLEISAGDYHVCGLRKPMTGRHRNISLVDCWGYNMTKNYVFGAQIQSISAGSEFNCGLFSQNRTVFCWGDETNSLVISLIPHDMRFHKISAGGYHVCGISEGVSSKTFCWGRSLNLEEEISVSHAGQGNVDLAPNDPMLSVVGGKFHACGIKSYDRGVICWGFIIKPSTPSPKGIKVFEVAAGDYFTCAVLAVKSLMPSCWGVDFPTSLPLAVSPGMCQPAPCAPGSYAIDQHKSLCKSPDSRVCMRCSGACPPEMHLKSACNLASDRVCEYNCSCCSSSECFLNCSSSYSNAAAAEKKSEKFWALQLPVLIAEIAFAVFVVSIVSITAVLYIRYRLRDCECSKGSMVKKLNGNSSLQNENKVRPDLEELKIRRAQTFTYEELETATSGFKEESIVGKGSFSCVFKGVLKDGTVVAVKRAIVSPNMQKNSKEFHTELDLLSRLNHAHLLNLLGYCEEGGERLLVYEFMAHGSLHQHLHATNQVLREQLDWIRRVTIAVQAARGIEYLHGYACPPVIHRDIKSSNILIDEEHNARVADFGLSLLGPADSGSPLAELPAGTLGYLDPEYYRLHYLTTKSDVYSFGVLLLEILSGRKAIDMQYEEGNIVEWAVPLIKSGDITAILDPVLKPPPDLEALKRIANVACKCVRMRGKERPSMDKVTTALERGLAQLMGSPCIEQPILPTEVVLGSNRLHKKSSQRSSNRSVSETDVAETEDQRFEFRAPSWITFPSVTSSQRRKSSVSEADVDGKNNAEGKNMGNVGGGGDVLRSLEEEIGPASPRERLFLQHNF

SEQ ID NO: 143635 - protein, 261 aa, Glycine max
  Coding DNA Sequence Number=SeqID_26857
  Gene Ontology: Cellular component=chloroplast; Biological process =chlorophyll biosynthetic process
  Homolog annotation: Hit_ID=Q9LX31; Match level="QueryCoverage=98%, HitCoverage=98%, E-value=6e-58, Identity=48%"; Hit description =Tetrapyrrole-binding protein, chloroplast precursor
  Pfam annotation: Domain name=GUN4; Domain location=79-222; Score =209.7; E_value=6.7e-60; Accession=PF05419.3; Description=GUN4-like
  Subcellular localization annotation: CTP_CleavageSite=14; ConfidenceScore=5.04e-01
MATNSLHYSIQHHQCSLTKRHHPSDTPPPTSLFLKPPTPPIHHNITLSHTPSNSYITYSISQTTPSSTTSQTTPSFDLLRHHLSTNNFQLADEETRRLLIVLAGEAAQKRGYVFFSEVKFISESALRAIDSLWREHSGGKFGYSVQKKLLEKANGDFTKFFIKLGWMKKLDTEMEQYNYRSFPTEFIWELNDDTPEGHLPLTNALRGTQLLNNVLKHPAFDVVDDKEEEEDGENKDNGAITDNGSSSKTLGQRIFKPDYSF

SEQ ID NO: 143636 - protein, 224 aa, Glycine max
  Coding DNA Sequence Number=SeqID_26858
  Homolog annotation: Hit_ID=Q2R7H6; Match level="QueryCoverage=85%, HitCoverage=63%, E-value=4e-34, Identity=39%"; Hit description =Expressed protein
MEVSASASKRRNNIGIKNLLLILLFFHFSSTITAIRKDVGFQIIHPCKTTVQGRYLLSDDNGCVRNATSVNSRSRCCPQRGEKVSCHGCNLLSQCCNSYEYCVSCCFNPALISKEQVVKMKVAKPATASSPSADWFLSDPKSPEHVVGLIQVFLTTVLGDVVIVLRAWKLKYPIKLTKTVHFEVHENAYISDFHHCFSLPSSSSGKNSTLTEARLSGINVVVGR

SEQ ID NO: 143637 - protein, 346 aa, Glycine max
  Coding DNA Sequence Number=SeqID_26859
  Gene Ontology: Mol. function=small conjugating protein ligase activity; Cellular component=cytosolic ribosome (sensu Eukaryota); Biological process=protein amino acid phosphorylation
  Homolog annotation: Hit_ID=Q9LX30; Match level="QueryCoverage=98%, HitCoverage=25%, E-value=1e-123, Identity=64%"; Hit description =Probable serine/threonine-protein kinase GCN2
MQKSEDTSIYDKVLNAIFDEEMLSTKHIRQNSSSIQYTDFETEVRDYVVDANREIFRQHCAKHLEIPTMRLLDDCPQFNRNAVKLLTHGGDMLELCHELRLPFVNWIISNQKSSFKRYEISCVFRRAIGHSSPNHYLQGDFDIIGGTSALTEAEVIKLSLIALLYSVVCYTTWFTIEAPVLDFISMVTRDIVTCFFHEDSCDIHLNHGDLLDAIWSWIGVKVEHRLKVAELLSMMGSLRPQSSERKSKWVVIRRQLLQELNLAEAMVNRLQTVGLRFCGSADQALPRLRGALPSDKRAFKALDELSELVSLLRIWRIDKNIYIDALMPPTESYHRDLFFQYYDCIL

SEQ ID NO: 143638 - protein, 74 aa, Glycine max
  Coding DNA Sequence Number=SeqID_26860
  Homolog annotation: Hit_ID=Q1SQP8; Match level="QueryCoverage=70%, HitCoverage=7%, E-value=5e-24, Identity=96%"; Hit description=PAS; PAS-associated, C-terminal; Protein kinase
MLRLLFHLLLKISLFNPGKKFWNLFHLQPMRDQKGEVQYFIGVQLDGSQHVEPLHNCIAEDTAKEGEQLVWSLF

SEQ ID NO: 143639 - protein, 436 aa, Glycine max
  Coding DNA Sequence Number=SeqID_26861
  Gene Ontology: Mol. function=small conjugating protein ligase activity; Biological process=protein amino acid phosphorylation
  Homolog annotation: Hit_ID=Q9LX30; Match level="QueryCoverage=90%, HitCoverage=33%, E-value=3e-73, Identity=42%"; Hit description =Probable serine/threonine-protein kinase GCN2
  Pfam annotation: Domain name=RWD; Domain location=34-140; Score=55.9; E_value=1.4e-13; Accession=PF05773.12; Description=RWD domain
MGHSSKKKKRGGGSGRRSKGRTQSKDHASQFGSDDYDQLSEEITALCAIFEEDCKVLPGSPPRVVIKLRPYSKDMGYEDLDVSAVLAVRQCPKLQITPEKGLSEADAKKLLSLLQDQATLNAREGRVMIYNLVEAAQEFLSGIEPIAKTNDSKLLHSMVESNEELFPKDMTSVNKKGSFVYGFIDLFSGCGETWSWSFGMDETAVKSSSLSPSKLDASKPLEKKSDSKETPLIMQELPAKLDTVGEVSEDSNNSLSLTSSSRSLVEDFVGNKNEGEKEYFIVDEYTTEHNEGINESESSESLSSESLPHHQPSQTVEKDLIMVHMLRLVCASKGTFADCLPQVVTELCNLGIISDSARDMASEPPSIFNKTFNRVFQKHLASSRISQFWKPDIGGSNTVPHGSRYLNDFEELRPLGKGTSWISVLSYMYNSVMSYS

SEQ ID NO: 143640 - protein, 118 aa, Glycine max
  Coding DNA Sequence Number=SeqID_26862
MAKLRDSVSLMMKGVARRRKVSEARKKKGFRSKEEEGFWKKLRGFLFGVLALFMESKSLVRTCSNQKERRVFKKEFPGSKKYLRSTKLRQERGLRAIGQFELVYGRVEVEAARVLDLA

SEQ ID NO: 143641 - protein, 838 aa, Glycine max
  Coding DNA Sequence Number=SeqID_26863
  Gene Ontology: Cellular component=nucleus; Biological process =regulation of progression through cell cycle
  Homolog annotation: Hit_ID=Q5N857; Match level="QueryCoverage=97%, HitCoverage=93%, E-value=1e-140, Identity=46%"; Hit description =Cyclin-like
MGVMSRRVVPVCGNLCCACPALRASSRQPVKRYKKLLADIFPRYQEAELNDRKIGKLCDYASKNPLRIPKITDNLEQICYKYLRYETFGSVEVVLCIYRKFLSSCKEQIPANEDKLNSESLDLLVQGIPKVEDPLTDITKKDPLLLKAVTGTEIDCVLDTAKDPTYWSKVCLYNMVKLAREATTLRRVLEPLFHYFDTENQWSSEKGVAAHVLMYLESLLAESGDNSCLLLSILVKHLDHKNVAKQPILQINIINTTTKLAQNVKQQASVAILGAISDLIKHLRKCLQNSAEASSIGNDGLKLNTELQFALEMCILHFSNKVGDVGPILDLMAVVLENISSTTIIARTTISAVYQTAKLIMSIPNVSYHKKAFPDALFHQLLLAMAHPDHETRVGAHSIFSLVLMPSPFSPQLDQKTKGYQKVPSESFSIQHESFLGAEQINGKPMEGKAVVGVSGKYAVHPYHGHIFSGALTDGKHELSSFRLSSHQVSFLLSSIWVQATSVESGPANFEAMAHTYSIALLFTRSKTSSYMALVRCFQLAFSLMSLSLDQEGGLQPSRRRSLFTLASYMLIFSARAGNFPELIQKVKTSLTETTVDPFLELIDDVRLQAVSRESENIIYGSQEDDVSAMKIMSAVKLDDKQLKETVISCFLTKFSKLSEDELSSIKKQLVQGFSPDDAYPLGPPLFMETPGKSSPLAQIEFPDFDEIVAPLALMDEETWPKSSGSQSDHKSSLSSNSPDILSVNQLIQSLESRDWVSSFKDMILYLVQVLETARQVASFPISSTPVSYDQMKNQCEALVTGKQQKMSILHSFKHQQETGAIVLSSENEIKVSPLPIK

SEQ ID NO: 143642 - protein, 57 aa, Glycine max
  Coding DNA Sequence Number=SeqID_26864
MGIPQSQDVDDVDGEGPFDDGGQRKDQKLPPHQTGMNAESEAARKKSEDLEREREDD

SEQ ID NO: 143643 - protein, 93 aa, Glycine max
  Coding DNA Sequence Number=SeqID_26865
MYPKRSGQDGPDSRQVRSSDRIKTRPNVYGRPYLYYNQNLRRTRKSKIKTRTAASQIAKMLRPGNRKSKDSNTNIVRRHMDANEIPHPPALSK

SEQ ID NO: 143644 - protein, 1386 aa, Glycine max
  Coding DNA Sequence Number=SeqID_26866
  Gene Ontology: Mol. function=phosphopantetheinyltransferase activity; Biological process=macromolecule biosynthetic process
  Homolog annotation: Hit_ID=Q2HU34; Match level="QueryCoverage=99%, HitCoverage=100%, E-value=0.0, Identity=72%"; Hit description=DNA -binding protein-like-Arabidopsis thaliana-related
MAIEKNSFKASRLDSECSPRSRESMSSDEEVIRRRNSAVESDDDDEFDDADSGAGSDDFDLLELGETGAEFCQIGNQTCSIPLELYDLAGLEDVLSVDVWNDCLSEEERFELAKYLPDMDQETFVQTLKEVFTGCNLHFESPIKKLFDMLKGGLCEPRVALYKEGLSSFQKRQHYHLLRKHQNNMVSNLCQIRDAWLNCRGYSIEERLRVLNIMRSQKSLMYEKEDLEVDSSDEESGEGIWSRKNKDRKISQKTGRYPFHGVGPGLDIHSRGRSVVREQEKYGKQNPKGILKLAGSKPPSVKDPTGRSSSVYHALDVNPGLNGSTSALSQQNKSVGYDSGSMHRMRDQLWNGDNEEMSYGVHQDRNLSRSNLMDKSSFRKVGKRNDLLRGDEMDTDNLMGLSLSSKTDLHGYTRNANQSSDMKIFPAKPFSKKGLYEYSRNSKYLENVQQFVGSDQAKPRVRSSQLSLKGTMVDSADYDELFYSNETPGQEFGMDSSFKYDDWYRKGKKWKAGRESPDLSYTPYRSSSPQVSDRLLSSDFRAKSLQEKIRGTSMQNGEKDPMPLRGSHMLLRGEETESDSSEQLGDDDDNTPLLQGKYAYLMGTAAGSRTKLLKSHLDPKKAKFVSDLKPHVITQSKKKGGFAERGQMHGVENYLSKVKQKGEIRNGGPFQKQAGKFIEEIYPSGSDMIDDADDDWRQVYKTGKNGRIRGDPIERLDMPSSNAYTAERKKKGRTDLDHSILRSKYLHDYAGDEDNSLERRRLVVDNNEVGQSRHGRKGQKYVSAYKGDQNERSEAPMLGCNSATKKRKMKDEVVDIGGRDEDGNLLSNTLTNDLTYSKRKSKKKIEAGMVSSEMDNSELRLNDMGTADIELETKPQKKTFTLITPTVHTGFSFSIIHLLSAVRMAMISPHAEDDLEMGKPREELNKAQEGTTTNGDLSNSKTDANCESADHPNMPSLTVQEIVNRVRSNPGDPCILETQEPLQDLIRGVLKIFSSKTAPLGAKGWKVLAVYEKSTRSWSWTGPVIHNSPDHDTIEEVTSPEAWGLPHKMLVKLVDSFANWLKCGQETLQQIGSLPAPPLELMQVNLDEKERFRDLRAQKSLNTIRPSSEEVRTYFRKEEVLRYSIPDRAFSYTAADGKKSIVAPLRRCGGKPTSKARDHFMLKRDRPPHVTILCLVRDAAARLPGSIGTRADVCTLIRDSQYIVEDVSDAQINQVVSGALDRLHYERDPCVQFDGERKLWVYLHREREEEDFEDDGTSSTKKWKRQKKDAADQSDQGTVTVACPGTGEQSGYDLCSDLNVDPPPCIDDDKGMEPLPTDTRPNAEAHVDVNRASEEGNACDGNSMAWEALDLNPTRELCQENSTNEDLDDESFGRERPVGLLSASLL

SEQ ID NO: 143645 - protein, 163 aa, Glycine max
  Coding DNA Sequence Number=SeqID_26867
  Homolog annotation: Hit_ID=Q1SB60; Match level="QueryCoverage=94%, HitCoverage=43%, E-value=1e-22, Identity=42%"; Hit description =Double-stranded RNA binding; Fungal hydrophobin
MDVNENSIFKSQNKEKCQYIIGNTVQVGVDQEKNYLSLKYNSNAYASAVKALKVDSTRMLIAEGGVNNLASLHNNYANGPNTSSEKGILVNYTPTANHSNSDLEKLQILSDSKKILSQTALAALIRKRNELALQQRKIEDEIAVCDKKIQRMLTGYSHGVGIS

SEQ ID NO: 143646 - protein, 986 aa, Glycine max
  Coding DNA Sequence Number=SeqID_26868
  Gene Ontology: Mol. function=nucleoside-triphosphatase activity; Cellular component=nucleus; Biological process=proteolysis
  Homolog annotation: Hit_ID=Q8H6B2; Match level="QueryCoverage=95%, HitCoverage=82%, E-value=0.0, Identity=64%"; Hit description =Bromodomain protein 103
  Pfam annotation: Domain name=AAA; Domain location=226-416; Score =267.5; E_value=2.6e-77; Accession=PF00004.19; Description=ATPase family associated with various cellular activities (AAA)
  Pfam annotation: Domain name=AAA_2; Domain location=222-356; Score= -43.3; E_value=0.018; Accession=PF07724.4; Description=ATPase family associated with various
  Pfam annotation: Domain name=AAA_5; Domain location=226-362; Score =9.7; E_value=0.00032; Accession=PF07728.4; Description=ATPase family associated with various
  Pfam annotation: Domain name=Bromodomain; Domain location=714-788; Score=1.3; E_value=0.0016; Accession=PF00439.15; Description =Bromodomain
  Pfam module annotation: Pfam domain module=AAA::AAA_2::AAA _5::Bromodomain; Domain location=226-416::222-356::226-362::714-788
MMQMMAKKEIEGDAEGEDEGEDEGDEDGDDEEGEEEQDGRRRYDLRNRSDVRRFSMEEGKAQPRSPRRVLHQGMGTKVSRDVRKGGSRVHKRHRLARPEDSDDSLLVDELDQGPAIPWGRGGNRSGPPWLFGGLDMHGTTAFGLNLAASGWGHQGDAVATLTSGIQTAGPSSKGGADIQPLQVDDSVSFDDIGGLSEYIDALKEMVFFPLLYPDFFASYHITPPRGVLLCGPPGTGKTLIARALACAASKAGQKVSFYMRKGADVLSKWVGEAERQLKLLFEEAQRNQPSIIFFDEIDGLAPVRSSKQEQIHNSIVSTLLALMDGLDSRGQVVLIGATNRIDAIDGALRRPGRFDREFNFPLPGCEARAEILDIHTRKWKHPPPNELKKELAASCVGYCGADLKALCTEAAIRAFRQKYPQVYTSDDKFVIDVDSVKVEKTHFIEAMSTITPAAHRGAIVHSRPLSLVVQPCLQRHLEKAMSIISDIFPPASITSELTKLSMLSYGSAIPLVYRPRLMLCGGEGTGLDHLGPAVLHELEKFPVHSLGLPSLLSDPSAKTPEEALVHIFGEARRTTPSILYLPQFDVWWETAHEQLRAVLLTLLEELPSDLPILLLGTSSVTLAEVEEVPTSIFPHRSIYKVNMPCAKDRTLFFNLLIEAAMSILLEGINKKSQDAGCLPELPKAPKLASGPKVSELKAKVEAEQHALRRLRMCLRDVCNRILYDKRFNAFHYPVTDEDAPNYRSIIQNPMDMATILQHAYNGEDYNGARIVSRACELRDAVHGMLSQMDPALVAYCDKIASQGGPVQLSDELGDSTFPATPVVQLGQSTRMSARLRHVQPEVNMDQSYEVLKRTKKIAEVHAEEKSQQDSVPSKSSLEQQANDTNSERLEHVSIEGDLHGTFTNNLADGNSPDDVTVLDGEFLGEVESVKQLFVKRSENYSIPQLERLYTRIMKGVFETKNKGVSGDLKSSVLKFLLNFVEDDANF

SEQ ID NO: 143647 - protein, 520 aa, Glycine max
  Coding DNA Sequence Number=SeqID_26869
  Gene Ontology: Mol. function=microtubule motor activity; Cellular component=microtubule associated complex; Biological process =microtubule-based movement
  Homolog annotation: Hit_ID=Q2HU33; Match level="QueryCoverage=94%, HitCoverage=46%, E-value=0.0, Identity=90%"; Hit description=Kinesin, motor region
  Pfam annotation: Domain name=Kinesin; Domain location=57-394; Score =580.1; E_value=2.2e-171; Accession=PF00225.13; Description=Kinesin motor domain
  Subcellular localization annotation: CTP_CleavageSite=22; ConfidenceScore=5.13e-01
MEATQRRLGGGMVPVSPSQTPRSSDKPVRDLRSADSNSNSHSKYDKDKGVNVQVLVRCRPLNEDETRLHTPVVISCNEGRREVSAVQNIANKQIDRTFAFDKVFGPNSQQKELYDQAVSPIVYEVLEGYNCTIFAYGQTGTGKTYTMEGGARKKNGEFPSDAGVIPRAVKQIFDILEAQNAEYNMKVTFLELYNEEITDLLAPEETSKFIDDKSRKPIALMEDGKGGVFVRGLEEEIVCTANEIYKILEKGSAKRRTAETLLNKQSSRSHSIFSITIHIKECTPEGEEMIKCGKLNLVDLAGSENISRSGAREGRAREAGEINKSLLTLGRVINALVEHSGHVPYRDSKLTRLLRDSLGGKTKTCIIATISPSIHCLEETLSTLDYAHRAKNIKNKPEINQKMMKSAMIKDLYSEIDRLKQEVYAAREKNGIYIPRDRYLHEEAEKKAMTEKIERMELEAESKDKQLVELQELYNSQQLLTDELSVKLEKTEVKVAMLNCFILSFWTFDPFRNLTVYILT

SEQ ID NO: 143648 - protein, 283 aa, Glycine max
  Coding DNA Sequence Number=SeqID_26870
  Homolog annotation: Hit_ID=Q1SB60; Match level="QueryCoverage=99%, HitCoverage=72%, E-value=7e-85, Identity=58%"; Hit description =Double-stranded RNA binding; Fungal hydrophobin
MAPSDVCLSEDAVQVFIEHLVDPLLPAKASVQDNPTPSQQKLVANQVRSTVLLYNYYHRKQHPELAYLPFNEFCKLAVVLRPPLLAYMQFMQNLNEEELTDVEKQLSLTEKMIMEACDVCKCLDASKDAPNIEGWPITKVSMLLIDSKKENCFLLFSSITSGVWSVIEKGLDTSSQSSLVEKGLNTSSQSSLVEKGLSTSYQSSEVTSGSKQYKKRRVIKKSAQKELKVDEDVFLQVGYSAVKEATGINNTDIMLLESGTVYSESKEKAASRFYIMQCYRTIN

SEQ ID NO: 143649 - protein, 49 aa, Glycine max
  Coding DNA Sequence Number=SeqID_26871
VGFGQPICTPLRHRCGECSISELCPSALKEISYSSPSSKSKKYRMNKKL

SEQ ID NO: 143650 - protein, 129 aa, Glycine max
  Coding DNA Sequence Number=SeqID_26872
  Subcellular localization annotation: CTP_CleavageSite=41; ConfidenceScore=5.52e-01
MAESSKKRKGTSSTTAAAGHRCHGPPKAPTVPVPPPLSSPRSSTLFSSDDQRLRQGARFEDTIVDDWKFDYSNHDARRMVCNDQADMTDDEPFVQVKRSFAIGAGVVPSFDYCKDRDGQWLRKQDLPHE

SEQ ID NO: 143651 - protein, 185 aa, Glycine max
  Coding DNA Sequence Number=SeqID_26873
MENWRTALGNQFAGLQTRWWRMHERQSIHGAPNKSGEWRIALGNHFAWLQTHWWRMHERQSIHGAPNKSGEWRIALGNHFAWLQTHWWRMHERKLIHGALNKSGEWRIALGNHFAWLQTHWWRMHERHSIHGAPNKSGEWRIALGNHFAWLQTHWWRMHERHSIHGALNKSGEWRIALGNHFAWL

SEQ ID NO: 143652 - protein, 91 aa, Glycine max
  Coding DNA Sequence Number=SeqID_26874
  Gene Ontology: Mol. function=nucleic acid binding
  Homolog annotation: Hit_ID=Q1T6D0; Match level="QueryCoverage=66%, HitCoverage=11%, E-value=7e-14, Identity=52%"; Hit description=Zinc finger, CCHC-type; Lipocalin
MEHKNSLSGSPENSQLEAPDGALEKCLLVKLLDKNVAFVTMKERLKAIWKLEDGFDLMDITNGYYLVNLDMGKDQDKAINGRPWMLFFIST

SEQ ID NO: 143653 - protein, 59 aa, Glycine max
  Coding DNA Sequence Number=SeqID_26875
GQRVRWQAEIPYGRPHHSLTKENEFDGFYSSRPETSSPTTHEILLCWAGMIKFDSMWKR

SEQ ID NO: 143654 - protein, 102 aa, Glycine max
  Coding DNA Sequence Number=SeqID_26876
MANDKALKDLGVKFNKVQKYKALMNYPSTFHCYYVQRQGQGKICLMQGRMKLDLVNVVIDNMFKTKRIGSFKCPYAILISRILDHIKVDTCDTLYPDIYINK

SEQ ID NO: 143655 - protein, 62 aa, Glycine max
  Coding DNA Sequence Number=SeqID_26877
  Homolog annotation: Hit_ID=Q6YPF2; Match level="QueryCoverage=65%, HitCoverage=5%, E-value=1e-08, Identity=63%"; Hit description =Putative MA3 domain-containing protein
MNQMVKGFGRVAESLDDLALDVPDAKIQFANYVERAKANGWNMQQRMALTNNNNNVGNHQQY

SEQ ID NO: 143656 - protein, 52 aa, Glycine max
  Coding DNA Sequence Number=SeqID_26878
GGVQLGVVVCVMVGHVLMRTARDIVGIVVVLRAADILGGREGERERGGFALK

SEQ ID NO: 143657 - protein, 90 aa, Glycine max
  Coding DNA Sequence Number=SeqID_26879
MYKDNWTQPWPLGSEIYPKIHENPRVFFCSSSSILLEPLAHGSGDWVLLGAPSSIGGAPNIPIKCQKCSWFLAHLRIKLIRKSFTDKVDP

SEQ ID NO: 143658 - protein, 274 aa, Glycine max
  Coding DNA Sequence Number=SeqID_26880
GAAKRNPLRSLAHILAADVQLSQLSGPCLAKRPMASRKRKSIGRHILPKRKVEIYHIELDEFKAELERRNFHKRLTNLVDNSIDLALVKEFYASLYSPEGPSPKQVRVRGHVVKIDADNLNTFLETPVVLAEGHPRKILRKDLTTLSQVLSVLSYSNLAPTSHTSDLTMDMNVGALISGQITSMAQCNSSRLGFPALITSLCKSNGVASDSLVFECLSPVSNLAYIRKNCWNPDDLTVTIRRARRARTRPTEAPSTSTAPPPARTLAAPSASTP

SEQ ID NO: 143659 - protein, 113 aa, Glycine max
  Coding DNA Sequence Number=SeqID_26881
MEHETFLATWLAEIDFSPNGLDGGSSQYCIIIMILQRILLGERAVYAMMLVFPPEFSPLKTILFGNPSQDTVEPLMEALEEDYKDGNEINESRQFIGGVLDLEKRINRLGTLT

SEQ ID NO: 143660 - protein, 124 aa, Glycine max
  Coding DNA Sequence Number=SeqID_26882
NTETFSSLTSYPELRRSEFLIGGYVGARASLLSTTPPFVAMTQELVARGDTLRLSAPCHSVTPSVIDEQRPMWSSAPFPEMSAFSDGDFSSLTSYPELRRSEFLIGGYVGARASLLSTTPLLLP

SEQ ID NO: 143661 - protein, 178 aa, Glycine max
  Coding DNA Sequence Number=SeqID_26883
MHKALRLKAPLPYPHLVTLFLQHFNIPLDSEPYVPIKRSFLISAAMIASFGYHKGHDGSWVKKGAQPIDKEGNLPVGEDSSLLQRILDRFDGLQTFVGERFDALELQVDMRFDEMESRITKVEGDVSYIRTCFDLPPPLPPSSYISIIFNIIRINEALGLNLALGLNLELGLDLKRAD

SEQ ID NO: 143662 - protein, 88 aa, Glycine max
  Coding DNA Sequence Number=SeqID_26884
MTGPLDESISCFLIKVDPWVLVPNTFRGLYVLAIRGLHILACRGLHALAFRGLRVLIFSVLHIHTLREYKVLCPYMLNRDLRSRLRGQ

SEQ ID NO: 143663 - protein, 434 aa, Glycine max
  Coding DNA Sequence Number=SeqID_26885
  Gene Ontology: Mol. function=transporter activity; Cellular component= membrane; Biological process=transport
  Homolog annotation: Hit_ID=Q7CIR1; Match level="QueryCoverage=61%, HitCoverage=83%, E-value=1e-97, Identity=67%"; Hit description =Peptide ABC transport inner membrane permease protein
  Pfam annotation: Domain name=BPD_transp_1; Domain location=53-294; Score=189.5; E_value=7.9e-54; Accession=PF00528.12; Description =Binding-protein-dependent transport s
MSTARSKHDHLSVASPAVADHHPALTLAGLLQFDFGVSSTNGQAIDIQLREVFPATLELCVLAFMLALLVGIPLGICAGVMRNKWQDKAISALALLGFSMPVFWLALLFTLLFSLTLGWLPVSGRFDLLYPVQNITGFALIDAWLSPSPWRHEMLVSALTHLILPVIVLAVAPTTEVIRLLRTSTSDVMDKNYVKAAATRGLSRFTVIRRHVLHNALPPVIPRLGLQFSTMLTLAMITEVVFNWPGLGRWLINAIRQQDYAAISAGVMVVGGLVILVSVLSDIIGAALNPLKHKECAMIGLYGFGILLFLCLFGGLLSPYGIDQQFLGYQLLPPSWSRYGDPFTERRGTDGWLCAAGNGAGSNLRAAAGRAGGDYPRFALGGDESRAGYAAVDSLFVAGDYRGGLSWPATGACDAGGTAGADPASGARNLHGGA

SEQ ID NO: 143664 - protein, 148 aa, Glycine max
  Coding DNA Sequence Number=SeqID_26886
  Subcellular localization annotation: CTP_CleavageSite=63; ConfidenceScore=5.61e-01
MSGRSSTRQFPSWKSGGHGRTKSNVLGTSSSLRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 143665 - protein, 182 aa, Glycine max
  Coding DNA Sequence Number=SeqID_26887
MRKKAQANQKHNIAPHVLSREGYEYSENKLMDEKRKKKLEEAAQSGSTDTVIDPLSPIRQHMKWKMARTKKTGQMTSQAAKEIAEKIESLEEQSSYGFFVAIGRPEHRSRVGVVGVGVTIKKYFGLAPRTSRMSSSMAPEDLEQLMQQIRDQLEESITEKVTQRLMLSFQATVHPEIRAIEI

SEQ ID NO: 143666 - protein, 91 aa, Glycine max
  Coding DNA Sequence Number=SeqID_26888
MYNSIITYIGLHCSAHWQMVVILPKENVVIWFCSLHTRPDNYLKGIINSALKDLTILHKVNPRLVLGGLLLKQKGSTKCGYYVMHWMSTII

SEQ ID NO: 143667 - protein, 63 aa, Glycine max
  Coding DNA Sequence Number=SeqID_26889
MDKSLKVREDKWREREKGGTNFMPQIGSYLTHGPKIYPMAHENLRAFSCISDPIFLESSIQCP

SEQ ID NO: 143668 - protein, 351 aa, Glycine max
  Coding DNA Sequence Number=SeqID_26890
  Gene Ontology: Mol. function=oxidoreductase activity; Cellular component=periplasmic space; Biological process=electron transport
  Homolog annotation: Hit_ID=Q7W8I6; Match level="QueryCoverage=99%, HitCoverage=45%, E-value=1e-122, Identity=61%"; Hit description =Putative biotin sulfoxide reductase
  Pfam annotation: Domain name=Molybdopterin; Domain location=18-218; Score=-120.4; E_value=0.0096; Accession=PF00384.12; Description =Molybdopterin oxidoreductase
WAAEICGVSAATITDFARQLHGKRVLVTVAHALQRAEHGEQPVWLGLVLAAALGQPGLPGGGYTYALGALGHYGKHHNLVSFPALPQGRNGIDRLIPVARIADMLLHPGTQFDYNGRRLTYPHIRLAYWAGGNPFHHHQDLARLRQAFCQLDTLIVHETAWTASARHADIVLPATMTLEREDIGGAPTDRHLFAMQLVAQPYAQAQDDYTIFAELARRLGREEAFTEGRDARGWLRHHYAQLQEKLAAHQVTIPDFDQFWLQGVIELPQLKDGGRMINAFRADPAAAPLPTPSGKIEIFSATIASFGYENCPGHPVWRAPQQQPDAEHPLWLIANQPATRLHSQLDFGDYS

SEQ ID NO: 143669 - protein, 220 aa, Glycine max
  Coding DNA Sequence Number=SeqID_26891
  Gene Ontology: Mol. function=transporter activity; Cellular component= integral to membrane; Biological process=transport
  Homolog annotation: Hit_ID=P77549; Match level="QueryCoverage=92%, HitCoverage=52%, E-value=1e-45, Identity=45%"; Hit description =UPF0226 protein yfcJ
MAWIGIAIYGAWALGAPLGVAIYHGWHFTGIAMAIIVVPLLPLMFITQVRAVAPTSTKRTPFYKVMGAVWRPGLGLALASVGFGMITAFIALLFAARAWGNASLAFTAFGVAFIAARLFFAHLPDKLGGARVALVCVLIEACGQLLIWRADDATLVYLGAALTGFGYSLAFPAFGVEAVRRAPPHTRSLAMGAYVAFLDIALAVTSPLAGALAAHRGVAS

SEQ ID NO: 143670 - protein, 79 aa, Glycine max
  Coding DNA Sequence Number=SeqID_26892
MQQKLSNCAANFANYAEKWLCSASHGKDFCIRNPRLNFKAIQWLTNRNEENVTEGSFMTNGIELFGYCESLEGLMGTRC

SEQ ID NO: 143671 - protein, 276 aa, Glycine max
  Coding DNA Sequence Number=SeqID_26893
  Gene Ontology: Mol. function=metalloendopeptidase activity; Cellular component=integral to membrane; Biological process=proteolysis
MHFLIACWWLHGRQVLNVPPTSPLFGYLAPGDVILSVDNVTIRNAQEWLKLNTLTYNIKLNNVNVSQRSGNLGVINRMKGYCVPSFMMDESKITELLENQHACPSELTAFVKSLCSANVTLDDGQSETDLLNRGWNMYCLNAKDVVKRYRCGDDWGLAITKGGGCTCSQDEFCLAPVQEPGSVWVEIAYSRTSHECLSHVQNRFPFSETSGVKETNCGGTFIFVGDVISMAHSIQLTSYQPRWGPQIVAYFPNLLERILIWTFHVSLALALLNGLP

SEQ ID NO: 143672 - protein, 361 aa, Glycine max
  Coding DNA Sequence Number=SeqID_26894
  Gene Ontology: Mol. function=transporter activity; Cellular component= integral to membrane; Biological process=transport
  Homolog annotation: Hit_ID=Q2NV88; Match level="QueryCoverage=95%, HitCoverage=90%, E-value=1e-117, Identity=61%"; Hit description =Putative transport protein
  Pfam annotation: Domain name=MFS_1; Domain location=1-349; Score =23.2; E_value=2.7e-05; Accession=PF07690.6; Description=Major Facilitator Superfamily
MALNGASEALIGIAIGIYGLAQAVFQIPFGLVSDRIGRKPLIVGGLLIFALGSVIAAATDSIWGVILGRALQGSGAIAAAVMALLSDLTREQNRTKAMAFIGVSFGITFAIAMVLGPIITHALGLHALFWMIAVLALAGIVITLAVLPQGAEQLAPAEAQLRHHVPAYPADVELRGAAASDGKSRTGSQRALDRLPGHHAGVIRRRGAFHHLCRKISPHEAGLYGLRGGAVLRRSAAVALRRAPVGHHRRRAAVLHGLQRGGLGVYRRRRVGRALVPGQQHHERAAVCQQPAHYAVGTGGEGFGAGKPSEGAARRGRSDRGAGRAQRLRQGGYQADQSRSAGSAGQFAIKHQGRQCRPRRD

SEQ ID NO: 143673 - protein, 39 aa, Glycine max
  Coding DNA Sequence Number=SeqID_26895
MVPTKEDDKEGGIGAEDAPVAPGRGVLVAAAEVDEPLRF

SEQ ID NO: 143674 - protein, 191 aa, Glycine max
  Coding DNA Sequence Number=SeqID_26896
  Gene Ontology: Mol. function=RNA-directed DNA polymerase activity; Biological process=RNA-dependent DNA replication
MGAYVKDEKLLMHFFQESLIGVAVTWYTNLESSRVCSWKDLMVAFIRKDLVAQVAPPMMEKEMITMIVDTLPLFYYENMVGYMPSSFIDLVFAGERIEVGLRRGKFDYPALLNRKPGANGENKNEGETHVVDVIPTWPNFPPAQQYQYSANIRPSHYPPPHQPRTPNHLQRPPPNWLQNPPDAHPRPKHHP

SEQ ID NO: 143675 - protein, 47 aa, Glycine max
  Coding DNA Sequence Number=SeqID_26897
MLLPSGPEEESVSLSWFLTKQVSYSSDKSSRLEIMANNSTNGSDELL

SEQ ID NO: 143676 - protein, 176 aa, Glycine max
  Coding DNA Sequence Number=SeqID_26898
  Subcellular localization annotation: CTP_CleavageSite=38; ConfidenceScore=5.09e-01
HGIKTNASAQEKVLPSQDQGSRGHQFTRMKGVNGAAPAASLAQSLRALASQNEWPPFIDILALLIFGVVLFLNMDGLVDLAAIDAFLAFHHNKESPVVVVLADIYDTFDRRVSVTPTQGCFKESTRHERWCRERTENLGEVATGPSTAIIAAKEEEAKAPEESEEVQALKAELEKA

SEQ ID NO: 143677 - protein, 323 aa, Glycine max
  Coding DNA Sequence Number=SeqID_26899
  Gene Ontology: Mol. function=methyltransferase activity; Biological process=cell division
  Homolog annotation: Hit_ID=Q3BXF9; Match level="QueryCoverage=80%, HitCoverage=77%, E-value=5e-95, Identity=71%"; Hit description=S -adenosyl-methyltransferase mraW
  Pfam annotation: Domain name=Methyltransf_5; Domain location=23-319; Score=359.5; E_value=5.2e-105; Accession=PF01795.10; Description =MraW methylase family
MWSEQAHRAVIQQTLSDEDLCDGLLDRCCEPGCPDAPRSAGRSPSGVAVSGGAPTGPLGPEGRLLVMDKDPEAIAVAERDFAPDPRVSIFRGSFAQLLQWDATAEGLDGVLFDLGVSSPQLDVAERGFSFGKDGPLDMRMDPDSGESAAQWINRVEDREIADVLWTYGEERQSRRIARAIVARREKQPFTRTAELAELIASVMPRGKDKIHPATRSFQAIRIHINRELADLEAGLDAAVERLKPGGRLAVISFHSLEDRIVKQYMNRLAKAPPANRRLPEAVAFVPTLDLIGGAIKATDEELAANPRARSAVLRVAQKREADA

SEQ ID NO: 143678 - protein, 275 aa, Glycine max
  Coding DNA Sequence Number=SeqID_26900
  Gene Ontology: Mol. function=transporter activity; Cellular component= integral to membrane; Biological process=transport
  Homolog annotation: Hit_ID=Q4IU33; Match level="QueryCoverage=84%, HitCoverage=52%, E-value=1e-46, Identity=43%"; Hit description=MFS permease
  Pfam annotation: Domain name=PMP22_Claudin; Domain location=12-168; Score=-60.1; E_value=0.1; Accession=PF00822.11; Description=PMP -22EMPMP20Claudin family
MHGIADIAGWRWLFALEGIPAVVLGCLVLWRLPDKPDDAVWLTTPQKHWLRQRLEQDNLGVTLNKNHSWLQALKDRTVLLLSLVWFLQAFGSIGITLFMPLIIKSMAAEQSNFIISLLSALPFVMVCVFMYLNGRHSDRSGERAWHMGLPLILSGLALTGAIYSGSLLLAYILLVLTVGLNFALTPIFWAVTTEKLAGVAAAASIAFINTVANFVGLGLPPLLGKMKDATQSYHSGLLIVAIALIVGGILGIIIARPSGGAGASKTRAQHVETGH

SEQ ID NO: 143679 - protein, 122 aa, Glycine max
  Coding DNA Sequence Number=SeqID_26901
  Gene Ontology: Mol. function=transcription factor activity; Biological process=regulation of transcription, DNA-dependent
  Homolog annotation: Hit_ID=Q6FEW5; Match level="QueryCoverage=85%, HitCoverage=34%, E-value=2e-22, Identity=49%"; Hit description =Putative transcriptional regulator
ELSHERHIVPGAALVVHERVDALYRKQGLAPENIIACNDIRLIRSLIAQGTGISVLSLLDVMTEVQENQLCFVPLRHSVMRPLTLALCTAPSRQLSRAAQMVIQRMTEVIEAMASVRPAGGP

SEQ ID NO: 143680 - protein, 184 aa, Glycine max
  Coding DNA Sequence Number=SeqID_26902
  Gene Ontology: Mol. function=unspecific monooxygenase activity
  Homolog annotation: Hit_ID=O04892; Match level="QueryCoverage=50%, HitCoverage=17%, E-value=3e-28, Identity=79%"; Hit description =Cytochrome P450 like_TBP
  Subcellular localization annotation: CTP_CleavageSite=58; ConfidenceScore=5.43e-01
MDGAKARDLYPAVGARTKPPMSRRARRSLQNPGREPGRSGRRCRSWCLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 143681 - protein, 103 aa, Glycine max
  Coding DNA Sequence Number=SeqID_26903
  Gene Ontology: Mol. function=serine carboxypeptidase activity; Biological process=proteolysis
  Homolog annotation: Hit_ID=Q1EP77; Match level="QueryCoverage=61%, HitCoverage=13%, E-value=5e-16, Identity=70%"; Hit description =Serine carboxypeptidase (Carboxypeptidase D), putative
MKLHSLASYLSQEILAEQEVDRVHGLPAQHPVKFNNMVVISLSMKLKEEHCSIGFSRPLTNQNKNPFSYGSMENHKPEGQEVSAVGVNIDNHMNEGSGWINSA

SEQ ID NO: 143682 - protein, 66 aa, Glycine max
  Coding DNA Sequence Number=SeqID_26904
  Homolog annotation: Hit_ID=Q9LZ20; Match level="QueryCoverage=70%, HitCoverage=8%, E-value=3e-09, Identity=63%"; Hit description=Amino acid transport-like protein
MTATATKSISLKPLGRDGTVRRHLAEEIPIVVPRYAIKPLATMALESNKVFLKFTYTKFGFVDKGV

SEQ ID NO: 143683 - protein, 374 aa, Glycine max
  Coding DNA Sequence Number=SeqID_26905
  Gene Ontology: Mol. function=hydrolase activity; Cellular component =integral to membrane; Biological process=carbohydrate metabolic process
  Homolog annotation: Hit_ID=Q5PHK0; Match level="QueryCoverage=96%, HitCoverage=43%, E-value=1e-127, Identity=62%"; Hit description =Putative hydrolase
MAKSVEDTLFFRNHVALAINEVGAEPLPHAFSLERFHREMQTRLQHQPDGLSGTSTHDTKRGEDARARLYTLSEAPALWAENVTRWRQMNQPHVVALADGPAPEPPVEWMLYQALAGVWPTTLQPEDTAALDALRDRFLPFVEKALREAKLRTDWADSNEAYENAVLEYARQLLSPTNPAFLQDFSHALQPFIRAGLVNSLSQTVIKLTAPGVPDIYQGCEALDFSLVDPDNRREPDFAQLTAQLDVHAAPDFASQQDWLSGRLKQQMVARLLHLRRDHAQLFRFGDYQPLSASGEHAEKVIAFARQDSDYALLVITPRLIFNGAQWSHTRLALPESLAHRHYRNVLTGETVVINDDVTLDNVSYSAPLVLISQ

SEQ ID NO: 143684 - protein, 691 aa, Glycine max
  Coding DNA Sequence Number=SeqID_26906
  Gene Ontology: Mol. function=hydrolase activity, hydrolyzing O -glycosyl compounds; Cellular component=cell outer membrane; Biological process=carbohydrate metabolic process
  Homolog annotation: Hit_ID=Q8ZPF2; Match level="QueryCoverage=99%, HitCoverage=100%, E-value=0.0, Identity=81%"; Hit description =Putative glycosyl hydrolase
  Pfam annotation: Domain name=Alpha-amylase; Domain location=170-566; Score=25.8; E_value=1.3e-07; Accession=PF00128.14; Description=Alpha amylase, catalytic domain
  Pfam annotation: Domain name=Isoamylase_N; Domain location=16-104; Score=121.8; E_value=1.9e-33; Accession=PF02922.8; Description =Isoamylase N-terminal domain
  Pfam module annotation: Pfam domain module=Alpha-amylase::Isoamylase _N; Domain location=170-566::16-104
MSNGKPLEITAGSGHQLGANFDGDGVNFALFSAHAERVELCLYDESGQHEIARFDLPEYTHEIWHGYVPGLKPGALYGYRVHGPFDPENGHRFNPSKLLIDPYARELQGNIDWNEAHFAYDLLHEDKDLTLDTRDSAPFTPKCRVIDTNEFDWQDHNRPSIPWSSTVIYETHVKGFTLLNTAIPAEMPGPYDGMTHKSTVDYLKSLGVTSVELLPVHWFPDDQHLLDRGLKNFWGYNSLAFFAPASRYFGPRGIQGFRDMVRAFHDAGIEVILDVVYNHTAEGNELGPTLSFKGIDNFSYYRTLPDQHRYYINDTGTGNTVNTSHPRVLQLVTDSLRYWAESMHIDGFRFDLGTILGREPEGFDQRGGFFDAMTQDPVLSKLKLIGEPWDIGPGGYQVGGFPPGWAEWNDKYRDTVREYWKGDNVSTDFAARLLGSGDLYDQRGRRPWASVNFITAHDGFTLNDLVSYNDKHNDANGEDNNDGHNDNRSYNYGAEGPTDDEGINAVRERQKRNFLATLFFSHGTPMLLAGDEFGRSQMGNNNGYCQDSEISWLHWEDLPASADALRDFTRQIIALRAQQPLLRRESWRDGMEIKWFNAGGGFQQAEQWDEGSTLGVYIGRPDLQTEEGIWHDVLMLFNPFEGNVPFRIPQFGEGGWVLELTTSDSASKGLVITKEKDFELEGRSLALFRRP

SEQ ID NO: 143685 - protein, 426 aa, Glycine max
  Coding DNA Sequence Number=SeqID_26907
  Gene Ontology: Mol. function=hydrolase activity, hydrolyzing O -glycosyl compounds; Cellular component=cell outer membrane; Biological process=trehalose biosynthetic process
  Homolog annotation: Hit_ID=Q5PHK1; Match level="QueryCoverage=99%, HitCoverage=70%, E-value=0.0, Identity=75%"; Hit description =Putative hydrolase
  Pfam annotation: Domain name=Alpha-amylase; Domain location=15-357; Score=31.9; E_value=7e-08; Accession=PF00128.14; Description=Alpha amylase, catalytic domain
RDWQGRPWHETVVYELHIGTFTAEGTFRAAIEKLPALADLGITMIEVLPVSQFGGTRGWGYDGVLLYAPHSAYGSPDDFKAFVDAAHALGLSVVLDIVLNHFGPEGNYLPLLAPAFFHEERMTPWGAGIAYDVDAARRYIVEAPLYWLKEFNLDGLRFDAIDQIEDTSSKHVLIEIAERIRSEIHSRPIHLTTEDSRNVIFLHPRDADGNAPLFSGEWNDDFHNAIHVFATGETHAYYQDFADVPEKLIARILTEGFAYQGELSPQSGQRRGVPSAGQPPVAFVDFIQNHDQVGNRAQGERLISLAGVDRTKVLLATLLLSPHIPLLFMGEEYGETNPFLFFTDFHGELAKAVREGRAREFTGHAGHDDTVPDPNAEETFTRSKLDWGKVENPAGQAWLTLTRQLLALRQQHIVPLLADARRHNGQ

SEQ ID NO: 143686 - protein, 178 aa, Glycine max
  Coding DNA Sequence Number=SeqID_26908
MAEYTLSVYLEKSEFNRGPHLDGAEGAEAIAAFILRPEHEEALASGLAHFTGLPLIDLRGDSAVVTSYLHESLGVKTHCGSMENSSQDVDSGGRHAARPRCAATSSMIIRYETGGAGWCPAWQQSGYSFQPNPLVMYLPVTTGTMTNKPDLTVDDITVIDNKLLKRAVSAAALGNTME

SEQ ID NO: 143687 - protein, 78 aa, Glycine max
  Coding DNA Sequence Number=SeqID_26909
  Gene Ontology: Mol. function=transcription factor activity; Biological process=regulation of transcription, DNA-dependent
  Homolog annotation: Hit_ID=Q0BR81; Match level="QueryCoverage=94%, HitCoverage=24%, E-value=1e-12, Identity=56%"; Hit description =Transcriptional regulators, LysR family
  Pfam annotation: Domain name=HTH_1; Domain location=7-66; Score=67.6; E_value=4.1e-17; Accession=PF00126.17; Description=Bacterial regulatory helix-turn-helix protein, lysR family
MINSAEYLALRAFVVVAQQLNFRAAAEILGVSASAVSQQITALEAQLGQRLLNRTTRAVYLTDDGKSLFLQTAPIMAN

SEQ ID NO: 143688 - protein, 988 aa, Glycine max
  Coding DNA Sequence Number=SeqID_26910
  Homolog annotation: Hit_ID=Q024C6; Match level="QueryCoverage=34%, HitCoverage=86%, E-value=2e-74, Identity=39%"; Hit description =Mandelate racemase/muconate lactonizing enzyme, C-terminal domain protein precursor
  Pfam annotation: Domain name=DUF1228; Domain location=119-190; Score=- 19.5; E_value=0.016; Accession=PF06779.4; Description=Protein of unknown function (DUF1228)
  Pfam annotation: Domain name=FCD; Domain location=753-879; Score =47.3; E_value=5.3e-11; Accession=PF07729.2; Description=FCD domain
  Pfam annotation: Domain name=GntR; Domain location=684-746; Score =79.0; E_value=1.5e-20; Accession=PF00392.11; Description=Bacterial regulatory proteins, gntR f
  Pfam annotation: Domain name=MFS_1; Domain location=1-246; Score= -43.8; E_value=0.032; Accession=PF07690.6; Description=Major Facilitator Superfamily
  Pfam annotation: Domain name=MR_MLE; Domain location=416-519; Score =68.4; E_value=2.3e-17; Accession=PF01188.11; Description=Mandelate racemase  muconate lactonizing enzyme, C-terminal domain
  Pfam annotation: Domain name=MR_MLE_N; Domain location=307-414; Score= 36.2; E_value=1.1e-07; Accession=PF02746.6; Description=Mandelate racemase  muconate lactonizing enzyme, N-terminal domain
  Pfam module annotation: Pfam domain module=DUF1228::FCD::GntR::MFS _1::MR_MLE::MR_MLE_N; Domain location=119-190::753-879::684-746::1 -246::416-519::307-414
MTGIPIALIIGTPVSSLLLELHGWLGLRGWQLMFLLEAIPAIALGLIVPFALPDRPEDARFLSADEQHWLVTTLAAERQKLPSRGHGGLLKALFSPLVLLFSLTYYGLANLNGAVSTFLPLIISETGLSHVQTGFITIIPYVFGLAGMLVLGRIADRPGSRLLANYLALIFSFVGLLCVAWFDNSLVKMMFLCCSAFGFFGAMPVFWGLPAQFIPASVVAGGLALINALGSIASVVNPWVIGVIRDRSGSYNGGFYWLAAMAMLSIITLSIIFRRQRLPAYQASNEQRVMPGEGDFWEERLARPTDIYAQFRTVNNHDGGVQLEDGFAITTVFLEIVSDEGVDGLAGPVPHAVASIIHGQLRPLLLGQDPRDTERLWDQMYRAQIHGRQGDGMLAISAVDCALWDLRAKWMQQPDMARVHERALEYKALGYRGQKWFFRHGPMSGREGLKKNIELAKTLREAVGDDYDLMFDCWQSMDVTYLLELAKGIEPYRPRWLEECVMADRIGSMQRLKDKLSIPMAGGEHEYTRWGFKRFFESGALDVIQPDIYWCGGLSETLKIAAIATLYDLQVIPHGHSSIATAHFSTTQSPIHTPYQEYLVKWNDIHQYFLRDPLVPQNGLIPVPQGPGMGMALNPAHIQQQTYFAHRHSDPLNARCLKDARHAMPADKLIIDWSSKNILRPQSLSSILADHIRDLIVNCQIAPGALISENDIATQLNVSRTPVRAALQKLEMERLVQIIPQRGTFVFSFNEREMRETCEMRQILESGALKLALQHDRQALIARLNEQLARGRDALQNAPETYRETDAAFHMALIEASQNSELVGFYKTSINRIRAFLNHLTRTPDEFQGSQNDHEAIVARLTNYEDEQALELLHWHLGGIMRMFQRQNIAEKRSRLKRCNHRQTRQLRAGQQLLNAVALTRSGRKSGHHGADKIGQALRVLWVAGRDIAPDGVLRGAMKHPGRLARLLILTANPFQHQATRKQLIPGI

SEQ ID NO: 143689 - protein, 168 aa, Glycine max
  Coding DNA Sequence Number=SeqID_26911
  Gene Ontology: Mol. function=protein binding; Cellular component =integral to membrane; Biological process=xylan catabolic process
  Homolog annotation: Hit_ID=Q1SWI7; Match level="QueryCoverage=92%, HitCoverage=35%, E-value=8e-37, Identity=40%"; Hit description =Leucine-rich repeat
  Pfam annotation: Domain name=LRR_1; Domain location=117-136; Score =11.6; E_value=1.9; Accession=PF00560.23; Description=Leucine Rich Repeat
  Pfam annotation: Domain name=LRR_1; Domain location=14-37; Score =10.7; E_value=2.9; Accession=PF00560.23; Description=Leucine Rich Repeat
  Pfam annotation: Domain name=LRR_1; Domain location=141-167; Score =4.0; E_value=50; Accession=PF00560.23; Description=Leucine Rich Repeat
  Pfam annotation: Domain name=LRR_1; Domain location=39-62; Score=2.5; E_value=96; Accession=PF00560.23; Description=Leucine Rich Repeat
  Pfam annotation: Domain name=LRR_1; Domain location=87-109; Score =5.2; E_value=31; Accession=PF00560.23; Description=Leucine Rich Repeat
  Pfam module annotation: Pfam domain module=LRR_1::LRR_1::LRR_1::LRR _1::LRR_1; Domain location=117-136::14-37::141-167::39-62::87-109
FSGNPCESLGSLCKLSSLWIDGNNFQGVVKEDDLANLTSLTDFGASGNNFTLKVGPNWIPNFQLTYLEVTSWQLGPSFPLWIQSQNQLQYVGLSNTGILDSIPTWFWEAHSQDKPMQLEFLNLASNNLSGEIPDCWINWPFLVEVNLQSNHFVGTSPHPWVPWLSCSH

SEQ ID NO: 143690 - protein, 85 aa, Glycine max
  Coding DNA Sequence Number=SeqID_26912
MASNSQQFSARNDAIVLRGVHKVATDSSSSTENKKLEGKLDALVNLVTPLAMNHKSAPVARQETRASIQGLTNQMGQMATQLNQA

SEQ ID NO: 143691 - protein, 294 aa, Glycine max
  Coding DNA Sequence Number=SeqID_26913
  Gene Ontology: Mol. function=transposase activity; Biological process= transposition, DNA-mediated
MESSNVKNKSSGKRKMSSEDTRSYFAWNLEMERVLADVLRDQRNLGNKGDRNWKAVAYSTAAQILSKHFGVHLMADNVKNHFRLWRTWYGIVSDILSQSGFDWDSTKYMITVENEIAWNEYVKSHEEAKRFRFKVIPNWDDIVDLCAKDRATGLGAENALDANDIMSKETNEEEAIHSVSFDLEGSSSATRKNIRPSKSGEKEGMISSMKEVAESLKEFVEVTKKKMENKKKMEIKEVQEAVHEVVSELDNIPNFNGALRHRAIDWLTENLIKFAIIKALPLDEKKDYILSFMP

SEQ ID NO: 143692 - protein, 297 aa, Glycine max
  Coding DNA Sequence Number=SeqID_26914
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=99%, E-value=2e-35, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTTRHHIQRATRPTFRGLHVLAFRVLHVLAFRGLHALTFEGLHVLAFRGLHVLAFRGLHTLTIRGLHVLAFRGVHGLTFRGLNALALKGLHTLAFRGVDVFAFRGLHALTFKGLHVLTSRGLHTLTFRGLPALSLRGLHALAFRGLHTLTFRRPHVLTFKGQHVLTFRGLHVLPFRGLDALSFRGLHVPAFKGLHVLSFRGLRVLTFRRLHALAFTGLDALTLRVLHVLAIRGLHAPAFVGLHALPSEDYTSSPSEGYTLLPSEEYTSSPSDDYMSSPSEDYTCSPSMDYTFSASEG

SEQ ID NO: 143693 - protein, 66 aa, Glycine max
  Coding DNA Sequence Number=SeqID_26915
IPKICFYRLTVGILKTITFGLPQSEDSALSTIPTEGNCAKWPKAALSPIPTERKCGERPEGALSEP

SEQ ID NO: 143694 - protein, 212 aa, Glycine max
  Coding DNA Sequence Number=SeqID_26916
  Gene Ontology: Mol. function=sequence-specific DNA binding; Cellular component=intracellular; Biological process=regulation of transcription, DNA-dependent
  Homolog annotation: Hit_ID=Q0B3K0; Match level="QueryCoverage=99%, HitCoverage=65%, E-value=4e-75, Identity=66%"; Hit description =Transcriptional regulator, AraC family
  Pfam annotation: Domain name=AraC_N; Domain location=1-80; Score= -24.4; E_value=3.3e-07; Accession=PF06719.3; Description=AraC-type transcriptional regulator N
  Pfam annotation: Domain name=HTH_AraC; Domain location=147-191; Score= 25.3; E_value=0.00022; Accession=PF00165.13; Description=Bacterial regulatory helix-turn-helix proteins, araC family
  Pfam annotation: Domain name=HTH_AraC; Domain location=95-141; Score =43.6; E_value=6.5e-10; Accession=PF00165.13; Description=Bacterial regulatory helix-turn-helix proteins, araC family
  Pfam module annotation: Pfam domain module=AraC_N::HTH_AraC::HTH _AraC; Domain location=1-80::147-191::95-141
MHLDFQLVAELMLQIEQHGAPHPPVAPQSMMSSPMDGAVKMAVLRLLEVLANPLEAAILGPARVRELYFRVLTGAQGNAMRAALALQGQFGKIGKALQHIHAAYAEPLTLTQLAMRAGMSVPTFHSHFKAITQMPPMQYVKSVRLHQARMLMVRQQITAAAASYAVGYESPSQFNREFKRLFGLPPAEEIKRMQHHFAIPPAQPASVFVSSH

SEQ ID NO: 143695 - protein, 109 aa, Glycine max
  Coding DNA Sequence Number=SeqID_26917
MPDSGREKRTQKGIVDSGMTNFFNKPLFDMNRIPPKGYQQQESREKCFRVSEYNGWPETSLGALGQNSEGLHRREKTSMSFSLPKACEWKIGLDKLKRVKREIPRLAPT

SEQ ID NO: 143696 - protein, 93 aa, Glycine max
  Coding DNA Sequence Number=SeqID_26918
  Homolog annotation: Hit_ID=Q9XIA7; Match level="QueryCoverage=44%, HitCoverage=77%, E-value=2e-12, Identity=73%"; Hit description =Mitochondrial import receptor subunit TOM6 homolog
MGRWALYWAVYTPILTGRDCYLFGKTKRAMIKKSMLRGIMFPGMFMRKPDKAAALKQLKSHAAMFGTWVVVIRVTPYVLHFLCAEKEELKLEL

SEQ ID NO: 143697 - protein, 400 aa, Glycine max
  Coding DNA Sequence Number=SeqID_26919
  Gene Ontology: Mol. function=metal ion binding; Cellular component =integral to membrane; Biological process=ubiquitin cycle
  Homolog annotation: Hit_ID=Q67YI6; Match level="QueryCoverage=82%, HitCoverage=90%, E-value=2e-47, Identity=39%"; Hit description=RING -H2 finger protein ATL3G
  Pfam annotation: Domain name=zf-C3HC4; Domain location=176-217; Score= 36.2; E_value=1.1e-07; Accession=PF00097.15; Description=Zinc finger, C3HC4 type (RING finger)
  Subcellular localization annotation: CTP_CleavageSite=41; ConfidenceScore=5.07e-01
MGKQPTGLNFTNDADVEQSSHHNTRKTTLKLKPYSSVFVIPTMMPPSQPPHWAPSPTPILSKSFLPPTSNSPAVDFTPPLIAMVVVVAAAFLVVTYSRLIARHLRPPVHRLLRRFRRRRFLPSSVGDLESLPYDSPFDGPHVFSPYGLDETVIKTIPFSLYTAKYDARFDESRYDCAVCLLEFEDEDYVRTLPVCSHTFHVDCIDAWLRSHANCPLCRAGVLCTDSPFTPMMAARIRPSLDDDTILHRISIDPLIDLPPQPASAVAISSVSEITPCVDENTPRRNQNHANVNSEDCFRDFLLKRSYSFGFERSLASERMVMEPATASPWRDEVTVLPEEGFFPVVGVEREVRQRGELVAAEQVDSESDVSAVLGGGSRGGVLVEPAEVRGSRGAAVAGEV

SEQ ID NO: 143698 - protein, 97 aa, Glycine max
  Coding DNA Sequence Number=SeqID_26920
  Subcellular localization annotation: CTP_CleavageSite=43; ConfidenceScore=5.52e-01
MDGLPGSVGTSASFSLRLGQTMFSSASLLFMSLGVEFYSYTAFCSKTGERVINFMPRMILVDDLFLSKIPLGVDISTYGSGCLILVLSFLYGLAEEN

SEQ ID NO: 143699 - protein, 333 aa, Glycine max
  Coding DNA Sequence Number=SeqID_26921
  Gene Ontology: Mol. function=protein binding; Cellular component =integral to membrane; Biological process=positive regulation of enzyme activity
  Homolog annotation: Hit_ID=Q8L9G7; Match level="QueryCoverage=79%, HitCoverage=96%, E-value=9e-71, Identity=51%"; Hit description=Gamma- secretase subunit APH1-like
  Pfam annotation: Domain name=Aph-1; Domain location=1-268; Score =318.4; E_value=1.3e-92; Accession=PF06105.3; Description=Aph-1 protein
  Pfam annotation: Domain name=DUF368; Domain location=86-333; Score= -129.5; E_value=0.054; Accession=PF04018.4; Description=Domain of unknown function (DUF368)
  Pfam module annotation: Pfam domain module=Aph-1::DUF368; Domain location=1-268::86-333
  Subcellular localization annotation: CTP_CleavageSite=48; ConfidenceScore=5.11e-01
MTVAAGMGYALLALGPSLSIFVSVISKKPFLILTVLSSTLLWLISLIVLSGIWRGVLPLNTTAWWPFGILIFSSVAFQEALRLFSWKIYKRLQDMLDAFADRISKPHLHLTDKMLIALAGGLGHGVAHAVFFCISLLTPAFGPATYFVDRCSKVPFFLLSAIIALAFVTIHTFSMVIAFNGYSEGNKVDQYFVPIVHVVAGMVICEVGKMINPNMVGCRERKQSKQSITLVNLAPGGCAVGIPLLYLVAILTLIHCGRMVWRKLTENPIRLVHSYCLVLAIPVGIHRIPKVIMHNRFFLDVMLPSFYNGLLFGASSQLSAFVSFTCRHCSQAY

SEQ ID NO: 143700 - protein, 533 aa, Glycine max
  Coding DNA Sequence Number=SeqID_26922
  Gene Ontology: Mol. function=protein serine/threonine kinase activity; Cellular component=flagellin-based flagellum; Biological process=protein amino acid phosphorylation
  Homolog annotation: Hit_ID=Q3YAT0; Match level="QueryCoverage=98%, HitCoverage=99%, E-value=0.0, Identity=66%"; Hit description=Calcium- dependent protein kinase 2
  Pfam annotation: Domain name=Pkinase; Domain location=57-315; Score =339.5; E_value=5.8e-99; Accession=PF00069.15; Description=Protein kinase domain
  Pfam annotation: Domain name=Pkinase_Tyr; Domain location=57-310; Score=-17.4; E_value=2.1e-11; Accession=PF07714.7; Description =Protein tyrosine kinase
  Pfam annotation: Domain name=efhand; Domain location=362-390; Score =34.1; E_value=5e-07; Accession=PF00036.22; Description=EF hand
  Pfam annotation: Domain name=efhand; Domain location=398-426; Score =27.5; E_value=4.8e-05; Accession=PF00036.22; Description=EF hand
  Pfam annotation: Domain name=efhand; Domain location=434-462; Score =33.7; E_value=6.6e-07; Accession=PF00036.22; Description=EF hand
  Pfam annotation: Domain name=efhand; Domain location=471-499; Score =37.0; E_value=6.7e-08; Accession=PF00036.22; Description=EF hand
  Pfam module annotation: Pfam domain module=Pkinase::Pkinase _Tyr::efhand::efhand::efhand::efhand; Domain location=57-315::57 -310::362-390::398-426::434-462::471-499
  Subcellular localization annotation: CTP_CleavageSite=33; ConfidenceScore=5.44e-01
MGSCISTQGVRTRKRSRSKNYKPSTPRGHEPARRSSVTARPLNVVSGPSPGNIFDKYQFGKELGRGEFGVTHRIVDVESGEAFACKTIAKTKLRTEIDVQDVRREVQIMRHLPQHPNIVAFKEAYEDKDAVYLVMELCEGGELFDRIVAKGHYTERAAADVAKTILEVCKVCHEHGVIHRDLKPENFLFADSSETAPLKSIDFGLSTFYVSGERFSEIVGSPYYMAPEVLRRNYGPEIDVWSAGVILYILLCGVPPFWAESEEGIAQAIIRGKVDFTRDPWPKVSDEAKHLVKRMLDPNPFTRITVQEVLDNSWIQNREHGRTISLGDQVRMRIKQFSLMNRFKRKVLRVVADNLSDEQVDVFKQMFDMMDKDKNGNLSFEELRDGLSMIGHAIPDPDVQMLMDAADIDGNGTLNYDEFITMSVHLRKIESDEHLSEAFRYFDKNQSGYVEFEELKDALSDDDLEASDDQVVKDILNDVDLDKDGRISFEEFKAMMKTGGDWKLASRQYSRALLNALSFKMFKDTSSNSVKCN

SEQ ID NO: 143701 - protein, 342 aa, Glycine max
  Coding DNA Sequence Number=SeqID_26923
MCRVHSQSPHPWLSEFVHSRHTQVFWVFDEHAKRPTSGLARAQVLGSIDECAKCPTGGLAHVRIAGKGLSMQSRTKPQWLPRDGESDLARHMERIPPGTPLKSSQRQCRNLPYDGSASEKPKSCLCMWKGVALAPMYPQAFSPLDQPPFTPIYRKNKHLGPWQLAQANWSSPRRAIYLTWKSFGGPSEPEASLGELESRKFPKMTLLPLPGGAAFYLLPVPPHLSRLSSHCGQAVHPRRMIFAECRGSSVEDFVEGPHHFGLVLDVLSYFNIAPTSHTSDINVDRACLICGLMMKMDMDLGNIISQQITQIASPAHATQDAPPVIPPLAAPFPIGSSSSSST

SEQ ID NO: 143702 - protein, 266 aa, Glycine max
  Coding DNA Sequence Number=SeqID_26924
  Homolog annotation: Hit_ID=Q8H6Q8; Match level="QueryCoverage=50%, HitCoverage=4%, E-value=1e-20, Identity=38%"; Hit description=CTV.20
MVLESDDYSEIDLFKQIQKAKQTKTVNTNPKSQKTNIPQQDKKDYIDAWTNVFWHQNNKYKHSWLIYFKNNTVYNFPNWFTQWWTYFGPIPQIFPEEVQQGFQQFCKFFNSQESRIPTDLMYFSNFALSWIFSWQYRHGKTENNKQYPPLQRHAFVKWWTQFDTSKAAPDQVKNWFQSHPELLKPANPETSLFFNQKSQLAAFLASSKSKDSLAKNLKEVLQMLQQEEEDESSKKEVESSEDFDDQDDDPFYQNEDDYFGISLEED

SEQ ID NO: 143703 - protein, 110 aa, Glycine max
  Coding DNA Sequence Number=SeqID_26925
  Homolog annotation: Hit_ID=Q2HSY3; Match level="QueryCoverage=94%, HitCoverage=48%, E-value=3e-10, Identity=32%"; Hit description =Nucleic acid-binding, OB-fold
MSRKENMISELHTRKGTWKIAVRITDLWQARKQNSKQTIEMVLMDQTGSKIGATLYQELFTELRDKLQCGSSYLIQNLRIVDNQSEYRVSPTPYLVYFLKTTFVKEIHRP

SEQ ID NO: 143704 - protein, 134 aa, Glycine max
  Coding DNA Sequence Number=SeqID_26926
MQEHPLYAKLRFKTLSFKEELDALFKDVMAMRKFSYAPSSRTLSNPIQEIEDLHRPSFENDNVDLEEALGDSEELVLAAARIVGAIGRIACASKSRSTTLNTLVVLGTSISKVMEEMDKIEEITSDEDWHARCS

SEQ ID NO: 143705 - protein, 109 aa, Glycine max
  Coding DNA Sequence Number=SeqID_26927
MECTHARSRFVLFSSPCESDKEKTQMGSLVRVVGPHCVKRCRDLLGAPSSIAGAPSKFSKWQKCPSAFLRTFFGWHSRKKNCGRTIFRGTTRKNFFRQSQRKKVLPWVN

SEQ ID NO: 143706 - protein, 88 aa, Glycine max
  Coding DNA Sequence Number=SeqID_26928
MCMGEGVVAREVTGGEIVGCAGKGEANNEVVKGEIEQKKAKIELVTEKTEQVTKMNEYVVTKNIWQKKTMKNIRQLLKIISIPKHIYF

SEQ ID NO: 143707 - protein, 68 aa, Glycine max
  Coding DNA Sequence Number=SeqID_26929
MDEDQWMYDSIISEEVDMDDQNEQECGVNEQHVDCLDAFNISQVFVPEMMFCSGLNPLLMKMNLWRSL

SEQ ID NO: 143708 - protein, 164 aa, Glycine max
  Coding DNA Sequence Number=SeqID_26930
  Gene Ontology: Mol. function=NADH dehydrogenase (ubiquinone) activity; Cellular component=mitochondrial respiratory chain complex I; Biological process=oxygen and reactive oxygen species metabolic process
  Homolog annotation: Hit_ID=O49313; Match level="QueryCoverage=40%, HitCoverage=46%, E-value=7e-27, Identity=82%"; Hit description =Expressed protein
  Pfam annotation: Domain name=GRIM-19; Domain location=1-90; Score =11.2; E_value=7.9e-07; Accession=PF06212.2; Description=GRIM-19 protein
MTVSDFTVLYSSLMIGFGDWALKEEKYAARRSILPVLQAEEDERFVKEWHKYLEYEAEVMKDVPGWKVGESVYHSSRWVPPASAALRNFKTRMHFEFVLYVAWQSHLSLMYTTSMTAHSWHRKLYCIEALISRRIRWKLNWGKEGLIPTFLKSSWPLSNLENLS

SEQ ID NO: 143709 - protein, 49 aa, Glycine max
  Coding DNA Sequence Number=SeqID_26931
MVLLSHVKNGLAKGETTTEGGASPSAPLVQDPAMQGHLEDKDGHAAGTL

SEQ ID NO: 143710 - protein, 141 aa, Glycine max
  Coding DNA Sequence Number=SeqID_26932
  Gene Ontology: Mol. function=transferase activity; Biological process= RNA-dependent DNA replication
MPEVYTVKVEEARPATHEKPSAGPVYRCIYAKDALTVLPSHFESPWEFFRVKIGWSRGGARMAIIQFGQLTIVLVRSQVARDQYKVTGNWKHLWKLKLPSNVKHFLWRACQDCLPTRLKLQQRDVECPSSCMNCSAGLENG

SEQ ID NO: 143711 - protein, 74 aa, Glycine max
  Coding DNA Sequence Number=SeqID_26933
MARGKGSPSPLTTSTTFKGDDLVDFRARQQWPDGAMLMAPGLGTGGTMSGAGDAMSSIGGKTERIDTAVKGERS

SEQ ID NO: 143712 - protein, 626 aa, Glycine max
  Coding DNA Sequence Number=SeqID_26934
  Gene Ontology: Mol. function=nucleotidyltransferase activity
  Homolog annotation: Hit_ID=Q2RBE2; Match level="QueryCoverage=55%, HitCoverage=43%, E-value=3e-92, Identity=52%"; Hit description =Nucleotidyltransferase family protein, putative, expressed
  Pfam annotation: Domain name=NTP_transf_2; Domain location=49-136; Score=23.5; E_value=0.00034; Accession=PF01909.13; Description =Nucleotidyltransferase domain
  Pfam annotation: Domain name=PAP_assoc; Domain location=216-305; Score=3.0; E_value=0.03; Accession=PF03828.9; Description=PAP25A associated domain
  Pfam module annotation: Pfam domain module=NTP_transf_2::PAP_assoc; Domain location=49-136::216-305
MDDKQENLLPSSLPSQLLSIDEELWRMIEERAQEILWTIQPNVLSEVNRKNIIDYVQRLIGEYCGAQVFPFGSFPLKTYLPDGDIDLTALSHEDEEEDLVRAVCNILKSEDDSEYQVKDIEHIRAQVQVVKCTVKNIPVDISFNQMAGLYTLFFLEQVDQLVGKNHIFKRSVILIKSWCYYESRILGAHCGLLSTYATEILVLYIINRFHSSVRGPLAVLYVFLDYYSSFDWEHNYISIWGPKVLSSLPEIVDTPEYDQGEFLLQKEFLKNYRDMCSSKAKASETMTNAFPVKHMNILDPLRNNNNLGRSVNIGNLSRIRLAFSLGSQRLKQILTLAGENMGAALEKFFFNTLENNGKGERADVGVPVSPFGTGRFEESVLSGDYDSYYGWSQYVQQYPNYAMPVTTVPSHFPSPPHQDNILALSTQLNWSEGDFPALSAQQNWSMFYQSGTNVYIPGQTLFHPTYSLGKGGRSRGTGTYIPDLSYNCYWDIHAKANRPRRFPYAKHNALLKSSPKSQQEKEFHTETKPFELSDEDFPLIPNVYKATPPTQAQESTPLTKVHSETDKDGNSRLSELLNEDFPLPLSAQVKESAPLAKVLSKTNMDGNSRSFELSNEDFPLLQRTHK

SEQ ID NO: 143713 - protein, 78 aa, Glycine max
  Coding DNA Sequence Number=SeqID_26935
MDLDLVALAGGDTFFWQESATGRWVVTHLGHYGYIDDCHSCGNSHDFSWDQLDQMSCSCSMPKVKEDLEGKSYEYTWR

SEQ ID NO: 143714 - protein, 51 aa, Glycine max
  Coding DNA Sequence Number=SeqID_26936
MYYVKTQLKLMLRQEKKKENQVEVEMKPCGRKQKVTPMWIMEEGSLIVMDF

SEQ ID NO: 143715 - protein, 106 aa, Glycine max
  Coding DNA Sequence Number=SeqID_26937
MTTQQNEDEICSQVSKILEALPLGVVLWPQYNSRSAFGFVIFSIPPRHKKPKSDKAIKRFLNILFPNSEEKCSTVFVFPVLSTLNLMLGSMLGGSVSLHKDSSGAR

SEQ ID NO: 143716 - protein, 182 aa, Glycine max
  Coding DNA Sequence Number=SeqID_26938
  Gene Ontology: Mol. function=RNA-directed DNA polymerase activity; Cellular component=chromatin; Biological process=RNA-dependent DNA replication
MFDEKGERMVVLRKNCSHTYPGSIDFYHKWDGEVCGKGAFGQFEDKAVVGKNLKDFVQVFQVIRKGFTIDQDIVEEDYNEVPQIRPKIGVHSFLKGRKGVAKPKRHYQKFIMAVENRGGEGACTRTNDAILKHRIDLGFNFLLLEMGVNGMVGGAGWRKLCWWSEKGWELVDDGEDSGMSSW

SEQ ID NO: 143717 - protein, 548 aa, Glycine max
  Coding DNA Sequence Number=SeqID_26939
  Gene Ontology: Mol. function=nucleotidyltransferase activity
  Homolog annotation: Hit_ID=Q2RBE2; Match level="QueryCoverage=48%, HitCoverage=42%, E-value=1e-47, Identity=37%"; Hit description =Nucleotidyltransferase family protein, putative, expressed
  Pfam annotation: Domain name=NTP_transf_2; Domain location=23-100; Score=19.1; E_value=0.0012; Accession=PF01909.13; Description =Nucleotidyltransferase domain
MAEERAQEILWTIQPNVLSEVNRKDVIDYVQRLIRGYYGAEVLPFGSVPLKTYLPDGDIDLTALSHEDAEEDLAQAVCYVLQSGDDPEYQVRLVKCTVKNIAVDISFNQMAGICTLRFLEQVLYIFLDYYGSFDWDHNYVSIWGPKPLSSFPEIAETLECDHGEFLLQKEFLRNYRNMCSFPSRATKTMTHEFPVKFMNILDPLRNDNNLGRSVNIASLHRFRFALSYGARRLKQILTLPGETMGAALEKFFFSTLDRNGKGERADVDVPVSPFGIGRSIESVLCGDCESYFGGLQYVQLYRNYALPVTVHSSSPSSPSQDDILASSTHQNWSMFYQGGTDVYIPAQTLYHPTYSLEGRGKSRGTGTYIPDLNYNSYWDMRTKPSRPRRFASSKYNALPKSPPKKLQAEEVHSETDINAISDSRLFELSSEDFPLLPCNCKDIPPTQAQDSTPLAKFHSETDMDVTSQLFEFSNEDFPLLPKICSETHMEGSSRSFELSKKDFPLLQSICKTVLSESAKLTKQAKSFPSSKESKLKNTEFGSFRNHNN

SEQ ID NO: 143718 - protein, 113 aa, Glycine max
  Coding DNA Sequence Number=SeqID_26940
  Gene Ontology: Mol. function=superoxide dismutase activity; Biological process=superoxide metabolic process
  Homolog annotation: Hit_ID=O82519; Match level="QueryCoverage=48%, HitCoverage=32%, E-value=6e-18, Identity=67%"; Hit description=Fe-SOD
MSISQATTLLISGPYPDILLTNQNAFGFKYTTQVTYARCYWKEISSHPSLIAGHISHSIFWKNLAPDHEGGGEPPKGSLGWAIDIHFGYFEALMQKVRCSAIGVWMGGELSRS

SEQ ID NO: 143719 - protein, 63 aa, Glycine max
  Coding DNA Sequence Number=SeqID_26941
MIEFESIRVYALKTKGLCTLLIGGAQSQSYCNHLGYALKDLRSNNQIKIWETAPKISGGVFDA

SEQ ID NO: 143720 - protein, 101 aa, Glycine max
  Coding DNA Sequence Number=SeqID_26942
  Gene Ontology: Biological process=defense response
  Homolog annotation: Hit_ID=P82787; Match level="QueryCoverage=55%, HitCoverage=73%, E-value=2e-12, Identity=60%"; Hit description=Low -molecular-weight cysteine-rich protein LCR78 precursor
  Pfam annotation: Domain name=Gamma-thionin; Domain location=9-44; Score=25.0; E_value=0.00023; Accession=PF00304.11; Description=Gamma- thionins family
MEARVVEAKICEKYSKTWSGWCGNSNHCDNQCKKWEGAKFGSCHWDLGGRLVSATSTVQVYVLSAARHGLVGVAAPTTVASNAGLRKVQFIELVTLTFGLK

SEQ ID NO: 143721 - protein, 268 aa, Glycine max
  Coding DNA Sequence Number=SeqID_26943
  Gene Ontology: Mol. function=hydrolase activity, acting on ester bonds; Biological process=lipid metabolic process
  Homolog annotation: Hit_ID=Q1SDJ4; Match level="QueryCoverage=99%, HitCoverage=100%, E-value=1e-125, Identity=82%"; Hit description =Lipolytic enzyme, G-D-S-L
  Pfam annotation: Domain name=Lipase_GDSL; Domain location=9-215; Score=105.4; E_value=1.7e-28; Accession=PF00657.12; Description=GDSL- like LipaseAcylhydrolase
MAAPARPLFVLFGSSIVQLSFSHGGWGSHLSDIYSRKADILLRGYYGWNSRRALQVLNQVFPKLIILLTLYNFLYPTSQDAAIQPSLVIVYFGGNDSMGPHSSGLGPHVPLHEYIENMRKILIHIQGLSEKIRIIVLSCPPVNEEKVRGNTSELVRTNELCQSYSEACIKLCKELDVKVVDLFNALQKRDDWMNACFTDGIHLAAEGSKIVVKEILRVLKEAEWEPCLHWKSMPTEFAEDSPYDLVAADGKTTLNPSEWTFYREIQWD

SEQ ID NO: 143722 - protein, 64 aa, Glycine max
  Coding DNA Sequence Number=SeqID_26944
AMRYVPPEASHVDVDEEGCRAIHAYEEVTQRSVFSRQSAGEGGQEASLHVFGYASPYSTIEGKC

SEQ ID NO: 143723 - protein, 405 aa, Glycine max
  Coding DNA Sequence Number=SeqID_26945
  Gene Ontology: Mol. function=solute:hydrogen antiporter activity; Cellular component=integral to membrane; Biological process =regulation of pH
  Homolog annotation: Hit_ID=Q1SCX4; Match level="QueryCoverage=96%, HitCoverage=48%, E-value=4e-88, Identity=43%"; Hit description =Probable Na/H antiporter [imported]-Arabidopsis thaliana
  Pfam annotation: Domain name=Na_H_Exchanger; Domain location=43-405; Score=108.0; E_value=2.8e-29; Accession=PF00999.11; Description =Sodiumhydrogen exchanger family
MEDQYVKRSVTTGCYNVDVSNPNDIWKSENILFFYLPNFAAQVAFMLLSTRLLYYILRPLNQPRLVSEILIGILISPELFGISALSEVLTPIKSILTTETISYVGLVYSVFLAGLDMNFDTILGARKKATSIAIAGIVIPMVLGAGIYALTLSMYKGPAEYWANFNTTNAYMFWALILSVTGFPMVSHILADLKLLYTGLGKVALTTAMVSDFYNWVMFAMLIPFAINGASAIYSVLGTIGFALLCFFVVRPYLVQIIVSKTNKNEWDNYGLFFVIMGSYASALVTDLLGTHPVVGALVYGIMIPRGKFTQMLIEKSEDFAAVYLAPLFFGSIGIRLRIVYVVNTQGLGLVLLILFLSFIPKILSTVIATQFYGMSVLDGVSIGLLMNTKGILPVLMLVNAWDKQ

SEQ ID NO: 143724 - protein, 335 aa, Glycine max
  Coding DNA Sequence Number=SeqID_26946
  Gene Ontology: Mol. function=solute:hydrogen antiporter activity; Cellular component=integral to membrane; Biological process =regulation of pH
  Homolog annotation: Hit_ID=Q1SCX4; Match level="QueryCoverage=92%, HitCoverage=39%, E-value=9e-76, Identity=47%"; Hit description =Probable Na/H antiporter [imported]-Arabidopsis thaliana
ILSVESFSILTVAVVMMTMMVPLIINAIYKPRKLYKQSKLKTIQNLKGDIELRILACVHNPRQATGMVNILDACHTTKLSPLRVFALQLIELTGNTISLLASHLNQHNQQQSGRAQALTKAQEDLESITNIFQAYTGTNENTSVETFAAASTYSTIHEDIYNVSQEKQANLILLPFHKQSNIEGILETTNTAFQDINRNVMRDAPCSVGIFVDRGLGSLFKVNLRMLMLFIGGPDDREALAVAWRMSKHQGVQLSVMRILMYGEAAEVDVLSSHLESRGLLAMVLDSERQKELDEEYVSAFRLKAVSNEDSIKYSEKEARCRDDIPRVLKEIEEI

SEQ ID NO: 143725 - protein, 338 aa, Glycine max
  Coding DNA Sequence Number=SeqID_26947
  Gene Ontology: Mol. function=protein kinase activity; Cellular component=integral to membrane; Biological process=protein amino acid phosphorylation
  Homolog annotation: Hit_ID=O04212; Match level="QueryCoverage=95%, HitCoverage=56%, E-value=1e-124, Identity=69%"; Hit description =Putative ABC1 protein At2g40090 precursor
MYNHTLIDMELDFLTEAKNSERCLENFHKLSPHIANYVYAPKVYWNLSTSKLLTMEFMEGAYVNDVKTIQKLGINLHELSTLVSQTFAEMMFKHGFVHCDPHAANLLACSNVSSNALKCGSLMRGARNDTHQAASIVLHWRKPQLILLDHGLYKELDFQTRTNYASLWKALVFADANAIKEYSTKLGAGEDLYALFAGVLTMRPWDRVVDPSMDHLVIQGNESDRLELQMYASQYFHQISELLRRLPRVILLMLKTNDCLRAVNNSLLQGSSLETFFVIGKVSSEAVIEAKMLQSKSLLTWLNVKLDKILLEVRLWGMQVALWLLQLRKSLSWSNQAL

SEQ ID NO: 143726 - protein, 209 aa, Glycine max
  Coding DNA Sequence Number=SeqID_26948
  Gene Ontology: Mol. function=kinase activity; Cellular component =mitochondrion; Biological process=protein amino acid phosphorylation
  Homolog annotation: Hit_ID=Q1SDK0; Match level="QueryCoverage=81%, HitCoverage=46%, E-value=1e-74, Identity=78%"; Hit description =Protein kinase
  Pfam annotation: Domain name=ABC1; Domain location=96-201; Score =96.1; E_value=1.1e-25; Accession=PF03109.7; Description=ABC1 family
MVVYSIMICVYYEYSLWGLLEGSSERERIKHEVHLRSAQKLQDLCFKNGGVYIKLGQHLGQLEYLVPEEYVRTMRESMLNRCPVSSYEQVCNVFKKELGDTPDKIFSEFDPVPIASASLAQVHVARTHDGQKVAVKVQHTHMTDTAAADHATVELVVNTLHRFFPSFDYRWLIDEISESLPKASCYLTLKHMPKNISMLIWWILLSGPA

SEQ ID NO: 143727 - protein, 75 aa, Glycine max
  Coding DNA Sequence Number=SeqID_26949
MQWADCPELGVIGDIVASNSFGSSSSVLVVQQYGFGGMVFDNSNAATQQQPREVVPADDDDDSGALAIKVEQHHQ

SEQ ID NO: 143728 - protein, 85 aa, Glycine max
  Coding DNA Sequence Number=SeqID_26950
  Homolog annotation: Hit_ID=Q1SDK0; Match level="QueryCoverage=65%, HitCoverage=15%, E-value=1e-07, Identity=57%"; Hit description =Protein kinase
  Subcellular localization annotation: CTP_CleavageSite=16; ConfidenceScore=5.28e-01
MLAAVAASRKRRWGTVAQSLSAVSGSSEVAMSAAVAPPPTAEATRESLAPARHNQAMWRLWQRPRGSREGIGDGVKKVRCGEEED

SEQ ID NO: 143729 - protein, 591 aa, Glycine max
  Coding DNA Sequence Number=SeqID_26951
  Gene Ontology: Mol. function=long-chain-fatty-acid-CoA ligase activity; Cellular component=integral to membrane; Biological process=metabolic process
  Homolog annotation: Hit_ID=Q96537; Match level="QueryCoverage=99%, HitCoverage=88%, E-value=0.0, Identity=66%"; Hit description=Acyl CoA synthetase
  Pfam annotation: Domain name=AMP-binding; Domain location=8-481; Score=238.9; E_value=1.1e-68; Accession=PF00501.18; Description=AMP -binding enzyme
VGPYEWITYQEAYDAAIRMGSAMRSRDVNPVTHLALFKILCIGKYGDRCGIYGSNCPEWIIAMEACNSYAVTYVPLYDTLGPNAVEFIINHAEVSIAFVQDNKFPSVLSCLDRCSSLKTVVSFGNVSTTQKKEAEELGASCFSWEEFLQLGNMDLDLPLKNKTNICTIMYTSGTTGEPKGVIIKNEAFMTQVLSIDQILNLTDRVGTEDDVYFSFLPLAHVYDQIMETYCIYKGSSIGFWQGDVRFLMEDIQALKPTLFCAVPRVYDRVYAGKARMLLVLALLSCKLGYLEKGLPQDKAAPLFDKLVFDKIKQALGGRVRLLLSGAAPLPRHVEEFLRVTFGATMSQGYGLTESCGGCFTAISNVFSMMGTIGVPMTTIESRLESVPEMGYDALSSEARGEICLRGNTLFSGYHKHQDLTEEVMVDGWFHTGDIGEWQPNGAMKIIDRKKNIFKLSQGEYVAVENIENKYLQCPLITSIWVYGNSFESFLVAVVVPERKALEDWAVKHNSTDDFKSLCENPKARKYILDELNNTGQKHQLRGFELLKAVHLEPIPFDMERDLITPTFKLKRPQLLKQYKECIDQLYKEAKA

SEQ ID NO: 143730 - protein, 59 aa, Glycine max
  Coding DNA Sequence Number=SeqID_26952
MPLFQIFKSQKNELKSISTVLIQFCERDSGGYCRELGIFIIQMEMVPGETNSLNNWTRD

SEQ ID NO: 143731 - protein, 168 aa, Glycine max
  Coding DNA Sequence Number=SeqID_26953
  Homolog annotation: Hit_ID=Q10EK6; Match level="QueryCoverage=94%, HitCoverage=43%, E-value=2e-41, Identity=51%"; Hit description =Expressed protein
MADFLAGSGKKHIIVLSSLDFGKWQKVDMSRKLHCETSHSDIGDHISGLQIHYLSSANSNGTDENCEQLGWKKLQEYDPSQKHWKHLSDLAEGNVTLEDITSVEDELEEENYYASLPFAALFSFLKAKGLKVTCLLCYCSEGDNISDAFQLGDAVCKLLQLNHPITAK

SEQ ID NO: 143732 - protein, 42 aa, Glycine max
  Coding DNA Sequence Number=SeqID_26954
MLNVRSNTARIVHLHVHVQDRVAGCNYELANMLGSNSAFLAK

SEQ ID NO: 143733 - protein, 214 aa, Glycine max
  Coding DNA Sequence Number=SeqID_26955
  Gene Ontology: Mol. function=RNA-directed DNA polymerase activity; Biological process=RNA-dependent DNA replication
MDEAVEIMDTLGKMEHIVGPLWLVILLLNAILANHITLEREIPDDIELKIEAAQLIFLTPSKEFYTFHRNAEDSWPWSGCWSGLYSTASAYKGLPNEVALEEGENLFPLVWNLQVPNKVKCLIWRALRDRLPSKANLARRNIIVNPTELLCPFCNHHIESLNHIFISSPLASDIWSSCYSWMPPVFAIVCPSSLKSHCWLHFGLGRNSTEQDIW

SEQ ID NO: 143734 - protein, 94 aa, Glycine max
  Coding DNA Sequence Number=SeqID_26956
MRSREEEMMFLLNKKKNAYSINVILDLLNYLVSSSFFFISLFILSDGKDCYDCNQGEANKEEKCVSCVATKEKPATRRNVSAVPKDSVMLKKDS

SEQ ID NO: 143735 - protein, 169 aa, Glycine max
  Coding DNA Sequence Number=SeqID_26957
  Gene Ontology: Mol. function=nucleic acid binding; Biological process= DNA integration
  Homolog annotation: Hit_ID=Q1T1E6; Match level="QueryCoverage=60%, HitCoverage=17%, E-value=1e-15, Identity=43%"; Hit description=Zinc finger, CCHC-type; Peptidase aspartic, catalytic
MASANTTPLVELSTAITLLIKLSSKNHHIWRTQITHLLQAYDLYGYVTRDISCPPPTVGDGDIAIVNPTYNRWKCQDHYVFLTFLGSCGHIAKTCYRLHGHLAEHPRHQANLISHEDQADTSWLLDSGASHHVTNYINRLSISSDYTGLDQLHVAIGKGLSIKHFGSIL

SEQ ID NO: 143736 - protein, 314 aa, Glycine max
  Coding DNA Sequence Number=SeqID_26958
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=5e-44, Identity=31%"; Hit description= UPI00006A17C9 related cluster
RGLHALIFRGLHVLTFRGLHALTFRGLHVLSFKGLHVLAFKGLHILAIRGLHAFTFRELHVLAIRGLHALTFRGLHALTFRGLHILTFRGLHVVAFRGQHILAFTFVGLHVLTFRGLHVLAFRGLHVLTFRGLHALTFVGLPALTFRGLHILTFRGLHVLAFTFVGLHALTFRRLHVLAFRGLHVLTFRGLHALTFVGLPTLTFRGLHILTFRGLHVLAFRGQHVLAFTFIGLHALTFRRLHVLAFRGLHILTFRGLHALAFIGLHVLTFRGPNILIFIGLHVLIFRGLHVLTFKGLHVLAIRGPHVLAFRGSH

SEQ ID NO: 143737 - protein, 116 aa, Glycine max
  Coding DNA Sequence Number=SeqID_26959
MAISKLRNDTKGFVLYRNREASWKISLQLKGSSRRGVSTENNGGLWWLLVAKEGEENGVFPKLLGLQGSKRTSEQCSQKWKRRAHSRYLLKDPNGHIVDKCFVKLQTKFREAPTVN

SEQ ID NO: 143738 - protein, 321 aa, Glycine max
  Coding DNA Sequence Number=SeqID_26960
  Gene Ontology: Mol. function=peptidyl-prolyl cis-trans isomerase activity; Cellular component=membrane; Biological process=protein folding
  Homolog annotation: Hit_ID=Q8LDP4; Match level="QueryCoverage=50%, HitCoverage=81%, E-value=7e-54, Identity=65%"; Hit description =Peptidyl-prolyl cis-trans isomerase CYP19-4 precursor
  Pfam annotation: Domain name=Pro_isomerase; Domain location=70-238; Score=264.0; E_value=3.1e-76; Accession=PF00160.11; Description =Cyclophilin type peptidyl-prolyl cis-
MASRGTGTLILVCLLWLFFLCATIAFLQLNFVDKGTTNNNPSSRSSNFIATQQHSADTPLEQDLEGVTHKVYFDIQIHGKLAVGINLDMYNSLGSKNYKFEQHLISGEKGVGRSGKSLHYKGSTFHRIIPSFMVQGGDFTRGDGRGGESIYGDKFADENFKLKHTGPGYLSMANSGEDTNGSQFFITTVKTSWLDGHHVVFGKVLSGMDVLYKIEAEGTLLANVGEIGVEIRVERDNLGDVAVEFLNEGHVFYHVVVHPRLLGGPRLGIPDVLRLLAVRLPGRRAHRCCRRGGVVAVAALVLLGAAVVGGVFHGGLCGGGG

SEQ ID NO: 143739 - protein, 141 aa, Glycine max
  Coding DNA Sequence Number=SeqID_26961
  Gene Ontology: Mol. function=phosphoinositide phospholipase C activity; Biological process=intracellular signaling cascade
  Homolog annotation: Hit_ID=Q1SDI4; Match level="QueryCoverage=84%, HitCoverage=18%, E-value=7e-22, Identity=51%"; Hit description =Phosphoinositide-specific phospholipase C
  Pfam annotation: Domain name=efhand_like; Domain location=26-121; Score=15.6; E_value=0.00037; Accession=PF09279.1; Description =Phosphoinositide-specific phospholipas
METYIIKVLNFLTKKGEVYKAEPPLDLKEAFSKFAGGENQMKKDQLLRFMVEHQGENNISTMEDLDKIVEKFLQLRNSCSSTKTSSTRIVDVYRKQGLSLNDFIDFLILDDFNGPLKDKVCTFSDRLRQKNSGNKLLLCAL

SEQ ID NO: 143740 - protein, 105 aa, Glycine max
  Coding DNA Sequence Number=SeqID_26962
  Gene Ontology: Mol. function=phosphoinositide phospholipase C activity; Cellular component=cytosol; Biological process =intracellular signaling cascade
  Homolog annotation: Hit_ID=Q1SDG3; Match level="QueryCoverage=66%, HitCoverage=11%, E-value=9e-28, Identity=84%"; Hit description =Phosphoinositide-specific phospholipase C
  Pfam annotation: Domain name=PI-PLC-X; Domain location=40-105; Score=- 42.6; E_value=0.036; Accession=PF00388.9; Description=Phosphatidylinos itol-specific phospholipase C, X domain
MLLCITCKLILSGHEISNKCLKHRNLAAPRNKHKFKVHHDMNAPLSHYFMYTGHNSYLTGNQLTSESSDEPIIEALKQGVRVIELDLWPSKSSNNDGIKVVHGRY

SEQ ID NO: 143741 - protein, 191 aa, Glycine max
  Coding DNA Sequence Number=SeqID_26963
  Homolog annotation: Hit_ID=Q1SDJ3; Match level="QueryCoverage=44%, HitCoverage=46%, E-value=2e-23, Identity=70%"; Hit description=GINS complex, Psf3 component
  Pfam annotation: Domain name=Psf3; Domain location=4-135; Score=8.5; E_value=3.4e-06; Accession=PF06425.2; Description=Partner of SLD five, PSF3
MAKYYDIDDIIIEEETVSVIFQRAASGVGIDPSSSILIETGSKVELPFWLAHELQLRQAVSVNVPPCFNQKTRQELHADSAAHELILLRRRVHHGRPPLEEAPPPSPPPPRHDDNNLEHDDRGVGRGGGGGGGRRPGGVGHPEQGVPAGAVGAGPEPATDSAGEREPAVSDARQHGKKRVPHSGTQRQHLQ

SEQ ID NO: 143742 - protein, 62 aa, Glycine max
  Coding DNA Sequence Number=SeqID_26964
MAKRSGRVTCCIVPSTVRCFVLCLQWFNGLMLKAMPSMAEMVAYSQLESRTELSVRMQESEH

SEQ ID NO: 143743 - protein, 117 aa, Glycine max
  Coding DNA Sequence Number=SeqID_26965
MKNGRKPSRICLRKHLGSEKGGGGCRPARPGDLSSPRRAGWQPPHPFSYKKAEGGCSKDPSAPWLCISAVLGEKNCFREENPSRGASVTLPRCFRKQIREGFRPFFIVLHPFFVLQR

SEQ ID NO: 143744 - protein, 90 aa, Glycine max
  Coding DNA Sequence Number=SeqID_26966
MPLRDRIASPGGFVYPLKSHEGHFYLRPCANDVIDIVTFLEHYLYHNSYLTPITSLFSISYILSNLGTWPRGFDPYYRWLKRVFATKEVD

SEQ ID NO: 143745 - protein, 105 aa, Glycine max
  Coding DNA Sequence Number=SeqID_26967
MAHTKKTGQMTFEAAKEIADKIDVLTTAIGRPEHPGHVRTTGAGVTIKQYFGPAPRTSRTYSSMLLVSTQRRVMLIPQGMIQTRVTQRNAGCTLKKIPPPPAWLP

SEQ ID NO: 143746 - protein, 211 aa, Glycine max
  Coding DNA Sequence Number=SeqID_26968
  Homolog annotation: Hit_ID=Q3BQT8; Match level="QueryCoverage=87%, HitCoverage=36%, E-value=5e-67, Identity=68%"; Hit description =Tryptophan halogenase
MEGAVPQRAPAEGLERERGVSRAGQRFHRATGVDQHPSDYQRGGAPDPVVPVRRPPCVAGEAVQRCHPPGNGARARLHHPALSRNAAHRTDVEGVSRNARARIAAPPAACVARARTRLAGPRRAVPRGIVDHRAARAGHRARSCPPAGAGSERRRSAHPVEGHPAAGAAGRRADADAGGVHRAVLQHAFSAAAGYSAATPVAMTRAVARRG

SEQ ID NO: 143747 - protein, 98 aa, Glycine max
  Coding DNA Sequence Number=SeqID_26969
  Gene Ontology: Mol. function=ATP binding; Cellular component =cyanelle; Biological process=protein folding
  Homolog annotation: Hit_ID=P0A344; Match level="QueryCoverage=98%, HitCoverage=100%, E-value=3e-46, Identity=93%"; Hit description=10 kDa chaperonin
  Pfam annotation: Domain name=Cpn10; Domain location=5-97; Score =189.5; E_value=8e-54; Accession=PF00166.12; Description=Chaperonin 10 Kd subunit
MADIKFRPLHDRVVVRRVESEAKTAGGIIIPDTAKEKPQEGEIVAVGAGARDEAGKLIALEVKAGDKVLFGKWSGTEVKIGGEDLLIMKESDILGIVG

SEQ ID NO: 143748 - protein, 88 aa, Glycine max
  Coding DNA Sequence Number=SeqID_26970
MEPNQFETYVLAVPRTRSNLSSSNNQEVIVIPDVESQNRVQEDGSNKRRRTEEEGEAAAASHSKDINEPLVCPICMDIWTSRRRTSHL

SEQ ID NO: 143749 - protein, 152 aa, Glycine max
  Coding DNA Sequence Number=SeqID_26971
  Gene Ontology: Mol. function=transporter activity; Cellular component= integral to membrane; Biological process=transport
  Homolog annotation: Hit_ID=Q8UCL6; Match level="QueryCoverage=89%, HitCoverage=42%, E-value=2e-16, Identity=28%"; Hit description=ABC transporter, substrate binding protein
DSIRSPLFWRIVRAFGASQARIFDTSEELLQALSAGSIDLAYNVSLSDVSKWQYDARDFTVIIPQDYVVALPWTALIPDRSRHANIAEQAITYLLSSNGQAILQQTGLVSETSPSDVASLQPVELGPELLVYLDGLKRSRFLDTWFQLTVHE

SEQ ID NO: 143750 - protein, 70 aa, Glycine max
  Coding DNA Sequence Number=SeqID_26972
MSVRGLLIMSPNRLPQDFSICCFLDQDNVGFRLYELTSQYGGLEAPNTLDFRPDGKRVTVFLLSIRKTKE

SEQ ID NO: 143751 - protein, 229 aa, Glycine max
  Coding DNA Sequence Number=SeqID_26973
  Gene Ontology: Mol. function=nucleoside-triphosphatase activity; Cellular component=chloroplast
  Homolog annotation: Hit_ID=Q2PMM5; Match level="QueryCoverage=74%, HitCoverage=7%, E-value=2e-99, Identity=100%"; Hit description =Protein ycf2
MIQNGSYSIVDQRFLYEKYESEFEEGGGVLDPQQIEEDFFNHIVWAPRIWSPWGFLFYCIERPNELGFPYWARSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKHCLGTSGAKVIEWHILLGEGAGRTISKQITHSFDREDHQDFVIRCRTYSNSIRDLNIMP

SEQ ID NO: 143752 - protein, 125 aa, Glycine max
  Coding DNA Sequence Number=SeqID_26974
MSPFSLSKRIQWTNRLRILLILPFETLQCVTTKDIPSNVLRKISQAVSPLKLCEGETKDISGGRRETQKEFRRLVLGKFFLAKGEENEKDIAHSCFQGLETRKLLAKEEEEEVQEDVQRVSKVVK

SEQ ID NO: 143753 - protein, 42 aa, Glycine max
  Coding DNA Sequence Number=SeqID_26975
MVEPSMKRKGSSSRSQRHSEVQDTPIPSSISSSSEHRKNNVY

SEQ ID NO: 143754 - protein, 84 aa, Glycine max
  Coding DNA Sequence Number=SeqID_26976
MDMCLAKLQTKFREDPTVNEGCAAFLPSQLHEFKIPVTGPVTEYPHPECPPHLTGVEGSFRRSSNGVDDSTGISCTGVGGSAGC

SEQ ID NO: 143755 - protein, 101 aa, Glycine max
  Coding DNA Sequence Number=SeqID_26977
VYTGESVIATTSPDDESERSAIPPTGEAGGSAFSSTGESGGAAASSDDASEMIIRGGDGGTTSSSGEGGRFTTRVHGSAGIGSTRAGVGSEGAASLVLTNG

SEQ ID NO: 143756 - protein, 286 aa, Glycine max
  Coding DNA Sequence Number=SeqID_26978
  Homolog annotation: Hit_ID=Q47522; Match level="QueryCoverage=21%, HitCoverage=83%, E-value=1e-21, Identity=75%"; Hit description=LacZ protein
  Pfam annotation: Domain name=3H; Domain location=100-184; Score= -24.8; E_value=0.023; Accession=PF02829.5; Description=3H domain
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSIGRVQNIMIEHPVYGEIQTYLKLTCRRDVQQFLEQVSESDFRALSELTNGVHYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143757 - protein, 107 aa, Glycine max
  Coding DNA Sequence Number=SeqID_26979
  Subcellular localization annotation: CTP_CleavageSite=51; ConfidenceScore=5.41e-01
MALGFPALVTGLCQSYRVPVPPSKVMPSRHRDRARKTPSGPGEVQQGLGVSSSNYESPSDLRSACHPQQAGNRRTVATSKAPQLIYKTWSVAYDPWSTSRRPSPKPK

SEQ ID NO: 143758 - protein, 199 aa, Glycine max
  Coding DNA Sequence Number=SeqID_26980
GTIDVAIVKEFYANLYDPEEKSPKQVRVRGHLIKFVADALNIFLKTPEVIEEGESFPAYSRFANLRPVPQELAARLCIPRRGLELNAAKLRLKILRKNLTTLAQTWSVLSFSNLAPTSHTSDITLDRAKLIYLLVMKMDMNLGSFISGQISLIAQHDSLRLGFPVLIIALCKARGVTSDSLTFESLSPTINLAYIKKNC

SEQ ID NO: 143759 - protein, 78 aa, Glycine max
  Coding DNA Sequence Number=SeqID_26981
MVKEFYANLYSPKDQSPKQVRVRGHLIRIDADSLNTFLETTIVLEEGETLPTYYRFTRMRIDPQEFAARLYIPGRGLF

SEQ ID NO: 143760 - protein, 102 aa, Glycine max
  Coding DNA Sequence Number=SeqID_26982
MTTIILSIFVLSSSKYFWHHQNLHDSQNDDKCLWYFDNGASKHMFGCKEKFLELEENVKGNVSFGDSSKVKIQGKDSRSQTENRAKNSTVERQQIPGVEDYI

SEQ ID NO: 143761 - protein, 60 aa, Glycine max
  Coding DNA Sequence Number=SeqID_26983
  Subcellular localization annotation: CTP_CleavageSite=42; ConfidenceScore=5.12e-01
MDSGRFQVSVPGNNYPSKTFFGRNVSAIPHLLRMPPSSDNTSLDGVAGGDTEGLPKCFQG

SEQ ID NO: 143762 - protein, 73 aa, Glycine max
  Coding DNA Sequence Number=SeqID_26984
  Subcellular localization annotation: CTP_CleavageSite=47; ConfidenceScore=5.08e-01
MHLRDQGSLIYNKEKNKMKDCKNTSGEDVSFTSRISQSLTNSSQALRTASASSSSLCRSLHNKNSLELGPFSL

SEQ ID NO: 143763 - protein, 80 aa, Glycine max
  Coding DNA Sequence Number=SeqID_26985
MWTNRCNIIGIGDFTLPSPTYTISNDRGMIQGGPSSKRRAMVLDGLAHLEYKEEEDAKRQKRVETNHRNKGLRAMGHPRN

SEQ ID NO: 143764 - protein, 138 aa, Glycine max
  Coding DNA Sequence Number=SeqID_26986
  Gene Ontology: Mol. function=serine-type peptidase activity; Biological process=proteolysis
  Homolog annotation: Hit_ID=Q3BXC5; Match level="QueryCoverage=99%, HitCoverage=16%, E-value=1e-61, Identity=82%"; Hit description =Putative secreted protein precursor
  Pfam annotation: Domain name=Peptidase_S9; Domain location=1-129; Score=-63.1; E_value=0.0035; Accession=PF00326.11; Description =Prolyl oligopeptidase family
MTANLLAHTRLFKAGIARSGAYNRTLTPFGFQAEERNYWQAQDVYQKMAPFNYADKIKDPILFIHGVDDNNSGTFPIQSERMFAAVKGLGGTARLVMLPNESHAYRARESIMTMLAESERWLEQTIGPAEQGKAKKKR

SEQ ID NO: 143765 - protein, 66 aa, Glycine max
  Coding DNA Sequence Number=SeqID_26987
MGFPLPAVTYLAENLSGLKIFHSLSFIDPTWEPNLDIWGETNLGVKVSISGRTSILFHKACVTMMI

SEQ ID NO: 143766 - protein, 56 aa, Glycine max
  Coding DNA Sequence Number=SeqID_26988
MKKGFCKEVARGSNEDTTKGKDHEALEGPMTRDRLKQAQHIIETRLVICIAAIDDD

SEQ ID NO: 143767 - protein, 38 aa, Glycine max
  Coding DNA Sequence Number=SeqID_26989
MPPLLTVTFSACPAPGKGQRSVGRDPILHLHPSLSTCK

SEQ ID NO: 143768 - protein, 53 aa, Glycine max
  Coding DNA Sequence Number=SeqID_26990
MVHLSLTALHHTGLTAILSKAHRRPAYKSQVFKNEEAEAATEPHNIDKDEEGR

SEQ ID NO: 143769 - protein, 148 aa, Glycine max
  Coding DNA Sequence Number=SeqID_26991
  Gene Ontology: Mol. function=ribonuclease H activity; Biological process=DNA integration
  Homolog annotation: Hit_ID=Q1S8I9; Match level="QueryCoverage=83%, HitCoverage=28%, E-value=3e-47, Identity=64%"; Hit description =Probable integrase-common tobacco
MMKEMCEDFKIKHHNSRPYRPKMNRAVEAANKNIKKIVQKMTVSYKDWHEMLPFMLHVYGMEVVLSFEVEVPSLRILVESGLKKSEWAQARFDQLNLIEGNRLAAMSHGRLYQRRVKNAFDKKVRAGVGPVINQPSSSICLKTLKKRY

SEQ ID NO: 143770 - protein, 230 aa, Glycine max
  Coding DNA Sequence Number=SeqID_26992
  Gene Ontology: Mol. function=spermidine synthase activity; Biological process=spermidine biosynthetic process
  Homolog annotation: Hit_ID=Q7NQK7; Match level="QueryCoverage=99%, HitCoverage=87%, E-value=1e-36, Identity=33%"; Hit description =Spermidine synthase
MVEVTETDGVRSMHLGSPTIQSSMKVKDPFALVLAYSWGALSSLLFKPDASKLVLVGLGGGSIAKYVWKYCQQIQQTVIELNPQVIQVARSHFFVPDDDERLQIIEGDGIAYIQQHPGQCDWLMMDAFGSNGLPPDFCTQSFFDDCADALTPNGLFTINLWGSDKKFDIYMQRMEQTFDDRVLMMPTGKPGNIIVFGFKPELAMPDLATLRKRAQDAMQSHHINFIDLID

SEQ ID NO: 143771 - protein, 52 aa, Glycine max
  Coding DNA Sequence Number=SeqID_26993
MKTGEALKHALSTQSSVEVVKDERHLKSTRRFKTLRSLWKLLEAVLQSVTIG

SEQ ID NO: 143772 - protein, 96 aa, Glycine max
  Coding DNA Sequence Number=SeqID_26994
  Homolog annotation: Hit_ID=Q9SQV1; Match level="QueryCoverage=100%, HitCoverage=7%, E-value=5e-13, Identity=42%"; Hit description =Probable DEAD-box ATP-dependent RNA helicase 40
  Subcellular localization annotation: CTP_CleavageSite=26; ConfidenceScore=5.47e-01
MRIGNTPFQNVMPSGNGSGIAGNAVPSMFVPPIGGPSPLSTNPLMRPPYMGSSDATDLSPAEIYCQQHEVTATGDNIPPPFMTFDATGFPPEILRE

SEQ ID NO: 143773 - protein, 100 aa, Glycine max
  Coding DNA Sequence Number=SeqID_26995
MQSRFQVTDGTSFWKRTFVLILILMIDIRVTFNVDARESSASEAESHREQSSLPMDIPKAYGNGEELNPSPPHSHPYKVTNNLSSIHNKEINISHVTRSQ

SEQ ID NO: 143774 - protein, 87 aa, Glycine max
  Coding DNA Sequence Number=SeqID_26996
MEPATEELINKTQLVRTKVRDHAGKLGSKCRGHLVMHRQVPPPHSNQSESQGSSKPSGMPPSTSIPPHEKLQVLTDKVYNISMQYEV

SEQ ID NO: 143775 - protein, 69 aa, Glycine max
  Coding DNA Sequence Number=SeqID_26997
MTDPLDESISCFLIKVDPWVLVPNTFRGLYVLAIKGLHILAYRGLHALAFRGLRVLIFSVAPYPHLRRI

SEQ ID NO: 143776 - protein, 252 aa, Glycine max
  Coding DNA Sequence Number=SeqID_26998
NNPKLIMHMSLNPWGGTHEIPHHNLADFEPCLGYTTEGQVVGVGRAPLAISKKGKLDQIEERLRTAEGGQDYAFADMEDLCLVPDMVILPKFKVPEFDKYKGTTCPKNHLKVYCRKMGAYAKDEKLLMHFFQESLTGEAITWYTNLEPSRVHSWKDLMVASLGSITQVAPPMTEREMITMIVDTLSVFYYEKMVDYTPSSFADLVFAGKRIEVGLKRGKFDFPGLINEKPGANRENEKEGGTHVVTVVPTWP

SEQ ID NO: 143777 - protein, 171 aa, Glycine max; identical to SEQ ID NO: 129126
  Coding DNA Sequence Number=SeqID_26999
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=15%, E-value=4e-94, Identity=100%"; Hit description=DNA -directed RNA polymerase beta chain
  Pfam annotation: Domain name=RNA_pol_Rpb2_1; Domain location=14-170; Score=119.0; E_value=1.4e-32; Accession=PF04563.6; Description=RNA polymerase beta subunit

SEQ ID NO: 143778 - protein, 298 aa, Glycine max
  Coding DNA Sequence Number=SeqID_27000
  Gene Ontology: Mol. function=oxidoreductase activity; Cellular component=cytoplasm; Biological process=metabolic process
  Homolog annotation: Hit_ID=Q8XVS6; Match level="QueryCoverage=82%, HitCoverage=93%, E-value=2e-70, Identity=58%"; Hit description =Probable ipr002198 short-chain dehydrogenase/reductase oxidoreductase protein
  Pfam annotation: Domain name=3Beta_HSD; Domain location=11-248; Score= -148.9; E_value=0.055; Accession=PF01073.9; Description=3-beta hydroxysteroid dehydrogenaseisomerase family
  Pfam annotation: Domain name=Epimerase; Domain location=10-250; Score= -51.4; E_value=0.0086; Accession=PF01370.11; Description=NAD dependent epimerasedehydratase family
  Pfam annotation: Domain name=KR; Domain location=9-193; Score=-27.8; E_value=9.7e-06; Accession=PF08659.1; Description=KR domain
  Pfam annotation: Domain name=ThiF; Domain location=6-143; Score= -42.8; E_value=0.014; Accession=PF00899.11; Description=ThiF family
  Pfam annotation: Domain name=adh_short; Domain location=8-176; Score =136.0; E_value=1e-37; Accession=PF00106.15; Description=short chain dehydrogenase
  Pfam module annotation: Pfam domain module=3Beta_HSD::Epimerase::KR::T hiF::adh_short; Domain location=11-248::10-250::9-193::6-143::8-176
MSPRLANKTAIITGAGSGIGSAIATLFAREGARLALFDRDAHSSEALAAQLQQQFGQRCLACAADVTQPQQVSRAVQQAQQALGDIDILINCAGVNVFRDPLTLDEDDWQRCMDTNLKGPYNLIRSVLPAMLARQYGNIVNVASVHGHKIIPGAFPYPVAKHGLIGLTRSLGVEYAAQGIRVNSISPGLIMTPAAEAWLASCPDPQAERARQAALLPCKRIGEPDEVAYTALFLASDEARFINATDILIDAESPVTDARAGNDRPPLPPDGRRYQRGQCGLSQYRRQSACRGQPAAPD

SEQ ID NO: 143779 - protein, 343 aa, Glycine max
  Coding DNA Sequence Number=SeqID_27001
  Homolog annotation: Hit_ID=Q470B5; Match level="QueryCoverage=23%, HitCoverage=17%, E-value=3e-25, Identity=63%"; Hit description =Aldehyde dehydrogenase
GHKVTNNTDTDNWYRLGQLFFPTANQQWVMELIGKADATQPTGTAASPVNLAGTGKTWINLQRLETVWADACHMGQPAVLDIRYSRVGTTYAVVWVKLRANSGDTLINLKTTGPTRFEAGSCSLFQPDFSVVTDTTKMGTLKPAARFGLHNGVAGIGANEKGVLTVATAAAPFGEAAASPFFCAWRERALFAAFFRVKTKASPAQLVEQRIRNAKVAGSTPVSGTSDGRQDNHNLKEAHCSGAAPCAAVLFTAAFISSLPSNQRPWFQKRADTRLSHLPAYAGVAETAERRARFVCQRVDHHAAGDQLFSYVARMLFIRPDYQCRQAVIAVVGYGDGFGFIAV

SEQ ID NO: 143780 - protein, 238 aa, Glycine max
  Coding DNA Sequence Number=SeqID_27002
  Homolog annotation: Hit_ID=Q1RWU1; Match level="QueryCoverage=54%, HitCoverage=34%, E-value=1e-09, Identity=32%"; Hit description =Resistance-like protein HAAS-2-related
  Pfam annotation: Domain name=DUF1723; Domain location=37-86; Score =49.9; E_value=8.5e-12; Accession=PF08330.1; Description=Protein of unknown function (DUF1723)
LSSHGRKVDKFDRPAPEIEGLVAATRLSSLIACSLDTSDRGLVSTFVERWHKGTSSFLLPVGEVTITLDDVASLLHLPIIGTFHSFEAFHVDEVMDLLVDLLEGPVALVHMYENLNDASKRSAMQLAGYITLLQIIMRGNHVLVVGGLGRHYQCRSIVISLFFGHIRWGSSTVIYRSERVVRQFGYVKTIPPHPGALSLYIEDIDDRWIQFSEYLAPDPPRHPPVVHEETFVEPDPPQ

SEQ ID NO: 143781 - protein, 250 aa, Glycine max
  Coding DNA Sequence Number=SeqID_27003
  Gene Ontology: Mol. function=chromatin binding; Cellular component =chromatin; Biological process=chromatin assembly or disassembly
  Homolog annotation: Hit_ID=Q1SAV4; Match level="QueryCoverage=86%, HitCoverage=55%, E-value=5e-57, Identity=49%"; Hit description =Integrase, catalytic region
  Pfam annotation: Domain name=Chromo; Domain location=163-214; Score =33.8; E_value=6e-07; Accession=PF00385.14; Description='chromo' (CHRromatin Organisation MOdifier
MSRHSRIGASPYEITYGKKPLTIPQYVTGTSKVTAMDDFLTNREVVFALYRKKLLKAREVMKTSTDTKRRDMNFQCGDWVMVKLRPHMQSSVSNTTHSKLAKRFYGPYQIVEQIGKVAYKLNLPAGSRIHPVFHCSILKPFKQTSTCIPLPLPAKAVDSKPLISPLTIVSTKWDQKSSSPKLLVLVQWEGLSLDDATWEDWEELKSDFNLEDKVIFDVVGDEIQSKIPQVKMTSRPKRKISTPKYLADYK

SEQ ID NO: 143782 - protein, 151 aa, Glycine max
  Coding DNA Sequence Number=SeqID_27004
SFGVPVTPSKVIRPLITRAFIEKYCTPRQAQGDAPQATDAPPPPHQADPVGSLGMERYLQHLVRQQAANHRGQVQIHECLYQLSLSQQGQGFAPIACPTPDQFRAMVAWPEDWPEAQAGEAPAGAPDDAEEARMDKEMMDLLGFLGGSGAT

SEQ ID NO: 143783 - protein, 290 aa, Glycine max
  Coding DNA Sequence Number=SeqID_27005
  Gene Ontology: Mol. function=RNA-directed DNA polymerase activity; Biological process=RNA-dependent DNA replication
KERALGLPYRTRARARVMSEIEEVQEQMKADMEAMKEQMTTMMEAMMSMRKMLEVNTTTVAVTSTVTEVDQTHPSDLNQVNPPVSDIVGQGGKAIPSHHMACHTPPDVAHTPDENVDNSAPMPILCQQPQSGQTHVPQPMGETHEVPKDHTLANSEPCLGYATMGVPPAMVEREKLDHIEERLRVIEGGRNYAFADMAELGLVYGVVIPPKFKVSDFDKYKRTTCPKNHLKNMFKREHESFKEYAQRWRDLVAQVAPPMMEREMITKIVDTLPVFYYEKMVNYMPSSGIL

SEQ ID NO: 143784 - protein, 49 aa, Glycine max
  Coding DNA Sequence Number=SeqID_27006
MESKDFEYGLYLKKDLAKAKDVTKQVEFESSTIRIISDHKQFEATDETG

SEQ ID NO: 143785 - protein, 146 aa, Glycine max
  Coding DNA Sequence Number=SeqID_27007
  Homolog annotation: Hit_ID=Q1SKD7; Match level="QueryCoverage=95%, HitCoverage=36%, E-value=2e-11, Identity=27%"; Hit description =Ankyrin
MAPRKFSAKRSRKDAVVEGTSATPEFNSHRFRSAGHQQRFEAIKEWSFHRERRVQLRDDDYTDFQEEIARRRWTSLVTPMAKFDPDVVLEFYANAWPTEEGVRDMRSWVRGQWIPFDADALSQFLGDSLVSEEGQECEYSQRRNLG

SEQ ID NO: 143786 - protein, 228 aa, Glycine max
  Coding DNA Sequence Number=SeqID_27008
MTHPPHAVVPRLWDLHLPCEEKAESQARLPSPETSQLKEWILEVPPHAKLMMGLRHSKVRLSETTPLALHRAVIRAGNPSLEVLDWDIEVIWPKIRAPTFMSMRETRPKISLALSTVRSEVCDVGVRLEYERTLYTWAKVVKSLLRILPGWPSAFKMNPQPGMHKAASISLYSMGSLQYLEYMGKVSPSANTTGVSKNVLRLSASIFTRWPLTLAYFGEGPSELYRFA

SEQ ID NO: 143787 - protein, 56 aa, Glycine max
  Coding DNA Sequence Number=SeqID_27009
MLCTSLCCTFAHLHHVVTHALYVGLVFCHEKPEGPYHLLNCTHGALRPQMHNCYLA

SEQ ID NO: 143788 - protein, 156 aa, Glycine max
  Coding DNA Sequence Number=SeqID_27010
  Pfam annotation: Domain name=zf-CCHC; Domain location=52-69; Score =13.7; E_value=0.0055; Accession=PF00098.13; Description=Zinc knuckle
MDSLITRLLRVPHALKDENLTDAVETSAMVAPRGRGGGRNSRGGHNGRSGRPQCTYCKRMGHTQENCYSLHGFPNKVAQVSKSEKSESKFSDEEYQEYLKLKSEKSSNQASSSSVPCFSTTCVSQSIGSPSPWILDLGASDHISGTWDGSTDWRRT

SEQ ID NO: 143789 - protein, 266 aa, Glycine max
  Coding DNA Sequence Number=SeqID_27011
  Gene Ontology: Mol. function=catalytic activity
  Homolog annotation: Hit_ID=Q5ZZE4; Match level="QueryCoverage=69%, HitCoverage=38%, E-value=1e-10, Identity=25%"; Hit description =Phosphoribosylglycinamide synthetase ATP-grasp (A) domain protein
MARAASSRAAESNWPCARIIVHIVNLSVRSKREQQEGRETPPEFRRDWRQADAAWRESRRGASDRRTAMSAARPPAPFRQAASGFNLKGYLGPVDAGDLFHQVHHAHAGQAKAHFEKVRFAVHHNEINVESAAPVAEGFTAEAHQAGEGGGQLLRRHRHMAGFVKADTAVGLGMLLNHLLAAGQRHRVSILHHALQRIFVTGQPAFDDKAGKAASAIVHGVEQPGNHRIQLAGLFHQPDAQPAAAVDRFDHAGVEQRIPRVANAER

SEQ ID NO: 143790 - protein, 43 aa, Glycine max
  Coding DNA Sequence Number=SeqID_27012
MDTSFTDNEIEQEHKCNAGCRCSSEKEKENKLYSSAAVAYRCI

SEQ ID NO: 143791 - protein, 189 aa, Glycine max
  Coding DNA Sequence Number=SeqID_27013
MKERGQKFFKPDCHSKSFSTGNIPPHMNKEEKTETPSFLSKNTTLEKILLVRDRGKTRWIVRSCRPTRFRSPMNCVFVHVSSTFEFGAMRSDCLVQFSILNLFRSPMNCVFVHVSSTFEFGAMRSDCLVQFSILNLFRSPMNCVFVHVSSTFEFGAMHISAILHSQPFLEPHELRFRSCVLHLRVWSYA

SEQ ID NO: 143792 - protein, 155 aa, Glycine max
  Coding DNA Sequence Number=SeqID_27014
  Gene Ontology: Mol. function=protein serine/threonine kinase activity; Biological process=protein amino acid phosphorylation
  Homolog annotation: Hit_ID=P93321; Match level="QueryCoverage=25%, HitCoverage=12%, E-value=1e-10, Identity=82%"; Hit description =Cdc2MsD protein
MNKERNRLVFEHETTLDNVHASICGGSKSFTHGEDKEVVREREECGVFFSEINNLKNTFVLVKEKVLRLEISVKDTLAMAMSNTLSDLGDQTLGSVLARDDLVTLCQNNFNLLDCDVVSEVEGTIVVVGACEGISIEVERESESEREMEKERGEA

SEQ ID NO: 143793 - protein, 219 aa, Glycine max
  Coding DNA Sequence Number=SeqID_27015
  Gene Ontology: Mol. function=histone-lysine N-methyltransferase activity; Cellular component=nucleus; Biological process=chromatin modification
  Homolog annotation: Hit_ID=Q9ZUM9; Match level="QueryCoverage=67%, HitCoverage=49%, E-value=2e-22, Identity=36%"; Hit description =Histone-lysine N-methyltransferase ASHR2
MQLVLPVTTVIEPTCASPLHSNPHTLLGYANHSTTPQFNTSSTTLQERQVQAHLIVASHNLFLHNHTPSKLHTFLYLHGTPDDAILDAANFLHSLISPLFPPQAQLSVDLIAQLLAKDRLNSFGLMDPYSCNGPQRSIKAYAIYPKATFFNHDCVPNASRLIEDVDEGKEVLHQLFQDWCKIEVNWDGEENNSDLPHVQFLSKYVCERNQYTKSTFPEF

SEQ ID NO: 143794 - protein, 367 aa, Glycine max
  Coding DNA Sequence Number=SeqID_27016
  Homolog annotation: Hit_ID=Q1RYY9; Match level="QueryCoverage=90%, HitCoverage=98%, E-value=1e-20, Identity=26%"; Hit description =Immunoglobulin/major histocompatibility complex
MACFLPCPDLGTNLIVSKEEFFSFHNIDRQLFTRLVVVLGRDTSQSTHVMAFIMWLEKQCKDMKMIKNMLQWSDTMIDSLADEVILVLNCVESSQFPYDDVVNDETLPLIKNILQNNVANLKYFYDNRVTIIGAVTKLLNNVCVRAFIDIVHEVQYMKAMKEQNLQIANIYGTDPYAKQAVYYTPLPSVTFVSQQVAIPTPQWSEGNSSSQETNINPPLETCDVSYQTDFNQNLNELLAMLNETSITTSASDGKKEVLVDDRIIFMTFSKGYPISEAEVREFFARRYGDIIEAFHMQDVVPPQQPLYARIVIRTEAIQFIDHLLESTNKVKLSINGKHAWARKYVRKGNKSPMTSRAPSPTSTRPSY

SEQ ID NO: 143795 - protein, 156 aa, Glycine max
  Coding DNA Sequence Number=SeqID_27017
QHVVEASGNRLPGCVIDYTEEHATSNRLPIVMAAQFIHDRVEMECLEGAWETLEGNARNPLARFSVLVEWILPTPTPYRLVEPVQVIELTSSEEDPEEDPKELPPEPAVDALDFLEGDEDPLPEVDSPEDVMSASEADSTEDSGPGEMAISGGSSS

SEQ ID NO: 143796 - protein, 88 aa, Glycine max
  Coding DNA Sequence Number=SeqID_27018
  Subcellular localization annotation: CTP_CleavageSite=28; ConfidenceScore=5.03e-01
MGPKSTLRLMRTLGPSLASLAQSSWSLLSNALGDRIASGNSLRPHGDQPESQESSKLSDMPPSTSIPPYEKPQVLIDKVYIISMQYEV

SEQ ID NO: 143797 - protein, 103 aa, Glycine max
  Coding DNA Sequence Number=SeqID_27019
MVEKTKKRLKEAAKSGSIEGIIDLPSPIRRHVKWKMARTKKTGQMTFETAKEITDRIESVTRIVRPPWTSGYPDCCHWATRAPGCVRAVGAGVTIKQYFGSVS

SEQ ID NO: 143798 - protein, 69 aa, Glycine max
  Coding DNA Sequence Number=SeqID_27020
MEKFLRKDIIDMKANGLDDRAYGRALVEKDKAPEWRRMTDDVILTRSRSLDTGYRVWMRPLPVKEDKSG

SEQ ID NO: 143799 - protein, 129 aa, Glycine max
  Coding DNA Sequence Number=SeqID_27021
YGKTENSKQYPPLQRHAFVKWWSQFDTPKAAPEQVKNWFQSNSEFLKPADPETSLFLNQKSQLAAFLASSKSKESLAQNLKEVLQLLQQEEEEELPKKEAESSENNDDQEDDPFYQNEDDCFGISLDDD

SEQ ID NO: 143800 - protein, 107 aa, Glycine max
  Coding DNA Sequence Number=SeqID_27022
MRVPLIHLVQQNKFHGLDHEDPYAHLTTFVHIYNIVKIHQVDDEFIRLIKLMSSTWPDDEAKINTLLAGFKPKTKHMFDALVEIKIMHTTLEEAKEIIENMASNDYE

SEQ ID NO: 143801 - protein, 95 aa, Glycine max
  Coding DNA Sequence Number=SeqID_27023
MWGYLPGSLPQRMPLLMLVLVRVPPSGYSWKDVCGGGCGFAMAISGMWFHMDVVMQYMDIQSKKGSKKNTSGPKIWRVYERRGKIGKEKYEGAEY

SEQ ID NO: 143802 - protein, 115 aa, Glycine max
  Coding DNA Sequence Number=SeqID_27024
  Gene Ontology: Mol. function=glutamate decarboxylase activity; Cellular component=cytoplasm; Biological process=carboxylic acid metabolic process
  Homolog annotation: Hit_ID=Q1S578; Match level="QueryCoverage=83%, HitCoverage=19%, E-value=8e-47, Identity=94%"; Hit description =Pyridoxal-dependent decarboxylase
MVLSKTASETDVSVHSTFASRYVRTSLPRFKMAEESIPKEAAYQIIHDELMLDGNPRLNLASFVTTWMEPECDKLIMAAINKNYVDMDEYPVTTELQASITYTILDINQLLMSFN

SEQ ID NO: 143803 - protein, 363 aa, Glycine max
  Coding DNA Sequence Number=SeqID_27025
  Gene Ontology: Mol. function=protein serine/threonine kinase activity; Cellular component=cell surface; Biological process =protein amino acid phosphorylation
  Homolog annotation: Hit_ID=Q1T003; Match level="QueryCoverage=99%, HitCoverage=51%, E-value=1e-179, Identity=87%"; Hit description =Protein kinase; Concanavalin A-like lectin/glucanase
  Pfam annotation: Domain name=Pkinase; Domain location=33-306; Score =185.4; E_value=1.4e-52; Accession=PF00069.15; Description=Protein kinase domain
  Pfam annotation: Domain name=Pkinase_Tyr; Domain location=33-306; Score=132.4; E_value=1.3e-36; Accession=PF07714.7; Description =Protein tyrosine kinase
  Pfam module annotation: Pfam domain module=Pkinase::Pkinase_Tyr; Domain location=33-306::33-306
VKRVNKFDSLGSEIIKMPKQFSYKELKSATKCFNANRIIGHGAFGTVYKGVLPENGDIVAVKRCSHSSQGKNEFLSELSIIGSLRHRNLVRLQGWCHEKGEILLVYDLMPNGSLDKALFEARTPLPWAHRRKILLGVASALAYLHQECENQVIHRDIKTSNIMLDEGFNARLGDFGLARQTEHDKSPDATVAAGTMGYLAPEYLLTGKATEKTDVFSYGAVVLEVASGRRPIEKDANGGGKGGISCNLVESVWSLHREGRLLMAADPRLGGEFDDGEMRRVLLVGLACSHPDPLTRPTMRGVVQMLVGEAEVPLVPRTKPSTGFSTSHSHLLLSLQDSVSDCDGIITISTSTSENSFNLGDIV

SEQ ID NO: 143804 - protein, 548 aa, Glycine max
  Coding DNA Sequence Number=SeqID_27026
  Homolog annotation: Hit_ID=Q9FFX7; Match level="QueryCoverage=36%, HitCoverage=23%, E-value=6e-66, Identity=55%"; Hit description=Alpha- mannosidase
  Pfam annotation: Domain name=Alpha-mann_mid; Domain location=477-543; Score=-3.0; E_value=0.00023; Accession=PF09261.1; Description=Alpha mannosidase, middle domain
  Pfam annotation: Domain name=Glyco_hydro_38; Domain location=250-491; Score=-55.0; E_value=2.7e-06; Accession=PF01074.12; Description =Glycosyl hydrolases family 38
  Pfam module annotation: Pfam domain module=Alpha-mann_mid::Glyco _hydro_38; Domain location=477-543::250-491
MAAFHGCHVSPQHPPNHLFPWHPFHTTIHHQSFLQDPFLLFHYTHSPYVHPAQSLGIDFESTHKPLLGLFGIEGTLPPSSPTLPLKMESNFHSALPLESINNFHCDNSLPPLVLKVRNRADETVPCEATEELVLLGTPELSSKVSPLSIKQVVAQAVLLSSQPVSTSKFSSKLPSLVTKHVVVQVVLLEVFRHRHIRLGKLSSPLRCAFRPSLRRRCWTSNCWDSQSHPGTNTKDTLKRWVPCASVIEEKEVNCKICYSIGMFCSLFCHTFSTRTSQHCENHKFLSRKSFLGSWEASRELKEAKAQLAWLQREYTEQVMGAQEESIREIEAMKMQAYLLGAKVGYDSLFFAQIDYQDKAKRKDVKTFEVMWRGSKSFGSSSQIFFGAFPEKEPPSNFYYEVNDDFPIVQDDVSLFDYNVPKRVKEFVATAISHTNIICTNHIMWTMRIDFKYQYAQTWFQQLDKFIHYVNQDDCVNAYRTRYLTSRPTIKGYVRFMTGYYLAARQLKYFKGKSPLFPKTGSLAEALPSAQHHDAVLFVINSTLTFEVS

SEQ ID NO: 143805 - protein, 149 aa, Glycine max
  Coding DNA Sequence Number=SeqID_27027
MDTKPWEGLDIDNPNLPLFVKGSISNAPSIISILAGVIPEIMNNCVVEESLSTQEFINRVKHEYEWDFLVKPWIRVVQFFKSTDLTDKIMRIMHHKVIEYVDHGKDISVGSVLALRKVYIIPKIIVPLRRIFCQILPFLHDTQVFSAKD

SEQ ID NO: 143806 - protein, 67 aa, Glycine max
  Coding DNA Sequence Number=SeqID_27028
  Gene Ontology: Biological process=response to stress
  Homolog annotation: Hit_ID=Q1T005; Match level="QueryCoverage=97%, HitCoverage=42%, E-value=1e-23, Identity=78%"; Hit description =Universal stress protein
MAKAVAKVYWGDPREKLCNAVEDLHLDFLVVGSRGLGPIKSVSNNVMTNASCPVTVVKGKQSSNSHH

SEQ ID NO: 143807 - protein, 618 aa, Glycine max
  Coding DNA Sequence Number=SeqID_27029
  Gene Ontology: Mol. function=phosphopantetheinyltransferase activity; Cellular component=integral to membrane; Biological process =macromolecule biosynthetic process
  Homolog annotation: Hit_ID=Q9FHT4; Match level="QueryCoverage=97%, HitCoverage=96%, E-value=0.0, Identity=70%"; Hit description =Endosomal protein-like
  Pfam annotation: Domain name=EMP70; Domain location=48-576; Score =826.3; E_value=1.6e-245; Accession=PF02990.7; Description =Endomembrane protein 70
  Pfam annotation: Domain name=Oxidored_q3; Domain location=303-502; Score=-28.7; E_value=0.035; Accession=PF00499.10; Description=NADH -ubiquinoneplastoquinone oxidore
  Pfam module annotation: Pfam domain module=EMP70::Oxidored_q3; Domain location=48-576::303-502
MACLVGAIVILWCCISHVTSDASDHRYMKGDSVPFYANKVGPFHNPSETYRYFDLPFCSPANVEEKREDLGEVLNGDRLVAAPYKLDFQIDIEPESYCKKRLTIKEVAQFRHAVLKDYFYQMYYDDLPIWGFLGKFDSEDKDDQSGAIVHLFKHVHFEILYNKDRIIDVFIRNDPQAVVDLTENKEVEVDFTYSAKWVETDTPFEKRLEKYSQTSSLSHNLEIHWFSVINSCVTVLLLTGFLAIILMRVLKNDFVKFTPDEEAIDDQEESGWKYIHGDVFRYPRFKSLFAAALGTGTQLFTLTIFIFMLALVGVFYPYNRGALFTALVIIYALTSGIAGYYAASFYYMIEGKNWVKILVLTGSLFSGPLFFTFCFLNTVALAYNATAALPLGTIVVIFLIWTLVTSPLLVLGGIAGKNSQSGFQAPCRTNKYPREIPQVPWYRTTLAQMAMAGFLPFSAIYIELYYIFASVWGHQIYTIYSILFIVFIILLIVTAFVTVALTYFQLATEDHEWWWRYVNFLHESALTVFLIHIPPSANGFDFGVIRSFLCGGSTGLFIYGYCLYYYYARSDMSGFMQTTFFFGYMACICYGFFLMLGTVGFRAALIFVRHIYLSIKCE

SEQ ID NO: 143808 - protein, 36 aa, Glycine max
  Coding DNA Sequence Number=SeqID_27030
MRDKVKFRCERSDRDDPWKVDSLARVSKIATWRRVE

SEQ ID NO: 143809 - protein, 44 aa, Glycine max
  Coding DNA Sequence Number=SeqID_27031
MGGHKGACGGILRYENGNWIGGFFKKDLVLVVFCLQNLVLFSWP

SEQ ID NO: 143810 - protein, 178 aa, Glycine max
  Coding DNA Sequence Number=SeqID_27032
  Homolog annotation: Hit_ID=Q1RZE1; Match level="QueryCoverage=51%, HitCoverage=60%, E-value=4e-08, Identity=29%"; Hit description=RNA -directed DNA polymerase
MAMENEEGNFITDPQEFKHLVTPLVIFNPLHQTLRLKMQFDMDKLKTPGPNGIHAMFFHMHWDVIVENPSMLSQYHPISLYNMVYNEIFHSTRKLKGMMVVKVDLEKAYDKLRREFVRHTLHDIGFHDHFVNLINALARGLATHGHEGFTMRGGVQTWAWAFVVTLSAKPHAQRAFCA

SEQ ID NO: 143811 - protein, 56 aa, Glycine max
  Coding DNA Sequence Number=SeqID_27033
MSHSEEGSMRPDKGDFDAVSDQKSSIPLSGVVHLVVGSATSVGGVTAVKGRPHPSV

SEQ ID NO: 143812 - protein, 73 aa, Glycine max
  Coding DNA Sequence Number=SeqID_27034
  Subcellular localization annotation: CTP_CleavageSite=32; ConfidenceScore=5.12e-01
MATPLGRARPSVMIATYRNLPFSGRARRNKKEVSSKKEMRGSRHQYLFKGKWSTMVLPLLLCILRCDEEFRPM

SEQ ID NO: 143813 - protein, 154 aa, Glycine max
  Coding DNA Sequence Number=SeqID_27035
MCKATHLKTKIMGRILIIAKLGMVSHAFHCTESQSSTHIWSGGELQHMGTPYGDLIGYRSKLDNMRPEQGSKMTYKSLKTPQDQHDCHHQKGRDCGSNVFQDYFDDAKESRVKQVPKNQESKRFNQVSKNQDSRIIKIKIQDSRFKNQEKTLSR

SEQ ID NO: 143814 - protein, 75 aa, Glycine max
  Coding DNA Sequence Number=SeqID_27036
MIAIHQEFVRLFREHEDDILSTQVNDDDDNDEVVTRSPSSPNVNNPQPPNKCLISSTVKVFQHSLKEYYGLGCNS

SEQ ID NO: 143815 - protein, 108 aa, Glycine max
  Coding DNA Sequence Number=SeqID_27037
MNRHNPDSQSNPRCHTLISSGDLCSMTCDHSLVLVRCLAPIIRQFVKFQDMPENQKNIDAQSHPGPLGPSGIFLQKAVASGGSNPARLGELSSPGRAGRQPPPLFCYK

SEQ ID NO: 143816 - protein, 162 aa, Glycine max
  Coding DNA Sequence Number=SeqID_27038
  Gene Ontology: Mol. function=polyphosphoinositide phosphatase activity; Cellular component=membrane of vacuole with cell cycle -correlated morphology; Biological process=cellular morphogenesis during conjugation with cellular fusion
  Homolog annotation: Hit_ID=Q10QV1; Match level="QueryCoverage=82%, HitCoverage=17%, E-value=4e-47, Identity=65%"; Hit description=SacIy domain containing protein, expressed
MASSENKPSSHSSPPAHACLHKFRLYETLSNFYMIGRDKSRTYWRVLKIDRLDPSELNVLEDSTTYTESECSDLLKRIHEGNRSTGGLKFVTTCYGIVGFIKFLGPYYMLLITKRRQIGAISGNTVYAVSKCEMIPLQSSSVHSNITDSINENRSLQSWMLY

SEQ ID NO: 143817 - protein, 709 aa, Glycine max
  Coding DNA Sequence Number=SeqID_27039
  Gene Ontology: Mol. function=phosphoinositide 5-phosphatase activity; Cellular component=Golgi apparatus
  Homolog annotation: Hit_ID=Q7XZU1; Match level="QueryCoverage=53%, HitCoverage=49%, E-value=1e-105, Identity=52%"; Hit description=SAC domain protein 4
  Pfam annotation: Domain name=Syja_N; Domain location=161-428; Score =13.0; E_value=1e-11; Accession=PF02383.9; Description=SacI homology domain
  Subcellular localization annotation: CTP_CleavageSite=50; ConfidenceScore=5.23e-01
MASAFAFAPPSPPPPPRNGGSPIGSSVVITAKEFLHSISLKLNNSNYLLWCQQVEPVLKGQCLFHLLTESQIPPLSWLQSTISDKVLPRLFGCKTAWHLWDKLHTHFYSIVRVKKQQFHDDLRNIFLNNSSISDYLFCIQTIIDSLSSIVEHVSESDHVDIVLNGLPDEFELLITFVSGKFESLSIDEVATLLLAHETQIARKKTLASSIALINLAEGAKPNFSPNSGQQDSHPQVYVAQGSGFDTILECGFGPIGKNKTWRIGEVFTWQGHMLCGSGVNKPMGWRRGVNDKGRVANDVETEQIVFEDVPEGLPVQICSVVQNRGSIPLFWSQETSRLNLKPDIILSKKDQNYEATRLHFENLVKRYGHPVIILNLIKSHERKPRESILRSEFGKAIDFINKDLSQENRLRFLHWDLKHFQSKATNVLLLLGKVAAYALTVTGFLYCQVPPTPRPEDCIKCPSISFAYGNIDKGSFQSTRQADVDNKDGNTLERKPSGESNLANGNHFVKPPMFQRGVLRTNCIDCLDRTNVAQYAYGLAALGHQLHALGIIDHPKIDLDDPLSDDLMGFYERMGDTLAHQYGGSAAHKKPQLGKPALWDLGSDQHYDIGRYGDDDASLCGNSELWLFRSFVKRCFSDGSIIDGNSTPMSTPNPKLEKFSKLGLQDQSEEGSKAFCESSPEISTSSETESDMSFSSPRFEYQLIVDPTG

SEQ ID NO: 143818 - protein, 258 aa, Glycine max
  Coding DNA Sequence Number=SeqID_27040
  Homolog annotation: Hit_ID=Q6AVG1; Match level="QueryCoverage=18%, HitCoverage=11%, E-value=3e-08, Identity=61%"; Hit description =Expressed protein
  Subcellular localization annotation: CTP_CleavageSite=26; ConfidenceScore=5.31e-01
MDNKHKYFKSINIVNRTFPQLNKTVKSSLTLPSPNTKLFFHVKFNFNQYDHNERNEIDSYTVASSSSSVAARTTLFIPQRQGLAVVNVVDQLMVPEPNKKLGQPFKKQRGLLNSPGRRQRRLRRLGRDNRFESAGGASRRGWREWWWSRRRWSRGGRDCCLWLRLKSGATTDFSIFLLGGKSCFCGGGVQRSTTVMVFVAGHGRVVMERASIVPMVHKLPFKQTPKVAFMFLKKGPGLLAPLWERFFKGNEAGLFLTK

SEQ ID NO: 143819 - protein, 77 aa, Glycine max
  Coding DNA Sequence Number=SeqID_27041
  Gene Ontology: Mol. function=ribonuclease H activity; Biological process=DNA integration
MGEMCEEFKIQHHNSTPYRPKMNGAMEAANKNINKIIQKMTVSYKDWHKMLPFMLHDVQGRVRAGTRLVVSRSSSRD

SEQ ID NO: 143820 - protein, 61 aa, Glycine max
  Coding DNA Sequence Number=SeqID_27042
MEEFMIMMGTLHFKRLSFFNFVKRITEKVECHIGAMMGSHEFWDSDSLQKRAKDTVMAGIY

SEQ ID NO: 143821 - protein, 105 aa, Glycine max
  Coding DNA Sequence Number=SeqID_27043
MAHPSSNSVCWVFFEPDFQEQCRGFCGFERGQCGFSGSVGGSVGSSEDNRFPAVFRWEEKEKSDFRQEDDKEKREGKVFERTRLVKSQFLTYKHNNIGFFMDNRC

SEQ ID NO: 143822 - protein, 466 aa, Glycine max
  Coding DNA Sequence Number=SeqID_27044
  Gene Ontology: Mol. function=DNA binding; Biological process =regulation of transcription
  Homolog annotation: Hit_ID=Q1S588; Match level="QueryCoverage=99%, HitCoverage=100%, E-value=3e-98, Identity=49%"; Hit description=Myb -like DNA-binding domain, SHAQKYF class, putative
  Pfam annotation: Domain name=Myb_DNA-binding; Domain location=277 -328; Score=41.7; E_value=2.5e-09; Accession=PF00249.21; Description =Myb-like DNA-binding domain
  Subcellular localization annotation: CTP_CleavageSite=55; ConfidenceScore=5.25e-01
MTLEGIFIEPTSTTAPDLSLHISPPTISSSSLISNHGSNNFPSRTTTLFQQAHTELSLGRNFTSETPTPTPTPTPTPHNPYYQSLNHFHHLHHHHNHNNNNNTSTSVNTTSTTTTNTPLNHINYGVSLLDVSSSDTLRPIKGIPVYHNRSFPFVAAMDHARDDDNNNNKDHHHHHKMCLYNNHHNMPSYHPSLSPSTAAPSPSPYFVDPMSLLNNGSTVAACRAATATRFNGFSGDAFKSSHPLHQYGVGPSEASSGFMRSRFLQKLPNKRSMRAPRMRWTSTLHARFVHAVELLGGHERATPKSVLELMDVKDLTLAHVKSHLQMYRTVKTTDKPAASSGHSDGSGEDDLSPMGSTADRGGLRQFPNHRGRPEWQAQQDMDYPSTTPILWSNSSSCGESRLRPSSNDIDGLRSPILQSQTISGGHQIQECDSTQLKNNMAGSNLKKNPSLEFTLGRPDWDGKEQA

SEQ ID NO: 143823 - protein, 54 aa, Glycine max
  Coding DNA Sequence Number=SeqID_27045
MGRCRGWVGFLYTVWLVTSKSLGLAKQSLSVTGSAITTYSAAWGTRNLADKNSI

SEQ ID NO: 143824 - protein, 63 aa, Glycine max
  Coding DNA Sequence Number=SeqID_27046
MEVTRFGMAIVSERELGVRLGLQWFENFFKSLRQLHHSQIYRVNRSGVFSSNISMLFLKHKRE

SEQ ID NO: 143825 - protein, 115 aa, Glycine max
  Coding DNA Sequence Number=SeqID_27047
  Gene Ontology: Mol. function=transcription cofactor activity; Cellular component=nucleus; Biological process=abscisic acid mediated signaling
  Homolog annotation: Hit_ID=Q9SEE4; Match level="QueryCoverage=62%, HitCoverage=24%, E-value=4e-27, Identity=79%"; Hit description=Pirin- like protein
  Pfam annotation: Domain name=Pirin; Domain location=30-106; Score =22.2; E_value=7.1e-07; Accession=PF02678.6; Description=Pirin
MSQSDHSSAFTTPRLVLKKVLAKSQHEGDGAVVRRGIGRSELKNLDPFLMLDHFSVSPPAGFPDHPHRGFEIVTYMLELAGILLDTANLRDPRCSSKDKYMASLLINGAPLITRY

SEQ ID NO: 143826 - protein, 55 aa, Glycine max
  Coding DNA Sequence Number=SeqID_27048
MPSLDRAISIVQDCDLRGQEDLLGAVGELDGDGFYVSGKVIWYGAWDIKVGKRIN

SEQ ID NO: 143827 - protein, 122 aa, Glycine max
  Coding DNA Sequence Number=SeqID_27049
  Subcellular localization annotation: CTP_CleavageSite=33; ConfidenceScore=5.13e-01
MTTLLLACFSVLPHTMYDQPSCSLNFLSSHIARKATLGTDVSNSKAVFRLISEASHFHLILKFEKNENPGRFSSKIGRDKDETTQTIHELGGMSPFYSMVIPLYHFLAKQKDRVNIPVQAQK

SEQ ID NO: 143828 - protein, 212 aa, Glycine max
  Coding DNA Sequence Number=SeqID_27050
  Gene Ontology: Mol. function=GPI anchor binding; Cellular component =membrane; Biological process=cell adhesion
  Homolog annotation: Hit_ID=Q2PES4; Match level="QueryCoverage=73%, HitCoverage=38%, E-value=2e-62, Identity=76%"; Hit description =Putative fasciclin-like arabinogalactan protein FLA2
  Pfam annotation: Domain name=Fasciclin; Domain location=77-195; Score= 2.3; E_value=0.0024; Accession=PF02469.12; Description=Fasciclin domain
MVSCTVALCGQAQLTRYYIAWQLIKCDNDGSLHSFYVKSVKEMPYYISVLQISAADSEAPTAAPSAIDPISIMSKQGCKAFTDLLRGSKALPSFKENVDGGLTVFCPTHSTVSGFAAKYKNLTEAQKVSLLLYHTTPVYESLHMLKSSNEIMNILAIEGANKYDFTVQSEGEDVNLKTKVNTTVYMTLKLSIIIQCANTYVNIGTTFYISKR

SEQ ID NO: 143829 - protein, 83 aa, Glycine max
  Coding DNA Sequence Number=SeqID_27051
  Homolog annotation: Hit_ID=Q2RA11; Match level="QueryCoverage=73%, HitCoverage=11%, E-value=5e-09, Identity=51%"; Hit description=CBS domain-containing protein, putative, expressed
MGEEAKKAYVEALELEPQSNVAQEALSRLGKFRHLLVVENGEVLGLLDIAKCLHDAIARMKKAAEKGKSIAAAVEGVEKHWGT

SEQ ID NO: 143830 - protein, 348 aa, Glycine max
  Coding DNA Sequence Number=SeqID_27052
  Gene Ontology: Mol. function=signal transducer activity; Cellular component=membrane; Biological process=response to light stimulus
  Pfam annotation: Domain name=NPH3; Domain location=90-344; Score =332.3; E_value=8.5e-97; Accession=PF03000.5; Description=NPH3 family
MTEEFAEKNLEARAEAYLRDTVLPNISSTVHVLHCCEALRPISEQINLVNKLINAIANNACKEQLTTGLLKLDHTFPSKTTPTMEPETPSDWWGKSFNVLSLEFFQRVVSVVKSKGLKQDMISKILMNYAHGSLQGIGVRDPQVVKGSLHDLEFQKKQRVVVETIVGLLPTHSRKSPVPMGFLSSLLKGAIAASASTPCKSDLERRISLQLDQAILEDILIPTNSPQNSHNTMYDTDSILRIFSIYLNMDEEDGEDSDNYIDESQMVYDFDSPGSPKQSSIIKVSKLLDNYLAEVALDSNLLPSKFTALAELLPDHARVVSDGLYRAVDIFLKTCSHQCVPVVCFLMI

SEQ ID NO: 143831 - protein, 143 aa, Glycine max
  Coding DNA Sequence Number=SeqID_27053
  Gene Ontology: Mol. function=nucleic acid binding; Cellular component= intracellular
  Homolog annotation: Hit_ID=Q39263; Match level="QueryCoverage=91%, HitCoverage=46%, E-value=7e-09, Identity=34%"; Hit description=Zinc finger protein 4
MKPNFDPEVEANAEDESEVSSKVSIQEACNDSCCDNLINISNITNPIGIHPNSEAISLDSTLNSMNCEPGERDSIGFSFSSNEPASQTTAPTIPRVFPCNFCQHKYISSQDLDGLIDEHRRERELAKRTMRMHSLFLLPDCSI

SEQ ID NO: 143832 - protein, 561 aa, Glycine max
  Coding DNA Sequence Number=SeqID_27054
  Gene Ontology: Mol. function=protein serine/threonine kinase activity; Cellular component=integral to membrane; Biological process=protein amino acid phosphorylation
  Homolog annotation: Hit_ID=P43298; Match level="QueryCoverage=98%, HitCoverage=58%, E-value=1e-170, Identity=55%"; Hit description =Putative receptor protein kinase TMK1 precursor
  Pfam annotation: Domain name=LRRNT_2; Domain location=23-56; Score =31.6; E_value=2.7e-06; Accession=PF08263.3; Description=Leucine rich repeat N-terminal domain
  Pfam annotation: Domain name=LRRNT_2; Domain location=320-359; Score =23.0; E_value=0.001; Accession=PF08263.3; Description=Leucine rich repeat N-terminal domain
  Pfam annotation: Domain name=LRR_1; Domain location=107-129; Score =10.6; E_value=3; Accession=PF00560.23; Description=Leucine Rich Repeat
  Pfam annotation: Domain name=LRR_1; Domain location=131-154; Score =6.9; E_value=15; Accession=PF00560.23; Description=Leucine Rich Repeat
  Pfam annotation: Domain name=LRR_1; Domain location=182-204; Score =5.6; E_value=25; Accession=PF00560.23; Description=Leucine Rich Repeat
  Pfam annotation: Domain name=LRR_1; Domain location=232-253; Score =7.1; E_value=13; Accession=PF00560.23; Description=Leucine Rich Repeat
  Pfam annotation: Domain name=LRR_1; Domain location=255-277; Score =11.9; E_value=1.7; Accession=PF00560.23; Description=Leucine Rich Repeat
  Pfam annotation: Domain name=LRR_1; Domain location=279-300; Score =5.2; E_value=30; Accession=PF00560.23; Description=Leucine Rich Repeat
  Pfam annotation: Domain name=LRR_1; Domain location=362-384; Score =5.3; E_value=30; Accession=PF00560.23; Description=Leucine Rich Repeat
  Pfam annotation: Domain name=LRR_1; Domain location=386-408; Score =14.7; E_value=0.34; Accession=PF00560.23; Description=Leucine Rich Repeat
  Pfam annotation: Domain name=LRR_1; Domain location=410-431; Score =7.2; E_value=13; Accession=PF00560.23; Description=Leucine Rich Repeat
  Pfam annotation: Domain name=LRR_1; Domain location=60-82; Score=3.5; E_value=63; Accession=PF00560.23; Description=Leucine Rich Repeat
  Pfam annotation: Domain name=LRR_1; Domain location=84-105; Score =17.6; E_value=0.044; Accession=PF00560.23; Description=Leucine Rich Repeat
  Pfam module annotation: Pfam domain module=LRRNT_2::LRRNT_2::LRR _1::LRR_1::LRR_1::LRR_1::LRR_1::LRR_1::LRR_1::LRR_1::LRR_1::LRR _1::LRR_1; Domain location=23-56::320-359::107-129::131-154::182 -204::232-253::255-277::...
  Pfam module annotation: Domain location=279-300::362-384::386 -408::410-431::60-82::84-105
MKPLALLAIGVFTMMTLLASSQEDDDASVMLALKNSLNPPGWSDPDPCKWARVRCSDNKRVTRIQIGRLNLQGTLPTTLQKLTQLEHLELQYNNISGPLPSLNGLSSLRVFVASNNRFSAVPADFFSGMSQLQAVEIDNNPFEPWEIPQSLRNASGLQNFSANSANVRGTMPDFFSSDVFPGLTLLHLAMNSLEGTFPLSFSGSQIQSLWVNGQKSVNKLGGSVEVLQNMTFLTQVWLQSNAFTGPLPDLSALKSLRDLNLRDNRFTGPVSTLLVGLKTLKVVNLTNNLFQGPMPVFADGVVVDNIKDSNSFCLPSPGDCDPRVDVLLSVAGVMGYPQRFAESWKGNDPCGDWIGITCSNGNITVVNFQKMGLSGVISPDFAKLKSLQRIMLADNNLTGSIPEELATLPALTQLNVANNQLYGKVPSFRKNVVVSTSGNIDIGKDKSSLSPQGPVSPMAPNAKGESGGGPGNGGKKSSSRVGVIVFSVIGAVFVVSMIGFLVFCLFRMKQKKLSRVQSPNALVIHPRHSGSDNESVKITVAGSSVNVGAASDTRTMPGSEA

SEQ ID NO: 143833 - protein, 210 aa, Glycine max
  Coding DNA Sequence Number=SeqID_27055
  Gene Ontology: Mol. function=hydrolase activity, acting on ester bonds; Cellular component=cellulose and pectin-containing cell wall; Biological process=lipid metabolic process
  Homolog annotation: Hit_ID=Q9LY84; Match level="QueryCoverage=86%, HitCoverage=46%, E-value=5e-52, Identity=55%"; Hit description=Early nodule-specific protein-like
  Pfam annotation: Domain name=Lipase_GDSL; Domain location=35-205; Score=45.9; E_value=1.4e-10; Accession=PF00657.12; Description=GDSL -like LipaseAcylhydrolase
MGFLVQFVVFMLFPWFLSVRAEENYSSQHCDFPAIFNFGDSNSDTGCMAAAFYPEVLPYGETFFHEPVGRASDGRLIIDFIAQHLGFPFLSAYINSIGTSYRHGANFAAGSSTIRRQKRTVFEGGTPFTFEIQVAQFNQFKARTRKFFNQDAQGKNSFRGHFPRPEDFAKAIYTFDIGQNDIAAAINKVDTEDSHAVISDIVDYFENQVQ

SEQ ID NO: 143834 - protein, 134 aa, Glycine max
  Coding DNA Sequence Number=SeqID_27056
  Gene Ontology: Mol. function=hydrolase activity, acting on ester bonds; Cellular component=cellulose and pectin-containing cell wall; Biological process=lipid metabolic process
  Homolog annotation: Hit_ID=Q9LY84; Match level="QueryCoverage=57%, HitCoverage=19%, E-value=5e-16, Identity=51%"; Hit description=Early nodule-specific protein-like
PIGCLPVAMPVHNAMNTTPGAGYLDQNGCINYQNDMAREFNKKLKNTVVKLRVQFPDASLIYVDMFSAKYELISNANKEEIMQIAARIGAFLLDATPGSGVTSFNGVLQELGLASLTGELRLGVASSTGDLSLK

SEQ ID NO: 143835 - protein, 86 aa, Glycine max
  Coding DNA Sequence Number=SeqID_27057
MAGSKISCTHEMVPRKLPSKRSRKGTTREGSSAAPQADTDFNRHQFSSAEHEQRFEAINGWSFLKERWVQLRDDDSRRLITQVRGG

SEQ ID NO: 143836 - protein, 139 aa, Glycine max
  Coding DNA Sequence Number=SeqID_27058
  Gene Ontology: Mol. function=nucleoside-triphosphatase activity; Cellular component=membrane; Biological process=proteolysis
  Homolog annotation: Hit_ID=Q1SGD5; Match level="QueryCoverage=98%, HitCoverage=26%, E-value=6e-51, Identity=73%"; Hit description=AAA ATPase, central region; MIT
MGVGHNDQKVLILAATNTPYALDQAIRGHFDKHIYIPLPDLKARQHMFKAWAIYMMMFIGLIVYCEPSKWPYNVHLGDTPHNLAESDFEHLAHKTKGFSGSDISVCVKDVLFESVHKTQDAMFFFKNPEDMWIPCGPKQ

SEQ ID NO: 143837 - protein, 132 aa, Glycine max
  Coding DNA Sequence Number=SeqID_27059
MDRARKNYWNPEDPSITFLGSHKAKAQAPSDAPVPAPTPVAPIPARAYGVEYSSWHLPGDAEYAESISTTADYEHEGVSGTEGTPEVEEAIEDTPEAKEASGATEADVDDDYVADITAALGTWDPWPTPAQD

SEQ ID NO: 143838 - protein, 77 aa, Glycine max
  Coding DNA Sequence Number=SeqID_27060
MALSHCCCYSVVALSAPCMCLLVISVRFVSKIAWERYKTNVHHRNIFPEQNVELAYSHYDEFLWELECRQWHKNLTR

SEQ ID NO: 143839 - protein, 167 aa, Glycine max
  Coding DNA Sequence Number=SeqID_27061
  Gene Ontology: Mol. function=RNA-directed DNA polymerase activity; Biological process=RNA-dependent DNA replication
MGIPTIAGKSKRSTFNYIKKKMGKKILSWRGKYLSLAGKEVLIKPVAQAVPSYICSQFHCARSCSKGNRWRIGDGSQITVSLEHWLRDGDNLKVTTVSNEEVANLTVHNLICLDGGGWNTTMVNPMLKDEDTNHVLKHDLAVKRAISLPPVIREFHKGEPHRCHLLD

SEQ ID NO: 143840 - protein, 78 aa, Glycine max
  Coding DNA Sequence Number=SeqID_27062
MPFRGLKSATKRTMFSAFSGKCDELAKRACCVKRVHQYSLCIYAFSEELVKRAYHAKRVHPLRMNTHPLDELPVAKRG

SEQ ID NO: 143841 - protein, 438 aa, Glycine max
  Coding DNA Sequence Number=SeqID_27063
  Gene Ontology: Mol. function=ubiquitin-protein ligase activity; Cellular component=ubiquitin ligase complex; Biological process =protein ubiquitination
  Homolog annotation: Hit_ID=Q8S8Z6; Match level="QueryCoverage=99%, HitCoverage=100%, E-value=1e-133, Identity=56%"; Hit description =Syringolide-induced protein 13-1-1
  Pfam annotation: Domain name=U-box; Domain location=32-106; Score =82.9; E_value=9.9e-22; Accession=PF04564.6; Description=U-box domain
MVLSWTKGRVFRRARKGKELKNFGGDLEIDIAIPTHFRCPVTLDMMKDPVTVSTGITYDRDSIEKWIESGNRTCPVTKTELTTFDMIPNHAIRRMIQDWCVEHRSHGIERIPTPRIPVTPYEVADTCTRILSAAQHGDENKCVELVSKIKAWGRESERNKRCIVSNGAALALANAFNSFSSRGLLIEKNVVVLDEILGALVWMRPLSEEGRSVLGSSSSISCMVWFMNGKQLSTRQNAALVLKEMHVEALVKCVGVFEALINMIKEPVGSGSTKACLSTIFNLVNNKRGVTTCQRFVELGLVDVVLEVLVDAERGVCEKALGVLDSVCDCKQGVEMAKANALTLPLVIKKLLRVSELCSSFAVSVLWKLCDKNIEEGVLIEALQMGVFHKLLVLLQVGCGEGTKEKATELLKLLNSCRSKAECVHHSSLDFKHLKNPF

SEQ ID NO: 143842 - protein, 111 aa, Glycine max
  Coding DNA Sequence Number=SeqID_27064
  Gene Ontology: Mol. function=zinc ion binding
  Homolog annotation: Hit_ID=Q7X6Y7; Match level="QueryCoverage=89%, HitCoverage=14%, E-value=6e-21, Identity=44%"; Hit description=Male meiotic MMD1
MSFALIEACKKRKRLPKFFRFNSFGDPGVVPIARSGPFRDNVRVFLQEAGDLEDYTVSGNPLWCILLIHDNSYAMAPLYTIEEHVDHSSHPFCDHCRCVGSFPNFAFLGLV

SEQ ID NO: 143843 - protein, 728 aa, Glycine max
  Coding DNA Sequence Number=SeqID_27065
  Gene Ontology: Mol. function=voltage-gated potassium channel activity; Cellular component=integral to membrane; Biological process=potassium ion transport
  Homolog annotation: Hit_ID=Q84LA0; Match level="QueryCoverage=99%, HitCoverage=91%, E-value=0.0, Identity=70%"; Hit description=Shaker -like potassium channel
  Pfam annotation: Domain name=Ank; Domain location=522-554; Score =19.6; E_value=0.012; Accession=PF00023.20; Description=Ankyrin repeat
  Pfam annotation: Domain name=Ank; Domain location=555-587; Score =28.2; E_value=3e-05; Accession=PF00023.20; Description=Ankyrin repeat
  Pfam annotation: Domain name=Ank; Domain location=611-641; Score=6.4; E_value=3.7; Accession=PF00023.20; Description=Ankyrin repeat
  Pfam annotation: Domain name=Ion_trans; Domain location=15-222; Score= 70.1; E_value=7.3e-18; Accession=PF00520.21; Description=Ion transport protein
  Pfam annotation: Domain name=Ion_trans_2; Domain location=150-228; Score=28.5; E_value=2.3e-05; Accession=PF07885.6; Description=Ion channel
  Pfam annotation: Domain name=cNMP_binding; Domain location=320-431; Score=60.5; E_value=5.6e-15; Accession=PF00027.19; Description =Cyclic nucleotide-binding domain
  Pfam module annotation: Pfam domain module=Ank::Ank::Ank::Ion _trans::Ion_trans_2::cNMP_binding; Domain location=522-554::555 -587::611-641::15-222::150-228::320-431
MEFGFFRGLPENLFILDIIGQIAFLVDIVLQFFVAYRDSQTYRMVYKRTPIALRYLKSNFIFDLLGCMPWDIIYKACGRKEEVRYLLWIRLYRVRKVEDFFHKLEKDIRVNYIITRIVKLIVVELYCTHTAACIFYYLATTLPESQEGYTWIGSLKLGDFSYSHFREIDLWKRYTTSLYFAIVTMATVGYGDMHAVNMREMIFIMVYVSFDMILGAYLIGNMTALIVKGSKTEKFRDKMTDLMKYMNRNRLGRDIREQIKGHVRLQYESSYTEASVIQDIPISIRAKISQTLYLPYIEKVSLFKGCSSEFINQIVIRLHEEFFLPGEVIMEQGNVVDQLYFVCHGVLAWDKLSDAEFSYLFVLYHLKKEEVGIAEDGTEETVSLLQPNSSFGEISILCNIPQPYTVRVCELGRLLRLDKQSFTNILDIYFYDGRKVLYNLLEGKESFRDKQLESDITFHLGKQEAELALKVNSAAFNGDMYQLKGLIRAGADPNKADYDGRSPLVRSLQLVMSCKYSGAFSSSMMLLHLAASRGYEDITIFLIQERVDVNIIDNFGNTPLLEAVKNGHDRVASLLVKEGASMKIENAAEGLYFMAKLLLEAGASVFTRDRWGNTPLDEARMCGNKNLIKLLEDAKSSQLSEFPSQEFTDKMHPKKCTVFPFHPWDPKDNRRHGIVLWIPHSIEELIKSAAEQIEISGGSCILSEDAGKITDVDMIKDGQKLYLVHETH

SEQ ID NO: 143844 - protein, 127 aa, Glycine max
  Coding DNA Sequence Number=SeqID_27066
MKEHMSVVWKPFQVMTITNLVADHDDGHRGWSSELRTKNRPNRRSGGSLYLHDANNPTAWQLPVRGRQGNDDNKCEDNDINVNHEADSTCYEFMATVFRNSNLISPINSRPESSTINHGYQTLELTR

SEQ ID NO: 143845 - protein, 85 aa, Glycine max
  Coding DNA Sequence Number=SeqID_27067
MSVNPGLLVFMEDLEGVSVASPSRLRSWHQQRAIKGELSSLSRTCKVCDEGAWRHRKEEVLWLKALMRRTSVCISLDYALVRGKT

SEQ ID NO: 143846 - protein, 76 aa, Glycine max
  Coding DNA Sequence Number=SeqID_27068
MAIEGFTTGGEEMGFGPSKARLARSDRALSACYRLNVCFCWIVRLARGSHLARVMNPASSCLTPRLVPVLACTLSA

SEQ ID NO: 143847 - protein, 280 aa, Glycine max
  Coding DNA Sequence Number=SeqID_27069
  Pfam annotation: Domain name=Chromo; Domain location=97-155; Score =8.4; E_value=0.097; Accession=PF00385.14; Description='chromo' (CHRromatin Organisation MOdifier
MSRPWEDLPMDFIVGLPPYRGNTTILVVVDKFSKGGGCFHQPEKEAFKVSRTNEGIADSHRRDINFEPSKWVMVKLRPHRQVTAIGPSHSKLAKHFYGPFQILSRIGQEQDQGEQRLKVLVQWEGLHLDDTTWEDWASRQNTYHLENKAETKKENHYSNPPEGLCLSGTKALCKWFWHCASLVVLGWYRDSLVRLVVVNIHMIGSDKVTKSRNFTRVVLALTVPTEKTHWPWQAWLGVREGLRFVEGIGFGERLMFGLELVFGEDMCFGGGVGGCIIGPL

SEQ ID NO: 143848 - protein, 155 aa, Glycine max
  Coding DNA Sequence Number=SeqID_27070
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=58%, HitCoverage=7%, E-value=2e-15, Identity=56%"; Hit description=Chromo
MSQPPTVEALIHKFHSQFQVPASLPPCWTTNHAINLRPNSEPVNVHPYRYSYFQKGHTSAGKGGCHSTIADTAILSSPSWAFGAYGFLPMLHQGAAFQQLMDAVSYAPVLRLSNFLIPFMVETDASGVGIGVVLSQLGHPIAFFSKNVLQKLCHT

SEQ ID NO: 143849 - protein, 85 aa, Glycine max
  Coding DNA Sequence Number=SeqID_27071
MAMAMVMTLKPKLWKTKTSPHCLRLRLCSCTHLLPFSSWSHFPYKDHDLLCEISEAINDSETKHEKGYSENPRLTRILPSLTPRH

SEQ ID NO: 143850 - protein, 146 aa, Glycine max
  Coding DNA Sequence Number=SeqID_27072
  Gene Ontology: Mol. function=transferase activity; Biological process= RNA-dependent DNA replication
  Homolog annotation: Hit_ID=Q1RYK2; Match level="QueryCoverage=87%, HitCoverage=68%, E-value=1e-17, Identity=32%"; Hit description =Polynucleotidyl transferase, Ribonuclease H fold
MNPFLERRDNVSRAERWKPPPHGAFKCNVDASFHKEENVTGMGMCIRDETGRVVALKTYQRRTSCMAVQEGEALALAVAMEFTLSLGFNNIDITFESDFVFAKRQINGVAHELVRAAPFFPSLYTSYQVIPCIESLVMNEMSQIIL

SEQ ID NO: 143851 - protein, 238 aa, Glycine max
  Coding DNA Sequence Number=SeqID_27073
  Gene Ontology: Mol. function=transferase activity, transferring hexosyl groups; Cellular component=mitochondrion; Biological process= metabolic process
  Homolog annotation: Hit_ID=Q84NV9; Match level="QueryCoverage=97%, HitCoverage=65%, E-value=2e-38, Identity=32%"; Hit description =Putative CRP1 protein
  Pfam annotation: Domain name=PPR; Domain location=117-151; Score =42.7; E_value=1.2e-09; Accession=PF01535.11; Description=PPR repeat
  Pfam annotation: Domain name=PPR; Domain location=12-46; Score=53.7; E_value=6.1e-13; Accession=PF01535.11; Description=PPR repeat
  Pfam annotation: Domain name=PPR; Domain location=152-186; Score =46.0; E_value=1.3e-10; Accession=PF01535.11; Description=PPR repeat
  Pfam annotation: Domain name=PPR; Domain location=47-81; Score=48.7; E_value=2e-11; Accession=PF01535.11; Description=PPR repeat
  Pfam annotation: Domain name=PPR; Domain location=82-116; Score=41.6; E_value=2.8e-09; Accession=PF01535.11; Description=PPR repeat
  Pfam module annotation: Pfam domain module=PPR::PPR::PPR::PPR::PPR; Domain location=117-151::12-46::152-186::47-81::82-116
MMLAQGVRPDLVTYNALINGLCKVGDLKEARRLVNEMTASGLKPDKITFTTLIDGCCKDGDMESALEIKRRMVEEGIELDDVAFTALISGLCREGRVHDAGRMLTDMLSAGFKPDDPTYTMVIDCFCKKGDVKMGFKLLKEMQSDGHVPGVVTYNALMNGLCKQGQMKNAKMLLDAMLNVGVAPNDITYNILLDGHSKHGSSVDVDIFNSEKGLVTDYASYTALVNESSKTSKDHLKR

SEQ ID NO: 143852 - protein, 56 aa, Glycine max
  Coding DNA Sequence Number=SeqID_27074
MDHGYGQNQVPGSGGGGGGGGGDNQGVVGGVATTSQKLTTNDVLSYLKEVKDMFQD

SEQ ID NO: 143853 - protein, 176 aa, Glycine max
  Coding DNA Sequence Number=SeqID_27075
  Gene Ontology: Mol. function=RNA-directed DNA polymerase activity; Biological process=RNA-dependent DNA replication
MGKVGEVALKIDIIKAFDQVNWNFLFGVLDKMGFNEKWVSWMKLCLRTMQFSIIVNGDHVGQISRERGLRQGLMIQKFQLLRRSYTFMDLLQTDFGIASTTGLANTSQKRGTSTWVVVTENKRGYICCGSVLVEGTSTRLLKENKGGYIPYGSLLVKEFTRLKRNLKDRRSFRDWM

SEQ ID NO: 143854 - protein, 518 aa, Glycine max
  Coding DNA Sequence Number=SeqID_27076
  Gene Ontology: Mol. function=catalytic activity; Cellular component =mitochondrial outer membrane
  Homolog annotation: Hit_ID=Q01G96; Match level="QueryCoverage=73%, HitCoverage=94%, E-value=2e-88, Identity=47%"; Hit description =Chromosome 01 contig 1, DNA sequence
  Pfam annotation: Domain name=ThiF; Domain location=110-245; Score =170.4; E_value=4.5e-48; Accession=PF00899.11; Description=ThiF family
  Subcellular localization annotation: CTP_CleavageSite=28; ConfidenceScore=5.07e-01
MERGKYLALVGGGALLGSVSTFFLLRLLQSQKRGVSQCSKNVTADFNGVDGCTIARMKIDRVVNEDLLKDEIVSEQLTRISINPTVFGWNVNAVTRNIQFFGFESQQKVTASYVVVIGLGGVGSHAASMLLRSGIGKLLLVDFDQVSLSSLNRHAVATRADVGISKAQCLEEHFSSIFPECQIVAKVLLYDSSTEEEILSGHPDFVLDCIDNIDTKVALLAACVRRGLKVLSATGAGARADPTRIRIADLRESTNDPLSRAVRHRLRKDYGIEGGIPVVFSLEKPKAKLLPFKGTSGEEENPSDYQIVPGFRVRIIPVLGTIPAIFGQFMASFVVTELAGVHVQTEPVVNFDMDHYHTLHQRLIEHEESLYGTSMEVQVDVEEVMYIVKELWHGRSAREQHVKDVGRGMWRSVNELMLVRWDRTKPASISNLILLKFKEVDEHESRTLEDIKENEPEFHSRVSAVLKRAELDFGLSTFLNLIIIFVFNCMEMVSKPRLKHRIRLKKSLSRKKKKVLIE

SEQ ID NO: 143855 - protein, 80 aa, Glycine max
  Coding DNA Sequence Number=SeqID_27077
MDAPVKKKALSRPSLSPQKKDKCIVFPLVSYCCACLDMPQLKTLLSQDVFHFVYYGLVWISFFLLEKLNYESFYEVKCIC

SEQ ID NO: 143856 - protein, 255 aa, Glycine max
  Coding DNA Sequence Number=SeqID_27078
  Gene Ontology: Mol. function=glutamate-ammonia ligase activity; Cellular component=chloroplast; Biological process=nitrogen compound metabolic process
  Homolog annotation: Hit_ID=P52782; Match level="QueryCoverage=89%, HitCoverage=64%, E-value=1e-79, Identity=65%"; Hit description =Glutamine synthetase nodule isozyme
  Pfam annotation: Domain name=Gln-synt_N; Domain location=17-97; Score= 131.3; E_value=2.8e-36; Accession=PF03951.9; Description=Glutamine synthetase, beta-Grasp domain
MSLLSDLISLNLSDTTEKVIAEYIWVGGSGIDMRSKARTLSGPVNDPSKLPKWNYDGSSTGQSPGVDSEVILFPQAAFKDPFRRGKNMLVMCDAYTAAGEPIPTNKRHNAAKIFSYPDVVAEEPWYGIHLVAERCAMATWMAYWWFSWAPGENSLSSIIKMEHLVSNGPYYCGIDANKDFGRDIVDSHFKACLHADINITGINAEVMPGQPYGIKTMLSTRHKRITEIAGVVLSVDPQPIKVDNSTHPGFYIDKS

SEQ ID NO: 143857 - protein, 164 aa, Glycine max
  Coding DNA Sequence Number=SeqID_27079
  Homolog annotation: Hit_ID=Q1SEJ5; Match level="QueryCoverage=82%, HitCoverage=26%, E-value=1e-23, Identity=55%"; Hit description=Helix- turn-helix, Fis-type; BRO1
  Subcellular localization annotation: CTP_CleavageSite=18; ConfidenceScore=5.54e-01
MTLLPFFKFKPPSGVLPLAMVFSKMHSCANASMSFSSIPAHSTMVEHPSPNRGLHGGVVGNEGEGSSHNNECMGGLAATIDDVRVIGQTNLAINDTQIKEHGGFLKLDALLFGGGHDTSGATKQSSAPCQSGVASRCRGIAVEGDMGVVKISDIERCLLGKEEQ

SEQ ID NO: 143858 - protein, 1197 aa, Glycine max
  Coding DNA Sequence Number=SeqID_27080
  Gene Ontology: Mol. function=zinc ion binding
  Homolog annotation: Hit_ID=Q1SUW3; Match level="QueryCoverage=96%, HitCoverage=90%, E-value=0.0, Identity=60%"; Hit description=Zinc finger, RING-type; Zinc finger, CHY-type; RINGv
  Pfam annotation: Domain name=Hemerythrin; Domain location=112-173; Score=28.5; E_value=2.4e-05; Accession=PF01814.13; Description =Hemerythrin
  Pfam annotation: Domain name=Hemerythrin; Domain location=301-363; Score=28.1; E_value=3.2e-05; Accession=PF01814.13; Description =Hemerythrin
  Pfam annotation: Domain name=Hemerythrin; Domain location=366-433; Score=17.5; E_value=0.047; Accession=PF01814.13; Description =Hemerythrin
  Pfam annotation: Domain name=Hemerythrin; Domain location=43-104; Score=27.6; E_value=4.4e-05; Accession=PF01814.13; Description =Hemerythrin
  Pfam annotation: Domain name=Hemerythrin; Domain location=650-711; Score=30.4; E_value=6.2e-06; Accession=PF01814.13; Description =Hemerythrin
  Pfam annotation: Domain name=Hemerythrin; Domain location=721-811; Score=24.3; E_value=0.00043; Accession=PF01814.13; Description =Hemerythrin
  Pfam annotation: Domain name=zf-C3HC4; Domain location=1122-1163; Score=19.8; E_value=0.0014; Accession=PF00097.15; Description=Zinc finger, C3HC4 type (RING finger)
  Pfam annotation: Domain name=zf-CHY; Domain location=993-1070; Score =147.7; E_value=3.1e-41; Accession=PF05495.3; Description=CHY zinc finger
  Pfam annotation: Domain name=zf-MIZ; Domain location=1118-1166; Score= -7.2; E_value=0.011; Accession=PF02891.10; Description=MIZ zinc finger
  Pfam module annotation: Pfam domain module=Hemerythrin::Hemerythrin::H emerythrin::Hemerythrin::Hemerythrin::Hemerythrin::zf-C3HC4::zf -CHY::zf-MIZ; Domain location=112-173::301-363::366-433::43-104::650 -711::721-811::...
  Pfam module annotation: Domain location=1122-1163::993-1070::1118-1166
  Subcellular localization annotation: CTP_CleavageSite=26; ConfidenceScore=5.17e-01
MATPLTGLNGGGGGVAVLTNPVNKVDSSANGGGGFGRSLSESPILIFSFFHKAIRNELDALHRLAMAFATGNCSDIQPLFQRYRFLRSMYSHHSNAEDEVIFPALDMRVKNVAQTYSLEHQGESDLFDHLFELLNSSIHNDESFPKELASCTGALQTSVSQHMAKEEEQVFPLLLEKFSLEEQASLVWRFLCSIPVNMMTEFLPWLSSSISPDESQDLQKCLSKIVPEEKLLQKVIFTWMEGRSSANTVENCLDHSQVRCSPNPLTHQNGKIKCACESTATGKRKYSGSSIDVSDTMRTHPIDEILLWHNAIKKELNEIAAQSRKIQLSGDFTNLSAFNERLQFIAEVCIFHSIAEDKVIFPAVDGKFSFYQEHAEEESQFNEFRSLIESIQSEEATSSSETEFYSTLCSHADHILEMIQRHFHNEEVQVLPLARKHFSFKRQRELLYQSLCMMPLKLIERVLPWLIRSLTEDEAQMFLKNMQLAAPAIDSALVTLFCGWACKARKDGLCLSSSVSGCCPAQRFTDIEENTVQSSCTSASALSGRVCSVLAESDGTQQRSVKRNISEVHKNEDVSKTSEIESIQKQCCSARSCCVPALGVNKNNLGLGSLSTTKSLRSLSFTASAPSLNSSLFIWETDNSSCDVGSTERPIDTIFKFHKAIRKDLEYLDIESGKLCDGDETIIRQFSGRFRLLWGLYRAHSNAEDDIVFPALESKEALHNVSHSYTLDHKQEEKLFEDISCVLSELSVLHENMQMTHMSVDLSENDFGISDANDNIKEYNELATKLQGMCKSIRVTLDQHIFREELELWPLFGKHFTVEEQDKIVGRIIGTTGAEVLQSMLPWVTSALTQDEQSKMMDTWKQATKNTMFNEWLNECLKETPVSTSQTEASERSTSQRGGDYQENLNLNEQMFKPGWKDIFRMNQNELESEIRKVYRDSTLDPRRKAYLVQNLMTSRWIAAQQKLPKALSGESSKQIEGCSPSFRDPEKEIFGCEHYKRNCKLRAACCGKLFTCRFCHDNASDHSMDRKATLEMMCMQCLTIQPVGPICMSPSCNGLTMAKYYCNICKFFDDERNVYHCPFCNICRVGQGLGIDYIHCMKCNCCLGIKSASHKCLEKGLEMNCPICCDDLFTSSATVRALPCGHYMHSSCFQAYTCSHYTCPICSKSLGDMAVYFGMLDALLAAEELPEEYRDRYQKK

SEQ ID NO: 143859 - protein, 238 aa, Glycine max
  Coding DNA Sequence Number=SeqID_27081
MGSRNGSGYEAEMVSIFSHIESPDRSLHDHIIEALSKLTVEQGIPYVTKKVQEVADCYLRYEFRYKKLQIIGHNLVKGSTWKLAYMEAHGTPSDFRQRFPPSPATLEQKNVKFTGLTSTVDVQTTVALRGSFLAPPLHLLNEEEEEPQRRRRKKKAQEEEAARRRNVMKQEDEEDEEVGRRRRELIRKKKKRSANAGRERERKLMSTFQGMDRKLWSTFLGLGIGFFDLETYTLHLGK

SEQ ID NO: 143860 - protein, 263 aa, Glycine max
  Coding DNA Sequence Number=SeqID_27082
  Gene Ontology: Mol. function=RNA binding; Cellular component =membrane; Biological process=positive regulation of cell proliferation
  Homolog annotation: Hit_ID=Q942M1; Match level="QueryCoverage=82%, HitCoverage=44%, E-value=3e-60, Identity=52%"; Hit description=STAM binding protein(Associated molecule with the SH3 domain of STAM)- like
  Pfam annotation: Domain name=Mov34; Domain location=105-207; Score =23.1; E_value=0.00013; Accession=PF01398.11; Description=Mov34MPNPAD- 1 family
MEDESLKKKDNSIAEHHKSELASILTQSEDCQLQPHPQPEPDQEPPSLISFETTETSAQIEVIRQPSPPPVLAEVQDLVPAVSPCVNEAGCKTEIPSLDNSVHAEDPLQLHISAALMESFMKLAKSNTKKNLETCGVLAGLLKNRKFYITALIIPKQESTSDSCQTTNEEEIFEVQDKRSLFPLGWIHIMLPESVAIVMAPRDSSRNHGIFRLTTPGGMSVIKQCDQRGFHPHSQPPDGGPIYKTCTDVYMNPDLKFEVIDLR

SEQ ID NO: 143861 - protein, 60 aa, Glycine max
  Coding DNA Sequence Number=SeqID_27083
MVRTRGLGRALGQVTRRVAVTADHVDEPVIPDPDVQDDPMGAPAVVEDIPADAGSEAAED

SEQ ID NO: 143862 - protein, 223 aa, Glycine max
  Coding DNA Sequence Number=SeqID_27084
MKQGAPCRDTLLHDSNSDFEFITSTDLEFESSSADELFSNGVILPIQMQEKTTARKLTHHVESPHPKLPPRPCASSVDKVKKETIRELLDVNSDNEKKPHSKSFWGFNRSKSLNCDTKKNLVCSSPLLSRSNSTGSVSNPKRVSSNKHPSAAKSSSSSYSFSTLNMYPMQKSPSGKSYGGSYPNGLRINPVLNVPTPCVSKGSANLLGLGSFLRVGKVKKSKK

SEQ ID NO: 143863 - protein, 2073 aa, Glycine max
  Coding DNA Sequence Number=SeqID_27085
  Homolog annotation: Hit_ID=Q5Z6I4; Match level="QueryCoverage=29%, HitCoverage=58%, E-value=0.0, Identity=62%"; Hit description =Putative Osnop
  Pfam annotation: Domain name=C2; Domain location=409-491; Score=65.7; E_value=1.5e-16; Accession=PF00168.20; Description=C2 domain
  Pfam annotation: Domain name=GRAM; Domain location=560-626; Score =86.9; E_value=6.1e-23; Accession=PF02893.10; Description=GRAM domain
  Pfam annotation: Domain name=RRM_1; Domain location=729-799; Score =6.6; E_value=0.035; Accession=PF00076.12; Description=RNA recognition motif. (a.k.a. RRM, R
  Pfam module annotation: Pfam domain module=C2::GRAM::RRM_1::RVT_1; Domain location=409-491::560-626::729-799::1704-2011
  Subcellular localization annotation: CTP_CleavageSite=39; ConfidenceScore=5.00e-01
MESNDSGDLLLHPRMTELPSRSSTSPSNSSSPVREEITSAKDEKSSTQKTITGRIAQIFSKSSDMSSTASRRSIDLDQSEISKVEVSEMKAEDQSSNETFEEAMRKLQSADQGSEIPSNLPAGVFIDQQYVIAPEDLNELLFSSDSNFLKSLAEVQGNTELEIGPWKFENDGEIFKRLVTYVKAPSKLIKAVKAYEEHTYLKADGKNFAVLVSVSTPDVMYGSTFRVEVLYVITPGPELPTGEQCSCLVVSWRMNFLQSTMMKGMIENGARQGMKDSFDQYATLLSQTVKPADLKDLSSNKEQALASLHAEPESDWRLAVQYFGNFTVFATVFMGLYVLVHIWLAAPSTIQGLEFGGLDLPDSIGEFVVCAVLVLQGECMLGKISRFIKARAQKGSDHGIKAQGDGWLLTVALIEGSSLASVDSSGLSDPYVVFTCNGKTRTSSIKFQKSNLTWNEIFEFDAMDDPPSVLDVVVYDFDGPFDEAASLGHAEINFLKANIADLADIWVPLEGKLALACQSKLHLRIFLDNTRGGNVAKDYLSRMEKEVRKKINLRSPQANSAFQKLFGLPPEEFLINDFTCHLKRKMPLQGRLFLSARIIGFHANLFGNKTKFFFLWEDIEDIQVIPPTFSSMGSPIIVITLRKGRGVDARHGAKTQDEQGRLRFHFQSFVSFNVAHRASGQQWSEGEENRGKGRDREWDPKTNYDNNKLGQFQRYHHHNWRDKDDITTFYFTRFHEHIIEEDLWAQFKKWGDVREIFIHKHRNKGGTRYGFVRFKGVLDKYRLEKQLDNIILDGLKMYVNIPKYGRGKARVKECISKLGVLKEGHSKEVEAGRHRAVQHRNPQKLYAKVVSTIQMDDGKMKHPKLPQLRYVDTHSSVHLQVAVGEKKWFTDAWVGRFKKLRALERIEDDIPWELGVNVVPKYLGDNMVLLLGLADNKAEHIIAEKTQHGTSPFHSLERWNPTMRLGHRLVWAQCWGIPIEAWDLGNIRKIVVAIGELVEVDDDVEEIRRMDRARILIRTPWKPFFHHTVSVTIGKELHQVVIVEEGASNDGRRNFSGRRPSYSLEELDFDGIDGESMISPYSPRYEIRHQPNNPHDDPEAIVDSDGVPRIGIGIPIGRATDPPEANHSDDLGGNPLNAAHVQSISCRGRKASPNEDTVPVATDKPRVMEQEGKGKGSETTINNGEINVGEAQKRKQQGEIESLTETVVHPEATIREIVVEDVQFQMRVDHQGEIESLTETVVHPEATIREIAVEDVQFQMRVNHDHELLTPPTGIQDLQNAEDGPNNGVFIRRKGCKQQMAQKDLTNGKATKSIFSGINPHTESIGTATSKRSKEADSQIPIKSIGADEGQIEEALTQWELAKLMWVSTDSEQTTIIHKIIDMETTDKKEAEDLGLGKGVKWAAVRRLARKNKMDILCIQETKKEQIDKPMCQALWGDMDVIPEGMWCFLGDFNSIRHPSERQGVSHRGVEVASINDFNEWISEMEFTEIPSDKSFVQTVIECWRNAQPKGWGGYVLKEKIKNLKEILKSWNKVHCGDTLNKVHKIEAELNSFEDASSTRQLSSQELVTRKKLQEKLWAAAHSHKHTNNAVKGIMANGSWVDDPRRVKEEIYRFFENRFIEPEQHRPILDETRFFGIDQQQNDMLVASFTEEEIRAAVWNCGSEKSPGPDGLNFKFVKQFWEMLKPEISRFIAEFHANGVFPRGTNASFIALIPKVKDPHHLNEYRPISLIGCVYKIVAKLLAHRLKKVLPNIIDERQSAFITGRQLLHSVLIANEAVEKGGTSHASFLKWITKKPMTRSSSMSLLVNGSPTNEFYPHRGLRQGDPLAPLLFSIVAEGLTGLMREALDKSLYSSLMNVMTIKSMLRVFELASGLKINFAKSSFGAIAHEHRKIAWVDWKTICLPKDKGGLGIKDLRTFNAALLGKWRWELFHKQKVPWAKVIDSKYGSQKFRFWEDPWTADELSLMEKYPRMYRISCQQKQLMMQMGSSMNNGKWTHTGKTPGFGNLTHELWKLKIPAKAAVFVWRLIRDRLPTKKNLSRRQVVMNDVLYSSEIDFVMHFNQWSSNLKEGFRS

SEQ ID NO: 143864 - protein, 69 aa, Glycine max
  Coding DNA Sequence Number=SeqID_27086
MPLKKHEGEEKDLSEDVVSDAVVESEGDSVIDIDFLSTGSDVDPVPVRRRRRPHRFSKRSVSPSSSSYS

SEQ ID NO: 143865 - protein, 274 aa, Glycine max
  Coding DNA Sequence Number=SeqID_27087
  Homolog annotation: Hit_ID=Q5QLJ2; Match level="QueryCoverage=71%, HitCoverage=38%, E-value=1e-22, Identity=36%"; Hit description=STAM binding protein-like protein
MSEKKKSVPQYLKGEGFLSVHIGILKVACLGCSYLESAVGKWITLSYVMMGCKALTGLLVLEFHADIFRAEKNIIDLYVMLLRFSSLVSETIPRHRDYRSSPQRQKESLKKKLLISLNELENLKPVVQQKINELNNKFAYQQNGQGKFISNNSLDFSPVKKLTSASYGLIKAVRPTAGEFVYQGSRSQQFSYVRPVEEHVRRLSLTLPPPKEETLSRHSILGPNGLKGHWRPPIIDKGIKYPSNIDLSPVELPRLLSILSFYSAFLYFWPSSFF

SEQ ID NO: 143866 - protein, 102 aa, Glycine max
  Coding DNA Sequence Number=SeqID_27088
  Gene Ontology: Mol. function=protein serine/threonine kinase activity; Cellular component=membrane; Biological process=protein amino acid phosphorylation
  Homolog annotation: Hit_ID=Q69MP3; Match level="QueryCoverage=53%, HitCoverage=6%, E-value=3e-14, Identity=63%"; Hit description =Putative receptor kinase 5
GLMLNGQEVAVKKLSLESRQGVREFTNEVRLLLRIQHKNLVTLLGCCAEGPEKMLLWSLAVGNSQWEKKTMMCSLVQKRQFNISLEWGLSSKGSPIRGMLKP

SEQ ID NO: 143867 - protein, 306 aa, Glycine max
  Coding DNA Sequence Number=SeqID_27089
  Gene Ontology: Mol. function=DNA binding; Cellular component=nucleus; Biological process=regulation of transcription
  Homolog annotation: Hit_ID=Q0PJK4; Match level="QueryCoverage=99%, HitCoverage=100%, E-value=4e-97, Identity=58%"; Hit description=MYB transcription factor MYB84
  Pfam annotation: Domain name=Myb_DNA-bind_2; Domain location=19-75; Score=-9.0; E_value=0.096; Accession=PF08914.1; Description=Rap1 Myb domain
  Pfam annotation: Domain name=Myb_DNA-binding; Domain location=20-67; Score=49.8; E_value=9.4e-12; Accession=PF00249.21; Description=Myb -like DNA-binding domain
  Pfam annotation: Domain name=Myb_DNA-binding; Domain location=73-118; Score=49.8; E_value=9e-12; Accession=PF00249.21; Description=Myb-like DNA-binding domain
  Pfam module annotation: Pfam domain module=Myb_DNA-bind_2::Myb_DNA -binding::Myb_DNA-binding; Domain location=19-75::20-67::73-118
MSTPSKSIICSREDDYELRRGPWSVEEDDLLISYIANNGEGRWNLLAIRSGLRRTGKSCRLRWLNYLKPNVKRGNLTSEEQLLIFELHSKWGNRWSKIAHQLPGRTDNEIKNYWRTRIQKRAKYLKFEAHRKSRFVEFVKGLQMTRYLHKAQESSPSAMSIQDQAIPLPFDGVTIPHYSSFGIGTTPTTQITCQGGLNHLNQQDQNSESEHNNGSCISSSESANIPYMSQPLGHTTSQFQALDNCDFGICSYDGYSIDNNSYDMDALNLTTTMVAENLELPVFDVQISEPYFMNMDELWQFRNIQR

SEQ ID NO: 143868 - protein, 68 aa, Glycine max
  Coding DNA Sequence Number=SeqID_27090
MGEEEKKLEENKVEEKKAEKEEKKEEKKSEESKDDKESKEESAPPEIVQDTTFAMHGHFKHDFWHLLS

SEQ ID NO: 143869 - protein, 273 aa, Glycine max
  Coding DNA Sequence Number=SeqID_27091
  Gene Ontology: Mol. function=transcription regulator activity; Cellular component=nucleus; Biological process=regulation of transcription
  Homolog annotation: Hit_ID=Q5FAM4; Match level="QueryCoverage=85%, HitCoverage=88%, E-value=4e-54, Identity=54%"; Hit description =Putative bZIPtranscription factor protein
  Pfam annotation: Domain name=HLH; Domain location=163-213; Score =21.9; E_value=0.00067; Accession=PF00010.16; Description=Helix-loop -helix DNA-binding domain
MAEFTENMQLQSNIIRPSQFPFLEIDPSMELLNQFIGMNQHVLENSNLSTMHNLVPFSCDTFLGPQEPEFPGNLEENFPALVNHNALPVSLPIFQAENEIHEGKKRKSVDLPETSSANSTPAVSESGSKIKHSSGRGKRVKSNVTEEEKAKEVVHVRARRGQATDSHSLAERVRRGKINEKLRCLQNIVPGCYKTMGMAVMLDEIINYVQSLQHQVEFLSLKLTAASTFYDFNSETDALETMQRARASEAKELGKYKKEGYGGVSFFQPAWPL

SEQ ID NO: 143870 - protein, 243 aa, Glycine max
  Coding DNA Sequence Number=SeqID_27092
  Pfam annotation: Domain name=VQ; Domain location=84-114; Score=42.7; E_value=1.2e-09; Accession=PF05678.4; Description=VQ motif
  Subcellular localization annotation: CTP_CleavageSite=59; ConfidenceScore=5.83e-01
MSPSQFHAKKPITSATTNNNINGLLSSPPLKINKESHFIKKSSSSSSSSSSSTSSSLVNSAMTRAMPTSLYKQPQQHHHPVIIYTHSPKVIHTQPKDFMSLVQKLTGLSRSGEEKEEGGNQSPQQLSNQEFGGDVAAVVGDKESDRKNVNIVKNEDNETSSVITEENNCSSVGENQVNSCFMTGEPSMLEPKLNPYVTNFPVMAPSSAEFVCSSQPFLNYSDSLFFSHNLRTSLEGMKEFLEH

SEQ ID NO: 143871 - protein, 64 aa, Glycine max
  Coding DNA Sequence Number=SeqID_27093
MNKKGTTIVHMINAGDQGVHADSQGNPPDGQGATQTKMLSCHHPVSPLVTIAFHHSSDFRNKLI

SEQ ID NO: 143872 - protein, 463 aa, Glycine max
  Coding DNA Sequence Number=SeqID_27094
  Homolog annotation: Hit_ID=Q9LS53; Match level="QueryCoverage=96%, HitCoverage=53%, E-value=1e-120, Identity=50%"; Hit description =Genomic DNA, chromosome 3, P1 clone: MYF24
  Pfam annotation: Domain name=C2; Domain location=228-328; Score=5.8; E_value=0.066; Accession=PF00168.20; Description=C2 domain
YGRYQRKLLVEDLDKKWKRIILNVSPITPLEHCEWLNKLLTEVWSNYFNPKFSIRISAIVEKRLKLRKPRLLERVELQEFSLGSCPPSLALQGMRWSTIGDQRFLQLGFDWDTNEMSILLLAKLAKPLIGTARIVINSLHIKGDLLASPILDGKALLYSFVSTPEVRIGVAFGSGGSQSLPATEWPGVSSWLEKLFTDTLAKTMVEPRRRCFTLPAVDLRKKAVGGIIYIRVISANKLSRSCFKTCRRQPNGTSNGCSEDNFDDKDLQTFVEVEIEELTRRTDVRLGSTPRWDAPFNMVLHDNAGTLRFNLYESCPNNVRCDYLASCEIKLRHVEDDSTIMWAIGPDSGVIAKQAQFCGEEIEMVVPFEGHNSGEVSVVVKEWQYSDGSHSLNSLRSSSSQQSINGSPNFQLRTGRKINVTVVEGKDLAAKDKSGKFDPYIKLQYGKVSCTAYLRDTDSSFIT

SEQ ID NO: 143873 - protein, 148 aa, Glycine max
  Coding DNA Sequence Number=SeqID_27095
  Homolog annotation: Hit_ID=Q9LDU3; Match level="QueryCoverage=92%, HitCoverage=39%, E-value=1e-42, Identity=58%"; Hit description =Arabidopsis thaliana genomic DNA, chromosome 3, P1 clone: MJK13
MGQYTPLDQVLISVLAMGMSMQWHLIQMDLYIHGARDTVVCARKRKTFVLVNSGLVYGFGSMGFGSLGFLYRRVSNKVLKPRILDTLGAHHVSQISTGLYNTVVITSRGQIFGFGDNERAQLGHDTLISYLEPTQIFIKDTFEDVEST

SEQ ID NO: 143874 - protein, 166 aa, Glycine max
  Coding DNA Sequence Number=SeqID_27096
  Gene Ontology: Mol. function=protein binding; Cellular component =membrane; Biological process=retrograde transport, endosome to Golgi
  Homolog annotation: Hit_ID=Q7X659; Match level="QueryCoverage=95%, HitCoverage=16%, E-value=1e-26, Identity=51%"; Hit description =Putative vacuolar sorting protein 35
MWTKYWDHVSRSFLENQSLMTIEQQTNKVMAMVIIQSITKNNTCISTFDKVAVLFELIKGLIMDLDGTTLDDVDEEDFNEEQNCVARLIRMLHNDEPEEMFKITIIMFIVKLNCIGVSLLSDSYNTTHSPSDNMYRKEAYYEWRTKELTFYSSFPDIFCTKGIFLP

SEQ ID NO: 143875 - protein, 152 aa, Glycine max
  Coding DNA Sequence Number=SeqID_27097
  Homolog annotation: Hit_ID=Q5VN67; Match level="QueryCoverage=32%, HitCoverage=5%, E-value=2e-11, Identity=64%"; Hit description =Putative NBS-LRR disease resistance protein
MQSYCSHDTHVVNLCFYHLQPKAGKERLVQKSILKEWIEKFRKYPRQNDINNTWKLNFLQKELLEVIICNIFLCFPFFGFNESFCYPQVNQSHALNQIVLRKDAQVQETIFQMLRCFWEGLTAVSALNKEGLTDLEMLECCPTGNIRLYIAM

SEQ ID NO: 143876 - protein, 85 aa, Glycine max
  Coding DNA Sequence Number=SeqID_27098
MQPCLIILWHHQNHVFIHSQQLAKQMAKRPSFGANIEKNPKEECVEAMTSKIILMMPKNQELSKFQRIRSQKASRIKFQRIKLQE

SEQ ID NO: 143877 - protein, 65 aa, Glycine max
  Coding DNA Sequence Number=SeqID_27099
  Subcellular localization annotation: CTP_CleavageSite=59; ConfidenceScore=5.38e-01
MARTKRYGQMTSTSTQQISDKIGQVSQSTSTLNRPYVGPTLPQHQSPNSNWLISWVTSRKSGGKK

SEQ ID NO: 143878 - protein, 157 aa, Glycine max
  Coding DNA Sequence Number=SeqID_27100
MANAMAGIDPLGELVKNLFDAYQKPIELPWDGTKFGIPKSTSLGYGSVYGFLEPQSIHHAKDRRQECQQYIETWVKGITLTSVLRTLLESSHVQTGGYEYGYYVMHWMWCIVRGDLKNEWNMWFFDGTALDGEAMTTLCKKWAAYFLQVKNMEFRQI

SEQ ID NO: 143879 - protein, 518 aa, Glycine max
  Coding DNA Sequence Number=SeqID_27101
  Gene Ontology: Mol. function=DNA binding; Cellular component=nucleus; Biological process=regulation of transcription
  Homolog annotation: Hit_ID=Q1S2L5; Match level="QueryCoverage=95%, HitCoverage=90%, E-value=2e-74, Identity=38%"; Hit description =Homeodomain-related
  Pfam annotation: Domain name=Myb_DNA-binding; Domain location=40-87; Score=48.3; E_value=2.6e-11; Accession=PF00249.21; Description=Myb -like DNA-binding domain
  Pfam annotation: Domain name=Myb_DNA-binding; Domain location=93-138; Score=48.8; E_value=1.8e-11; Accession=PF00249.21; Description=Myb -like DNA-binding domain
  Pfam module annotation: Pfam domain module=Myb_DNA-binding::Myb_DNA -binding; Domain location=40-87::93-138
MSSVTSGGDNRKISKGRRSSSLEEEAGVGGNIRGESPLKKGPWTAAEDAILVEYAKKHGQGNWNAVHKYSGLARCGKSCRLRWANHLRPDLKKGEFTAEEENRILELHAKMGNKWARMAAELPGRTDNEIKNYWNTRIKRMQRAGLPIYPEELCQRILNCNQESQNISILSNEASQHGDLSQTDFDIPDVEFKIFKFRHGLSHGQSIFDMPESSLFDQSSDSSHSYNLFPTMRPTKRPRESEMLYDSFESCTINAAPLFDQYDNYTSEKISDHPRLSLPRDPVLNTNDQFNGDNLTGSHAALNGNASSSVPMFRAMKLELPSLQYPETQHGSWGTPTSPLPSLESVDTLIQSPVVEPILLDPISPQSSGLLEAIVHNSKSLKGSNNDLLLQETIGTTNEVAKSSTLNHSFQTKWYELGEPNSPFGQSAASVLIEYTPVSMCSVDGPQSIETTQDHDDKHEALTTQFPDSSRKKKNILKQMDYTQPDALLDLGWFGNSTEYGSDQSVLQDALSALLGED

SEQ ID NO: 143880 - protein, 106 aa, Glycine max
  Coding DNA Sequence Number=SeqID_27102
  Homolog annotation: Hit_ID=Q1S8E6; Match level="QueryCoverage=37%, HitCoverage=5%, E-value=9e-09, Identity=72%"; Hit description =Transporter, major facilitator family, putative
MQGAEGEEDAGFGWDFCWVHTLCGWCLLVESLGLMALSPALTIMLGFVIYENRTSGLYIEKKQVKFKGDTEELTLDGSVDWHGRPIIRAKSSRRVIGTIVLCMFQK

SEQ ID NO: 143881 - protein, 116 aa, Glycine max
  Coding DNA Sequence Number=SeqID_27103
MEVPSAVPSCLECSISCFVYGFMFEQCEVKGFVAMTTAVMIVVIGGTSFVDQFVRFLDIVDDEVTAGDREDARLVEEGKVNEVEGLVMTGGIWSGKEGLGGGRGSREGMRLREKRR

SEQ ID NO: 143882 - protein, 232 aa, Glycine max
  Coding DNA Sequence Number=SeqID_27104
MEEGEISGDLGIMEVDEVQKPENVTGNMIYLSKIENQEKEKGYDSKSSMVNALQDANNSEKVEPRTSGKKGIVCGVEVAMSKETIECQKEDKTKLDNASKKNKCGGNKGKKKSRVVSTSVRKCKFQHTPLNNNHVSSSVKQNHLTKSAGIHSCTSVEHKVTNTVQKQPIPPKGISFINLAKLSPSFSSLKQDTVTTKESPVQIGTREDQSAFHKTQNKVDIPKKLPAVTPKE

SEQ ID NO: 143883 - protein, 283 aa, Glycine max
  Coding DNA Sequence Number=SeqID_27105
  Gene Ontology: Mol. function=receptor activity; Biological process =protein amino acid phosphorylation
  Homolog annotation: Hit_ID=Q9ZU94; Match level="QueryCoverage=94%, HitCoverage=97%, E-value=2e-63, Identity=46%"; Hit description =Expressed protein
  Pfam annotation: Domain name=DUF26; Domain location=184-238; Score =55.3; E_value=2e-13; Accession=PF01657.8; Description=Domain of unknown function DUF26
  Pfam annotation: Domain name=DUF26; Domain location=83-137; Score =65.1; E_value=2.3e-16; Accession=PF01657.8; Description=Domain of unknown function DUF26
  Pfam module annotation: Pfam domain module=DUF26::DUF26; Domain location=184-238::83-137
  Subcellular localization annotation: CTP_CleavageSite=26; ConfidenceScore=5.17e-01
MAKRSNISHTLLSSMYVFLCVVGFSECSSISTFLYSGCTQQRYTPNSPYEWNINSLLTSLVNSATYSAYNNFTVVGSTQQDAVYGLYQCRGDLAMPDCAACVARAVTRAGDICRGTCGGAVQLDGCFVKYDNATFLGAADKTVVLKKCGPSVGYNPDAMGSRDAVLAGLAAAGGNFRVGGSGGVHGVAQCTGDLSYGECQDCVAEAISRLKSDCGTADYGDMFLGKCYARYSVGGAHDESKAHDKSNHGGVKTFSIIIGSLAGVAILIIFFAFMSKICGRQGK

SEQ ID NO: 143884 - protein, 241 aa, Glycine max
  Coding DNA Sequence Number=SeqID_27106
  Homolog annotation: Hit_ID=Q8H6T6; Match level="QueryCoverage=66%, HitCoverage=99%, E-value=4e-56, Identity=71%"; Hit description=Auxin- regulated protein
  Pfam annotation: Domain name=Auxin_inducible; Domain location=54-147; Score=118.3; E_value=2.2e-32; Accession=PF02519.5; Description=Auxin responsive protein
MDSDGGSKLNGIRQIVKLKEMLQKWQSVTLGTKPSNSLSDHVTNDDGSISPLINKSVLNVMNCESDNEDSCQSPAEPLPPPDVPKGYLAVYVGPELRRFIIPTSYLSHPLFKVLLEKAADEFGFDQSGGLTIPCEIETFKYLLKCMENEQKEQLGDSAQREVTKRDVSKNSEIDFICLGEERHGRGRTELLRWNTIYGETAAGSSGSVEEIVPRVVVAVSSNLDDDRNDKKRESFQRKESG

SEQ ID NO: 143885 - protein, 43 aa, Glycine max
  Coding DNA Sequence Number=SeqID_27107
MRHNVHKRALAMSEMRKSHAASKEVEAEVANSPKREEMKRNER

SEQ ID NO: 143886 - protein, 486 aa, Glycine max
  Coding DNA Sequence Number=SeqID_27108
  Gene Ontology: Mol. function=protein kinase activity; Cellular component=integral to membrane; Biological process=protein amino acid phosphorylation
  Homolog annotation: Hit_ID=Q9FMD7; Match level="QueryCoverage=94%, HitCoverage=75%, E-value=1e-121, Identity=51%"; Hit description =Receptor-like protein kinase
  Pfam annotation: Domain name=LRR_1; Domain location=17-38; Score =12.3; E_value=1.4; Accession=PF00560.23; Description=Leucine Rich Repeat
  Pfam annotation: Domain name=LRR_1; Domain location=39-61; Score=8.6; E_value=7.2; Accession=PF00560.23; Description=Leucine Rich Repeat
  Pfam annotation: Domain name=Pkinase; Domain location=193-459; Score =77.5; E_value=4.2e-20; Accession=PF00069.15; Description=Protein kinase domain
  Pfam annotation: Domain name=Pkinase_Tyr; Domain location=192-459; Score=65.5; E_value=1.7e-16; Accession=PF07714.7; Description =Protein tyrosine kinase
  Pfam module annotation: Pfam domain module=LRR_1::LRR_1::Pkinase::Pkin ase_Tyr; Domain location=17-38::39-61::193-459::192-459
NNNFSGEISPKFNSLTRLATLYLERNNFTGSIPDLDAPPLDQFNVSFNSLTGSIPNRFSRLDRTAFLGNSLLCGKPLQLCPGTEEKKGKLSGGAIAGIVIGSVVGVLLILLLLFFLCRKNNRKNENETLPPEKRVVEGEVVSRESGGNSGSAVAGSVEKSEIRSSSGGGAGDNKSLVFFGNVSRVFSLDELLRASAEVLGKGTFGTTYKATMEMGASVAVKRLKDVTATEKEFREKIEQVGKMVHHNLVSLRGYYFSRDEKLVVYDYMPMGSLSALLHANGGVGRTPLNWETRSAIALGAARGIAYIHSHGPTSSHGNIKSSNILLTKTFEARVSDFGLAYLALPTSTPNRVSGYRAPEVTDARKISQKADVYSFGIMLLELLTGKAPTHSSLTEEGVDLPRWVQSVVQDEWNTEVFDMELLRYQNVEEEMVKLLQLALECTAQYPDKRPSMDVVASKIEEICHPSLEKEEGKNHDFKDADNGFSQ

SEQ ID NO: 143887 - protein, 82 aa, Glycine max
  Coding DNA Sequence Number=SeqID_27109
MYSYVAITPDCHPHNNVRPSRPGKIGGRCWALIRAENSPYNQQLLGTDDAEYLRHLRAWRSSQRERVWPYVVTWTMHYICHT

SEQ ID NO: 143888 - protein, 765 aa, Glycine max
  Coding DNA Sequence Number=SeqID_27110
  Gene Ontology: Mol. function=RNA binding; Cellular component =ribonucleoprotein complex; Biological process=regulation of translation
  Homolog annotation: Hit_ID=Q2R1U8; Match level="QueryCoverage=72%, HitCoverage=60%, E-value=1e-120, Identity=43%"; Hit description =CRS1/YhbY domain containing protein, expressed
  Pfam annotation: Domain name=CRS1_YhbY; Domain location=185-269; Score=45.3; E_value=2.1e-10; Accession=PF01985.11; Description=CRS1 YhbY domain
  Pfam annotation: Domain name=CRS1_YhbY; Domain location=410-494; Score=40.1; E_value=7.8e-09; Accession=PF01985.11; Description=CRS1 YhbY domain
  Pfam annotation: Domain name=CRS1_YhbY; Domain location=621-708; Score=108.7; E_value=1.6e-29; Accession=PF01985.11; Description=CRS1 YhbY domain
  Pfam module annotation: Pfam domain module=CRS1_YhbY::CRS1_YhbY::CRS1_ YhbY; Domain location=185-269::410-494::621-708
  Subcellular localization annotation: CTP_CleavageSite=61; ConfidenceScore=5.80e-01
MAFPNTCKLSELSFNSSFASLNHPHSSFRKFPFRTLTFASLPTPKPNPSAPWLTKSPSPKRAVEPLPAGDPTPDRKPQNAVDRIVLRLRNLGLPSEEEEQEQEHEEEIPATNPAPVTGEERLGELLQREWVRPDAVLVGEDDDEEEEMMLPWERDEEEKEVVVVSEEGLLKKRRVRAPSLADLTLEDELLRRLRREGMRVRERVSVPKAGLTEEVMEKIHKRWRKEELVRLKFHEELAKDMRKAHEIVEQILLSLVTSLHCGLVVLVFGWVWRNFSINIVQRRTGGLVTWRSGSVMMVYRGIDYQGPDSRKELNEKKGDGFFVPDVSKREDSTATSTSEKSEVVVREREHPENMSEAEAEYNALLDGLGPRFFGWWGTGILPVDADLLPRTVPGYKTPFRLLPTGMRSRLTNAEMTNLRKLAKSLPCHFAVGRNRNHQGLACAILKLWEKSLVSKIAVKRGIQNTNNELMAEELKMLTGGTLLLRNKYFIVIYRGKDFVPTSVAAVLAEREELTKQVQDVEDKVRCRAVDAIPSGQGEATAQAGTLAEFYEAQARWGREISPDEREKMMEEAAKAKTAKLVRQIEHKIFIAQTKKLRAEKLLAKIEASMVPAGPDYDQETITDEERVMFRKVGLRMKPYLPLGIRGVFDGVVENMHLHWKHRELVKLMTKQKTLAFVEDTARLLEYESGGILVAIEKVSKEFALIYYRGKNYKRPITLRPRNLLTKGKALKRHVAMQRHEALSQHITELEKTIEQMKKELRRGHS

SEQ ID NO: 143889 - protein, 147 aa, Glycine max
  Coding DNA Sequence Number=SeqID_27111
  Gene Ontology: Mol. function=hydrolase activity; Biological process =aromatic compound metabolic process
  Homolog annotation: Hit_ID=Q9LF16; Match level="QueryCoverage=86%, HitCoverage=37%, E-value=2e-41, Identity=60%"; Hit description =Lipase-like protein
MAAITTKEQQVVVNYMSEELQTIFLSNLDEAPARRRAREAFKDIQLAIDHCLFRLSSDGVKTKEVYEVNSRGLKIFSKSWLPESSHLKAIICYCHGVARKLASSGYGVFALDYPGFGLSDGLHGYIPSFESLVNDVIEHFSKIKGEI

SEQ ID NO: 143890 - protein, 525 aa, Glycine max
  Coding DNA Sequence Number=SeqID_27112
  Gene Ontology: Mol. function=structural constituent of ribosome; Cellular component=intracellular; Biological process=translation
  Pfam annotation: Domain name=DUF1666; Domain location=331-496; Score =139.1; E_value=1.2e-38; Accession=PF07891.2; Description=Protein of unknown function (DUF1666)
MSCSKEEALVRLFYNASSSFHLLFLFLFSSSVLLFKFINFIGSFTIFQRDHHYEYVSSEYDDEEEEIQESYSYVHDSIESDHLVADIICGGETLLFVHKNQPQRTHSSSDEFTSPRDSLVEDLEENYSTETLSFHKSPLVSDFENEQDAEEFPAEDADSVPNSVPAESRPTSPITLNLYKSDLVDSDKNYDEDHVEIGVIENKKVQEESLTRDERFFAYAPTLLEAKKLIVEEKDDEEIYGDSCTVGSTSKSSSEWRSSINCRDSGTEDPFSSSSRRSCPKWESYTVFQKYDEEMTFLDRISAQKLHETERIVFKFSSMNKKPGDMRHNPYRELEAAYVAQICLTWEALNWNYKNFQTKRASRGQDVDVGCPATVAQRFQQFQVLLQRYVENEPYEHGRRPEIYARVRHLAPKLLLVPEYREKDESERSSAFPQMLEEEKVEGRRRDGDFDGTHRPQSVSRVLRMSELSEEQLHWCEEKMSKVRPEMRGKLGKDECLGHLMNIESERPKTKQGMKIETRIALVCL

SEQ ID NO: 143891 - protein, 65 aa, Glycine max
  Coding DNA Sequence Number=SeqID_27113
MLFEQYRIKASRNRSHDKSLGPTHLKVLAGYGSLADEDGLTWSLGLASGVGQQIKAMKGLHDSVY

SEQ ID NO: 143892 - protein, 136 aa, Glycine max
  Coding DNA Sequence Number=SeqID_27114
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=P59229; Match level="QueryCoverage=50%, HitCoverage=41%, E-value=2e-11, Identity=55%"; Hit description =Vacuolar ATP synthase 16 kDa proteolipid subunit 4
  Pfam annotation: Domain name=ATP-synt_C; Domain location=67-123; Score=-2.3; E_value=0.02; Accession=PF00137.12; Description=ATP synthase subunit C
MAEYSLLACLAGTTGGIAAYVEEYPAISVGGFRSSRFCSWGHAYVANSTGGTTPRRDPLRKMLKKRPLYEGMGATYGTTKSGVGVASIGVMRSELVMKSIVPVVMVGVLGIYGLIIVVIITIGINSKAKSYYLFDG

SEQ ID NO: 143893 - protein, 81 aa, Glycine max
  Coding DNA Sequence Number=SeqID_27115
  Gene Ontology: Mol. function=catalytic activity; Biological process =metabolic process
MNVKRREDIVAMLPRKRILMRHGNSTCPLRSHPIDVPRVQTVFLEEEDYWREGRVASSRTGLRKLSREREDEGYKGNMQTF

SEQ ID NO: 143894 - protein, 90 aa, Glycine max
  Coding DNA Sequence Number=SeqID_27116
  Gene Ontology: Cellular component=integral to membrane
  Homolog annotation: Hit_ID=UPI0000162E08; Match level="QueryCoverage =76%, HitCoverage=7%, E-value=6e-24, Identity=71%"; Hit description =calcium ion binding / oxidoreductase
  Pfam annotation: Domain name=NADPH_Ox; Domain location=1-45; Score =2.6; E_value=6.6e-06; Accession=PF08414.1; Description=Respiratory burst NADPH oxidase
  Pfam annotation: Domain name=efhand; Domain location=46-74; Score =20.0; E_value=0.0084; Accession=PF00036.22; Description=EF hand
  Pfam module annotation: Pfam domain module=NADPH_Ox::efhand; Domain location=1-45::46-74
MEDSKEFAVCIFDALVRRKERRVSSINREELHEFWLQISDQSFDARLQIFFDMADSNEDGRITREEVQEVRFKILKNMRISTKLFTTIIY

SEQ ID NO: 143895 - protein, 471 aa, Glycine max
  Coding DNA Sequence Number=SeqID_27117
  Gene Ontology: Mol. function=oxidoreductase activity; Cellular component=integral to membrane; Biological process=electron transport
  Homolog annotation: Hit_ID=O81211; Match level="QueryCoverage=93%, HitCoverage=45%, E-value=1e-168, Identity=65%"; Hit description =Respiratory burst oxidase protein E
  Pfam annotation: Domain name=FAD_binding_6; Domain location=291-386; Score=-16.8; E_value=0.025; Accession=PF00970.14; Description =Oxidoreductase FAD-binding domain
  Pfam annotation: Domain name=FAD_binding_8; Domain location=289-407; Score=168.0; E_value=2.4e-47; Accession=PF08022.2; Description=FAD -binding domain
  Pfam annotation: Domain name=Ferric_reduct; Domain location=92-248; Score=149.4; E_value=9.3e-42; Accession=PF01794.9; Description =Ferric reductase like transmembrane component
  Pfam module annotation: Pfam domain module=FAD_binding_6::FAD_binding_ 8::Ferric_reduct; Domain location=291-386::289-407::92-248
MLLLEKDRYMNYSRQLSTASVNWSQNMPDLRPKNEVQRLCRTLQCLALEYWRRGWILLLWLVTTACLFAWKFYQYRNRSTFQVMSYCIPIAKGAAETLKLNMALILLPVCRNTLTWLRSTGARKFVPFDDNINFHKIIAFAIAVGIAVHAGNHLACDFPLLVNSSPEKFSLISSDFHNKRPTYKSLLTGVEGVTGISMVVLMAISFTLATHHFRRNAVRLPSPFNRLTGFNAFWYSHHLFGLVYVLLLVHGTFLYLTHRWYQKTTWMYISVPLLLYIAERTLRTRRSAHYTVKILKVSGLPGNVFSLLMSKPNGFKYKSGQYIFLQCPKVSPFEWHPFSITSAPGDEYLSVHIRTVGDWTQELKHLLTKEDDKLPSVNCQATFGELMQLDQRGQPRLLVDGPYGAPAQDYQNFDVLLLIGLGIGATPFISILRDLLNNTRAMDELVVQESNTETSQTTRSDESSNSFTSSN

SEQ ID NO: 143896 - protein, 117 aa, Glycine max
  Coding DNA Sequence Number=SeqID_27118
  Gene Ontology: Mol. function=oxidoreductase activity; Cellular component=integral to membrane; Biological process=electron transport
  Homolog annotation: Hit_ID=UPI0000162E08; Match level="QueryCoverage =59%, HitCoverage=7%, E-value=2e-29, Identity=87%"; Hit description =calcium ion binding / oxidoreductase
  Pfam annotation: Domain name=NAD_binding_6; Domain location=2-91; Score=-13.0; E_value=0.00069; Accession=PF08030.2; Description =Ferric reductase NAD binding domain
MSQGQIELHNYLTSVYEEGDARSTLITMIQALNHAKHGVDILSGTRVRTHFARPNWKEVFTKIAAKHPFATVEMGGSSRWKLWIIQSKACTGQNNPTYKELWIYLCSIDHDEEMNIF

SEQ ID NO: 143897 - protein, 128 aa, Glycine max
  Coding DNA Sequence Number=SeqID_27119
  Gene Ontology: Mol. function=dimethylaniline monooxygenase (N-oxide -forming) activity; Cellular component=intrinsic to endoplasmic reticulum membrane; Biological process=electron transport
  Homolog annotation: Hit_ID=Q9LMA1; Match level="QueryCoverage=72%, HitCoverage=30%, E-value=4e-17, Identity=38%"; Hit description =Probable flavin-containing monooxygenase 1
MCCRCHRCDLVTASHRQVLHPVVSGAAPPLWRIEFEDNSKLEADVVVLATGFDGKKKLKSILPHPLRSLGTVYPLIPSMAFVGSRPGVEKMLSQTLEEMDVMKRSTRKKNWITEAFSPYSSEDYRKKD

SEQ ID NO: 143898 - protein, 113 aa, Glycine max
  Coding DNA Sequence Number=SeqID_27120
  Gene Ontology: Mol. function=DNA binding; Cellular component=oxygen evolving complex; Biological process=DNA integration
  Homolog annotation: Hit_ID=Q1ST43; Match level="QueryCoverage=98%, HitCoverage=8%, E-value=1e-33, Identity=60%"; Hit description =Integrase, catalytic region; Peptidase aspartic, catalytic
MATVRVVLALASINRWHLHQLDVSNTFLHWDLREDVYMETPPSLLGYTSSQSCKLKKSLYGLKQSSRQWYEKLSNLLLICGYSHAHADHSLFIMPHNSEFTALIVYVDDIVLT

SEQ ID NO: 143899 - protein, 69 aa, Glycine max
  Coding DNA Sequence Number=SeqID_27121
  Subcellular localization annotation: CTP_CleavageSite=53; ConfidenceScore=5.29e-01
MATSGSSSEDNLTPPPPPPSLSHITMVQYQQLMNLLSKSSGPGGASSETTLTQANLIHSNPNQIHNSDF

SEQ ID NO: 143900 - protein, 316 aa, Glycine max
  Coding DNA Sequence Number=SeqID_27122
  Gene Ontology: Mol. function=hydrolase activity, acting on ester bonds; Cellular component=cellulose and pectin-containing cell wall; Biological process=lipid metabolic process
  Homolog annotation: Hit_ID=Q9LJP1; Match level="QueryCoverage=92%, HitCoverage=77%, E-value=1e-51, Identity=40%"; Hit description=GDSL -motif lipase/hydrolase-like protein
  Pfam annotation: Domain name=Lipase_GDSL; Domain location=51-310; Score=116.3; E_value=8.7e-32; Accession=PF00657.12; Description=GDSL- like LipaseAcylhydrolase
  Subcellular localization annotation: CTP_CleavageSite=71; ConfidenceScore=5.33e-01
MTKQNFPLGCSVVCISIILIQFIASMNFSTSQSFKNETSSISTTTTTTKAFFIFGDSTVDSGNNNYLNTIPENKADYKPYGQNGFFQEPTGRFSDGRVIVDFIAEYAKLPLLPPFLQPNADYSNGANFASGGAGVLAETHQGLVIDLQTQLSHFEEVTKLLSENLGEKKAKELISEAIYFISIGSNDYMGGYLGNPKMQESYNPEQYVGMVIGNLTHAVQSLYEKGARRFGFLSLSPLGCLPALRALNQEANKGGCFEAASALALAHNNALSNVLPSLEHVLEGFKYSNSNFYDWLRDRIDNPANYGMYCNMRPIN

SEQ ID NO: 143901 - protein, 125 aa, Glycine max
  Coding DNA Sequence Number=SeqID_27123
MAEWYSSLVYVEDRDVLYETCEPMVERVLDFIGYVVVGVRIGIFSSCPNTYPVYWRPKPFFGLRPKEGFYVKYLLLQIFLSTKHQGHTMHQLMWCLIPARIPKESTSTRRGITVTSKWLEEPSGH

SEQ ID NO: 143902 - protein, 249 aa, Glycine max
  Coding DNA Sequence Number=SeqID_27124
  Gene Ontology: Mol. function=RNA-directed DNA polymerase activity; Biological process=RNA-dependent DNA replication
MVSPHSALNMPPITFTLDDFKGIEPVQDDRMAISIEIVNCIIKKTFVDQGSLADILFQHTFKQMEIPESKILSHDDPLFGFAGEQVGTNRCIWLYIKFEHKGPLQKRLKITYVIMLSHTSYNMFLGRPSLNALDTIFSIPYLDMKFWSDSGTIITVHVNQRMARECYMTSLRLHSHAKEEAPKFFHYIEAKTKIEEVEELELNLRTNDDNWMKPVEETSTFQLNLKEGQVAQLRNQLFSDNRSRIQRTI

SEQ ID NO: 143903 - protein, 133 aa, Glycine max
  Coding DNA Sequence Number=SeqID_27125
  Gene Ontology: Mol. function=DNA binding; Cellular component =mitochondrion; Biological process=DNA integration
MGYQMMEKVALTLVNAAHLRQYFQSHRITIQADCPIAKILRKLELTGRVMAWSIELIEYEIVNKPKRDIRAQVLANFFLHNHVWSRNGGRCVWMAPPIDMEAEYEAFLARLRHAREVGTQRVRRRSNSKDEAE

SEQ ID NO: 143904 - protein, 103 aa, Glycine max
  Coding DNA Sequence Number=SeqID_27126
  Gene Ontology: Mol. function=hydrolase activity, acting on ester bonds; Biological process=lipid metabolic process
  Homolog annotation: Hit_ID=UPI000004839A; Match level="QueryCoverage =80%, HitCoverage=22%, E-value=1e-16, Identity=46%"; Hit description =carboxylic ester hydrolase/ hydrolase, acting on ester bonds / lipase
MEGFKDGVHACRGSGPYGGVFSCGGTKKVIEYFSLCDNVGEYVWWDSFHPTEKIHEQLSKALWNGPPSSVGPYNLENFFNKEIKLTIADVVDAPQIQNGEFHY

SEQ ID NO: 143905 - protein, 165 aa, Glycine max
  Coding DNA Sequence Number=SeqID_27127
  Gene Ontology: Mol. function=catalytic activity; Biological process =cellular metabolic process
  Homolog annotation: Hit_ID=A0EJL8; Match level="QueryCoverage=48%, HitCoverage=21%, E-value=5e-38, Identity=92%"; Hit description=GDP-D- mannose-3',5'-epimerase
MWLPFMRKLVTFSILHISLLLSPNGSTLSLKNLIENEYGEQSKLQGAASQNYVNWTAKMAVEMGTGVSWVMCKEDDAPDLVNLVGVLRLTKSNFREPVNIGSDEMVSMNEMAEIILGFENKNIPIHHIPGPEGVRGRNSDNTLIKEKLGWAPTMRLKDGLRITYF

SEQ ID NO: 143906 - protein, 58 aa, Glycine max
  Coding DNA Sequence Number=SeqID_27128
MGVCALLYMGSWKRLVAQQCLCSWWRLAARLDSGGNGGLWHNDMHYMMVACGRGACLD

SEQ ID NO: 143907 - protein, 164 aa, Glycine max
  Coding DNA Sequence Number=SeqID_27129
  Gene Ontology: Mol. function=hydrolase activity, acting on ester bonds; Biological process=lipid metabolic process
  Homolog annotation: Hit_ID=Q8L8G1; Match level="QueryCoverage=63%, HitCoverage=28%, E-value=4e-24, Identity=49%"; Hit description =Lipase SIL1
MALIALYLKANKSDSFEAAFALDLAHNNALNNVLTSLKHFLEGFMHSNSNFYDWLLDRIDNPTNYGFKDKINACCGSGPFGGIFTCGGTMKVTKYNLCDNVEEYVWWDSIHGTEKINEQFSKALWNGPPSFVGPYNLKNFFNNEMIKLTIVDVGYVRQDISVSF

SEQ ID NO: 143908 - protein, 52 aa, Glycine max
  Coding DNA Sequence Number=SeqID_27130
MVGAFLQNRVTLTDHLMILLSESDLTYPLCGELAYDEFHAGDGGLSCDRGML

SEQ ID NO: 143909 - protein, 119 aa, Glycine max
  Coding DNA Sequence Number=SeqID_27131
MDPKKSNRALGFPALVAGLCQSYRVPVPQARSCHRDIGIAPAKTPSGPGAVQQGPGFYGVPVTSGKGIRPPTNRAFIKKYSIPRQAQGETPQQPGDGQQRATDAPPSPLEFTSAHPQKG

SEQ ID NO: 143910 - protein, 245 aa, Glycine max
  Coding DNA Sequence Number=SeqID_27132
MGEGKEQKLEDAPDILSFYFTRSARRYGFVRFKQVDNAKKLDRQLDNLVLGGLKLHVNLPKHGRKQNPTETINKKHKEKEEIAIEKVEERDKGKGKGTAEHMTMTKGLQQQNPQRATGFRSYVNVVATGSKHLTKRWTPKYVQASNMTAHSSIQLTISMDKTWLTKAWVGRLRNLMAFDRLEEELMWDEGEEIKPKYIGGNMVLLIGLADIRTEELCREGVESGLSMFHTLEKWSPSLRLGFRLV

SEQ ID NO: 143911 - protein, 43 aa, Glycine max
  Coding DNA Sequence Number=SeqID_27133
ALVFIRFGDPFAAHDRNQWVVVSWERSAIKFSYQSSGAFSLLG

SEQ ID NO: 143912 - protein, 227 aa, Glycine max
  Coding DNA Sequence Number=SeqID_27134
  Gene Ontology: Mol. function=RNA-directed DNA polymerase activity; Biological process=RNA-dependent DNA replication
  Homolog annotation: Hit_ID=Q8H6Q8; Match level="QueryCoverage=97%, HitCoverage=47%, E-value=8e-29, Identity=33%"; Hit description=CTV.20
YNYWDYIDAWTNVFWHQNSKFKHSWLIYFKNNTVYNFPNWLLQWWNYFGLIPQIFPEEVQQGFQQFTKLFNSKESRIPADLKYFSSFALSWIFSWQYRYGKTENIKQYPPLQRHAFVKWWSQFDTSKAAPEQVKNWFQSNPEFLKPTDPETSLFLNQKSQLAAFLASSKSKESLAQNLKEVLQLLQQEEEEEPPKKEAESSEKNDDQEDDPFYQNEDDCFGISLDDD

SEQ ID NO: 143913 - protein, 233 aa, Glycine max
  Coding DNA Sequence Number=SeqID_27135
  Gene Ontology: Mol. function=protein translocase activity; Cellular component=type II protein secretion system complex; Biological process=protein secretion by the type II secretion system
  Homolog annotation: Hit_ID=UPI000068BCA2; Match level="QueryCoverage =96%, HitCoverage=21%, E-value=9e-49, Identity=45%"; Hit description =putative protein-export transmembrane SecDF protein
  Pfam annotation: Domain name=Sec_GG; Domain location=147-175; Score =30.8; E_value=4.7e-06; Accession=PF07549.4; Description=SecDSecF GG Motif
MVVLECIVLTMAMAVDTNVIIYERTKEELFAGKSILEAYKDGFKHALNAIIDGHSTTFLTAVVLFFFGTGPIKGFALTLMIGIAMTLFTSVLLSRVMIFNRLNKGKHLSVWTAPTKNLFRNTWIDFIGKRKYAYIISAILTVICIGSIATQGFKYGIDFTGGRNYVVRFDKDVNAEDIEQNLVKMFKTEDGKNSSVEAKTFGNSKQLKISTDYLIDDESLKADQTVEQKLYEG

SEQ ID NO: 143914 - protein, 96 aa, Glycine max
  Coding DNA Sequence Number=SeqID_27136
  Homolog annotation: Hit_ID=Q0MX19; Match level="QueryCoverage=53%, HitCoverage=28%, E-value=8e-07, Identity=50%"; Hit description =Leucine rich protein
MGDKLHRREGNSPDHQLRPLNDRSVIKEVGVQRQPGGERSALEGRTRASSAGRSGSENVGLSNATLVRIQCLENPRVPPQGSSRRVSQGLRSGRRA

SEQ ID NO: 143915 - protein, 173 aa, Glycine max
  Coding DNA Sequence Number=SeqID_27137
  Homolog annotation: Hit_ID=UPI0000E45228; Match level="QueryCoverage =25%, HitCoverage=20%, E-value=3e-10, Identity=79%"; Hit description =conserved hypothetical protein
MSISPSLSPRQCPDRYAFRAGRNLPDKEFRYLRTVIVTAAVHRGFGVSPHTWSYDFAETCVFGKQSPGPGHCDPLCEEAPLLPKLRGYFAEFLRESCLAPLGILYLPTCVGFGYRYPFVEGRSSFSWEYGMDYFSAVAPGTRTLARGIFSTPYYPEKAGAPCVLEPITIFRLT

SEQ ID NO: 143916 - protein, 128 aa, Glycine max
  Coding DNA Sequence Number=SeqID_27138
  Gene Ontology: Mol. function=DNA binding; Biological process =transposition, DNA-mediated
  Homolog annotation: Hit_ID=P06956; Match level="QueryCoverage=89%, HitCoverage=33%, E-value=1e-15, Identity=37%"; Hit description =Recombinase cre
  Pfam annotation: Domain name=Phage_integr_N; Domain location=25-104; Score=6.0; E_value=0.02; Accession=PF02899.8; Description=Phage integrase, N-terminal SAM-like domain
MSKTDTLPGITASPALMHSADEDIAERLIEFVSDKEAFSDNTWRQLLSVMRIGSRWATEHGRQFLPMDPADLRDYLLWLLASGRASSNIATHAALISMLHRNAGLVPPNVSPLVFRAVKIINRSAVIA

SEQ ID NO: 143917 - protein, 71 aa, Glycine max
  Coding DNA Sequence Number=SeqID_27139
MWMLVSLVLLAECPVSTCLVGATGGLPSQHLSRWCYWRVACIALGAGGTQPRLARASGGIHGVADAAGGIK

SEQ ID NO: 143918 - protein, 126 aa, Glycine max
  Coding DNA Sequence Number=SeqID_27140
DFAQVQKNTRHLLVVERAVQNEFWMFAMRKAVILVGVLGRVFCLCPVFLAVMLGRIDGDPVLRETRIWATWEYVSSVGGGQQGMSGTWRYVAGVRRPWGRQASSWQSTDKRNKDHKARRLVVAGQL

SEQ ID NO: 143919 - protein, 103 aa, Glycine max
  Coding DNA Sequence Number=SeqID_27141
  Subcellular localization annotation: CTP_CleavageSite=90; ConfidenceScore=5.25e-01
MSPPPLEPNNHSQTHLKLSGWLPLLAQFSASGLVGACTLSATLDRLARISEFQLSTRLLAQQMDSSGALSGMVPHSTNMHNSSFFQILPRAQPKGWCAQGMAS

SEQ ID NO: 143920 - protein, 298 aa, Glycine max
  Coding DNA Sequence Number=SeqID_27142
  Gene Ontology: Mol. function=N-acetyltransferase activity; Cellular component=outer membrane-bounded periplasmic space; Biological process=metabolic process
  Homolog annotation: Hit_ID=Q6D584; Match level="QueryCoverage=45%, HitCoverage=41%, E-value=4e-50, Identity=70%"; Hit description=ABC transporter, substrate binding protein
  Pfam annotation: Domain name=Acetyltransf_1; Domain location=191-270; Score=63.5; E_value=7e-16; Accession=PF00583.14; Description =Acetyltransferase (GNAT) family
SPITSLSKAEDIAGLRIIVGSGTNQEAILLAWDKENQAKGLKPFTPVYTKDDAAQTLALQAGRADAYFGPNVIGAWKAALTKKTRLVGSVDGGWPKAAHIAVTVKKDNGLVQPINTALNGVIKNGDYDKVLNRWGGMSQQFFREVSPEAPELQPILDGLFGEYAARYGDFFRKHNEVELTEWYLPPRGLFIVLERDGEIIAMGAYKPWDATTAELKRIWTRRDLRRQGLALLILQELERRALRAGYQRVFLTTGFRQPEAVQLYIGHGYQPQFELREDMEIYGQPPHDGRLRFLKVID

SEQ ID NO: 143921 - protein, 219 aa, Glycine max
  Coding DNA Sequence Number=SeqID_27143
MVKEFYANLYSPKDQSPKQVRVRGHLIRIDADSLNTFLETTIVLEEGETLPTYYRFTRMRIDPQEFAARLYIPGRDLTTHAQTWSVLSYNNLTPTSHTSDLNMDRARLVYGLVTGMDMNIGALISGHISTIAQSNSSRLGFPALITALCRARGVTSDTLTYESLSPTINLTYINKNCWNVDDLIVNFRGARKVRARPADIPSSSAPPAPPTSATPTLAA

SEQ ID NO: 143922 - protein, 161 aa, Glycine max
  Coding DNA Sequence Number=SeqID_27144
HPEEPFFRKNYFFRKLSGRGVPGGSSGRPLVSSGIFPKQLLSEVPEKPLTDLPKVAAISPLSPFFPASSTLVFYPNITILRFHCYNNVGYYNQRRVRETNLEASFVEKKKQLGAWLTEKKKQLDGVEDARTGRTKIAIGSASLGGGGTFHNFLLKGKMAHS

SEQ ID NO: 143923 - protein, 105 aa, Glycine max
  Coding DNA Sequence Number=SeqID_27145
  Homolog annotation: Hit_ID=Q1S895; Match level="QueryCoverage=50%, HitCoverage=7%, E-value=9e-09, Identity=52%"; Hit description=GRAS transcription factor
  Subcellular localization annotation: CTP_CleavageSite=48; ConfidenceScore=5.30e-01
MKTPQSHFLSLPPPPAIPQPYPASTELSRKEHTNSTQMLLENSVCFTVGFMAANLVILEAAFEEKTETSRGSNICTLNALSTCEQNVAVKIAAVAANGGEERLRA

SEQ ID NO: 143924 - protein, 186 aa, Glycine max
  Coding DNA Sequence Number=SeqID_27146
  Gene Ontology: Mol. function=homoserine O-succinyltransferase activity; Cellular component=cytoplasm; Biological process =methionine biosynthetic process from homoserine via O-succinyl-L -homoserine and cystathione
  Homolog annotation: Hit_ID=P07623; Match level="QueryCoverage=99%, HitCoverage=60%, E-value=1e-87, Identity=79%"; Hit description =Homoserine O-succinyltransferase
  Pfam annotation: Domain name=HTS; Domain location=1-176; Score=194.7; E_value=2.1e-55; Accession=PF04204.6; Description=Homoserine O -succinyltransferase
IQRVLHWAKEHVTSTLFVCWAVQAALNILYGIPKQTRQNKLSGVYEHQILHPHALLTRGFDDNFLAPHSRYADFPSQLIRDYTDLELFAESESTGAYLMASKDKRLAFVTGHPEYDALTLSGEYHRDYEAGLHPEVPFNYFPQDNPELPPRATWRSHGNLLFSNWLNYYVYQITPFDLRHMNPTLE

SEQ ID NO: 143925 - protein, 176 aa, Glycine max
  Coding DNA Sequence Number=SeqID_27147
  Gene Ontology: Mol. function=transposase activity; Biological process= transposition, DNA-mediated
  Homolog annotation: Hit_ID=Q1SC10; Match level="QueryCoverage=57%, HitCoverage=20%, E-value=9e-22, Identity=40%"; Hit description =Ubiquitin-activating enzyme, E1; Transposase, IS4
MESSIVDALAASRKRRRDEEEEEELEQAFFIIVSVVTMLLGALTWYHDKYFVKEPARNLELELCTLVPIAEAMTMFLHILAHNLKYRVVNFSYCRSMEIITLDGIHIPVTVAAEDRPRYRNKKGDISTNVLGVCGPDLKFIYVLPGWEGSAGDSGVLRDVLHRQNCLYIPNDNIMK

SEQ ID NO: 143926 - protein, 73 aa, Glycine max
  Coding DNA Sequence Number=SeqID_27148
  Subcellular localization annotation: CTP_CleavageSite=31; ConfidenceScore=5.02e-01
MILDLADSTSNRQHLHKLTFCPPGKPLSIPRCRPARKNEVESFNKEDIMEMRRRYLNQKTMRRSLSDLEFEEV

SEQ ID NO: 143927 - protein, 116 aa, Glycine max
  Coding DNA Sequence Number=SeqID_27149
MAFAKALTIMSETSERKIDILEKINLSQVVGSSFKATVWEVVGQNNEDNNKLMACLASLKNLKELEDCHVNIIRSLVNDSDEEIESVMQLYIMFEYTNLLNPKPQPQRTSILKGHE

SEQ ID NO: 143928 - protein, 143 aa, Glycine max
  Coding DNA Sequence Number=SeqID_27150
  Subcellular localization annotation: CTP_CleavageSite=80; ConfidenceScore=5.27e-01
MAVWAETKGPGVSLGVLAPNYGGSSDFSEGISILGSASSASRSSSTMRRKNREAHLWPLVNFASQLKQRPLSLQLAISSRVSLLKGKGGGLAGEGKRGSVGGKGELEGSEPSNLGTSSFMWGGWVKGVVDVGMADEEEGDGSC

SEQ ID NO: 143929 - protein, 274 aa, Glycine max
  Coding DNA Sequence Number=SeqID_27151
  Gene Ontology: Mol. function=chromatin binding; Cellular component =chromatin; Biological process=chromatin assembly or disassembly
  Homolog annotation: Hit_ID=Q1SAV4; Match level="QueryCoverage=79%, HitCoverage=69%, E-value=2e-49, Identity=40%"; Hit description =Integrase, catalytic region
  Pfam annotation: Domain name=Chromo; Domain location=205-262; Score =15.1; E_value=0.016; Accession=PF00385.14; Description='chromo' (CHRromatin Organisation MOdifier
MQKGHIWLPKRLPAIQIILAEFHFTPTGGHIGVAKTLARELFKLSGTKLHMSFAYHPQSDGQTKWSYNTSTHTTTGMSPYEVMFGKKPPSIPQYLTGMTNVEVVDDWLSQRDVILTREWLLVKLRPRRQTSVTEGLYSKLAKRFYGPFQVTKKIGPVAYQLNLPATSRIHPIFHYSLLKPYLPPTNLVDVPILLQNSAEDNQPIITPLTILDTKWENIDNGRQLLVLVQWKGLFLEDTSWEKCEDLKLEYNLEDKVVLEAHRDVMTNSIEQQDT

SEQ ID NO: 143930 - protein, 121 aa, Glycine max
  Coding DNA Sequence Number=SeqID_27152
  Gene Ontology: Mol. function=protein serine/threonine kinase activity; Cellular component=membrane; Biological process=protein amino acid phosphorylation
  Homolog annotation: Hit_ID=Q1S7U2; Match level="QueryCoverage=92%, HitCoverage=39%, E-value=3e-40, Identity=69%"; Hit description =Protein kinase
  Pfam annotation: Domain name=Pkinase_Tyr; Domain location=5-121; Score=-160.4; E_value=0.013; Accession=PF07714.7; Description =Protein tyrosine kinase
MDPSNLKIPMPSCGQKPVPSKACCVIAEFLPGGTLKQYLFKNRQNKLPYKVLIQLALDLSRGLSYLHSKKIVHRDVKTDNMLSDANQNVKMADFDVARVEAINQSEMTGETGTYELWHRRF

SEQ ID NO: 143931 - protein, 72 aa, Glycine max
  Coding DNA Sequence Number=SeqID_27153
  Gene Ontology: Mol. function=homocysteine S-methyltransferase activity; Biological process=methionine biosynthetic process
  Homolog annotation: Hit_ID=Q8LAX0; Match level="QueryCoverage=57%, HitCoverage=12%, E-value=3e-11, Identity=66%"; Hit description =Homocysteine S-methyltransferase 3
MGVTKSKSTYTHSAYTATLVKSSGAAEDDFISYIGKWRDAGASLFGGCSKTTPNTMRGTAEATYGKLKDKCI

SEQ ID NO: 143932 - protein, 210 aa, Glycine max
  Coding DNA Sequence Number=SeqID_27154
DPLVLEEGQHCEFGQRRNRADGFDEEAIAQLLCTPGQDFTRTTAGRRVRIMRTSMTTLTQMWMTLLLSNVLPSDHNSDLPLPECQLVYAILTRMSVHVAQVIADAIYLFAGMPPTRHPLDPDKSSRALGFPALITGLYQSFGVPVTPSKVIRSPITRAFIEKYCTPRQAQGDAHQATDAPPPPRQADPAGSLGMEHYLQHLVRQQAANHR

SEQ ID NO: 143933 - protein, 145 aa, Glycine max
  Coding DNA Sequence Number=SeqID_27155
MGVQGGKQGGIGAVLLDELEVIVGNFNFVVRNLRRKLRWKNDFILLLPHRSAWWLDENMRPKQVDPIARYDFSGRVGNADRFVHLWVESENRRSDVATAKMNKGATITNDKTTTDVKTISPMKGVRQKLTGHEQHEISRDSRKKE

SEQ ID NO: 143934 - protein, 179 aa, Glycine max
  Coding DNA Sequence Number=SeqID_27156
  Gene Ontology: Mol. function=protein kinase activity; Cellular component=nuclear speck; Biological process=fat cell differentiation
  Homolog annotation: Hit_ID=Q656B0; Match level="QueryCoverage=80%, HitCoverage=17%, E-value=1e-32, Identity=49%"; Hit description =Putative Noc3p
  Pfam annotation: Domain name=NOC3p; Domain location=77-170; Score =137.4; E_value=3.8e-38; Accession=PF07540.2; Description=Nucleolar complex-associated protein
TKTVSENDPSEEGTGEDVNKDKGMVKLTKAEKRAKLKKMRKEAKQQGKEVAKAEVEETPQAAVLAEVKEDLTVEEAFESKKHKLAELGNALLTDPESNIKFLKEMVQISKDNDDTIVKLGLLSLLAVFKDIVPGYRIRLPTEKELEMKVSKTVRKMRYYESTLLSAYKVHINAQVLRLL

SEQ ID NO: 143935 - protein, 251 aa, Glycine max
  Coding DNA Sequence Number=SeqID_27157
  Gene Ontology: Mol. function=molecular_function; Cellular component =nucleus; Biological process=fat cell differentiation
  Homolog annotation: Hit_ID=Q656B0; Match level="QueryCoverage=87%, HitCoverage=25%, E-value=5e-53, Identity=51%"; Hit description =Putative Noc3p
MAKRIEDEQKFKNNKSKKRKNLEASNQLENERKKSRKEMISKTREEVEADYKAASLAPDVMEKKHMQTETLSAVFETYFRILKHTMQSIRARPEANTGALSSAVELLPLLAPCLKGLAKFSHLIDLDFMGDLMNHLRVLASGSSNSGNTSDKCSKCLTVSERLQCCIVAFKVMRNNLDALNVDLQDFFLHLYNLVLEYRPGRDQGEVLAEALKIMLCDDKQHDMQKTAAFIKRLATLSLCVGSADSMAGMF

SEQ ID NO: 143936 - protein, 128 aa, Glycine max
  Coding DNA Sequence Number=SeqID_27158
MDTGLGYRTKQRITQFFDQEYKRIPRKGAKWSFYFSRPQLARLVSGSPRPWNYLLAKQSAHLGEFISSGLRHDGGSFKGLEGTTLKGVERIERKEEERRGNEVKTLPNRDRDQSLRRFLFCVLRAAVS

SEQ ID NO: 143937 - protein, 97 aa, Glycine max
  Coding DNA Sequence Number=SeqID_27159
MKKGEDSSLARKCNECDQPEYLRFDCPVLKRRMEKSDKRNFKEKKEKKAYITWEDNDLDSSSDSENEIINLGLMANDYESGEELEGGSWKLKLEVGS

SEQ ID NO: 143938 - protein, 62 aa, Glycine max
  Coding DNA Sequence Number=SeqID_27160
  Gene Ontology: Mol. function=nucleotide binding; Cellular component =cytoplasm; Biological process=small GTPase mediated signal transduction
  Homolog annotation: Hit_ID=Q8W4C8; Match level="QueryCoverage=82%, HitCoverage=28%, E-value=5e-21, Identity=96%"; Hit description=ADP -ribosylation factor-like protein
MGLWDSFLNWLRSLFFKQEMELSLVCLQNAGKTSLVNAIATGGYSEDMIPTVCIYLCFLIAS

SEQ ID NO: 143939 - protein, 79 aa, Glycine max
  Coding DNA Sequence Number=SeqID_27161
  Homolog annotation: Hit_ID=Q10PU3; Match level="QueryCoverage=74%, HitCoverage=6%, E-value=7e-09, Identity=57%"; Hit description=No apical meristem protein, expressed
MVGHQILAWQLCLTTVTELCMTAKNEDNSSEWRSKIGKLLEDGYNGGTIVMPTVPRKVAEYMCSQSPDSNISCSSPMSD

SEQ ID NO: 143940 - protein, 108 aa, Glycine max
  Coding DNA Sequence Number=SeqID_27162
  Gene Ontology: Mol. function=beta-galactosidase activity; Cellular component=beta-galactosidase complex; Biological process =carbohydrate metabolic process
  Homolog annotation: Hit_ID=Q1SN78; Match level="QueryCoverage=99%, HitCoverage=14%, E-value=9e-44, Identity=72%"; Hit description =Rhodopsin-like GPCR superfamily; D-galactoside/L-rhamnose binding SUEL lectin; Galactose-binding like
MRTSQILLVLLWFFCVYAPSSFGANVTYDHRALAIDGKRRVLMWPDLIQKSKDGGLDVIETYVFWNLREPVRGQYNFEGRCDLIKFVKVVAAAGPYVHLQIGPYACAE

SEQ ID NO: 143941 - protein, 293 aa, Glycine max
  Coding DNA Sequence Number=SeqID_27163
  Gene Ontology: Mol. function=GPI anchor binding; Cellular component =membrane; Biological process=cell adhesion
  Homolog annotation: Hit_ID=Q1SGD7; Match level="QueryCoverage=74%, HitCoverage=73%, E-value=5e-75, Identity=69%"; Hit description=Beta -Ig-H3/fasciclin
  Pfam annotation: Domain name=Fasciclin; Domain location=83-217; Score= 90.3; E_value=5.7e-24; Accession=PF02469.12; Description=Fasciclin domain
  Subcellular localization annotation: CTP_CleavageSite=89; ConfidenceScore=5.38e-01
MLKKQSLLSFSLALLVSFMYCTTTLAQLSPASAPLKPTQPTPTPPAAAPQQPLVPSLPQSPSDSTPDSTPAVDIVGILRKAKSFNILIRLMKTTQLINQLNAQLLTTKSGGITILAPDDSSFSELKAGFLNSVSDGQKLELLQFHVISDYVSSSNFDTLTNPVRTLAGAKPGKVELNVISYGGSVNISTGEVNTTITGIIYTDKHLAIYKVGKVLLPMDFFAVSKAPAKAPSLAPEPSAKAPKADKEKSLSPDSSESSEINSTNENSGTVNINVHAKWVPLVLGLVLMTVFLS

SEQ ID NO: 143942 - protein, 77 aa, Glycine max
  Coding DNA Sequence Number=SeqID_27164
MSTAAVVTVAMREPMVVEEPQLWTLDALKIWWRWCLYSKSGNPYLSRKGGINNDWWGEEAEPKYWQVIFPHPVEACI

SEQ ID NO: 143943 - protein, 571 aa, Glycine max
  Coding DNA Sequence Number=SeqID_27165
  Gene Ontology: Mol. function=inositol or phosphatidylinositol phosphatase activity; Biological process=abscisic acid mediated signaling
  Homolog annotation: Hit_ID=Q9LR47; Match level="QueryCoverage=99%, HitCoverage=98%, E-value=0.0, Identity=70%"; Hit description=Type I inositol-1,4,5-trisphosphate 5-phosphatase CVP2
  Pfam annotation: Domain name=Exo_endo_phos; Domain location=78-531; Score=154.3; E_value=3.2e-43; Accession=PF03372.13; Description =EndonucleaseExonucleasephosphatase family
MVRKFFNIKSKTEDSQANGVAYGGGDMEYRGRNSFSEREPCTIKKSKTEKFSRSTDQVRRAKMNLDHPRIIDVQNYSIFVATWNVAGRSPPSTLNLDDWLHSSSPADIYVLGFQEIVPLNAGNILGAEDNGPAKKWLALIRKALNNLPGTSGSSGCYTPSPIPHPLVELNADFEGSARQKNSSFFHRRSFQTTSSGWGMDNDPSVVQPRLDRRYSVCDRVIFGHRPSDFDPSFRWGYRPSDYSRASDYSRPSDYSRWGSSDDDNGLGDSPSTVLFSPMSCGGGGGAGPAFNEDGYAMPGHSRYCLVASKQMVGIYLTIWVRSELKDHVQNMKVSCVGRGLMGYLGNKGSISISMSVHETSFCFICSHLTSGQKEGDELRRNSDVMEILKKTRFPRVQGVDNEKSPQTILEHDRIIWLGDLNYRIALSYRSAKALVEMQNWRALLENDQLRIEQKRGRAFVGWNEGKIYFPPTYKYSTNSDRYAGDDMHPKEKRRTPAWCDRILWYGEGLHQLSYVRGESKFSDHRPVYGIFWAEVESAHGRLKKTMSCSRSRIEVEELLPYSGGYTELSFF

SEQ ID NO: 143944 - protein, 409 aa, Glycine max
  Coding DNA Sequence Number=SeqID_27166
  Homolog annotation: Hit_ID=Q1WK56; Match level="QueryCoverage=93%, HitCoverage=100%, E-value=6e-70, Identity=47%"; Hit description=CYC3
  Pfam annotation: Domain name=TCP; Domain location=92-327; Score =115.0; E_value=2.1e-31; Accession=PF03634.4; Description=TCP family transcription factor
MFSSTYDSNFFPNFPLSTYPILPFLIESENDFASHTLLVEDPLVVPLTHDPPPFPEETVANFAVADHHCTAMLDNQHDAAANTNYGSHYGSSISNFLTHQKPAAATAKKDRHSKIHTSQGLRDRRVRLSSEIARKFFDLQDMLEFDKPSNTLEWLFTKSENAIKELARSKHSGSVSTGGDKSSRDPSGDSNNNFNNNKSMVGGGVGDGSKGRKLKWAQRGDACIQNKKESRERARARARERTCFKKCSSIRVQQQKDFDERCPATTNTTQMLHQLWSSIQPEPEEPRARWVQPYYNPYFVDDNEAPRDHGFNVIEESIMIKRNMKPLSQPNLVIPREASFNNNEFPLLPYSTTPNWESTNGAVNYCGISTMNLSTCFMNPCQWHVKVLIKSSMVKSTDVLLVQGLQGSG

SEQ ID NO: 143945 - protein, 210 aa, Glycine max
  Coding DNA Sequence Number=SeqID_27167
KWPRESSPQRDPGRTPLEKALALPSQQTRITTAADSRAPSISSASRPSRDGHYSERGMMSSLTPMAKFDPEIVMEFYANAWPTEEGARDMRSWVRGQWIPFDADALSQFLGRPLILEEGQHCEYKQRRSQVSGFNEDAIAQLLCIPGQDFAWTAAGRRVQIMRSSMTTLTQIWMMLLLNNILPSDHNSDLPLPKCQLVYAILAQMSIHVA

SEQ ID NO: 143946 - protein, 75 aa, Glycine max
  Coding DNA Sequence Number=SeqID_27168
MVGAKSLVGNPYVDRLAKEEKITIGDMTKSMVKPRNILLTLKEHNANNYRTMKQVYNARYGYRSSIRGNNTKYNN

SEQ ID NO: 143947 - protein, 115 aa, Glycine max
  Coding DNA Sequence Number=SeqID_27169
MVIPPKFKVSDFDKYKGTTCPKNHLKVYCRKMRAYAKDEKLLMHFFQEILTGAIITWMQLQNMCKKEHESFKGYAQRWRDMVAQVVPPMTEKEMIRMIVDILPVFYYEKMVSYKP

SEQ ID NO: 143948 - protein, 145 aa, Glycine max
  Coding DNA Sequence Number=SeqID_27170
METISKRFEELDVCDKVTLKSKLREIVYPKLNSMCPPPEKVKTKVKRSASSSDQTILRKTMPMLDQFHLCIHDSIKNIVDVKANSNGGYHAIVVLLSMSEDSWALVCNHLLKELAKWSDKYINLFGGIDKFEELKRSLLVDRLSI

SEQ ID NO: 143949 - protein, 124 aa, Glycine max
  Coding DNA Sequence Number=SeqID_27171
  Homolog annotation: Hit_ID=Q2HV96; Match level="QueryCoverage=74%, HitCoverage=61%, E-value=6e-08, Identity=38%"; Hit description =P8MTCP1; CHCH
MPRGHGSSNGVNHAPRLAPIQGGDCGSLFRIVAEGITFGIGSAVAHRIVDLVFDPRSIQHETIVNGPVVVVTTPMTNSLSGDTCNAPTKAFQDSFRPILMILASTIGGQALVIIGSQSVCEKSS

SEQ ID NO: 143950 - protein, 140 aa, Glycine max
  Coding DNA Sequence Number=SeqID_27172
MSENVGKYLANINGEFLEYDPNNNSGGWRSYMRVGVIGDVHVPLKKVKKVKKPSRDWKGTSGLGMTTTKRLASMNVVTETVEFDENPKAVQIQGPRTRGRTKQSEDTLQQMVAVLLDKAQVEKDEGPEALPRILVVEGPN

SEQ ID NO: 143951 - protein, 92 aa, Glycine max
  Coding DNA Sequence Number=SeqID_27173
MASLVEDKMKSLAMVEEEEDGFVFCTQAMKAHMAAIWKPWEGVTIKDVERVNFLFQFFPKLDMQSITNGVPWYFDNQLLILDKLKPNDVPDQ

SEQ ID NO: 143952 - protein, 87 aa, Glycine max
  Coding DNA Sequence Number=SeqID_27174
MGAKRSSTCSFGSVFKACFSSGGSYDEYWEGSGSGRRMFASDEDRGRWVAEPGIDRKASDFIARYYASRTTGCVLGWFLPAVLIWLY

SEQ ID NO: 143953 - protein, 77 aa, Glycine max
  Coding DNA Sequence Number=SeqID_27175
MGTNHTGKRFYQVKIKGLDVTSLKELGRLMGPLQMQAFRKAYGKILDLTIAEISTEVVVSLTQYYDQPLRCFTFGDF

SEQ ID NO: 143954 - protein, 51 aa, Glycine max
  Coding DNA Sequence Number=SeqID_27176
MALYGLALAYSNPLKDTRLPCSGVFRLPRAGKGRQSVGRNPSLYLHPFLSI

SEQ ID NO: 143955 - protein, 94 aa, Glycine max
  Coding DNA Sequence Number=SeqID_27177
  Subcellular localization annotation: CTP_CleavageSite=55; ConfidenceScore=5.26e-01
MELHHRGKTLRIKRTSMTTLTQIWMTLLLSNILPSTAVGSGTVAVRGGPATASRRCAATTSTAATIPGVYLRSPVEDGTPDTRVYAACDWPAGG

SEQ ID NO: 143956 - protein, 243 aa, Glycine max
  Coding DNA Sequence Number=SeqID_27178
  Gene Ontology: Mol. function=transferase activity, transferring hexosyl groups; Cellular component=integral to membrane; Biological process=carbohydrate biosynthetic process
  Homolog annotation: Hit_ID=Q1SD94; Match level="QueryCoverage=99%, HitCoverage=75%, E-value=1e-115, Identity=74%"; Hit description =Glycosyl transferase family 8, putative
  Subcellular localization annotation: CTP_CleavageSite=57; ConfidenceScore=5.37e-01
CIKRTGLFGVQSSPGLATTGPMQKTHRPSVQVPATPLHVIATQPMLVPPVLNWRHVSREHQQKRGQRTQLVDPIVLLNLHPPLYPLAVPDSPPPHQIYHHHARVEVAWPPPGERPREARVRPERCGEVLGEVGVAVFRGADGFEEVSEIISGVVEGLFEGLSDRGGDQVADDLGIKVIDLEVQLREGGFDEGFEVGFGDEEVEEDVLRALGVLEDGVDGGDGAAEVLDVEGDGDVDEGGVADG

SEQ ID NO: 143957 - protein, 35 aa, Glycine max
  Coding DNA Sequence Number=SeqID_27179
MGLVPCFLPRKQVQGTGTRFMRHKKEQDDNKSATE

SEQ ID NO: 143958 - protein, 130 aa, Glycine max
  Coding DNA Sequence Number=SeqID_27180
  Pfam annotation: Domain name=DUF789; Domain location=1-130; Score= -175.1; E_value=0.0051; Accession=PF05623.3; Description=Protein of unknown function (DUF789)
MKGRKTGESITGSYYVQEDLRETYREWSAYGVDVVVSPNGEGDIKMYYVPFLSAIQLYVVRNKLVLDEEEEEEDEHDGGEELAAANALMTLILPGTGNFLNTPNPVEPQVHTLQLRNDTNPEFATNRSLF

SEQ ID NO: 143959 - protein, 82 aa, Glycine max
  Coding DNA Sequence Number=SeqID_27181
  Gene Ontology: Mol. function=protein transporter activity; Cellular component=membrane; Biological process=protein secretion
  Homolog annotation: Hit_ID=Q64R40; Match level="QueryCoverage=87%, HitCoverage=20%, E-value=1e-18, Identity=63%"; Hit description =Putative multidrug resistance protein
MGLGTKVKIEIDALAGKTFEGEVAAISEATGSKYSAVPVDNSTGNFVKVQQRIPVRINFTASNTPKDLAMLRVGMNAIIRVQ

SEQ ID NO: 143960 - protein, 145 aa, Glycine max
  Coding DNA Sequence Number=SeqID_27182
  Subcellular localization annotation: CTP_CleavageSite=71; ConfidenceScore=5.29e-01
MWGANTFRVRKYNYRTFHLKVRRSRLFWFFRRFPQINVGGDSAPANKPVHTQRFTSSSVQTTSAVLTREVRGQRKYPSGYPYKHSFAISKTQRMIPCRDKRHFLHPFSIAVNKSVDMWRFTSSSAQTTSAVQTREVSGPAEIPKW

SEQ ID NO: 143961 - protein, 90 aa, Glycine max
  Coding DNA Sequence Number=SeqID_27183
MSAIVFSIQSVNEVCMMSVRKCSIGADEDMTKSKGKDPLEGLGGPMTRARARKAKEALQQVLSILFEYKPKFQGEKSKVVSCIMAQMEED

SEQ ID NO: 143962 - protein, 98 aa, Glycine max
  Coding DNA Sequence Number=SeqID_27184
MKNERRTMKNSEKSSRNHPRKHLGSVTEAPRLRFSSRKQFFSLILSDSQIPGGGKEGGGCRPARPSELGCFHQKASPSVGRSWESQVGSGCYLYTPVY

SEQ ID NO: 143963 - protein, 188 aa, Glycine max
  Coding DNA Sequence Number=SeqID_27185
AKRESAAMASKKRKAPSTPSQVRYDQSRFTSQEAWERYTDIIVPRKLLPERNVVVYYTEFDEFKEELKRRHWDEELTDFADCSIDVAIVKEFYANLYDPEDKSPKGFELNADGQPLKILRKNITNLAQTWSILSFSNLIPTSHTFDVTLDRAKLIYGIIMKMHMNVGSMQGQRNPIRFKIPEEPEPCH

SEQ ID NO: 143964 - protein, 319 aa, Glycine max
  Coding DNA Sequence Number=SeqID_27186
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=1e-41, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLYVLAFGNLHVLTFRGQHALSFRGLHALTVRGLHVLAIRGLHALAIRGLHVHPIKGLHAPTFRGLHVVTFRGLHALTFRGLHVLAFRRLHVLTFRGLHVLAIKGLHVIAITGLHVLPIRGLHPLTFRGLHILAFRGQHDLTFGGLQVLTFKGLHVLAIRRLHAHAIRGLHVLAIKGLHAFSIRGLHILAIRGLHALAIRGLHALAFRGLHVMAFRGLHALAIRGLHVLAIKDLQALTFRGLHALTFRGLHVLTFRGLHVLGITGLHVLPNTSFSCPRHQRTTRPRHQRGARLHRQRATHPRHQRTTRPRHQRAAHLHL

SEQ ID NO: 143965 - protein, 92 aa, Glycine max
  Coding DNA Sequence Number=SeqID_27187
MVQPKPSAGLKGKPHQHALTFMLSCVSTNKGLGPLGLSHVLAFILILASCPHPKMAKIPLRHFTEHLVGTLLGTKNKGMGAMWLVPSFQNTT

SEQ ID NO: 143966 - protein, 124 aa, Glycine max
  Coding DNA Sequence Number=SeqID_27188
MEKFNHIEERLRAIEGGGDHAFADMTELCLMPDIVIPPKFKVPDFNKYKGTTCPKNHLKVYCRKMRAYAKDEKLLMHFFQESLTRAAITWYTNLEPSRVHSWKDLMVAFIRQYQYNSDMAPDRM

SEQ ID NO: 143967 - protein, 127 aa, Glycine max
  Coding DNA Sequence Number=SeqID_27189
MSEIEEVQEQMKVNAAIVVSASTTTEVDPTHPSGLNQVNPPVLDIVGQRGEVLGSTSDPYFVQVQNKHSFPPYGLPPNYIPPNVANTPNENVNNSAPIPIESQQPQSDHAHVSQPMGGHMKRLESAL

SEQ ID NO: 143968 - protein, 67 aa, Glycine max
  Coding DNA Sequence Number=SeqID_27190
  Homolog annotation: Hit_ID=Q2HV71; Match level="QueryCoverage=81%, HitCoverage=7%, E-value=5e-08, Identity=48%"; Hit description =Protease-associated PA; Proteinase inhibitor I9, subtilisin propeptide
SSNGLWHALNFGEDVIVGVIDIGVWLESEGFKDHRMTNKILNKWKGSYEEVQDFNTHVGCSCCSHDE

SEQ ID NO: 143969 - protein, 68 aa, Glycine max
  Coding DNA Sequence Number=SeqID_27191
MILHEIRRPNSLKAVPSRVANYRNLPFHARAMRGSWVRLPRKENARSHHQRLFEENVEKTGKSVVYEL

SEQ ID NO: 143970 - protein, 62 aa, Glycine max
  Coding DNA Sequence Number=SeqID_27192
MDELKDLIKQVTPPGIPLYGIDETQMVLIESNYWKKIGPIEILVVFSKLIPKMEDELSLSQN

SEQ ID NO: 143971 - protein, 314 aa, Glycine max
  Coding DNA Sequence Number=SeqID_27193
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=4e-41, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DRPWGTSTHTIRGLHALTFTGLHVLAFGGLHVLAFRGLHALAFRGLHVLAFKGLRVLAFRGLHAFTFRGLHVLAYRGLHALAFRGLHVLAFRGLHVLAFRGLHVLAFKMLLALTIRGLHVLAFRRGLHVLTFRGLHTFAFRGQHVLAFRGLHVLAFRGLHALAFKGLHTLTFRGLHVFAFKGQHVLTFRGCTFSPSEGYTPSPSEGCTPSTSEAYTGLHVLAFRGLHALAFRGLHVLAFRGLHVLVFRGLHVLAFRGLHALAFRGLHVLAFRGLLTHTFRGLHVLAFRGLHVLVFKGLYVLAFRGLHVLTFGGH

SEQ ID NO: 143972 - protein, 178 aa, Glycine max
  Coding DNA Sequence Number=SeqID_27194
MGKAEEVQEQMKADMEAHERANGHNDGGHDEHEEDNGSQCDCSYRSVVAKCKNKHAFPPYDLPPYYTPPNVAYTPNENVNNSTPILIESQQPQSDHAHVSRPMGETHEIPHHNLADFKPCLGYATEGQAVGSGPLKEAKIVPLLKELFLVPNIITPPKFKVSDFDKYKGTTCPMNHLK

SEQ ID NO: 143973 - protein, 123 aa, Glycine max
  Coding DNA Sequence Number=SeqID_27195
MAYSELWPSLLENHLVVAIPGKVFQSPYPKWYNLNATCAYHSGAPRHNIDSCLPFKYKVQHLINAGWLSFQEEGPNVKTNPLASHGGASVNAIEKDRPSGSKRLEDVATSRRFIYQSLQEACM

SEQ ID NO: 143974 - protein, 88 aa, Glycine max
  Coding DNA Sequence Number=SeqID_27196
RDSSWVKKGTQPADEEGNLPVEDNSTLLRRLMDKFDGLQTFVGDKFDAMELQDDIRFDAVESRITKVEEDVAFIRTCFDPPPPPPSSS

SEQ ID NO: 143975 - protein, 116 aa, Glycine max
  Coding DNA Sequence Number=SeqID_27197
  Gene Ontology: Mol. function=structural constituent of ribosome; Cellular component=ribonucleoprotein complex; Biological process =translation
  Homolog annotation: Hit_ID=Q2QD65; Match level="QueryCoverage=68%, HitCoverage=65%, E-value=3e-37, Identity=96%"; Hit description =Ribosomal protein S12
  Pfam annotation: Domain name=Ribosomal_S12; Domain location=8-115; Score=158.6; E_value=1.6e-44; Accession=PF00164.15; Description =Ribosomal protein S12
  Subcellular localization annotation: CTP_CleavageSite=54; ConfidenceScore=5.08e-01
MGQILQDQTLWELRNDGKKRNKKKSGSKGDLSVNFSTITPKKPNSALRKVARVRLTSGFEITAYIPGIGHNLQEHSVVLVRGGRVKDLPGVRYHIVRGTLDAVGVKDRQQGRSSAL

SEQ ID NO: 143976 - protein, 280 aa, Glycine max
  Coding DNA Sequence Number=SeqID_27198
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=3e-35, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHALTFRGLDILAFIGLHVLAIRGLHALTFKGLHVFTIKGLHALTFRGLHVLAIRGLHALTFRGLDILAFRRPHDLAIRGPHVLAIRGLHALTFRGLQVLGIRGLHVLTFRELHVHAITLRGLDILPFRGLHVLAIRGLHALTFRGLHAFAIKGLHALTFRGLHVLAIRGLHALIFRGLHVLAIRGLHALTFRGLDILAFRGLHVLAMRGLHALTFSGIQVLASRGLDALSFRGLHVFTIKGLHALTLRGLHVLAIRWLHTPTFRGLQVLAIIGLHAVTF

SEQ ID NO: 143977 - protein, 156 aa, Glycine max
  Coding DNA Sequence Number=SeqID_27199
MGEIEEVQEQIKADMEVMKDQMATMMEAMLSMKIIMESNAAAVTTTSAATEEGKALGSIGGPHVVQSKNNFPPYGLPPNYTPPNVAHAPDENGQAVGGVPLLDTLGGPQFCPQAQALHFMVERVPPAMVEKGKFDHIEERLRAIERGGNYAFADMA

SEQ ID NO: 143978 - protein, 104 aa, Glycine max
  Coding DNA Sequence Number=SeqID_27200
MVCPKKQKVAYITYTLVEEAEYWWENTSQCFEAKGRDVESLKCVKFLNGLRPEVKQAVNNQGVRSSSLMDSFASWKMNGSGMEKEEREETPLQGEDESRISSPP

SEQ ID NO: 143979 - protein, 113 aa, Glycine max
  Coding DNA Sequence Number=SeqID_27201
MFEGDPTVNESGIMAVTKDLFLGINTKVFKNLGDQNCIGTPEKNNPLGHQYDINNNVYPIDLQLPLHKTDKEKILPSQLSMIVPPQSNNPSNYIGQKPMLKHQRFSTKTLISI

SEQ ID NO: 143980 - protein, 92 aa, Glycine max
  Coding DNA Sequence Number=SeqID_27202
MIESFQQQQQMSVLELYVEKDVAGGSMFHAANSVTSGGRNVSHHELELPRNISNLHDDEDDDDDDYLASNLYVEESFDEDDSDDGISDTDDE

SEQ ID NO: 143981 - protein, 95 aa, Glycine max
  Coding DNA Sequence Number=SeqID_27203
MKREKHASYSSHDSCKSLSEELSDYYRGRHRPHTKHHSHRREKDKRPQEVNISLPYFHGKDNVEVYLDWEMKVEQLFACHHIGDERTVPLSTISR

SEQ ID NO: 143982 - protein, 75 aa, Glycine max
  Coding DNA Sequence Number=SeqID_27204
MQQGQADILIARFPDPNYGVKTIKFREDPTVKEGWAVFLPRQLHVAFSRSFIKRLPPEASSWLLRVLQAQLAHAS

SEQ ID NO: 143983 - protein, 347 aa, Glycine max
  Coding DNA Sequence Number=SeqID_27205
  Gene Ontology: Mol. function=RNA-directed DNA polymerase activity; Biological process=RNA-dependent DNA replication
STLEDPPFIGADETEGTSFQGLTVEGKKPEKNEVSFATWKSAQKVVQEGTGVGWGKVVQLIESKNREGLGFASSAGSAMNSVGSSSITSTFCSAGFINNSPEANAVLEDVPEKIVLTFVTPGKLVRNWDAVDIPSVVHASKLGIYEPVEHNNPALSPNFESPVYEAEEEEDDEIPEELARLLEYEKKTIRPHEEVVEVINLGTEEDKKEVKIGASLEATVKRRVIELLKEYADVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHVDVLVDSAAKSK

SEQ ID NO: 143984 - protein, 351 aa, Glycine max
  Coding DNA Sequence Number=SeqID_27206
MASRKTKAPASVSQARKIKRRNWHKELTNFSEGIIDMALVKEFYANLYDLEDKSPKQVKVRGHLIKFDDDALDTFLKTPAVIEEGESLLSYSKFCKLRPDPQELETHLCIPRRGFELNADGMPLKILRKNLTTLAQTWSVLSFSNLAPTSHTLDITLDRAKLIYGLVMQMNMDLGSLILGQISLIAQHDSSRLGFPAIITALCKARGVTSNSLTFESLSPAPSTSAPPTSAPSTSPLSPAPAAPVLLDPSSQSFEPSLSMLQSLHQGQLLIMWPGQESSLHLWEEEDIPKATEPTPPKPFTLESDPVVVQANPTISPQPEPSALVSDLPLSQDPSFAPALDLNEHAMNRDH

SEQ ID NO: 143985 - protein, 171 aa, Glycine max
  Coding DNA Sequence Number=SeqID_27207
  Homolog annotation: Hit_ID=Q156E3; Match level="QueryCoverage=28%, HitCoverage=44%, E-value=8e-19, Identity=91%"; Hit description =Putative transport protein
NQREYEESLYPLGHHVPPYEIHTLLPHVSNTEFRDPDQILCDREVESNSGAGGTIAVELAEHVERGDEADEAEAHDEHHRRRDLEAGGVVGVEPQHIASAGAGAAADRGGAGSSAEAATAHAGSGGSGAARSHHARSRGGVGRCGLRLRGASRHVDDHEGKGGGGVGERNS

SEQ ID NO: 143986 - protein, 110 aa, Glycine max
  Coding DNA Sequence Number=SeqID_27208
  Subcellular localization annotation: CTP_CleavageSite=55; ConfidenceScore=5.66e-01
MVFSLFFLGLNSPKPAFGSPGPPNNFKAKGLGRLGELTASGLSFSSPGRAPTAPRKGLEVERIERRKKEEEERRGNEVEALPNRHCDHSLRHFLVPCSSCNSQLVLFFKS

SEQ ID NO: 143987 - protein, 99 aa, Glycine max
  Coding DNA Sequence Number=SeqID_27209
ISESQSESESESDTDKESERERERERERARLTVRARGSTATESESMKCESGCEKKDPAFENLHGKEYDLEDGKEGEATTDANDGDGGVCLLELDKQINN

SEQ ID NO: 143988 - protein, 79 aa, Glycine max
  Coding DNA Sequence Number=SeqID_27210
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=69%, HitCoverage=29%, E-value=2e-21, Identity=87%"; Hit description =Anaphase-promoting complex subunit 10
  Pfam annotation: Domain name=APC10; Domain location=1-79; Score= -69.7; E_value=0.0027; Accession=PF03256.7; Description=Anaphase -promoting complex, subunit 10 (APC10)
KPYTALGTVVGAQSSKLSMLPVNKLIVLYVVFKLDESYTPSKVSIRAGDGFHNLKEIKTVELVKPTGWVYLSLSGADPR

SEQ ID NO: 143989 - protein, 181 aa, Glycine max
  Coding DNA Sequence Number=SeqID_27211
EKLEKLVRRKILELSLDGGGVGHELEGEEGGDFQLHSSLREICMSDMVEPNDGVVPSSAIEPPIGEGGQPTNKVDHNDNEVVEVTPNMPSSVLTKRKRDDETMHVIKLMFGSGLPSVAVSQGSPLASLVIQDAIVAPPPSSLPTQYVYVSPPSMVIVPVLLVATIIAPPFPIVSPLLSTLM

SEQ ID NO: 143990 - protein, 281 aa, Glycine max
  Coding DNA Sequence Number=SeqID_27212
DIAQTFWRVKHAKVANTIVAFAEAIRSNQHMSSKIGDALAKLLHTKLDGDKMFERCKVLQRKKNDLADKVDSAIDEKDELANVSELGALEDMVNNKELEEKLLARFFTKEHDLGLCNPFKDMKDDELFDEEEIIAIEEYADEEKANMAIVLLIILVMLPFGLWSFSPDACEERELTKGVPWVFVGALTKAGPSVSCIPRPDLGFNKLWTKEVFILEIRDSRKVDPRFDKPLKKRDSPRANLGFDAPLEKQDSPRVDLAFDEPLEMQNSPRPDLGFDEPLEK

SEQ ID NO: 143991 - protein, 291 aa, Glycine max
  Coding DNA Sequence Number=SeqID_27213
  Gene Ontology: Mol. function=RNA-directed DNA polymerase activity; Cellular component=chromatin; Biological process=chromatin assembly or disassembly
MYTCIHNIISAQGIAPDPENISAMLAWPIPISPTALRGFLGLTGFYRKFIKGYAAIAFPLTSLLRKDKFSWSPEAQTAFTALQQAMISAPVLANPNFSLPFTIETDASATAMGAVLLQEDHPIAYYSKVLCPRLQKASAYIRELHAITSSVRKWRHYLLGATFTILTDHRSLKDLMTQVIQTPEQQLYLSKLLGYDYTIRYKPGAANVVADALSRITPPEATCLALTMPHPLFLSELRQALLQDPRYVTLLQDIQSTPANHPEFSLHHDLILRKKRIWIPFPCVITQSLLE

SEQ ID NO: 143992 - protein, 78 aa, Glycine max
  Coding DNA Sequence Number=SeqID_27214
VAWPGAQPSLSGGGVHMAQEEETSTDQILEPSPTPITNDAIPSAPASELEQPISQDSPVAQVLDLNEHAQEQPQEQDI

SEQ ID NO: 143993 - protein, 152 aa, Glycine max
  Coding DNA Sequence Number=SeqID_27215
MLTSSKRVQMTTLASACQSNLGSPNDEVRITERCLRMLPDSWVMIAKGGVVDKSEAFAPTYPPFVMKNSDLRSSFYSFIPKRPFRGNTGPDRIEEYHSKCTNLTQGRVCGKLGFWLKACRTAGHDICQDVGLASGSGKKEKSHIISMIHMQH

SEQ ID NO: 143994 - protein, 74 aa, Glycine max
  Coding DNA Sequence Number=SeqID_27216
MKGRGQEVFKPDKYSARWKKPSGPFGPANKSCSEPHELIVVHASSTNEFGAPRIDCLVLFANSPFSTFIRSPMN

SEQ ID NO: 143995 - protein, 211 aa, Glycine max
  Coding DNA Sequence Number=SeqID_27217
  Homolog annotation: Hit_ID=Q84VH5; Match level="QueryCoverage=81%, HitCoverage=29%, E-value=5e-76, Identity=76%"; Hit description =Envelope-like protein
VVDIAVSEHQIAKEITAKQVQHWPKKGKLSAGKLSVKYAILHRIGVANWVPTNHTSTVATESFAVKLPIAFPTVLCGIMLSQHPNILNYTDSVKKRESALSLHYKLFEGTHVPDIVSTSGKAAASGAVSKDALIAELKDTCKVLEATIKATTEKKMELERLIKRLSDSGIDDGEAAEEEEEAAEEEEEAAEEEEDAAEDTESDDDDSEATP

SEQ ID NO: 143996 - protein, 109 aa, Glycine max
  Coding DNA Sequence Number=SeqID_27218
VERPDESFGPADQSFLEPMNCVFVHVFSTFEFRAMRSDCLVQFSILHPFSEPMNCVFVHVSSTFEFGAMRSDCLVQFSILNLFRSPMNCVFVHVSSTFEFGAMRSDCLV

SEQ ID NO: 143997 - protein, 174 aa, Glycine max
  Coding DNA Sequence Number=SeqID_27219
  Gene Ontology: Mol. function=transition metal ion binding; Biological process=cytoskeleton organization and biogenesis
MKILKGYTKNLHHPEASIVERYIAEEAIEFCSEYIEKAKLVGLPECRHDERVGGKGSRALHVLTPSVEDLQQAHLYVLNNSNEVFPYIHQHEGLVKKGVLMITIMTTKDDDKGDEKKAQRSKNNSSESRTSQEFKNQEEFKTQEESLESRIMIQDSRSQDLKNQDQDSRLKIQE

SEQ ID NO: 143998 - protein, 54 aa, Glycine max
  Coding DNA Sequence Number=SeqID_27220
MVTKGWSFVGQQWWRKKKRTATYATCLHLSGAKGPAFSLDVTHAQPHEEKNLTF

SEQ ID NO: 143999 - protein, 224 aa, Glycine max
  Coding DNA Sequence Number=SeqID_27221
  Gene Ontology: Mol. function=RNA-directed DNA polymerase activity; Biological process=RNA-dependent DNA replication
MQPNAKREKSDRYCGFHKHRGHTTEECAQLKVAIERLIKQGHLGEYIDKPRNKRRDDPPRRDNNRDQQQRREDKGHRRDLDNNDNQPTRGIIFFISGGPAGGDSQNAKRTLARSARMNQERASPSARIYQIRRPDHSIVFNSSDLEDPDEDHVDALVVTTTVANFLVKKILVDGGSSADIMYLHALKQLGIDNALFSRISTRLKGFKGESEKKKRVAIRKIKSN

SEQ ID NO: 144000 - protein, 45 aa, Glycine max
  Coding DNA Sequence Number=SeqID_27222
MTRELVARGDTLRLSAPRHSVTPSVIGYVGARALLLSAAPQSLSY

SEQ ID NO: 144001 - protein, 163 aa, Glycine max
  Coding DNA Sequence Number=SeqID_27223
  Gene Ontology: Mol. function=serine-type peptidase activity; Biological process=regulation of transcription, DNA-dependent
  Homolog annotation: Hit_ID=P15238; Match level="QueryCoverage=100%, HitCoverage=68%, E-value=3e-22, Identity=34%"; Hit description =Repressor protein C
  Pfam annotation: Domain name=HTH_3; Domain location=8-61; Score=35.1; E_value=2.4e-07; Accession=PF01381.12; Description=Helix-turn-helix
MAKLSDIIRSKRKEMGLTQKAFGNLFGAQQTTVSDWEKGKISMMRNWQKLAGSLGLRESEFLDLMAEATTESEKTERMIPALRQATAPVINTGSIIAAPKPPSGERDVPVLGRSKGGSDGEFEFNGQIMGWEWRPPHLAGVAEAYASYVDGESMYPRYKPGET

SEQ ID NO: 144002 - protein, 90 aa, Glycine max
  Coding DNA Sequence Number=SeqID_27224
MAASDRAALNASNQLAITKPIMPEGEMNMRKTAANDFENLAPVEHESSAGVVVHAAKNEKGRNEPAPPVTPPLLRTNTPRRPSPKGGIKA

SEQ ID NO: 144003 - protein, 118 aa, Glycine max
  Coding DNA Sequence Number=SeqID_27225
MAAQLIRDRVEMEFLEGAWETLEGNTSALWSGYYPTPTPYRLVEPVQVIEVTSSEEDPEEDLEELPPEPAVDALDFLEGDEDPLLEVDSPEEVMSASEADSTEDSGPGEMTISGGSSS

SEQ ID NO: 144004 - protein, 178 aa, Glycine max
  Coding DNA Sequence Number=SeqID_27226
  Pfam annotation: Domain name=zf-CCHC; Domain location=75-92; Score =9.9; E_value=0.023; Accession=PF00098.13; Description=Zinc knuckle
MQKSSFRFMSRSSSKAINTDTSYDDEFDDDSSDEDDQLAFISRKIRNMWKKRSGSDRKRSKKPYRERKDKDKSSIICYKCKKPGYFKLQCPYLDVFNHNKNIPIMIPRQWLLTSHDRRKIGLDVSFSKDGCVVKHKNMNQLFTAKRQGFDDAKTKATQVLFQVQIKTKKTKIKKKAES

SEQ ID NO: 144005 - protein, 106 aa, Glycine max
  Coding DNA Sequence Number=SeqID_27227
MKPIKEEVMILHEIRRPNSLKKIPSGVANCRNLPFGGRATQGSRVRLPREEGARSRHQCLFEENVEKTGKVRVWSANFECERFGSCIYARGRYWHPTRPSQGTTAF

SEQ ID NO: 144006 - protein, 81 aa, Glycine max
  Coding DNA Sequence Number=SeqID_27228
  Homolog annotation: Hit_ID=Q6H890; Match level="QueryCoverage=37%, HitCoverage=9%, E-value=7e-07, Identity=67%"; Hit description=BRAP2 -like protein
MTNANCPQESLHSVSNGNLRLGSKLKNLFVLFVKPLTTCGYVLYVGMLAVEDNGCGSCNSEDNAMNEVILNSKLEAVMLQD

SEQ ID NO: 144007 - protein, 204 aa, Glycine max
  Coding DNA Sequence Number=SeqID_27229
MGDLEEVQEQMKVDMSALKEQMDSMMDAMLGMKQLMESNAAPAAVVSSAAEADLTLSTAAHHPIPNKVGREKSTPGHVGNPHLGYNRGAYPYGLPPNYTPPVIRDDAGHVPPPILEGEPPRHPDVVHEDHREHAQGDIDSYSPFSTEGLAPNALPQPNITGEPRSHPTQPIFLSVGGPPLAAEGTGKLDLIEERLRVVEGFGDY

SEQ ID NO: 144008 - protein, 213 aa, Glycine max
  Coding DNA Sequence Number=SeqID_27230
  Homolog annotation: Hit_ID=Q8TGM6; Match level="QueryCoverage=42%, HitCoverage=72%, E-value=4e-10, Identity=41%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSLAPPFQGTWARSAH

SEQ ID NO: 144009 - protein, 76 aa, Glycine max
  Coding DNA Sequence Number=SeqID_27231
STDTAYSQHRLWITPIIIRASRRLNLALPPFSERGVLPADTLIREMELGICFETSSLRATNCHYSEAYGDPPKLKG

SEQ ID NO: 144010 - protein, 88 aa, Glycine max
  Coding DNA Sequence Number=SeqID_27232
  Gene Ontology: Mol. function=transferase activity; Biological process= RNA-dependent DNA replication
MGVTKCLEMGKYLGVPSMVGRSKQRCLNTSWWNSKGDRCKGINQLRWEKLSQRKENGGMGFQDLKASNMALLGKQGWKIISKPWESYS

SEQ ID NO: 144011 - protein, 118 aa, Glycine max
  Coding DNA Sequence Number=SeqID_27233
MGTSKPYTRAMRGITHEPQASIGADQNPLNESILCFLIWVDPWVLEPIALRGLHVLAIRGLHALTFRGLHVLTFRGLHALTFKGLHVLTFRGLHALAFIGLHVLAIIGAACPHLQRTT

SEQ ID NO: 144012 - protein, 117 aa, Glycine max
  Coding DNA Sequence Number=SeqID_27234
  Subcellular localization annotation: CTP_CleavageSite=45; ConfidenceScore=5.52e-01
MNSLPSVVHVSSTIESGAPRIHCLALFANSPFSTFIRRPMNSLPSAVHASSTIESGAPRIHCLALFANSPFSTFIRRPMNLLPSAVHASSTNESGAPRIYCLALFANSPFSTFFEAP

SEQ ID NO: 144013 - protein, 81 aa, Glycine max
  Coding DNA Sequence Number=SeqID_27235
  Homolog annotation: Hit_ID=Q86AI8; Match level="QueryCoverage=74%, HitCoverage=9%, E-value=9e-07, Identity=40%"; Hit description =Similar to Homo sapiens (Human). Mucin 2
  Subcellular localization annotation: CTP_CleavageSite=84; ConfidenceScore=5.54e-01
MRTRSPLKVRACSPLKARMCSPLEVRACSPLMARACSPLKVRACSPLMARMCSPLKVRTRSPLTVRVTSTQVLSRQGRVVL

SEQ ID NO: 144014 - protein, 90 aa, Glycine max
  Coding DNA Sequence Number=SeqID_27236
  Homolog annotation: Hit_ID=O04237; Match level="QueryCoverage=58%, HitCoverage=19%, E-value=1e-11, Identity=53%"; Hit description =Transcription factor
MDLDEVSFEGNAGKSSERRDYGGPRGPYRGGGGRHGGFSNGETGEAEKGRPRRAFDRHSGTGRRVTDEVANETEKNLGDEKPTVEEDVAD

SEQ ID NO: 144015 - protein, 175 aa, Glycine max
  Coding DNA Sequence Number=SeqID_27237
  Gene Ontology: Mol. function=oxidoreductase activity; Cellular component=cytosol; Biological process=retinoid metabolic process
  Homolog annotation: Hit_ID=Q8LBR3; Match level="QueryCoverage=67%, HitCoverage=30%, E-value=9e-40, Identity=64%"; Hit description =Alcohol dehydrogenase, putative
  Pfam annotation: Domain name=ADH_zinc_N; Domain location=21-158; Score=61.6; E_value=2.5e-15; Accession=PF00107.16; Description=Zinc -binding dehydrogenase
MESTMWWWWWCNMVCVGGDENEKWYLVVAEGAGARGASRIIGVDINSDKFIKAREMGITDFINQRDDERPVYERIGEMTGGGVHYSFECAGNLNVLRDAFLSAHEGWGLTVLVGIHLSPKMLPIHPMELFHGRRIVGSNFGGIKGKTQLPHFAKECMNGVTTTILSEFAFVLFKK

SEQ ID NO: 144016 - protein, 160 aa, Glycine max
  Coding DNA Sequence Number=SeqID_27238
MNVYTDNHSGIFARQRDSNVSMTDLVSAEDDVNLRVSTGLSAAIDEGRRRQHSKKNVYTDNHSGISARQRDSNVSMTDLVSAEDDVNLRGSTGLSAAIDEGRRRRHSKKNVYTDNHSGISARQRDSNVSMTDLVSAEDDVNLRVSTGLSAAIDEGRRRRR

SEQ ID NO: 144017 - protein, 91 aa, Glycine max
  Coding DNA Sequence Number=SeqID_27239
  Gene Ontology: Mol. function=ATP-dependent helicase activity; Cellular component=nucleus; Biological process=rRNA processing
  Homolog annotation: Hit_ID=Q9LIH9; Match level="QueryCoverage=52%, HitCoverage=8%, E-value=1e-17, Identity=83%"; Hit description=DEAD -box ATP-dependent RNA helicase 51
  Pfam annotation: Domain name=Helicase_C; Domain location=8-69; Score=- 7.0; E_value=0.073; Accession=PF00271.21; Description=Helicase conserved C-terminal domain
MVLQRHPRGSIQHTDIDSYFCTSAKRGSNHTSRRFRRVQAKHRDWIVQYDPPDEPNEYIHRVGRIARGEGGKGNALLFLIPEELQFLRYLK

SEQ ID NO: 144018 - protein, 474 aa, Glycine max
  Coding DNA Sequence Number=SeqID_27240
  Gene Ontology: Mol. function=protein serine/threonine kinase activity; Cellular component=integral to membrane; Biological process=protein amino acid phosphorylation
  Homolog annotation: Hit_ID=Q1SB06; Match level="QueryCoverage=84%, HitCoverage=44%, E-value=9e-55, Identity=36%"; Hit description =Protein kinase
MLKCREHELASIYAIIDLRKVCLVIVLYMHTDSMRSALVWIFTLNVCLQILFIPGGDSKPHPRFREKITEEYNPGFISIDCGASNDYLDEETSTFYKTDTDFIETGENLLTSSQFINTNIPDYGRQLRTLRSFPEGNRNCYTLKPEYKQGEQQSYMIRAMFGYGNYDGKNHAPTFDLYLGVNYWKNVNTANRSYIWTEIIHAPTTDTIQVCLVNIDTGILWIDTQNLELTFSARDFVALWRYKLISDWKGRMKREKVRIDNVSYRYKDDIYDRRWYWRDVKDWYKINTTIDVNKSGNDIYKVPAEVLKTAVQSFNRSYDLHYDFEIEWNLQLNKYSGYYVYFHFAEIQQLAPGLRRIINITLNDENILSEPITLEYMKPVTISNKNATQGFVRFSIRATAESDAPPILNAFEVYKLVTDLNSPTDIKDVDAIVNIKRYYGISRIDWQGDPCVPEIFRWSGLDCSYGINPRIISL

SEQ ID NO: 144019 - protein, 112 aa, Glycine max
  Coding DNA Sequence Number=SeqID_27241
  Gene Ontology: Mol. function=protein serine/threonine kinase activity; Cellular component=integral to membrane; Biological process=protein amino acid phosphorylation
  Homolog annotation: Hit_ID=UPI0000048380; Match level="QueryCoverage =89%, HitCoverage=11%, E-value=6e-29, Identity=58%"; Hit description =kinase
MEYVDSKKQEFSYSEVQMITNNFERVVGKGGFGTVYYGCIGETRVAVKMLSHSTQGVRQFQTEANILTRVHHRCFTPLIGYCNEGTRTALIYEYMTNGDLAEKLSGIGAYLN

SEQ ID NO: 144020 - protein, 125 aa, Glycine max
  Coding DNA Sequence Number=SeqID_27242
  Gene Ontology: Mol. function=protein serine/threonine kinase activity; Cellular component=integral to membrane; Biological process=protein amino acid phosphorylation
  Homolog annotation: Hit_ID=UPI00001630F7; Match level="QueryCoverage =92%, HitCoverage=15%, E-value=1e-19, Identity=49%"; Hit description =kinase
MYQQQLQAPQDTLTQKIITGRTVILKTQVRTHIIKWVSSMLADDGEIDGVVDTRLQGEYDSEAARKVIDVAMACVAPSSVNRPTMNQVVMELKQCFPMGKLGTTSTGSSEIFSAGEISGLSSLAR

SEQ ID NO: 144021 - protein, 201 aa, Glycine max
  Coding DNA Sequence Number=SeqID_27243
  Gene Ontology: Mol. function=methyltransferase activity; Biological process=metabolic process
  Homolog annotation: Hit_ID=Q8RJZ2; Match level="QueryCoverage=98%, HitCoverage=82%, E-value=2e-30, Identity=36%"; Hit description =Methyl transferase
  Pfam annotation: Domain name=Methyltransf_11; Domain location=7-100; Score=90.8; E_value=4.1e-24; Accession=PF08241.2; Description =Methyltransferase domain
  Pfam annotation: Domain name=Methyltransf_12; Domain location=7-98; Score=62.1; E_value=1.8e-15; Accession=PF08242.2; Description =Methyltransferase domain
  Pfam module annotation: Pfam domain module=Methyltransf _11::Methyltransf_12; Domain location=7-100::7-98
MEGLSVIDMGCGTGDFLRYAARNGAGRLVGLDSSERMIREALKRSEDYEIDYICGDFATASETEAFDLCFSSLAFHYVSDISALFNRISRLLRQDGTLIFSVEHPVASAQLARWHADEKANETWGVEGYLAEGERKSRWFGQEAIKFHRPFSSWFNALQTAGFRLTNISEPCPSQNTLDIRRKAGLASDRPAFIVFKAIKA

SEQ ID NO: 144022 - protein, 321 aa, Glycine max
  Coding DNA Sequence Number=SeqID_27244
  Homolog annotation: Hit_ID=Q27TE2; Match level="QueryCoverage=67%, HitCoverage=86%, E-value=2e-65, Identity=62%"; Hit description=VagD
MVESGLPWPVLRWWCLSESHARKPNPQKTVRDGPLSGTVENGGRLSYPVFQCQTRYPLKLPHIVRHQHGAGSDGVSGDRRVVRADRRAGQAQRHLNLRGGVHRGAVPGQDGIEPGAEFLDQLYVTRRGLRAGGAEAHLGVGHGRYHDAVTAQHRLLQALNDGGRLLAHDERADTGVQHISFVHRSNRPSSLTTSPRSAIKSGSAFSSCRNEPQFGRTGRRMMLSPSRTISSSLTPSKSRSRGRRMARLLPFLNIDTVLMVRQMQMINICVCNTYADAGDMDMPDLSSVLSFSAEIRKKAEPDLCRRTLMAGRDSDRLDEVR

SEQ ID NO: 144023 - protein, 286 aa, Glycine max
  Coding DNA Sequence Number=SeqID_27245
MRQGGSGSEAAPDPPQRARHTSGKVLYWPESGSGAEKGDQMGRSIPVKIGQKEFKSKKATVGYFMDQREAVKAGGPLKDGEFFDELRDLYLRYCEITDHRLGNREVHSFSVNYETRHTDQNYGNGVKMMMKADGIVRGITGPVAHPLTVRVSSPRAGIRGRLAAGLIAGVIASAGVVPATPAATRDEVIHLNAAYPSGSVMVCSKNLPGDGKMIQPTVLQMRGTVVNRKQDSAVYEVSSTWTIPGKSSSSDLTLKLRMLERMDDKGSYSRIVPDSMSVSMPSVGPA

SEQ ID NO: 144024 - protein, 76 aa, Glycine max
  Coding DNA Sequence Number=SeqID_27246
ANFSRISDRARVNDVEGDEDAEAAGICFFTARGKADRKQYPPSLINCGVMSTLYSVVQNGSVITLHRAEAGGYESG

SEQ ID NO: 144025 - protein, 317 aa, Glycine max
  Coding DNA Sequence Number=SeqID_27247
  Gene Ontology: Mol. function=protein binding; Cellular component =periplasmic space; Biological process=cell wall catabolic process
  Homolog annotation: Hit_ID=UPI00005F723E; Match level="QueryCoverage =98%, HitCoverage=88%, E-value=1e-137, Identity=76%"; Hit description= COG1376: Uncharacterized protein conserved in bacteria
  Pfam annotation: Domain name=ErfK_YbiS_YhnG; Domain location=75-214; Score=207.5; E_value=3.2e-59; Accession=PF03734.5; Description =ErfKYbiSYcfSYnhG
AASATEYPLPPPDSRLIGENTTYTVPNDGRPLEAIAADYKIGLLGMLEANPGTDPFLPKPGSVLTIPTQMLLPDTKREGIIVNLAELRLYYYPKGENKVIVYPIGIGQTGMHTPLEVTSVSQKIPNPTWTPTANIRKRYQSQGVTLPAVVPAGPENPMGLFALRLAMGRGEYLIHGTNANFGIGMRVSSGCIRLRPTDIEALFNQVPRGTRVQVINDPVKISVEPDGKRYVEVHQPLSRVESDDPQTMPIALSKAEKAFAADAQTDRAVFDSAVVRRSGMPVLVNVGESPSAVSLTPAATPEANKSPFKAAPISSVN

SEQ ID NO: 144026 - protein, 264 aa, Glycine max
  Coding DNA Sequence Number=SeqID_27248
  Gene Ontology: Mol. function=DNA binding; Biological process=DNA integration
  Homolog annotation: Hit_ID=Q1T035; Match level="QueryCoverage=52%, HitCoverage=19%, E-value=3e-20, Identity=36%"; Hit description =Integrase, catalytic region
  Pfam annotation: Domain name=zf-CCHC; Domain location=74-91; Score =28.7; E_value=1.8e-05; Accession=PF00098.13; Description=Zinc knuckle
MASSSKEQVSRSSSKTLKVNNSFDDESKEDSNENQLAFILRKIYKIWRDKCGSRWKNSSRRMPKEKKDKGKSSIICYECNKSGHFKSECPKLEKGDEEANICPMADTGSEESESDQEDKDNLGKFDSRSDSETFLRYSEISKAFIVYNSRTLIAEEVIHVSFDKNKPDKDLLELDESFVDLRLDDGSIETSLSRQNPETEALTKQVVQEEITLISEVEPQYIDDAMQDDNWIKVMQEELDQFQKNDVWKLVELPKENKDTHNKK

SEQ ID NO: 144027 - protein, 128 aa, Glycine max
  Coding DNA Sequence Number=SeqID_27249
  Gene Ontology: Mol. function=nucleic acid binding; Biological process= DNA integration
  Homolog annotation: Hit_ID=Q1SXA8; Match level="QueryCoverage=77%, HitCoverage=6%, E-value=7e-15, Identity=40%"; Hit description=Zinc finger, CCHC-type; Polynucleotidyl transferase, Ribonuclease H fold
MDRRAKTHIATQLQGSKCDVVCSIRRGVHQGTQLKKCKTNVGHSRYNIQRNVTGENIQRMFGCFRAILNGLRSLGKTYDNNDHIDKISRSLTRKWRSWVMTLRALKNLDSLSLKELVSTLKVHEQELQ

SEQ ID NO: 144028 - protein, 128 aa, Glycine max
  Coding DNA Sequence Number=SeqID_27250
MLRGHSSNDVEHPPWLMPSDVAWLGVQSSSLGGVEASATQEPQPEPEVAREPTPETTPQASPATSPVLEVSEEEDGVVDADYAANMTAAQSTWDPWPVTDQETPQPSQDTPSSPHGEPASAQDEPTPA

SEQ ID NO: 144029 - protein, 58 aa, Glycine max
  Coding DNA Sequence Number=SeqID_27251
EACQAITERLEHFLNLRIVTAGIEIHEVMEDCLRITRGVTTEGNVYVRSRQRRRTDQR

SEQ ID NO: 144030 - protein, 90 aa, Glycine max
  Coding DNA Sequence Number=SeqID_27252
MWMDRFALTLNGSQELPRLLAKAKAMADTYSAPEEIHGLLGYLRIKSLPQFISSRHCMLVSSFVTGSRKVHVTPNVQYWRSELPFPGLRG

SEQ ID NO: 144031 - protein, 108 aa, Glycine max
  Coding DNA Sequence Number=SeqID_27253
MSNEELKLQDSRCRIQCPGHPAREYWSCCIMQDKSQVVKLQDPRCRIRCPDIRPDNTGHIILFSGKKIDLIQHQEVVAQKRTLLYKHGGCTSSVPSPGLKSYFVSFGT

SEQ ID NO: 144032 - protein, 119 aa, Glycine max
  Coding DNA Sequence Number=SeqID_27254
MPISPCGSISWSVPSRHRDHARKTPSGLEEIQQGPGVSSFGYGPLDRVRKTPSGPREVQQGPGVPTLITGLYQFYGVSIAPSRVIRPLLTGLSSRSIAPPGRRRARHHSSRQQAHRHHP

SEQ ID NO: 144033 - protein, 56 aa, Glycine max
  Coding DNA Sequence Number=SeqID_27255
MDTLEPYTRAMKGTMHKLQVMTKDNDWYLKALHWGNERHHAKTSSEPRGRLEVLTQ

SEQ ID NO: 144034 - protein, 66 aa, Glycine max
  Coding DNA Sequence Number=SeqID_27256
MSTWKADIGGESADGLLRDDISEDWVAELRQAIQKVKNYQRLNSQSQNGHLNSQSQDGHPNSESQS

SEQ ID NO: 144035 - protein, 661 aa, Glycine max
  Coding DNA Sequence Number=SeqID_27257
  Gene Ontology: Mol. function=protein-tyrosine kinase activity; Cellular component=integral to membrane; Biological process=protein amino acid phosphorylation
  Homolog annotation: Hit_ID=Q1SXM9; Match level="QueryCoverage=99%, HitCoverage=88%, E-value=0.0, Identity=60%"; Hit description=Protein kinase
  Pfam annotation: Domain name=LRR_1; Domain location=118-140; Score =17.1; E_value=0.064; Accession=PF00560.23; Description=Leucine Rich Repeat
  Pfam annotation: Domain name=LRR_1; Domain location=13-36; Score=2.4; E_value=1e+02; Accession=PF00560.23; Description=Leucine Rich Repeat
  Pfam annotation: Domain name=LRR_1; Domain location=142-161; Score =14.4; E_value=0.41; Accession=PF00560.23; Description=Leucine Rich Repeat
  Pfam annotation: Domain name=LRR_1; Domain location=164-186; Score =14.4; E_value=0.42; Accession=PF00560.23; Description=Leucine Rich Repeat
  Pfam annotation: Domain name=LRR_1; Domain location=37-59; Score =10.1; E_value=3.7; Accession=PF00560.23; Description=Leucine Rich Repeat
  Pfam annotation: Domain name=LRR_1; Domain location=61-83; Score=9.6; E_value=4.5; Accession=PF00560.23; Description=Leucine Rich Repeat
  Pfam annotation: Domain name=LRR_1; Domain location=85-107; Score =14.0; E_value=0.53; Accession=PF00560.23; Description=Leucine Rich Repeat
  Pfam annotation: Domain name=Pkinase; Domain location=378-657; Score=- 10.6; E_value=6.2e-08; Accession=PF00069.15; Description=Protein kinase domain
  Pfam annotation: Domain name=Pkinase_Tyr; Domain location=371-657; Score=-20.7; E_value=3.4e-11; Accession=PF07714.7; Description =Protein tyrosine kinase
  Pfam module annotation: Pfam domain module=LRR_1::LRR_1::LRR_1::LRR _1::LRR_1::LRR_1::LRR_1::Pkinase::Pkinase_Tyr; Domain location=118 -140::13-36::142-161::164-186::37-59::61-83::85-107::378-657::371-657
MKLVPRIRYWGNYVEVVQLSTNSLGGMLPNETSQFLRLTALKVSNNSLEGFLPPILGTYPELEEIDLSLNQLSGFVLPSFFTSTKLINLNLSNNKFSGSIPILFQPPNNPLVSAENFSLVFLDLSHNNLSGTLPSNMSRLHNLAYLNLCNNQLEGTIPDDLPDELRVLNVSFNNLSGVVPESLKQFPDSAFHPGNTMLVFPHSQSSPKDTSNLGLREHRLHKKSATRIALIACLVAGGFVMAFVAIIIYYKAHHEKERTSKQNEAMSITQESTFTSNTEAPDRNLGALPPAQRGSSDDARNIHPVGKKPIDPGPFELGKNEEGTSTPMSILSPSNPSSSKSYQFENPGSLKVSSPDKLVGDLHIFDGSLVLTVEELSCAPAEVIGRSCHGTLYKATLDSGHELAIKWLREGITKGKKELAREIKKLGTIKHPNLVSVQGYYLGPKEHEKLIISNYMNAQSLDIYLQETDKRNLHPLSLDERLRVAVEVARCLHFLHDEKAIPHGNLKSTNILLETPNRNVLLTDYSLHRILTAAGTAEQLLNAGALGYRPPEFSRSSKPCPSLTSDVYAFGVVLLELLTGRNSGEIVSGIPGVVDLTDWVRFLAEQDRSNQCFDRSIMDRHNGERQSKILDEMLKVALRCILPASDRPDMKTVFGDLSTIR

SEQ ID NO: 144036 - protein, 201 aa, Glycine max
  Coding DNA Sequence Number=SeqID_27258
IPQVYTDNHSGISARQRDSKVSMTDLLSTEDDQKVYTDNHSGIFARLRDSKVSMTDLVSAEDNGAEDDVSLCVLPGFSSYRLQKVYTDNHSGISARQRDSKLSMTDLVSAEDDAAKDDVSLCVLSSFSSYRMQKVYTDNHSGISARQRDSKVSMTDLVSTEDDAFRLTNNKNFIRITTRGISARQRDSKVNMTDLVERGKM

SEQ ID NO: 144037 - protein, 94 aa, Glycine max
  Coding DNA Sequence Number=SeqID_27259
MENWRTTLLNNFAGLQSRRWRMHEQRQAMTFMGLRKKVENGELWRMENWRTALRNNFAGLQTRWWRMHEQRQAMTFMGLRKKLENGELANSATQ

SEQ ID NO: 144038 - protein, 78 aa, Glycine max
  Coding DNA Sequence Number=SeqID_27260
  Subcellular localization annotation: CTP_CleavageSite=45; ConfidenceScore=5.18e-01
MLPRTKVQDHHRHQSHDTKIAKPKRVHMTLSLRKTRQQVSRSLCRAHATPPQGDQPKSQGSSPRDMPPSTSIFPYEKL

SEQ ID NO: 144039 - protein, 326 aa, Glycine max
  Coding DNA Sequence Number=SeqID_27261
  Gene Ontology: Mol. function=transferase activity, transferring phosphorus-containing groups; Cellular component=membrane; Biological process=nucleobase, nucleoside, nucleotide and nucleic acid transport
  Homolog annotation: Hit_ID=Q1H0F7; Match level="QueryCoverage=100%, HitCoverage=28%, E-value=1e-116, Identity=62%"; Hit description =Periplasmic sensor hybrid histidine kinase
  Pfam annotation: Domain name=HisKA; Domain location=242-308; Score =81.3; E_value=3e-21; Accession=PF00512.15; Description=His Kinase A (phosphoacceptor) domain
MFMASALSIVAYTGAMGPLAQSFSTFISLFTAMLLSPLIAWYTKGKYYLARQRPKYLQPNATKQCVICEREYEVSDMAHCPAYGGAICSLCCCLDARCHDTCKPHGRLSAQWEALNKRILPKQLWPHLNGGVAHFLLLMVIAVILFGATISLIYLHDALTIGRESPELMHRFRLGYLKVFVAMLFLGGIVAWWLVLTSASRRVAQEESNRQTGLLLEEIESHKKTDAQLQKARRLAEEANQAKSRYITGISHELRTPLNSILGYAQLLTNDDSIPEHRRQAIRTISRGGEHLLSLIESTLDIARIESGKMAFDVKPLHFPEFISQI

SEQ ID NO: 144040 - protein, 80 aa, Glycine max
  Coding DNA Sequence Number=SeqID_27262
MATIALLSRYGSKLAYGTGIRVNCTCFFSGKFLPWSVFWFVLRVVFGIGCAAGDFVADLGVAFVDDWVFLADKVVGNEKG

SEQ ID NO: 144041 - protein, 259 aa, Glycine max
  Coding DNA Sequence Number=SeqID_27263
MAVVKEFYANLYSPEEPAPKQARVRGHLIKIDADNLNEFLQTLVGQPWKLLRKDLTTLAQTWSVFSYSNLAPTSHTSDLNMDKATLVYGLVCNMDMNIGALISGVTSDSLTYESLSPTINLAYIKKNYWNVEDLTVNFRGARKARARLADVPSSSAPPAPSTSTTPTPAPPGLSAQDSQCFEAMLQSLHQGQILLMQSLQVVSPPGSTLLLEQFMEKDASSEATIPGAFDFLGGGLEMRPDKAASPEPILVPADPPSPV

SEQ ID NO: 144042 - protein, 349 aa, Glycine max
  Coding DNA Sequence Number=SeqID_27264
  Gene Ontology: Mol. function=cellulose synthase (UDP-forming) activity; Cellular component=membrane; Biological process=cellulose biosynthetic process
  Homolog annotation: Hit_ID=Q2HT16; Match level="QueryCoverage=95%, HitCoverage=44%, E-value=1e-149, Identity=75%"; Hit description =Cellulose synthase
MRREQTPVSLRMFPLRVIWENKEGLSDELPHLIYVSREKKQEHPHQYKAGAMNVLTRVSGVMTNAPFILNLDCDMHVNNPKIVLHALCILLDSKGEKEVAFAQCIQQFYDGLKDDPLGNQLVAAFRYLGGGLAGLQGIFYLGTNCMHRRKVIYGLSPYHGIQNGKKDHGVSNGKFSEKKTIFGTSKGFVESATHALEGKTFTPNNNICKSLEAASEVSSCEYEYGTAWGKQVGWMYGSTSEDLLTGLKIHTKGWRSEVCSPELSPFMGCSPQDILVVIGQQKRWISGLLDILLSKHCPIFGTLFGKLQFRQCLGYLWITTWSLRPVPEICYAALPAYCIINNSSFLPKV

SEQ ID NO: 144043 - protein, 69 aa, Glycine max
  Coding DNA Sequence Number=SeqID_27265
EEKGFSSRVTVIGVEAPSAYHMAPRSEAPCQVPPVPEAIAGAIGVSPVSVGLDGTTAKKKSDSILAREC

SEQ ID NO: 144044 - protein, 81 aa, Glycine max
  Coding DNA Sequence Number=SeqID_27266
MAMNCGGVVVRFGYIVGPPLYWHFIEHVNHSSSSSSCAPCVCDCSSQPIITIPQVIHECCTTSGLTGISNKAICNRHGIMI

SEQ ID NO: 144045 - protein, 440 aa, Glycine max
  Coding DNA Sequence Number=SeqID_27267
  Gene Ontology: Mol. function=cellulose synthase (UDP-forming) activity; Cellular component=membrane; Biological process=cellulose biosynthetic process
  Homolog annotation: Hit_ID=Q2HT12; Match level="QueryCoverage=95%, HitCoverage=85%, E-value=2e-55, Identity=44%"; Hit description =Cellulose synthase
ELGQWIPATLLVIYNVSTLLENLKIGLSIRTWCNNQRMARITTMNSWFFGFLAILLKRLRISNIGFEITRKDETFSNEGANENDGRFIFNKSPVFIPGTTILLIQLTALVTMWLGWQPPVRNNGHGSGVGEVFCSTYLVVCYWPFLKGLFEKGKIPELPWMDLFVTTADPILEPPIITVNTLLSLLALDYPANKLACYVSDDGEESDTIHPARTLDRRLQVDWAKDAREGPRVLMSLRANEDSLEFRQEWLRVKDEYGELTLKIENTATKPNLFQPVGEHAEFSKAQPTNHPTILKLFYDGLKDDPFGSQLMAMSVVRQISNIIGKNPIRRKLAKEYVASGFAGLQGIMYSGTNCFLRRKVIYGLSPGHDIQIGKEGLGFTNGKTFASIDNLGNVDLEAANQVASCAFERNTAWGQKVAKLGGVDVWINIRGCAHGAKYT

SEQ ID NO: 144046 - protein, 151 aa, Glycine max
  Coding DNA Sequence Number=SeqID_27268
  Homolog annotation: Hit_ID=O80895; Match level="QueryCoverage=76%, HitCoverage=63%, E-value=9e-36, Identity=62%"; Hit description =Expressed protein
  Pfam annotation: Domain name=DUF1068; Domain location=1-143; Score =173.9; E_value=4.1e-49; Accession=PF06364.3; Description=Protein of unknown function (DUF1068)
MVTQFGTIPKTFMYLLVIGYMHVFLTSAMKELERFHECAKHNPKVDGDTENNFAELLSEELNLRETEALKNQHRADMALLESKKIASQYQKEADKCNSGMETCEEAREKAEMALVAQKKLSALWEQRARQKGWNEGLAKSKKQSKGKVHTA

SEQ ID NO: 144047 - protein, 982 aa, Glycine max
  Coding DNA Sequence Number=SeqID_27269
  Gene Ontology: Mol. function=cellulose synthase (UDP-forming) activity; Cellular component=membrane; Biological process=cellulose biosynthetic process
  Homolog annotation: Hit_ID=Q2HT12; Match level="QueryCoverage=72%, HitCoverage=94%, E-value=0.0, Identity=74%"; Hit description =Cellulose synthase
  Pfam annotation: Domain name=Cellulose_synt; Domain location=4-741; Score=356.2; E_value=5.5e-104; Accession=PF03552.5; Description =Cellulose synthase
MDSLIFLLLLILLSYRVYSISHYSFPWFLATLCESWFTLTWLTTISTKWTPARTTTHLDRLFLRVGELPQVDVFVTTADPVLEPPIITINTVLSLLALDYPANKLACYVSDDGCSPLTFYALVEATKFAKLWVPFCKKYNVQVRAPFRYFSEDATVDKNTDLQEFEQEWSLMKKEYEQLCRKIQNASQKSNPCPLVGEYAVFSKTELKNHPSIIKVIWENKEGLRDGVPHLIYISREKRPQHPHHYKAGAMNVLTRVSALMTNAPYILNVDCDMYVNNPKIAQHALCIFLDSKGEKEVAFVQCPQRFYDTVKDDAYGNQLVALPMYIGGGFAGLQGIIYAGTNCFHRRKVIYGLSPDYDIQNMKKDFGFINGTKSQKKTMQIFGASRGFVESAKHALEEMTFTPNDKLFKSLELKAANQVASCDYEYSTAWGKQVGWLYGSTSEDVLTGLVMHTKGWRSEVCSPDPMAFMGCSPQDNLGQMGQHKRWSSGLFDIFLSSHCPIFGTLFGKLQFRECLAYVWITNWALRSVPEICYALLPAYCIITNSSFLPNKEPGMWIPTSVFVMYNVATLLEHLISGLSARTWWNNQRMGRITTMTSCFFGFLDIVLKRLRISDTVFEITKKDQPSSNDENVGRFIFNKSPIFVPGTAILLIQLTALVISWWRWQQSLLKNERTYGLGEVFCSAYLVLCYLPLLKGLFAKGKYGIPLSTICKAMGSDGTAIPLDGIIPAKKVRHNQSRGECDNVLTRALFIGHTGRPGLRPIGPIQVVQQLGPFLLGEPVRLEPVRFVEYNGVPHDELLKAAQQLALLDVEDRVVRTQPEVLSGSTVLEWNRRVHAQRFVDHGLDQVHLFDRVEVAGYGIDQRGEKNGESAVGVEAQHEEQIVDGFFFVVEVVVVSTDEEERVGKGVEEDFFQGLKDAHADWSAPARTLQRNVKRNCCNGKRYETDEDFESDASMLSHSVSRFDSSSDTHMPELLFRISMM

SEQ ID NO: 144048 - protein, 305 aa, Glycine max
  Coding DNA Sequence Number=SeqID_27270
  Gene Ontology: Mol. function=protein binding; Cellular component =nucleus; Biological process=mitotic cell cycle
  Homolog annotation: Hit_ID=Q2HT10; Match level="QueryCoverage=96%, HitCoverage=43%, E-value=1e-112, Identity=67%"; Hit description =Barren
MDDIFENVDGYLFKSLGFRSKKNAWAGTDHWKFQKAKGSESEVHRASEDVLVQKTRQPGTKRQVEVDLDFTSFVEKKISDIFSPPRNPKSLQLPENIPPSITKLPEDCHYEPEDLVNLFLLPYVKCIGRKARKLSGEFADVSGEQCNNYESFPSWDNGSVCDDDVTDVHSEMDDSTSLISQPRQLEHKYDYFQITQINKVEVQYDKTFKQVNVQALKITLWDHIQESVQVPIQGKKEVVSFKHMLTNFPSKCNAAATISDISPHLCFICLLHLANEKGLNIQSCPNLDDLGICLPDDGATITGTV

SEQ ID NO: 144049 - protein, 108 aa, Glycine max
  Coding DNA Sequence Number=SeqID_27271
  Homolog annotation: Hit_ID=Q10MT7; Match level="QueryCoverage=69%, HitCoverage=30%, E-value=4e-16, Identity=55%"; Hit description=Gamma interferon inducible lysosomal thiol reductase family protein, expressed
MSTSRNWALLCETWMLELQYAAETSALEPPHKYVPWVVVDGEPLYEDYENFLSYLCKAYKGTVTPQSCTQASYLREVNAKPKHSVCYKDSGIMLTWEKVRSTIASWMH

SEQ ID NO: 144050 - protein, 171 aa, Glycine max
  Coding DNA Sequence Number=SeqID_27272
  Gene Ontology: Mol. function=scavenger receptor activity; Cellular component=membrane
  Homolog annotation: Hit_ID=Q10MT8; Match level="QueryCoverage=83%, HitCoverage=48%, E-value=6e-36, Identity=52%"; Hit description=Gamma interferon inducible lysosomal thiol reductase family protein, expressed
  Pfam annotation: Domain name=GILT; Domain location=25-151; Score =122.2; E_value=1.5e-33; Accession=PF03227.6; Description=Gamma interferon inducible lysosomal thiol reductase (GILT)
MVSVSLLLFLSFFAFFAPSESHDKVSLELYYESLCPYSANFIVNHLPKIFTPDLAPIVHLKLVPWGNAKLRANATFDCQHGPYECLLNTVEACAIHIWPQLEMKSGATWTNELLVNLESKHFPFIYCVEDLVFQSKREEWESCFEKLDLDSEPINQCYNSEHGKQVKKIRR

SEQ ID NO: 144051 - protein, 307 aa, Glycine max
  Coding DNA Sequence Number=SeqID_27273
  Gene Ontology: Mol. function=transition metal ion binding
MQNSGVTLRAESQHFATVHDDNPFVASIPYFGFIDEIWELNYVKFTVCVFKCKWVDSNTGVRTDDIGFTLVDLKKLAYQNDPFIMAEQAKQVFYVQDPCDERWSVVLNGKTIGVNVEDDDSYMDTYVSPLSTQMTSNNVGEEEADDAEFQIPEASDNRTKKKILQIVGERWRQFKSDLTRKWALAVDKDGADDIVCEKYGISKEKWTQFCQTRRDPSWEDVRKKAQASQKQNTAPHVLSRGGYEYLEEKLMAEKAKKRLEEAAQSGSTEGIIDPPSPIRRHVKWKMAHTKKTGQMTSEAAKEIADRI

SEQ ID NO: 144052 - protein, 82 aa, Glycine max
  Coding DNA Sequence Number=SeqID_27274
MGIMEVEIVADVWDFDIVKHTMHDVGPIDVLLLNYNMFMLLLPNINLMATLNLLKFALPKSVRTTTHVSSVNIDNSNLDGMT

SEQ ID NO: 144053 - protein, 141 aa, Glycine max
  Coding DNA Sequence Number=SeqID_27275
MGILFSAWKSCAKMPGKPDTDDWRVERGEQIQFQSSIYSHHQPWWRGVGENASKSSSDDQLNGSIVNGITRSETNDKSGGGVAKEYQNIKHAMLSTPFTMEKHLAPNPQMELVGHSVVLTSPYSDAQYGQILTTYGQQVMV

SEQ ID NO: 144054 - protein, 54 aa, Glycine max
  Coding DNA Sequence Number=SeqID_27276
  Pfam annotation: Domain name=CBFB_NFYA; Domain location=9-41; Score =29.8; E_value=9.5e-06; Accession=PF02045.6; Description=CCAAT -binding transcription factor (CBF-BNF-YA) subunit B
MPLPLEMEEEPVYVNAKQYHGILRRRQSRAKAEIEKKGGDYTANWEGSTILKKD

SEQ ID NO: 144055 - protein, 475 aa, Glycine max
  Coding DNA Sequence Number=SeqID_27277
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q94IR2; Match level="QueryCoverage=96%, HitCoverage=83%, E-value=0.0, Identity=87%"; Hit description =Carotenoid 9,10-9',10' cleavage dioxygenase
  Pfam annotation: Domain name=RPE65; Domain location=3-466; Score =646.6; E_value=2.1e-191; Accession=PF03055.6; Description=Retinal pigment epithelial membrane protein
MYICLTTKACGELVRDNCIQGTHWVGINFFSSHGRMIHGLRIKDGKATYVSRFVRTSRLKQEEYFGGSKFMKIGDLKGLFGLLMVNIHMLRTKWKVLDVSYGTGTANTALVYHHGKLLALSEADKPYAIKVFEDGDLQTLGMLDYDKRLGHSFTAHPKVDPFTVIPTNKYPVCRGDVYTYRVISKDGYMHDPVPITVSDPIMMHDFAITENYAIFLDLPLIFRPKEMVKNKTLIFSFDSTKKARFGVLPRYAKDEKLIRWFELPNCFIFHNANAWEEEDEVVLITCRLQNPNLDLVGGTAKEKLENFSNELYEMRFNMKTGEASQKKLSASAVDFPRVNESYTGRKQRYVYGTTLDSIAKVTGIIKFDLHAEPDHGKTKLEVGGNVQGLYDLGPGKYGSEAVYVPRVPGTDSEEDDGYLIFFAHDENTRKSFVHVINAKTMSADPVAVVELPHRVPYGFHAFFVTEEQLQEQGKL

SEQ ID NO: 144056 - protein, 1212 aa, Glycine max
  Coding DNA Sequence Number=SeqID_27278
  Gene Ontology: Mol. function=nucleotide binding; Cellular component =chromosome; Biological process=chromosome organization and biogenesis
  Homolog annotation: Hit_ID=Q9SN90; Match level="QueryCoverage=99%, HitCoverage=100%, E-value=0.0, Identity=69%"; Hit description =Chromosome assembly protein homolog
  Pfam annotation: Domain name=ABC_tran; Domain location=872-1191; Score=-51.8; E_value=0.0067; Accession=PF00005.17; Description=ABC transporter
  Pfam annotation: Domain name=DUF869; Domain location=361-887; Score= -352.2; E_value=0.038; Accession=PF05911.2; Description=Plant protein of unknown function (DUF869)
  Pfam annotation: Domain name=ERM; Domain location=735-1006; Score= -206.2; E_value=0.077; Accession=PF00769.9; Description =Ezrinradixinmoesin family
  Pfam annotation: Domain name=KID; Domain location=1048-1058; Score =3.2; E_value=1e+02; Accession=PF02524.5; Description=KID repeat
  Pfam annotation: Domain name=KID; Domain location=204-214; Score=3.5; E_value=87; Accession=PF02524.5; Description=KID repeat
  Pfam annotation: Domain name=KID; Domain location=378-388; Score=2.4; E_value=1.5e+02; Accession=PF02524.5; Description=KID repeat
  Pfam annotation: Domain name=KID; Domain location=433-443; Score=6.3; E_value=22; Accession=PF02524.5; Description=KID repeat
  Pfam annotation: Domain name=KID; Domain location=454-464; Score=1.0; E_value=2.9e+02; Accession=PF02524.5; Description=KID repeat
  Pfam annotation: Domain name=KID; Domain location=506-516; Score=0.6; E_value=3.6e+02; Accession=PF02524.5; Description=KID repeat
  Pfam annotation: Domain name=KID; Domain location=831-841; Score=3.9; E_value=72; Accession=PF02524.5; Description=KID repeat
  Pfam annotation: Domain name=KID; Domain location=901-911; Score=0.3; E_value=4e+02; Accession=PF02524.5; Description=KID repeat
  Pfam annotation: Domain name=Pox_A_type_inc; Domain location=1001 -1023; Score=0.0; E_value=80; Accession=PF04508.3; Description=Viral A-type inclusion protein repeat
  Pfam annotation: Domain name=Pox_A_type_inc; Domain location=370-392; Score=5.4; E_value=13; Accession=PF04508.3; Description=Viral A-type inclusion protein repeat
  Pfam annotation: Domain name=Pox_A_type_inc; Domain location=425-447; Score=13.1; E_value=1; Accession=PF04508.3; Description=Viral A-type inclusion protein repeat
  Pfam annotation: Domain name=Pox_A_type_inc; Domain location=487-509; Score=5.9; E_value=11; Accession=PF04508.3; Description=Viral A-type inclusion protein repeat
  Pfam annotation: Domain name=SMC_N; Domain location=2-1201; Score =348.3; E_value=1.2e-101; Accession=PF02463.9; Description =RecFRecNSMC N terminal domain
  Pfam annotation: Domain name=SMC_hinge; Domain location=530-651; Score=115.2; E_value=1.9e-31; Accession=PF06470.4; Description=SMC proteins Flexible Hinge Domain
  Pfam annotation: Domain name=Tropomyosin; Domain location=309-536; Score=-117.6; E_value=0.067; Accession=PF00261.10; Description =Tropomyosin
  Pfam module annotation: Pfam domain module=ABC_tran::DUF869::ERM::KID: :KID::KID::KID::KID::KID::KID::KID::Pox_A_type_inc::Pox_A_type _inc::Pox_A_type_inc::Pox_A_type_inc::SMC_N::SMC_hinge::Tropomyosin; Domain location=...
  Pfam module annotation: Domain location=872-1191::361-887::735 -1006::1048-1058::204-214::378-388::433-443::454-464::506-516::831 -841::901-911::1001-1023::370-392::425-447::487-509::2-1201::530 -651::309-536
MYIKEICLEGFKSYATRTVVPGFDPFFNAITGLNGSGKSNILDSICFVLGITNLQQVRASNLQELVYKQGQAGITKATVSVVFDNSHSSRSPLGYEGHSEITVTRQLCLPPMLQLFGFRIVVGGRNKYLINGKLAQPSQVQNLFHSVQLNVNNPHFLIMQGRITKVLNMKPQEILSMLEEAAGTRMYETKKEAALKTLEKKQSKVDEINKLLDQEILPALEKLRKEKTQYMQWANGNAELDRLRRFCIAYEYVQAKRIKDNAASEVEEVKARIAEIDDVAKINKVEIKEMETKITQLTAEKEANMGGEMKSLSEKVDALSQNLVRETSVLNNKEDTLRSEEANKANLVKNIEELKHSVQEKASAVKKAEEGVADLKNKVDELTKSLEEHEKEYQGVLAGKSSGNEEKCLEDQLRDAKVAVGSTETELKQLKAKISHCEKELKEKTSQLRSKCEEANAVENELSTRKKDVGNVRMELESLSYKEGEMEDLQKERMTEMDCVQKLKDEIRNLSANLANVEFTYCDPVKNFDRSKVKGVVAKLIKVKDRSTMTALEVTAAGKLYNVVVDTENTGKQLLQNGNLRRRVTIIPLNKIQSYSVSSRVQQAAVRLVGKGNAEVALSLVGYEEELRSAMEYVFGSTFVCKTIDAAKEICIVLFICITLELDGLFYKYLATVAFNREIHTTSVTLEGDIFQPSGLLTGGSRKGGGDLLGQLHALSEAESKLSVHQRRLSEIEAKISKLLPLQKKFIDLKAQLELKLYDLSLFQSRAEQNEHHKLGELVKKIEQELNEVKSTVKDKQLLYKDCVKTVSSLEKSIKDHDNNRESRLKGLEKKIKTIKSQMQSSLKDLKGHDSEKERLVMEMEAVIQEQASLENQLASLGTLISNLASEVEEQRSSVVAARDNLDQVQSQLKSVRLKMKECDQEISAIIKEQQKLEHKISESNLERKRMENEVKRMEMEQKDCSVRVDKLIEKHAWIASEKQLFGRSGTDYDFSSRDPTKAREELEKLQAEQSGLEKRVNKKVMAMFEKAEDEYNDLMSKKNIIENDKSKIKMVIEELDEKKKETLNVTWIKVNNDFGSIFSMLLPGTMAKLEPPEGCSFLDGLEVRVAFGSVWKQSLSELSGGQRSLLALSLILALLLFKPAPLYILDEVDAALDLSHTQNIGRMIKAHFPHSQFIVVSLKEGMFNNANVLFRTKFVDGVSTVQRTVAAKQSK

SEQ ID NO: 144057 - protein, 277 aa, Glycine max
  Coding DNA Sequence Number=SeqID_27279
  Gene Ontology: Mol. function=sequence-specific DNA binding
  Homolog annotation: Hit_ID=Q7N0F1; Match level="QueryCoverage=97%, HitCoverage=76%, E-value=4e-48, Identity=39%"; Hit description =Similar to transcriptional regulator
  Pfam annotation: Domain name=DUF955; Domain location=141-262; Score =42.3; E_value=1.7e-09; Accession=PF06114.4; Description=Domain of unknown function (DUF955)
  Pfam annotation: Domain name=HTH_3; Domain location=10-64; Score =40.9; E_value=4.4e-09; Accession=PF01381.12; Description=Helix-turn -helix
  Pfam module annotation: Pfam domain module=DUF955::HTH_3; Domain location=141-262::10-64
MALKFYGERLRLARLIKGVTLQKIGDAVAVTRQSIHQYESDVRAPATDVLNALAEYLEVSPGFFSVPLSGEVKPEQCHFRKRLTTPAGVKDRVQAYSTILEQNNSEIPELTPPIIEKIAEVARLRWGLTSDAPIDNMINVLENQGAIVTCFDGVFDKVDALSVSRKFPIMIRNKARESACRMRFDLVHECGHLIMHDGIETGCTKTVREADIFASAFLFPRESFAKEFPTCLSKVGSIVWKKIYELMLRWKVSAKAIIFRVNFLGFINAQQYRNANV

SEQ ID NO: 144058 - protein, 735 aa, Glycine max
  Coding DNA Sequence Number=SeqID_27280
  Gene Ontology: Mol. function=protein binding; Cellular component =mitochondrion; Biological process=defense response
  Homolog annotation: Hit_ID=Q19PN1; Match level="QueryCoverage=93%, HitCoverage=53%, E-value=3e-75, Identity=30%"; Hit description=NBS -LRR type disease resistance protein
  Pfam annotation: Domain name=LRR_1; Domain location=581-603; Score =7.7; E_value=11; Accession=PF00560.23; Description=Leucine Rich Repeat
  Pfam annotation: Domain name=LRR_1; Domain location=605-627; Score =9.2; E_value=5.4; Accession=PF00560.23; Description=Leucine Rich Repeat
  Pfam annotation: Domain name=LRR_1; Domain location=629-651; Score =13.9; E_value=0.6; Accession=PF00560.23; Description=Leucine Rich Repeat
  Pfam annotation: Domain name=LRR_1; Domain location=653-674; Score =13.0; E_value=1.1; Accession=PF00560.23; Description=Leucine Rich Repeat
  Pfam annotation: Domain name=LRR_1; Domain location=676-698; Score =10.8; E_value=2.8; Accession=PF00560.23; Description=Leucine Rich Repeat
  Pfam annotation: Domain name=LRR_1; Domain location=700-723; Score =3.2; E_value=71; Accession=PF00560.23; Description=Leucine Rich Repeat
  Pfam annotation: Domain name=NB-ARC; Domain location=216-514; Score =140.4; E_value=4.9e-39; Accession=PF00931.13; Description=NB-ARC domain
  Pfam annotation: Domain name=zf-C2HC_plant; Domain location=11-65; Score=8.0; E_value=0.0046; Accession=PF07567.3; Description=Protein of unknown function, DUF1544
  Pfam module annotation: Pfam domain module=LRR_1::LRR_1::LRR_1::LRR _1::LRR_1::LRR_1::NB-ARC::zf-C2HC_plant; Domain location=581-603::605- 627::629-651::653-674::676-698::700-723::216-514::11-65
MGRPRGDEKYWNEVTSFEENGKQKWKCKHCEKTYGGGYSRIKLHLDKEQKGQGITKCPVYCSNEEVLNIIASTSIHPQETVNTLNPLQVVEDVVAGEMIVPVGAPINHQTNNESTSLFEGWAPEHAIVGSNNSNGIFQSKISVINELVSDLSREEDDIKEQLEWLESRGKKRKGDVDDWMDELRDLKKHVADVDWLGFTNFYASDLVDKLRKHKIDKPLVLSNEFVGEQFELNVGKMWKLLVDDQVFVIGINGMGGVGKTFLATYMENEIKRKGSFRHVFWVTVSHDFTTFKLQHQIAKKIGVKLDGDDERCRATILSSELEKIENSVLILDDVWRYIDLQKVGIPLKVNGKVNGIKLIMTSRLKHVCRQMDCLPDNTIQIYPLKKEEEEEEAWELFLLKLGHRGTPARLPPHVLEIARSVVMKCDGLPLGISAMARTMKGKNEIHWWRHALNKLDRLEMGEEVLSVLKRSYDNLIEKDIQKCFLQSALFPNHIFKEEWVMMLVESGLLDGKRSLEETFDEGRVIMDKLINHSLLLGCLMLRMNGLVRKMACHILNDNHTYLIKCNEKLRKMPQMREWTADLEAVSLAGNEIEEIAEGTSPNCPRLSTFILSRNSISHIPKCFFRRMNALTQLDLSFNLRLTSLPKSLSKLRSLTSLVLRQCSKLKDIPPLGDLQALSRLDISGCDSLLRVPEGLQNLKKLQCLNLSRDLYLSLLPGCALPGLSNMQYLDLRGSS

SEQ ID NO: 144059 - protein, 125 aa, Glycine max
  Coding DNA Sequence Number=SeqID_27281
  Subcellular localization annotation: CTP_CleavageSite=59; ConfidenceScore=5.60e-01
MRRARGNGGRFLNTKKLENNNSNSTSDKGNNTRANASTNSPNTQLLFTNNLNLGSSNVSQATVQHMHTEQSFTIGYHNGNGLTALYRSQANGKKEGNCFGEDEGLYLIQLVMLYRRQFILGLVKW

SEQ ID NO: 144060 - protein, 394 aa, Glycine max
  Coding DNA Sequence Number=SeqID_27282
  Gene Ontology: Mol. function=motor activity; Cellular component =nucleus; Biological process=signal transduction
  Homolog annotation: Hit_ID=Q5ZAY6; Match level="QueryCoverage=82%, HitCoverage=71%, E-value=1e-95, Identity=62%"; Hit description =Putative WDR13 protein
  Pfam annotation: Domain name=WD40; Domain location=112-150; Score =41.1; E_value=3.9e-09; Accession=PF00400.22; Description=WD domain, G-beta repeat
  Pfam annotation: Domain name=WD40; Domain location=154-192; Score =10.4; E_value=2.2; Accession=PF00400.22; Description=WD domain, G -beta repeat
  Pfam annotation: Domain name=WD40; Domain location=244-287; Score =6.9; E_value=5.7; Accession=PF00400.22; Description=WD domain, G -beta repeat
  Pfam annotation: Domain name=WD40; Domain location=298-340; Score =1.2; E_value=26; Accession=PF00400.22; Description=WD domain, G-beta repeat
  Pfam annotation: Domain name=WD40; Domain location=346-384; Score =27.4; E_value=5.1e-05; Accession=PF00400.22; Description=WD domain, G-beta repeat
  Pfam annotation: Domain name=WD40; Domain location=68-107; Score=2.2; E_value=20; Accession=PF00400.22; Description=WD domain, G-beta repeat
  Pfam module annotation: Pfam domain module=WD40::WD40::WD40::WD40::WD4 0::WD40; Domain location=112-150::154-192::244-287::298-340::346 -384::68-107
MQLSHLCGRWFPSPTPHGTRWSEVDSLSSGRDLQNANPVYNHRTSFGSSVSDSDRPRHRGVEAAYSFVGMHCIFDQCKASVTVLKFGHMSSDLLAYGASDGTLTVCSVSENPSVIKQLNGHSKDVTDFDFTSNNQYIASSSLDKTVRVWEIAKGICIRVIYGVSSQLCIRFHPVNNNFLSVGNANKEINVFNFSTGRVINRSIFDSEVTSMDHDHTGHLLFCGDAQGCIYSVNMNSHTGVLSRSHRYRSSSRHKSAVTTVQYRSFSLLARGPVLLTCTQDGNLSFFSVALEIKGYLTLRCSLKLAPRIHKIQASFCPLLSLEKGEFIVAGSEDSNVYFYDLTKPKNTCVNKLQGHRFPVMGIAWNHGENLLASSDFYGIVIVWKRERSHQKRNT

SEQ ID NO: 144061 - protein, 600 aa, Glycine max
  Coding DNA Sequence Number=SeqID_27283
  Gene Ontology: Mol. function=protein binding; Cellular component =mitochondrion; Biological process=defense response
  Homolog annotation: Hit_ID=Q19PN3; Match level="QueryCoverage=96%, HitCoverage=52%, E-value=2e-56, Identity=30%"; Hit description=NBS -LRR type disease resistance protein
  Pfam annotation: Domain name=LRR_1; Domain location=193-215; Score =11.3; E_value=2.2; Accession=PF00560.23; Description=Leucine Rich Repeat
  Pfam annotation: Domain name=LRR_1; Domain location=217-239; Score =14.6; E_value=0.37; Accession=PF00560.23; Description=Leucine Rich Repeat
  Pfam annotation: Domain name=LRR_1; Domain location=241-263; Score =14.8; E_value=0.32; Accession=PF00560.23; Description=Leucine Rich Repeat
  Pfam annotation: Domain name=LRR_1; Domain location=265-286; Score =12.0; E_value=1.6; Accession=PF00560.23; Description=Leucine Rich Repeat
  Pfam annotation: Domain name=LRR_1; Domain location=288-309; Score =13.3; E_value=0.9; Accession=PF00560.23; Description=Leucine Rich Repeat
  Pfam annotation: Domain name=LRR_1; Domain location=311-337; Score =7.8; E_value=9.7; Accession=PF00560.23; Description=Leucine Rich Repeat
  Pfam annotation: Domain name=LRR_1; Domain location=495-519; Score =4.3; E_value=44; Accession=PF00560.23; Description=Leucine Rich Repeat
  Pfam annotation: Domain name=LRR_1; Domain location=521-542; Score =3.9; E_value=53; Accession=PF00560.23; Description=Leucine Rich Repeat
  Pfam annotation: Domain name=LRR_1; Domain location=554-576; Score =0.1; E_value=2.8e+02; Accession=PF00560.23; Description=Leucine Rich Repeat
  Pfam annotation: Domain name=LRR_1; Domain location=578-599; Score =2.9; E_value=81; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=193 -215::217-239::241-263::265-286::288-309::311-337::495-519::521 -542::554-576::578-599
MLKLGHHGTPATLPPQVVEIARSVVRKCDGLPLAINVMARTMKGCYDTIMWKHELNKLENLEMGEEVKEEVFTVLKRSYDNLIEKDLQKYLLYFAQIPNNSGFQSKSYLVKKLVESGLLKNVKRSLREVFDEACAMANKLVDHSLFVGYDYHTKMHGLVRNMACRILNESNNYMVKCEGNLSEIPDVKEWIVDLEVVSLGGNRIKEIPEGISPNCPRLSTLILSGNCIGHIPEGFFIHMNALTVLNISYNDFLTSLPHSLSNLRSLVSLVLQNCSNLEYIPPLGELQALSRLDISGCSIRQVPEGLKNLINLKWLDMSINEHLTLAPRCVLPGLTNLQYLDLRCDSAIIAEDVQGMSMLECFGGIFLGKDNYNSYVQEILDRGHGPKTYDIHVEDVRDLIFAFDIDDPVSLYEDHQNVRFWQCEGLLYLLPRDLKKLSMERNDQWVCLCGALSSSGPLSSLNQIDIIGGYSFTAICEEDAVDLTRSLSPRGVFSNLKKFQLSQCHEIETLLTPLLVPQLQNLEVLSVESCRSMREIFAVSNSGNDDNFNIILPKLIRLRLWNLPELTTVCREILVCGSADILFINHCPKLERLPRIVVYD

SEQ ID NO: 144062 - protein, 234 aa, Glycine max
  Coding DNA Sequence Number=SeqID_27284
  Gene Ontology: Cellular component=integral to membrane; Biological process=lipopolysaccharide biosynthetic process
  Homolog annotation: Hit_ID=P77377; Match level="QueryCoverage=57%, HitCoverage=36%, E-value=6e-11, Identity=25%"; Hit description =Lipopolysaccharide biosynthesis protein wzxC
MDRSTYPLLSEKEFVEIARRILAGKYNNAKGFYNDLADFLLTGGDTAQTPQQLRARGIILLSEHHLINSIATWPVLKEYGDTRKKSGQRQMLSLLAQILQANELNLLAIAVVILLVIDTLADRGFGNALIRYQSLNNSELSKLYWGNGQHYRAILQREKQFTRIAFTETSSVLAGLAVTLFTVWLTPSVLCAIWGYLAMVSIRMLIYCYYGRPWFQPEYRFSLKAFAAVRARNG

SEQ ID NO: 144063 - protein, 72 aa, Glycine max
  Coding DNA Sequence Number=SeqID_27285
MSSKLEGKGKREMFDGMEYRFNQMGNINWGHKLGIPVEPCKFTWTHIDRTITSCATSKKQIGNSVARWEPSS

SEQ ID NO: 144064 - protein, 408 aa, Glycine max
  Coding DNA Sequence Number=SeqID_27286
  Gene Ontology: Mol. function=nucleic acid binding; Cellular component= nucleus
  Homolog annotation: Hit_ID=Q9SJT4; Match level="QueryCoverage=99%, HitCoverage=45%, E-value=1e-101, Identity=47%"; Hit description =Expressed protein
  Pfam annotation: Domain name=RRM_1; Domain location=277-353; Score =64.1; E_value=4.5e-16; Accession=PF00076.12; Description=RNA recognition motif. (a.k.a. RRM, R
VARTVIFGGLINSDMAEEVHGKAREIGTVCSIKYPLSRKDLEQHGLLQDGCTLDASAVLYTSVKSARASVATLHRKEIGGGNIWVRQLGGEGSKTQKWKLIVRNLPFKAIQKLNGSKFAKRLIAVDWAVSKKIFSSDTNNALASEKGQQNMSDEDSTDEDFELVDKRSGQGDSDTDYSSAMEEEGTPPEDNFDKEADIAKKVLNNLLTSSSKGTSVNNDSMLIKENKGSRSDEIVKDADEKASNESEKVSGVSKPEISSRNNLLNPKGTEDDLQRTVFISNLPFECDNEEVKQRFSGFGEIEYFVPVLHQVTKRPRGTGFLKFKTVEAANTVISTARAASGMGILLKGRPLKVLKALDKKSAHDKELEKAKNEVHDHRNLYLAKEGLILEGTTAAEGVSASDMLKRLE

SEQ ID NO: 144065 - protein, 117 aa, Glycine max
  Coding DNA Sequence Number=SeqID_27287
MAYVGSTFMTLLLIPPYFSIQSLAKKLPINFIRVPLHSHPVYVPRAQTGEILFDEDMTKSKGKDPLEGLGGPMTRARARKANEVLQQVLFILFEYKPKFQGEKSKVVSCIMTQMEED

SEQ ID NO: 144066 - protein, 181 aa, Glycine max
  Coding DNA Sequence Number=SeqID_27288
  Pfam annotation: Domain name=Ank; Domain location=5-38; Score=19.2; E_ value=0.015; Accession=PF00023.20; Description=Ankyrin repeat
MNDQYGRIPLHYTAMRGRMEIARELIGAKPESLMMLDGSDNFEKASTVRYLLSISKIREEANIKKMGYTALDMLEHGPKDTRSLQIQIMLMDVGFKNNERNQLDHPPSTTTLAIVVPSSMTIDPNEKYWSKFLKRVNKFLQLKSNRLEEMRGMLSLISTMISTVTFGVVMNLPGGNNTYQC

SEQ ID NO: 144067 - protein, 93 aa, Glycine max
  Coding DNA Sequence Number=SeqID_27289
  Homolog annotation: Hit_ID=Q2HT10; Match level="QueryCoverage=74%, HitCoverage=9%, E-value=3e-07, Identity=47%"; Hit description=Barren
MEQVENLVFVETGMRMGWLGVEVGGEGLAADCGGAGFTGLGPFKLVVVGAHEERARRRLDTSGHGNRLFVREGTGQQRYLPRKETDVAVLWPK

SEQ ID NO: 144068 - protein, 36 aa, Glycine max
  Coding DNA Sequence Number=SeqID_27290
MVDFLPTAVDNLRRKACHGSAIRQAVHLKLESKYTP

SEQ ID NO: 144069 - protein, 148 aa, Glycine max
  Coding DNA Sequence Number=SeqID_27291
  Homolog annotation: Hit_ID=Q2HT09; Match level="QueryCoverage=65%, HitCoverage=56%, E-value=4e-24, Identity=59%"; Hit description=Acid phosphatase/vanadium-dependent haloperoxidase related
  Pfam annotation: Domain name=DUF212; Domain location=18-146; Score =6.9; E_value=1.6e-06; Accession=PF02681.5; Description=Divergent PAP2 family
  Subcellular localization annotation: CTP_CleavageSite=9; ConfidenceScore=5.23e-01
MADVTANLQAATTASTPYALPTNLPLLSAFLSFALAQFLKIFTSWYKEKRWDSKRLLDSGGMPSSHSATVSALAVAIGLQEGAGSTAFAVAVVLACILHVQYLFSEDLCLLNPLMPQFQIIPYPLKNNSNSKFNISIMIVMMLPLMEY

SEQ ID NO: 144070 - protein, 49 aa, Glycine max
  Coding DNA Sequence Number=SeqID_27292
  Gene Ontology: Cellular component=nucleus; Biological process=rRNA processing
  Homolog annotation: Hit_ID=O82346; Match level="QueryCoverage=92%, HitCoverage=23%, E-value=4e-18, Identity=89%"; Hit description =Expressed protein
  Pfam annotation: Domain name=Fcf1; Domain location=1-39; Score=14.2; E_value=8.7e-06; Accession=PF04900.3; Description=Fcf1
MHKCYIVATCDRDLKRRIRKIPGVPIMYITKRKYSIERLPEATIGGAAP

SEQ ID NO: 144071 - protein, 576 aa, Glycine max
  Coding DNA Sequence Number=SeqID_27293
  Gene Ontology: Mol. function=oxidoreductase activity, acting on NADH or NADPH; Cellular component=membrane; Biological process=electron transport
  Homolog annotation: Hit_ID=P77611; Match level="QueryCoverage=68%, HitCoverage=53%, E-value=0.0, Identity=89%"; Hit description =Electron transport complex protein rnfC
  Pfam annotation: Domain name=Complex1_51K; Domain location=296-519; Score=337.7; E_value=1.9e-98; Accession=PF01512.8; Description =Respiratory-chain NADH dehydrogenase 51 Kd subunit
  Pfam annotation: Domain name=FeS; Domain location=43-77; Score=55.2; E_value=2.1e-13; Accession=PF04060.3; Description=Putative Fe-S cluster
  Pfam annotation: Domain name=Fer4; Domain location=110-133; Score =34.1; E_value=5e-07; Accession=PF00037.17; Description=4Fe-4S binding domain
  Pfam annotation: Domain name=Fer4; Domain location=140-163; Score =23.0; E_value=8.6e-05; Accession=PF00037.17; Description=4Fe-4S binding domain
  Pfam annotation: Domain name=Fer4; Domain location=549-572; Score =14.1; E_value=0.0022; Accession=PF00037.17; Description=4Fe-4S binding domain
  Pfam annotation: Domain name=NQRA; Domain location=209-575; Score= -246.6; E_value=0.038; Accession=PF05896.2; Description=Na(+) -translocating NADH-quinone reductase subunit A (NQRA)
  Pfam module annotation: Pfam domain module=Complex1_51K::FeS::Fer4::Fe r4::Fer4::NQRA; Domain location=296-519::43-77::110-133::140-163::549- 572::209-575
MTAIWIAIAVLAALALVFGALLGYASRRFEVEEDPIVEQIDAILPQSQCGQCGYPGCRPYADAVGNNGEAINKCAPGGEQTMLKLAELLNVEPQPLDGGAEVLTPVRTVAWIDEANCIGCTKCIQACPVDAIVGATRAMHTVLSDVCTGCNLCVAPCPTQCIDLRPVAQTTETWKWDLQAIPLFSAFRKDKIWDFNGGIHPPEMKTQSNGTPLRQVPLPQRFVIPLKQHIGAEGELCVQPGDKVLRGQPLTRGFGRMLPVHAPTSGTVTAISPHSTAPPFSLAELSVIIDADGEDCWIERDGWSDYRSQCREALIERIHQFGVAGLGGAGFPTGVKLRGGSDKIQTLIINAAECEPYITADDRLMQDCAAQVVEGIRILAHILQPREVLIGIEDNKPQAISMLRAVLAGSHDIALRVIPTKYPSGGAKQLTQILTGKQVPHGGRSSDIGVLMQNVGTAYAVKRAVIDGEPLTERVVTLTGESVSRPGNVWARLGTPVRHLLEQAEFCPGTDQMVIMGGPLMGFTLPWLDVPVVKITNCLLAPSSTEMGEVQEEKGCIRCSACADACPADLLPQQLY

SEQ ID NO: 144072 - protein, 58 aa, Glycine max
  Coding DNA Sequence Number=SeqID_27294
MRETITKLNVELLAKVNKERTLESIMSAPGPSTTTVHETDHHVDYAQVDRPHDMSMDH

SEQ ID NO: 144073 - protein, 614 aa, Glycine max
  Coding DNA Sequence Number=SeqID_27295
  Gene Ontology: Mol. function=microtubule motor activity; Cellular component=microtubule associated complex; Biological process =microtubule-based movement
  Homolog annotation: Hit_ID=Q2HT07; Match level="QueryCoverage=98%, HitCoverage=43%, E-value=0.0, Identity=82%"; Hit description=Kinesin, motor region; Prefoldin
  Pfam annotation: Domain name=Kinesin; Domain location=93-425; Score =546.9; E_value=2.1e-161; Accession=PF00225.13; Description=Kinesin motor domain
MAFLSEAASAIKSRFGFHDHPSESLSLVQNTPDLFKSAVKDTLSQSSIVRNLSDWDDESVVGPSSAAVSSSQSFEFGEDPSFWKDHNVQVIIRMRPLSNSEISVQGYGKCVRQESSQAITWTGHPESRFTFDLVADENVSQENLFKVAGLPMVENCMGGYNSCMFAYGQTGSGKTHTMLGDIEGGTRRHSVNCGMTPRIFEHLFTRIQKEKEARRDEKLKFTCKCSFLEIYNEQILDLLDPSSNNLQIREDSKKGVYVENLKETEVTYAREVIQLLIQGAANRKVAATNMNRASSRSHSVFTCIIESQWESQGVTHFRYARLNLVDLAGSERQKSSGAEGERLKEATNINKSLSTLGLVIMNLVSISNGKSHHVPYRDSKLTFLLQDSLGGNSKTIIIANISPSICCSLETLSTLKFAQRAKFIKNNAIVNEDASGDVIAMRIQIQQLKKMFGGTFSVHFLGKKEVSRLRGLVGGGEIQDNDISVVSFPGSPGSFKWEGVQGSFSPLTSVKRISQKKDYDIALVGAFRREKDKEMELQALRDEIQASMKLVKQREDEIQSLKMRLRFREAGIKRLETVASEKISAETHLLKEKEEHLKEIEVLRAQVKVILYGR

SEQ ID NO: 144074 - protein, 764 aa, Glycine max
  Coding DNA Sequence Number=SeqID_27296
  Gene Ontology: Mol. function=microtubule motor activity; Cellular component=microtubule associated complex; Biological process =microtubule-based movement
  Homolog annotation: Hit_ID=Q2HT07; Match level="QueryCoverage=97%, HitCoverage=54%, E-value=0.0, Identity=63%"; Hit description=Kinesin, motor region; Prefoldin
MIMFCHNTPSKAKACNQHIMLKSFCMEGEREWMSEQIMVLENKLLEALDWKFMHETDLKTNSDLMMEDVHNDGNLISKQESSPKSRWQSLLREENEFLKIQAIQNQAEMDTICKKLEVCLEEKEKLKSHVDDLMAKLEQEKCQTINEGKERMDLPSTTDMPVINSNDQLELKAMVDAIASASQREAEAHETAIMLAKENDELKMKLKALIEDNSKLIELYEQAAAENNNRNVNKGEDAQEIGSKIDNGCYSLETTKEETELKGVVENLQHQLMEMNEENEKLLSLFERAMQERDEIKKTLSCFGHERVETKGDMDFPEKLVEVDGGERDSRVQTVSQEVQGRDESECEPSTSGSDMDIECGAHEQEQILKDDNGADILVNSEKKYEVSDLSEAKLTEELNCATKKLERVDEHISDAVKTIASLGCAEKAMAQVDELSREIEVTEQDIQVKRQQFESLKLQLSEAQERRTIVNKKFSALKYSLSNFSSTYSYFEQREARARAVVNDLTSHLDQKKGELAALQASKQGLENAQKKNQECEVEIVKNIACIKSKLEEENRKREGEKVLFAVENTQNIGSALKNLHLNCKATELLKLEEEKTKLQAEMKISLEKLGVIRKELGNLNKKEANVESQIQAVQLEIKQCLRNTEEKELALQRVMKEKGMLLEFRDNGMSEIEHMIIELQQYVFDYDLKEAEIKILGEELQIDLIRAEELQTARIIAANNKNNVLSSISYSGMFEKLKEEMQNLRATIFDTKLLLEGISHAT

SEQ ID NO: 144075 - protein, 104 aa, Glycine max
  Coding DNA Sequence Number=SeqID_27297
MRLPGKESLLMKSPITINEILDVSISFLNDHLEETPGSTKIEEIHSKCINLAQCGAKKSLAHGILGKVYGESGFWLKACRMARHDTCQGLVWFKDKKGCPTLFP

SEQ ID NO: 144076 - protein, 173 aa, Glycine max
  Coding DNA Sequence Number=SeqID_27298
MTQMVLLRSPPVTRRRGRRGVGEVAGSATAECAAVCCCVPLTVMDMVVLATYKLPACLLKKAMHKRKRRLLQKKKKKTEALLDHGPVTADNAGPGPKLEDHLAKEVAEEKLEASRLEAEMWAQFNGTGFWRSASQRYQQQQTGQIKPIINLPIEPLTYYIDQVTDRVGFPNYG

SEQ ID NO: 144077 - protein, 359 aa, Glycine max
  Coding DNA Sequence Number=SeqID_27299
  Gene Ontology: Mol. function=strictosidine synthase activity; Cellular component=cellulose and pectin-containing cell wall; Biological process=biosynthetic process
  Homolog annotation: Hit_ID=Q9C586; Match level="QueryCoverage=99%, HitCoverage=88%, E-value=1e-100, Identity=53%"; Hit description =Putative strictosidine synthase-like
  Pfam annotation: Domain name=Str_synth; Domain location=178-251; Score=19.3; E_value=1.7e-05; Accession=PF03088.7; Description =Strictosidine synthase
MPAWSEVPTDRDKDNSLLKSELLFVNQVQGPESIAFDPLGRDPYTGVADGRILFWNGQSWTDFAYTSPNRSHFSSFLLTLPTQLLNITILTSQTKKLGFNSSKHVSEQYNPKASASPMSYVKTEHICGRPLGLRFDKKSGDLYIADAYFGLMKVGPQGGLATSLATEAEGVPLRFTIDVDIDTEGNLYFTDSSTNFQRSNFIQLVLSGEASGRVLKYKLPLRNHCSHEERSISKRHLLKQGWLRKYWLKGDKAGTSEILAILPVFLTTRYMYSYLNSLYPKMRKVILKLPIPTRIQYMFHIGGRFHAVAVKYSPEGKLLRILEDSEGKVVRAVSAVEEKDGKLWVGSVLMPFMAVHNLT

SEQ ID NO: 144078 - protein, 445 aa, Glycine max
  Coding DNA Sequence Number=SeqID_27300
  Gene Ontology: Mol. function=transferase activity; Biological process= cell adhesion
  Homolog annotation: Hit_ID=Q8RWC5; Match level="QueryCoverage=88%, HitCoverage=88%, E-value=1e-150, Identity=70%"; Hit description =Fasciclin-like arabinogalactan protein 16 precursor
  Pfam annotation: Domain name=Fasciclin; Domain location=268-401; Score=20.5; E_value=7.2e-05; Accession=PF02469.12; Description =Fasciclin domain
  Pfam annotation: Domain name=Fasciclin; Domain location=51-174; Score= 99.9; E_value=7.6e-27; Accession=PF02469.12; Description=Fasciclin domain
  Pfam module annotation: Pfam domain module=Fasciclin::Fasciclin; Domain location=268-401::51-174
MDRRIYGVSGHRIFLSLLFLVSVFPQALTLSPSPTAQINSNSILVALLDSHYTELAELVEKAMLLQKLEDTVATHNITIFAPTNEALDRNLDPDFKRFLLEPANLHSLQTLLLSHITPAQIGSKTLTRHVTSLSDHNLKLSENLTTVDEAKVTHPDVVTRPDGVIHGIDRLLLPRSVEDDFNRRRSLRSITAVKPEPSPEIDPRTHRLKKPPPPVKPGSSPELPIYDAMAPGPALAPAPAPGPGGPHHHFNGERQVEDFIHTLLHYGGYNEMADILVNLTSLAVEMGRLVSEGYVLTVLAPNDEAMAKLTTEQLSEPGAPEQIMYYHIIPEYQTEESMYNAVRRFGKVRYDTLRLPHKVVAQEADGSVKFGHGDGSAYLFDPDIYTDGRISVQGIDGVLFPTVEVEGAERVRPVTRTGQNGAKVVVKHRRGAYDIPTSFCVYDRL

SEQ ID NO: 144079 - protein, 422 aa, Glycine max
  Coding DNA Sequence Number=SeqID_27301
  Gene Ontology: Mol. function=zinc ion binding
  Homolog annotation: Hit_ID=Q2HT04; Match level="QueryCoverage=84%, HitCoverage=90%, E-value=1e-125, Identity=66%"; Hit description=Zinc finger, RING-type
  Pfam annotation: Domain name=zf-C3HC4; Domain location=44-84; Score =35.8; E_value=1.5e-07; Accession=PF00097.15; Description=Zinc finger, C3HC4 type (RING finger)
MEGAGMEENNIINDDDNNNKSEAHLTSAAAFVEGGIQDACDDACSICLEAFCDSDPSTVTSCKHEFHLQCILEWCQRSSQCPMCWQPISLKDPTSQELLEAVERERNFRFNPSRNATIFHHPTLGDFELQHLPVGASDADLEERIIQHLAAAAAMGRARHIARREGQRNRSSAQGRPHFLVFSTNPNSPPMAPASSSPSQRGDDEPIPTIAVANLSPTPATGEESSQLTLVPPIQAEQVSASGSGSTALATDHQGSSYNNRRSPNQSSPSSQDRAGPSELQSFSESLKSKLNAVSTRYKESISKSTRGWKERWFSRNNTMSDLGSEVRREVNAGIATVSRMMERLETSDNNRSNSNSAPSNIEDGSVQEYNGQTLTPGNEGDDFASELNICMLVLVEIELPIGDVKFHGCDALPIGWRRPGK

SEQ ID NO: 144080 - protein, 577 aa, Glycine max
  Coding DNA Sequence Number=SeqID_27302
  Gene Ontology: Mol. function=nucleic acid binding; Cellular component= nucleus; Biological process=regulation of transcription, DNA-dependent
  Homolog annotation: Hit_ID=Q6Z0U0; Match level="QueryCoverage=95%, HitCoverage=71%, E-value=1e-175, Identity=55%"; Hit description =Putative SNF2 domain/helicase domain-containing protein
  Pfam annotation: Domain name=Helicase_C; Domain location=424-502; Score=62.5; E_value=1.4e-15; Accession=PF00271.21; Description =Helicase conserved C-terminal domain
  Pfam annotation: Domain name=ResIII; Domain location=43-223; Score= -13.7; E_value=0.00065; Accession=PF04851.6; Description=Type III restriction enzyme, res subunit
  Pfam annotation: Domain name=SNF2_N; Domain location=49-390; Score =22.6; E_value=2.5e-09; Accession=PF00176.13; Description=SNF2 family N-terminal domain
  Pfam module annotation: Pfam domain module=Helicase_C::ResIII::SNF2 _N; Domain location=424-502::43-223::49-390
VKRSTRTYASDSWNSKGKADVFGINVAEDDLVVTDIAAHPRHMKQMKPHQVEGFNFLVRNLAGDHPGGCILAHAPGSGKTFMIISFMQSFLGKYPNARPLVVLPKGILSTWKKEFQTWQVEDIPLYDLYTVKADSRSQQLEVLKQWMEQKSILFLGYKQFSSIVCDNGTNNTSLSCQEILLKIPTILILDEGHNPRNENTDMVQSLAKVQTARKVVLSGTLYQNHVREVFNILNLVRPKFLKMETSRPIVRRIHSRVHIPGVRSFYDLVENTLQKDTDFKRKIAVIQDLREMTSKVLHYYKGDFLDELPGLVDFTVVLTLSPRQKPEIQKLKKLSRRKFKINSVGSAVYLHPKLKPLAENCGENSTSDNIMDDLIEKLDMRDGVKSKFYYNMLNLCESAGEKLLVFSQYLLPLKYLERLTMKWKGWSLGREIFVISGESSSEQREWSMEKFNNSPDARVFFGSIKACGEGISLVGASRIIILDVHLNPSVTRQAIGRAFRPGQMKKVFVYRLVSADSPEEEDHNTCFKKELISKMWFEWNEYCGDRAFEVEAVEVKECGDLFLESPLLGEDVKALYK

SEQ ID NO: 144081 - protein, 282 aa, Glycine max
  Coding DNA Sequence Number=SeqID_27303
  Gene Ontology: Mol. function=nucleic acid binding
MESADDVSASKRPLPTGFSPGPDGPKRLRLSSDSLPYPACDQIEPKTPKNPNVVDYSNPFAITDILDRLENGKFGSVTKDIEALIALKMQIMGPYFAKYPILVNQLLKVVTHHDEETPKLENQQVTGLTHQSVIDLEGEYTEKDVPAVPNTVVIIDSDEEDDRDKKSVIPFHEVVLPRKVAPSPALKVIGYHTYLGESNDLKIEINMADKGNNTRSNKGVYVGAQGEEEDKADTEDDGLQDIWKEMSMAIECSKHTVIVIGIQYIALWLNLSMLYLLYAYNM

SEQ ID NO: 144082 - protein, 53 aa, Glycine max
  Coding DNA Sequence Number=SeqID_27304
  Gene Ontology: Mol. function=transcription factor activity; Cellular component=intracellular; Biological process=regulation of transcription, DNA-dependent
  Homolog annotation: Hit_ID=Q8ZPG2; Match level="QueryCoverage=98%, HitCoverage=32%, E-value=3e-16, Identity=81%"; Hit description =Putative marR-family transcriptional regulator
PQLFQLRHLAADGGVIAPGAIGQLDHAEGTKAANLDQQRKQGAIQLDTGLFYQ

SEQ ID NO: 144083 - protein, 311 aa, Glycine max
  Coding DNA Sequence Number=SeqID_27305
  Gene Ontology: Mol. function=oxidoreductase activity
  Homolog annotation: Hit_ID=Q20Z18; Match level="QueryCoverage=99%, HitCoverage=99%, E-value=8e-69, Identity=48%"; Hit description =Alcohol dehydrogenase, zinc-binding
  Pfam annotation: Domain name=ADH_N; Domain location=25-100; Score= -9.0; E_value=0.0043; Accession=PF08240.2; Description=Alcohol dehydrogenase GroES-like domain
  Pfam annotation: Domain name=ADH_zinc_N; Domain location=131-272; Score=44.4; E_value=4e-10; Accession=PF00107.16; Description=Zinc -binding dehydrogenase
  Pfam module annotation: Pfam domain module=ADH_N::ADH_zinc_N; Domain location=25-100::131-272
MKAAIVSAAGEKPVWGDFPPPQADEQHVVVTVKAAAISQLAKARAAGAHYSAGSHYPFIAGIDGTGTLSNGDPVYFLAFSAPWGSMAQQTRVPAAAVVALPPTLDPLLAAAIANPGMSSWAALTRRAQFQAGETVLINGATGTSGGLAVRIARHLGAGKIIATGRNRAVLEQLRTQGADIILTLDELPGALPALMQQGIDVVLDYLWGQSALDIMHAAVAGGEKTVRFVQIGSLSGQEIALHSKLLRSSGLTLMGSGLGSVSDSELIACIGEMLNAAAESDFSIAFQQRPLSEVEQAWQQDDSRCRTVFTL

SEQ ID NO: 144084 - protein, 590 aa, Glycine max
  Coding DNA Sequence Number=SeqID_27306
  Gene Ontology: Mol. function=small protein activating enzyme activity; Cellular component=nucleus; Biological process=protein modification process
  Homolog annotation: Hit_ID=Q8LKN2; Match level="QueryCoverage=92%, HitCoverage=95%, E-value=1e-162, Identity=53%"; Hit description=SUMO activating enzyme 2
  Pfam annotation: Domain name=ThiF; Domain location=10-189; Score =48.3; E_value=2.6e-11; Accession=PF00899.11; Description=ThiF family
  Pfam annotation: Domain name=UBACT; Domain location=334-404; Score =126.1; E_value=9.8e-35; Accession=PF02134.11; Description=Repeat in ubiquitin-activating (UBA) protein
  Pfam module annotation: Pfam domain module=ThiF::UBACT; Domain location=10-189::334-404
MAYSSPSVIKDAKVLMVGAGGIGCELLKTLALSGFPDIHIVSSLLYSGLSNFELCVFGDIGGVCESEEGSHVGAYSLLASIAFVLIEVRDDGSRVFVSGVSVFHQSDEVFNQVARDAVLKFRPHINITPYHANVKDPEFNVDFFKQFNVVLNGLDNLDARRHVNRLCLAANVPLVESGTTGFLGQDLLFAKLFGDKNQDNDLNVRSSDAASSSKNVEDVFERRKDEDIDQYGRKIFDHVFGYNIELALSNEETWKNRNRPKPIYSKDILSDEPAQQNGNLEKKYESDELSVSAMASLGMKNPQDIWSLKENSRIFLEAFRLFFTKREKEIGNLSFDKDDQLAVEFVTAAANIRAASFGIPLQNLFEAKGIAGNIVHAVATTNAVIAGLIVIEAIKVLKNDIKNYRYDVISPPAKLGMNLPLIMCASNLLYEAGDVEDDMIAIYEANLEKALAELPSPVTGGTMLTVEDMQQEFVCNINIKHREEFDEEKEPDGMVLSGWTQPVSAAENKDKSVGNGASTSDALITAVESEKDDEITIVSALKKRKLPDESDISNSAAEAKNQKQLEVIDDEDDLVMLDGDLNSVKKRRLS

SEQ ID NO: 144085 - protein, 683 aa, Glycine max
  Coding DNA Sequence Number=SeqID_27307
  Homolog annotation: Hit_ID=P0ADQ2; Match level="QueryCoverage=40%, HitCoverage=84%, E-value=1e-124, Identity=79%"; Hit description =Hypothetical protein yiiD
  Pfam annotation: Domain name=Acetyltransf_1; Domain location=367-443; Score=69.4; E_value=1.2e-17; Accession=PF00583.14; Description =Acetyltransferase (GNAT) family
  Pfam annotation: Domain name=Tyr_Deacylase; Domain location=215-353; Score=272.5; E_value=8.5e-79; Accession=PF02580.7; Description=D-Tyr- tRNA(Tyr) deacylase
  Pfam module annotation: Pfam domain module=Acetyltransf_1::Tyr _Deacylase; Domain location=367-443::215-353
MTTQAGNLAYVSLLALVPLIAVVFALFAAFPVFSDISVQLKNFIFTNFMPAAGDVIQRYLDQFVANVNKMTAVGARAQRHLAQRQAAPDGLLLCGLLDDPDAGTAAGRCQSGHQLLSAVAALGERDRRHQPDRSGAAHLPAGFVDSRLLAAVQHCADAARAGTRCVDRCGGRGSAVRAGQKRLRALCYDVSFVSVNLRRAGGDPHPVSVGLLDLRVTRASVSVDNATVGEIGAGLLVLLGVEKGDDEQKSQRLAEKVLGYRIFGDENDKMNLSVQQTGGSVLVVSQFTLAADTQKGMRPSFSGGAHPAEAERLYHDFSDRCRALGVTTANGRFAANMQVSLINDGPVTFWLQGSERDAWDALAHHQMVVDEHGKPVAVGRLYINAENEAAIRFLAVHPSVQGKGLGTLVAMTLESVARQEGAKRVTCSAREDAVEFFAKLGFVNQGEITAPQTTPVRHFLMIKPVVTLDDILHRADWCGQLQQAWYEHIPLSEKMGVRILQYTGQKFVTTMPEAGNQNPHHTLFAGSLFSLATLTGWGLIWLLLRERHLGGTIILADAHIRYSKPISGRPGAIADLGSLSGDLDRLARGRKARVQMEVELFGDDELGAVFEGVYIVLPADPDGPLEEGGSGARSPLMATKKAQLTRIALFSAIGHAIITAPARHASSAAPTAYPSLTTNCLLR

SEQ ID NO: 144086 - protein, 341 aa, Glycine max
  Coding DNA Sequence Number=SeqID_27308
  Gene Ontology: Mol. function=zinc ion binding
  Homolog annotation: Hit_ID=Q1SKJ1; Match level="QueryCoverage=95%, HitCoverage=76%, E-value=1e-88, Identity=53%"; Hit description=Zinc finger, RING-type
  Pfam annotation: Domain name=zf-C3HC4; Domain location=183-241; Score= 14.8; E_value=0.0047; Accession=PF00097.15; Description=Zinc finger, C3HC4 type (RING finger)
MDRLINFYLVHHSPLSNQTISRNVSIKVSIEQVKELAESSTLSCPYPAKLPHSLPSTSLSVSPLQSQSHPLPSSSTPSRWPCHSPGLQLSRQVSDSLILGFKTPSNFYVSEERPVFPSWSNESGTHSQGGSSDNWSRPGFSELTSTSLKERWSFDSESFGFNCERPVRSSSRFSNSPVDLQTCGVCSKLLTEKSSWGTQKIIASNDLSVVSVLICGHVYHAECLESLTSEVNKYDPSCPVCTFGEKYTLKLSEKALKAEMDLKAKNKKSSDIDDSVLYEHFREKGHHGKGPRINSCSSGRKSNGKPFLRRHFSFGSRSTKSMLDNQPTRKKGFFWAKSHKE

SEQ ID NO: 144087 - protein, 133 aa, Glycine max
  Coding DNA Sequence Number=SeqID_27309
  Gene Ontology: Mol. function=transferase activity, transferring phosphorus-containing groups; Cellular component=membrane; Biological process=regulation of transcription, DNA-dependent
  Homolog annotation: Hit_ID=Q2NQR9; Match level="QueryCoverage=100%, HitCoverage=38%, E-value=2e-53, Identity=78%"; Hit description=Two -component nitrogen regulation protein
  Pfam annotation: Domain name=PAS; Domain location=7-111; Score=8.6; E_ value=0.062; Accession=PF00989.14; Description=PAS domain
  Pfam annotation: Domain name=PAS_4; Domain location=13-116; Score =12.3; E_value=0.012; Accession=PF08448.1; Description=PAS fold
  Pfam module annotation: Pfam domain module=PAS::PAS_4; Domain location=7-111::13-116
MATGTLPDAGQILNSLINSILLVDNDLVIHYANPAAQQLLAQSSRKLFGTPLPELTGYFSLNIEVMSESLGAGQGFTDSEVTLVVDGRAHIMSLTAQRLPDGFILLEMAPMDNQRRLSQEQIQHAQQVAARDL

SEQ ID NO: 144088 - protein, 69 aa, Glycine max
  Coding DNA Sequence Number=SeqID_27310
MGGGSGRVKKKAKRYFGNRFMEEEYDRPKFDGSNQNDFMLLEDFEEEEVKMAIWDCESSKCPKTFISYS

SEQ ID NO: 144089 - protein, 189 aa, Glycine max
  Coding DNA Sequence Number=SeqID_27311
  Gene Ontology: Mol. function=zinc ion binding
  Homolog annotation: Hit_ID=Q1SKJ1; Match level="QueryCoverage=57%, HitCoverage=23%, E-value=6e-30, Identity=60%"; Hit description=Zinc finger, RING-type
MFYSKQEHWLSDDCDFLFFPIICSTVTLWIIAIGDTVFSSVVIGIELCSPVLVDEGAIGVVLLIMGAVCCVAAKDKTIQSASPSEILHRNIRHSPTWNFRWDHRGRVAGEDTAVTWFSNDISGNNGLENKNESSYVSEDGDPLQNYQIQRNRLQKSPISEGTARNVINSSSGNFHQINSLVLIIIHAPT

SEQ ID NO: 144090 - protein, 335 aa, Glycine max
  Coding DNA Sequence Number=SeqID_27312
  Gene Ontology: Mol. function=heat shock protein binding; Cellular component=integral to membrane; Biological process=protein folding
  Homolog annotation: Hit_ID=Q9T024; Match level="QueryCoverage=96%, HitCoverage=86%, E-value=1e-115, Identity=65%"; Hit description=DnaJ- like protein
  Pfam annotation: Domain name=DnaJ; Domain location=1-39; Score=36.4; E_value=1e-07; Accession=PF00226.21; Description=DnaJ domain
ARIVHPDKNPEDPKAAENFQKLGEAYQVLSDPGKRAAYDEHGKEGVPQDSMMDPTTVFGMIFGSEFFEEYIGQLALASLASIEIEEDSQDPEVLRQRIQEKMKAWQKEREQKLSTFLKDRLQPFVDGREDEFTAWAKSEARSLSKAVLAPMWFLNQEQGKDNEMNTPGLSGAFGEAMLHTIGYIYTRKAARELGKDIRYMNVPFLAEWVRGKGHCIKSQVTAASGAVSLIQIQEELKKLNQGENKEESIVKAIEDKKDAMINSLWQINVIDIESTLSHVCQTVLKDPSASKDVLKSRAKALKKLGTIFQGAKIAYNRENSLRRESGKTPDAASSS

SEQ ID NO: 144091 - protein, 429 aa, Glycine max
  Coding DNA Sequence Number=SeqID_27313
  Gene Ontology: Mol. function=peptidase activity; Cellular component =anchored to membrane; Biological process=proteolysis
  Homolog annotation: Hit_ID=Q1SAR7; Match level="QueryCoverage=100%, HitCoverage=96%, E-value=1e-118, Identity=53%"; Hit description =Eukaryotic aspartyl protease, putative
  Pfam annotation: Domain name=Asp; Domain location=93-421; Score= -84.8; E_value=1.3e-08; Accession=PF00026.14; Description=Eukaryotic aspartyl protease
MAKMPHSSSLAIVLLCLYINISFLNALDGGGFSVEIIHRDSSRSPYYRPTETQFQRVANALRRSINRANHFNKPNLVASTNTAESTVIASQGEYLMSYSVGTPPFQILGIVDTGSDIIWLQCQPCEDCYNQTTPIFDPSQSKTYKTLPCSSNICQSVQSAASCSSNNDECEYTITYGDNSHSQGDLSVETLTLGSTDGSSVQFPKTVIGCGHNNKGTFQREGSGIVGLGGGPVSLISQLSSSIGGKFSYCLAPLFSQSNSSSKLNFGDEAVVSGRGTVSTPIVPKNGLGFYFLTLEAFSVGDNRIEFGSSSFESSGGEGNIIIDSGTTLTILPEDDYLNLESAVADAIELERVEDPSKFLRLCYRTTSSDELNVPVITAHFKGADVELNPISTFIEVDEGVVCFAFRSSKIGPIFGNLAQQNLLVGYDL

SEQ ID NO: 144092 - protein, 327 aa, Glycine max
  Coding DNA Sequence Number=SeqID_27314
  Gene Ontology: Mol. function=oxidoreductase activity; Cellular component=proton-transporting two-sector ATPase complex; Biological process=flavonoid biosynthetic process
  Homolog annotation: Hit_ID=Q39224; Match level="QueryCoverage=82%, HitCoverage=75%, E-value=1e-93, Identity=59%"; Hit description=SRG1 protein
  Pfam annotation: Domain name=2OG-FeII_Oxy; Domain location=210-305; Score=69.2; E_value=1.3e-17; Accession=PF03171.10; Description=2OG -Fe(II) oxygenase superfamily
MEEINTKPLATSLLVPSVQELAKQNFSSVPQRYIQHQHEDMVLICEETNSTSSLEIPVIDMHNLLSIEAENSELDKLHLACKEWGFFQLINHGVSPSLLKKLKLEIQDFFNLPMSEKKKFWQTPQHIEGFGQAYVVSEDQKLDWGDMFYMTTLPTHSRIPHLFPQLPLPFRDTLELYSCNMKNIAMAIIGQMGKALKIEEMEIRELFEDEIQKMRMNYYPPCPQPEKVIGLTNHSDGVGLTILLHVNEVEGLQIKKDGVWVPIKPLPNAFVVNIGEILEKRGYLLAISMLLNGCDMATMTKWHDDFFANHHKHFVKGGPLLRHRRLQ

SEQ ID NO: 144093 - protein, 174 aa, Glycine max
  Coding DNA Sequence Number=SeqID_27315
  Homolog annotation: Hit_ID=Q39224; Match level="QueryCoverage=61%, HitCoverage=27%, E-value=4e-07, Identity=33%"; Hit description=SRG1 protein
MEKFFNPSGTSLLVPSVQELATRNLSTVPQRYIQHQHEDMVLLSEEANISLEIFQLLTCRACFLQNLGLQNWLSFTLLARNGDSSRTIIKEVKLINHGVSSALLDKVKLKTQDFFNLARQTAQNGLPPVEEWRENLLQYCFRKLIEFPDKYKDQWDDAYWDAIIQTTSASQNQR

SEQ ID NO: 144094 - protein, 122 aa, Glycine max
  Coding DNA Sequence Number=SeqID_27316
  Gene Ontology: Mol. function=oxidoreductase activity
  Homolog annotation: Hit_ID=Q39224; Match level="QueryCoverage=78%, HitCoverage=23%, E-value=3e-17, Identity=49%"; Hit description=SRG1 protein
  Pfam annotation: Domain name=2OG-FeII_Oxy; Domain location=50-118; Score=20.2; E_value=0.0013; Accession=PF03171.10; Description=2OG -Fe(II) oxygenase superfamily
MLMIPEEAHSTLEIPVIDMHRLLSVESGTSELEKLHQSPCLQGMGILPDGIQLMRMNYYYPPCPEPEKVIGLTPHSDGIGLAILLQSNEVEGLQIRKDGVADLRWLQGDAVCVKEFTENLIE

SEQ ID NO: 144095 - protein, 289 aa, Glycine max
  Coding DNA Sequence Number=SeqID_27317
  Gene Ontology: Mol. function=oxidoreductase activity; Cellular component=proton-transporting two-sector ATPase complex; Biological process=flavonoid biosynthetic process
  Homolog annotation: Hit_ID=Q39224; Match level="QueryCoverage=92%, HitCoverage=75%, E-value=7e-95, Identity=60%"; Hit description=SRG1 protein
  Pfam annotation: Domain name=2OG-FeII_Oxy; Domain location=209-288; Score=69.4; E_value=1.1e-17; Accession=PF03171.10; Description=2OG -Fe(II) oxygenase superfamily
MEEITKNLSGTSLLVPSVQELAKEKISNVPQRYIQPQHEEDIVILSEEANSSLEIPVIDMQSLLSEESGSSELDKLHLACKEWGFFQLINHGVSSSLVEKVKLEIQDFFKLPMSEKKKFWQSPQHMEGFGQAFVVSEDQKLDWADLFFMTTLPKHLRIPHLFPQLPLPFRDALEIYSQELKKLAMVVVEQMGKALKMEETEMREFFEDGMQSMRMNYYPPCPQPEKVIGLTPHSDGVGLTILLQATEVEGLQITKDGMWVPIKPLPNAFIINIGDMLEDSKTDQPVSPL

SEQ ID NO: 144096 - protein, 32 aa, Glycine max
  Coding DNA Sequence Number=SeqID_27318
MSLDSLLLSLKLMGGLVPMKRREEARIGDDFR

SEQ ID NO: 144097 - protein, 398 aa, Glycine max
  Coding DNA Sequence Number=SeqID_27319
  Gene Ontology: Mol. function=porin activity; Cellular component =nuclear pore; Biological process=transport
  Homolog annotation: Hit_ID=UPI000016318A; Match level="QueryCoverage =99%, HitCoverage=44%, E-value=1e-95, Identity=45%"; Hit description =transporter
  Pfam annotation: Domain name=Nucleoporin2; Domain location=263-395; Score=28.1; E_value=3.9e-08; Accession=PF04096.4; Description =Nucleoporin autopeptidase
  Subcellular localization annotation: CTP_CleavageSite=95; ConfidenceScore=5.86e-01
SAAPTGGQTASAFGQNTSPFGQTTTPSFSQPSLFNSPSSGLVGSIFSSSAPLTSNNLTGFGQTALSISTPFQSAQPAQSSGAFGFGNFGQTQPVGASSFGGTPGMSSTPLSSVAVQAVPNTNPFGTLPALPQMSIGRVGTTPSIQYGISSMPVAFFSDDEDTPTTPKADALFIPRENPRALIICPVEQWPGKASEKASTFKDRSIPVNENESAVENGFVKEQAQPISTKPTSNGSNEDHSPQKADVYKTLRGHRAGEAAIVYEHGADVEALMPKLRRSDYYTLPRIHELAAKERAEPGFCSHVKDFVVGRQGYGSIRFLGETDIRGLDLESLIQFNNREVIVYMDDSKKPPVGQGLNKPAEVTLLNIKCFDKKTGHQYTEGPKIEKYKEMLKSKTEDQ

SEQ ID NO: 144098 - protein, 86 aa, Glycine max
  Coding DNA Sequence Number=SeqID_27320
MEGIFVHPVGRMTLINSIPYAIPSYHTSFDLLPKRIKTSPTREQTIPINFPRGGLGVNQATTCHLSRLDRMCPNKERCLRVEAHTR

SEQ ID NO: 144099 - protein, 135 aa, Glycine max
  Coding DNA Sequence Number=SeqID_27321
  Gene Ontology: Mol. function=metal ion binding; Cellular component =nucleus; Biological process=regulation of transcription
  Homolog annotation: Hit_ID=Q1S622; Match level="QueryCoverage=79%, HitCoverage=66%, E-value=2e-18, Identity=52%"; Hit description=YABBY protein
  Pfam annotation: Domain name=YABBY; Domain location=19-135; Score =51.0; E_value=1.2e-15; Accession=PF04690.4; Description=YABBY protein
  Subcellular localization annotation: CTP_CleavageSite=45; ConfidenceScore=5.63e-01
MSIFFSSLPCSTSQKVNGNIVRVLTFKFCHVSVPCSSLLTIVTVRCGHCANLLTVNMGASLQTFPSQDTTQRFSTVGKLQRQHLSVQEACSKELGSSSKCKSFETVDHEQQPRIPPIRPPEKRQRVPSAYNRFIK

SEQ ID NO: 144100 - protein, 46 aa, Glycine max
  Coding DNA Sequence Number=SeqID_27322
MKGIQKLYKYKVCIIEGLVIVLESMWSKFSRSRKRLSVEGSNQQRC

SEQ ID NO: 144101 - protein, 295 aa, Glycine max
  Coding DNA Sequence Number=SeqID_27323
  Gene Ontology: Mol. function=aspartic-type endopeptidase activity; Cellular component=lysosome; Biological process=sphingolipid metabolic process
  Homolog annotation: Hit_ID=Q9FRW8; Match level="QueryCoverage=99%, HitCoverage=70%, E-value=1e-111, Identity=61%"; Hit description =Aspartic proteinase 2
  Pfam annotation: Domain name=Asp; Domain location=2-294; Score=113.8; E_value=5e-31; Accession=PF00026.14; Description=Eukaryotic aspartyl protease
  Pfam annotation: Domain name=SapB_2; Domain location=142-176; Score =54.2; E_value=4.3e-13; Accession=PF03489.7; Description=Saposin-like type B, region 2
  Pfam module annotation: Pfam domain module=Asp::SapB_2; Domain location=2-294::142-176
MELGIFQVSLPRTMSRFEIWLFMTRILLRQLDVGFQEISVGNAAPIWYNMLNQHFLTQPVFSFWLNRNTNEEQGGQIVFGGIDSDHYKGEHTYVPVTQKGYLAGLCAAKCLAIVDSGTSLLAGPTGVIAQINHAIGAVGIVSQECKALVAQYGKTILDKLINEALPQQICSQIGLCTFDGTQGVREHLVVGMMPDAQLLCDLVPSPKGESVVECNTLSEMPNVSFTIGGEVFELSPEQYILKVGKGATAQCISGFIALDIAPPRGPLWILGDIFMGSYHTVFDYGNMKVGFAESA

SEQ ID NO: 144102 - protein, 396 aa, Glycine max
  Coding DNA Sequence Number=SeqID_27324
  Gene Ontology: Mol. function=protein serine/threonine kinase activity; Cellular component=cell cortex; Biological process=protein amino acid phosphorylation
  Homolog annotation: Hit_ID=Q9FLQ2; Match level="QueryCoverage=84%, HitCoverage=75%, E-value=1e-71, Identity=43%"; Hit description =Similarity to NPK1-related protein kinase
  Pfam annotation: Domain name=Pkinase; Domain location=3-255; Score =240.0; E_value=4.9e-69; Accession=PF00069.15; Description=Protein kinase domain
  Pfam annotation: Domain name=Pkinase_Tyr; Domain location=3-255; Score=47.7; E_value=2.1e-15; Accession=PF07714.7; Description =Protein tyrosine kinase
  Pfam module annotation: Pfam domain module=Pkinase::Pkinase_Tyr; Domain location=3-255::3-255
  Subcellular localization annotation: CTP_CleavageSite=28; ConfidenceScore=5.24e-01
MEWTRGFIIGRGSSATVYTATSSHSSTVAAVKSAELTLSNSEQLQREQRILSSLFSPHIVTYKGCNITEDNNTLWFNLFMEYMPFGTLSQESHRHGGRLSEPATVYYTRQVLQGLQYLHNKGVVHCDIKGGNILIGEDGAKIGDFGCAKFANDSSAVIGGTPMFMAPEVARGEEQGYPADVWALGCTVLEMATGFAPWPNVEDPVTVLYRVAYSDDVPEIPCFLSEEAKDFLGKCFRRNPKERWSCGQLLKHPLLGEFSSNDKKIQESNSCSPTSILEQGFWNSMEEAEVECVSASANVVQVKSFEDSPRGRIRRLASCSGDPIGELDDENWITARGSEMGASSSCDGLDLDVNSRISGYFCDDYYKCRDVSVVVDSFNFERGNSEKLLPLTLDFL

SEQ ID NO: 144103 - protein, 91 aa, Glycine max
  Coding DNA Sequence Number=SeqID_27325
MTALCILSSPLFLLNACTPKQHIDGAILQMAYTMQKHKSSAGTYDFNKVIIRFGARKLHCYCNRGRVIEVYGPEFRSRRCNEQKSIHTCCS

SEQ ID NO: 144104 - protein, 733 aa, Glycine max
  Coding DNA Sequence Number=SeqID_27326
  Gene Ontology: Mol. function=transferase activity; Cellular component= chloroplast thylakoid membrane; Biological process=regulation of transcription, DNA-dependent
  Homolog annotation: Hit_ID=Q6Z8Z5; Match level="QueryCoverage=91%, HitCoverage=90%, E-value=1e-179, Identity=49%"; Hit description =Putative pentatricopeptide (PPR) repeat-containing protein
  Pfam annotation: Domain name=PPR; Domain location=158-192; Score =29.1; E_value=1.5e-05; Accession=PF01535.11; Description=PPR repeat
  Pfam annotation: Domain name=PPR; Domain location=193-227; Score =13.2; E_value=0.2; Accession=PF01535.11; Description=PPR repeat
  Pfam annotation: Domain name=PPR; Domain location=228-262; Score =31.7; E_value=2.5e-06; Accession=PF01535.11; Description=PPR repeat
  Pfam annotation: Domain name=PPR; Domain location=263-297; Score =55.9; E_value=1.4e-13; Accession=PF01535.11; Description=PPR repeat
  Pfam annotation: Domain name=PPR; Domain location=298-332; Score =52.2; E_value=1.7e-12; Accession=PF01535.11; Description=PPR repeat
  Pfam annotation: Domain name=PPR; Domain location=333-367; Score =28.7; E_value=2.1e-05; Accession=PF01535.11; Description=PPR repeat
  Pfam annotation: Domain name=PPR; Domain location=369-402; Score =11.5; E_value=0.33; Accession=PF01535.11; Description=PPR repeat
  Pfam annotation: Domain name=PPR; Domain location=404-438; Score =22.8; E_value=0.0012; Accession=PF01535.11; Description=PPR repeat
  Pfam annotation: Domain name=PPR; Domain location=447-480; Score =22.5; E_value=0.0015; Accession=PF01535.11; Description=PPR repeat
  Pfam annotation: Domain name=PPR; Domain location=481-515; Score =35.9; E_value=1.4e-07; Accession=PF01535.11; Description=PPR repeat
  Pfam annotation: Domain name=PPR; Domain location=516-550; Score =18.4; E_value=0.027; Accession=PF01535.11; Description=PPR repeat
  Pfam annotation: Domain name=PPR; Domain location=551-585; Score =11.7; E_value=0.31; Accession=PF01535.11; Description=PPR repeat
  Pfam annotation: Domain name=PPR; Domain location=618-652; Score=3.4; E_value=3; Accession=PF01535.11; Description=PPR repeat
  Pfam annotation: Domain name=PPR; Domain location=653-687; Score=8.8; E_value=0.67; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=158 -192::193-227::228-262::263-297::298-332::333-367::369-402::404 -438::447-480::481-515::...
  Pfam module annotation: Domain location=516-550::551-585::618 -652::653-687
MALLSNSKLLRWTPTLHPNPLSAFSTAEALSETDHPSPPSPQPQPPPIIPPRENNLELTICKMMSNRAWTTRLQNSIRSLVPEFDPSLVYNVLHGAASPEHALQFYRWVERAGLFTHTPETTLKIVQILGRYSKLNHARCILFNDTRGGVSRAAVTEDAFVSLIDSYGRAGIVQESVKLFKKMKELGLDRTVKSYDALFKVILRRGRYMMAKRYYNAMLLEGVDPTRHTFNILLWGMFLSLRLDTAVRFYEDMKSRGILPDVVTYNTLINGYFRFKKVDEAEKLFVEMKGRDIVPNVISFTTMLKGYVAAGRIDDALKVFEEMKGCGVKPNVVTFSTLLPGLCDAEKMAEARDVLGEMVERYIAPKDNALFMKMMSCQCKAGDLDAAADVLKAMVRLSIPTEAGHYGVLIESFCKANVYDKAEKLLDKLIEKEIVLRPQNDSEMEPSAYNLMIGYLCEHGRTGKAETFFRQLLKKGVQDSVAFNNLIRGHSKEGNPDSAFEIMKIMGRRGVARDVDSYRLLIESYLRKGEPADAKTALDGMLESGHLPESSLYRSVMESLFDDGRVQTASRVMKSMVEKGAKENMDLVLKILEALLLRGHVEEALGRIDLLMHNGCEPDFDHLLSVLCEKEKTIAALKLLDFVLERDCIIDFSIYDKVLDALLAAGKTLNAYSILCKILEKGGSTDWSSRDELIKSLNQEGNTKQADVLSRMIKGTDGRTLRRGGKRKATVST

SEQ ID NO: 144105 - protein, 802 aa, Glycine max
  Coding DNA Sequence Number=SeqID_27327
  Gene Ontology: Mol. function=ubiquitin thiolesterase activity; Cellular component=lysosome; Biological process=ubiquitin-dependent protein catabolic process
  Homolog annotation: Hit_ID=Q9C585; Match level="QueryCoverage=96%, HitCoverage=83%, E-value=0.0, Identity=59%"; Hit description =Ubiquitin-specific protease-like protein
  Pfam annotation: Domain name=DUF1055; Domain location=3-131; Score= -9.1; E_value=6e-06; Accession=PF06337.3; Description=Domain of Unknown Function (DUF1055)
  Pfam annotation: Domain name=UCH; Domain location=181-794; Score =347.3; E_value=2.6e-101; Accession=PF00443.19; Description=Ubiquitin carboxyl-terminal hydrolase
  Pfam module annotation: Pfam domain module=DUF1055::UCH; Domain location=3-131::181-794
MGFLSKVQDQVYLLPHEERHSDSKNVMKDDKGFSATDSDMADVYPLQLRLSVQRETNSFGVRISKKDNAVELFKRACKMFSVDSEMLCIWDYSDQITFLMNDNNQVPVDCQRQSDQEILLELQVYGLSDSIRCREGKKDEMANFSGSASLKMNGTYDGANSDCMNANSLTFSSGPGEAGSLGLTGLQNLGNTCFMNSSLQCLAHTPKLVDYFLEDYIREINHDNPLGMNGEIALAFGDLLRKLWAPGASPVSPRIFKSKLARFAPQFSGFNQHDSQELLAFLLDGLHEDLNRVKCKPYIEVKDGDGRRDEEVADEYWHNHLARNDSVIVDVCQRLYHAIELLRKKIISFFVGRGERGVGDISAEGNGFMKVSVTFDPFMYLSLPLPSTTVRTMTITVVSGNGGEMSQLSPYTITVPKNGRFEDLTRALGIACSLGADETLLVAEVYNNCIIRFLEDPTDSLSLIRDADKLVAYRFLKCNVDAPLVVFINQRMEEQYVYGKQTLNWKAFGIPVVDRLYSVTNGSDLRNLYLKWFYPFQNPIEEALENCLVSKETEEDAETEVTTPSLGSNVNELDTPSDGGMEFYVTDEKGTIKNSKILMNEPLAINGDLRLLHVLVCWSEEQLKIYDTQLCSSLPEVFKSGFLAKRPQESVSLYKCLEAFLQEEPLGPEDMWYCPGCKEHRQASKKLDLWRLPEILVIHLKRFQYSRYLKNKLETYVDFPVDNLDLSAYITYGNDESYHYTLYAVSNHYGSMGGGHYTAFVHRGGDQWYDFDDSHVNPISKEKIKSSAAYVLFYRRNFEVST

SEQ ID NO: 144106 - protein, 128 aa, Glycine max
  Coding DNA Sequence Number=SeqID_27328
  Gene Ontology: Cellular component=anchored to membrane
  Homolog annotation: Hit_ID=Q1S608; Match level="QueryCoverage=56%, HitCoverage=47%, E-value=4e-17, Identity=56%"; Hit description=E1 protein and Def2/Der2 allergen
MEATRVNTTGWDGGKVIVYHKRRQRRQDGILDGIRVSGIEITPDPVVRARPATFKISAATGEAIYGGKWVTAVAYFGFVVLKEIHDFCEEISCPVATGSFVAAHTQKLPAFAPPLLNLLEFMEFHEAG

SEQ ID NO: 144107 - protein, 121 aa, Glycine max
  Coding DNA Sequence Number=SeqID_27329
  Gene Ontology: Mol. function=ubiquitin thiolesterase activity; Biological process=ubiquitin-dependent protein catabolic process
  Homolog annotation: Hit_ID=Q9C585; Match level="QueryCoverage=89%, HitCoverage=12%, E-value=2e-31, Identity=63%"; Hit description =Ubiquitin-specific protease-like protein
MDCASEDCSDNSQRPDSHKDQRVYFVPHRWWKDAQDSMPEADSDKKKGIAFASFPGSSYAGPMKIINNIFNSDLVFSLRREEDSPRIRENGEVGVSGRDFALVSGDMWLQALKCFVQCLRA

SEQ ID NO: 144108 - protein, 74 aa, Glycine max
  Coding DNA Sequence Number=SeqID_27330
MDGHYEHCDRDEDDERIRLALGLKRSEGVPSLRKLPRPIVMQWLASESRARRSWFCVYCRDANDDVGGSTFAAT

SEQ ID NO: 144109 - protein, 118 aa, Glycine max
  Coding DNA Sequence Number=SeqID_27331
MTLRALLLQSEQNSGKSTSKNKKVATSEEGTVAVVAAAEVSRALKQAKKHPMAVVREQDRRTNLSVEASCSSGPSVSWKRLGAGKVYRTRYEVGTRGACGAWECGDGGGEWERCRMRV

SEQ ID NO: 144110 - protein, 139 aa, Glycine max
  Coding DNA Sequence Number=SeqID_27332
MPPPTSPSPNWFVQTTTYLPFIKSACLNDHCTTTSLPLQVPIHVLWQAMNYDLCGVGGEGGAGSGGGGDNDEGGGSCSGDSNGGCDDGVGGGISNCDGGDAGGGCGNVTSDGRRNNSYCGGDIVNDSGRGGGIYDSCSL

SEQ ID NO: 144111 - protein, 377 aa, Glycine max
  Coding DNA Sequence Number=SeqID_27333
  Homolog annotation: Hit_ID=Q6H4U9; Match level="QueryCoverage=52%, HitCoverage=67%, E-value=4e-20, Identity=32%"; Hit description =Dentin sialophosphoprotein-like
MALWQALVLHCEFLPQASVSKAKFLKAGGTLARTPLEKSHLDGQPFNPSTPVKCCEEGGERTDSLEQTPSSCISNAQSTQCDPIDSTEGIRTGSLHSLDKNTASVSPWPSTTYTKRRNKFVRFECGSDLSSCDSSDYGGRHMKKTDSPNNESAYKPSPNPTPMKLSDEMQTPGTVYPATKDLPNGKPRLKSQFVYPINNPGDDVSLKKFEESESVELSQITTSTPEKGLKKMSCENVCKVEESLSSWLKPAAVILEERNKRMQTAYNQVRKTPADRPIIGMVAAHWNEDEDSQAPPPKWWDGNGIPNSTNKYKEDQKVKWHATPFEERLEKALSEETVISQRKDACGKSIPFDDNEESDTALSQLQSSTHPQSVVSF

SEQ ID NO: 144112 - protein, 119 aa, Glycine max
  Coding DNA Sequence Number=SeqID_27334
  Gene Ontology: Mol. function=bile acid:sodium symporter activity; Cellular component=membrane; Biological process=sodium ion transport
  Homolog annotation: Hit_ID=Q016H2; Match level="QueryCoverage=100%, HitCoverage=31%, E-value=3e-22, Identity=47%"; Hit description=[P] KOG2718 Na+-bile acid cotransporter
  Subcellular localization annotation: CTP_CleavageSite=66; ConfidenceScore=5.28e-01
MTPFLTATLAGKYVAVDASGLLISTLQVVLFPVLAGAFLNQFFKPFVKLVSPLMPPIAVTTVAILCGNSIAQSSSAILVCGGQVILATFLLHASGFFFGYIFGRLLGLDVSSSRTISTQ

SEQ ID NO: 144113 - protein, 103 aa, Glycine max
  Coding DNA Sequence Number=SeqID_27335
  Gene Ontology: Mol. function=bile acid:sodium symporter activity; Cellular component=membrane; Biological process=sodium ion transport
  Homolog annotation: Hit_ID=Q672Q4; Match level="QueryCoverage=79%, HitCoverage=20%, E-value=1e-08, Identity=36%"; Hit description =Putative anion:sodium symporter precursor
MARAPRRSSRVKVIPIPSMMMLRPLIVTFGVTQLKQFGFINPNTHPIETHNGNAIERNSPASTSHSRTLLTSFPPYMLEEMPHRTLELKILVGGFGVQRFSSG

SEQ ID NO: 144114 - protein, 175 aa, Glycine max
  Coding DNA Sequence Number=SeqID_27336
MAVEWRRKRERRCHFKEKMSLEEAHHHRRPWIRAWRKKEMNEGRGRKEHEILCSKRALKSEIWFSPLIQDQVQDSPLSVLRCHEPMSPKSNLRLMRTLGPSLASLAQSSWSLLSNSVRGPFAKCKPRAKRIFGHTLSRESLELSAQPLHLRLTWSAKLPKDELSTFQFDLNWAKR

SEQ ID NO: 144115 - protein, 313 aa, Glycine max
  Coding DNA Sequence Number=SeqID_27337
  Gene Ontology: Mol. function=alpha,alpha-trehalose-phosphate synthase (UDP-forming) activity; Cellular component=cytosol; Biological process=trehalose biosynthetic process
  Homolog annotation: Hit_ID=P93653; Match level="QueryCoverage=99%, HitCoverage=36%, E-value=1e-122, Identity=64%"; Hit description =Trehalose-6-phosphate synthase
  Pfam annotation: Domain name=Trehalose_PPase; Domain location=2-247; Score=260.2; E_value=4.2e-75; Accession=PF02358.7; Description =Trehalose-phosphatase
GFNGTLTEPIEREGDRFKERELTVHPELKQPLAELCSDPKTTVVVLSGSCRTVLDENFKEYDIWLAAENGMFLNPSKGEWMTTMPEQLNMEWVDSVKHVFDYFTDRTPRSYFEEREASLVWSYRHADVEFGRLQARDMLQHLWTGPISNASVEVVQGSRSVEVRAANVTKGAAIDRILGEIVHSKSMTTPIDYVLCIGHFLTKQDEDIYAFFEPELPRSKVTEGVKFPVERVSSSQNKGQRPVSNSEKKTNNHVCRLPRRPAPEKISWNVLDLKKENYFSCAVGRTQTNARYTLASPDEVVAFLKELHTLSQS

SEQ ID NO: 144116 - protein, 43 aa, Glycine max
  Coding DNA Sequence Number=SeqID_27338
  Gene Ontology: Cellular component=membrane
  Homolog annotation: Hit_ID=Q5DMX2; Match level="QueryCoverage=97%, HitCoverage=12%, E-value=5e-12, Identity=69%"; Hit description=EXO
MEKVFKIFVYEEGEPPLFHNGLNKDIYATEGRFIHEMEKGSIY

SEQ ID NO: 144117 - protein, 47 aa, Glycine max
  Coding DNA Sequence Number=SeqID_27339
MLKRNTDSEGATLTEARPFGGYENSDDTSIIRLKNYMNAQYFGEIGI

SEQ ID NO: 144118 - protein, 88 aa, Glycine max
  Coding DNA Sequence Number=SeqID_27340
  Gene Ontology: Mol. function=sequence-specific DNA binding; Cellular component=nucleus; Biological process=regulation of transcription
  Homolog annotation: Hit_ID=Q2HT21; Match level="QueryCoverage=98%, HitCoverage=14%, E-value=3e-13, Identity=62%"; Hit description=DNA -binding WRKY
MEVKVVAKAAVKLGSAAMATLTVSARVCIETFEGQKTWIGYTVLGQISEATMRLVNWESYKGQQGRRFGIGLVALGTVMGLETNSSPM

SEQ ID NO: 144119 - protein, 70 aa, Glycine max
  Coding DNA Sequence Number=SeqID_27341
MNVIQIEVDGMLELLSQGLNQLIDLPALRMLEDFLYNTPKKTIGVLEYYFEVPYESDSTTFVIFDLRGLG

SEQ ID NO: 144120 - protein, 96 aa, Glycine max
  Coding DNA Sequence Number=SeqID_27342
  Gene Ontology: Mol. function=cellulose synthase (UDP-forming) activity; Cellular component=membrane; Biological process=cellulose biosynthetic process
  Homolog annotation: Hit_ID=Q2HT19; Match level="QueryCoverage=75%, HitCoverage=8%, E-value=5e-31, Identity=79%"; Hit description =Cellulose synthase
MGWLNGSISEDVPTGLNIQRRGWRPECCTPDPIAFTGSSPGGLLTTMVQQKRWASGLTIVFFGKHSPLIGMLFWHDNFVGAFDNNVDKVLWVATNS

SEQ ID NO: 144121 - protein, 668 aa, Glycine max
  Coding DNA Sequence Number=SeqID_27343
  Gene Ontology: Mol. function=cellulose synthase (UDP-forming) activity; Cellular component=membrane; Biological process=cellulose biosynthetic process
  Homolog annotation: Hit_ID=Q2HT17; Match level="QueryCoverage=98%, HitCoverage=94%, E-value=0.0, Identity=64%"; Hit description =Cellulose synthase
  Pfam annotation: Domain name=Cellulose_synt; Domain location=9-668; Score=263.7; E_value=3.8e-76; Accession=PF03552.5; Description =Cellulose synthase
MANQGHVLPLSEKIWFKRTFQRVIDTLILVLLLLNLSYRVFSSNNFTFPWFLAFICESWFTFIWIVILNTKWSPAVTITHPNRLLQRVPELPPVDMFVTTADPVLEPPIITINTVLSLLALDYPANKLACYVSDDGCSPLTFYALVEASKFAKFWVPFCKKYNVQVRAPFRYFSNVAISKSEESLEFKQEWLQMKDMYHNLSQNLEEVTSKTIPFQLDGEYAVFSNTEQRNHPTIIKVIFENMDGLSDQLPHLIYISREKRPQYPHNYKAGAMNVLTRVSGLMTNAPFMLNVDCDMFVNNPKIVQHAMCILMDSKSGKEVAFVQCFQQFYDGIKDDPFGNQWVAVFEYIVRGMAGLQGPFYCGTNTFHRRKAIYGVYPDETGSRRNGKLEEKILIQQFGSLEEFVKSAAHAMEGSAYSANDITPSSFIEAAIQVADCGYEDGTWWGKQMGWLYGSLTEDVLTGLSMKRRGWRSECCTPDPIAFTGCAPGGLLSTMLQQKRWFTGHTVIFFGKHSPLMCMLFGKIQFRAGLSYFWVSTLSLREYVKIGLSMRQWWNNQRMCIVRTTTASFLGFLNGMVQLSGLSDIAFDITEKEYPTSSADENSTDAGRFTFNESPVFVIGTTILLVYLTAILIKFWGLQPTHSGNGSGLGEFICKVMVSVDDLTFAEE

SEQ ID NO: 144122 - protein, 748 aa, Glycine max
  Coding DNA Sequence Number=SeqID_27344
  Gene Ontology: Mol. function=cellulose synthase (UDP-forming) activity; Cellular component=membrane; Biological process=cellulose biosynthetic process
  Homolog annotation: Hit_ID=Q2HT17; Match level="QueryCoverage=99%, HitCoverage=100%, E-value=0.0, Identity=70%"; Hit description =Cellulose synthase
  Pfam annotation: Domain name=Cellulose_synt; Domain location=9-747; Score=354.4; E_value=1.9e-103; Accession=PF03552.5; Description =Cellulose synthase
MANQGFDLPFYEKIWFKRTFQRVMDTFILVLLLLLLSYRIFSSNNFTFPWFLAFLCESWFTFTWIVILNAKWSPAVTITHPDRLLQRVPELPRVDLFVTTADPVLEPPIITANTVLSLLALDYPANKLACYVSDDGCSPFTFYALVEASKFAKLWIPFCKKYNVQVRAPFRYFSNVATTKSDDSPDFKQEWSQMKDMYDNLRQNIEDVTRKQIPLELDGEFAVFSNTEQINHPSIIKVILENKDVLSDGLPYLIYISREKKPNHSHNYKAGAMNVLTRVSGLMTNAPFMLNVDCDMVVNNPKFVLHAMCILMDSKSGKEVAFVQCFQQFYDGIKDDPFGNQWVAAYEYIIRGMAGLQGPYYGGTNTFHRRNAIYGLYPHEMENGREDEKLGEKILIQQFGSSKEFVKSAAVALDGKAYLPKDISPSNFIEAAIQVARCGYECGTFWGKKIGWLYGSISEDVPTGLNIHRRGWRSECCTPDPIPFTGCAPRGFISTMVQQKRWASGLTVVFFGKHSPVMGMLFGKIQFRAGLSYFWLTNWGSRGPFQVCYAALPAYCIITNTNIFPKGPGLWIPIALLVIYNLHTLLEYLRIGLSIRYWWNNQRMSLVTTTTAWFIGFLSAMLKLSGISDTVFEITEKEQSTSGSDGNNADAGRFTFDESPVFVVGTTILLVHLTAMLIKFWGLQPTHSENGSGLGEFICSTYLVMCYWPYFKGLFGRGKYGIPFSTMCKSVVFALVFVHFCRSNAISG

SEQ ID NO: 144123 - protein, 169 aa, Glycine max
  Coding DNA Sequence Number=SeqID_27345
  Gene Ontology: Mol. function=chromatin binding; Cellular component =chromatin; Biological process=chromatin assembly or disassembly
  Pfam annotation: Domain name=Chromo; Domain location=77-133; Score =17.4; E_value=0.0087; Accession=PF00385.14; Description='chromo' (CHRromatin Organisation MOdifier
MQRRIFTSFLALSPKGGVVKGLLGFWPRGTIIFNLPTTSRIHPVFHCSLFKPYLAPTNQADVPLELPNSVEDNQPIITPLTILDAKWEKTNIGKELLVLVQWRGLFPEDTSWEDLKLKYNLKDKVTLEAHGDVMNKNMEQQNTEQEPEKEENRRLRREINKPHYLRDFV

SEQ ID NO: 144124 - protein, 214 aa, Glycine max
  Coding DNA Sequence Number=SeqID_27346
MEWFVGRDRGSVIGAWNSASNWVVPTDRLEGESIHLHYLFEAGDRAVGTPILGSASFASCSSSAMRRKNQEAHLWPLVNFSSQLKQRSLSLQLAISSGVSLFKGKGGGLAGEGKRGSHANPAAWTKVQPRYEAAKEEWWRQPYNAIGKRLRFRQPEGSDPSNLGISNFIRGGLVTRGMGVGMTNEDEGEGDGWELFSRLVTLLISASSFFVTWR

SEQ ID NO: 144125 - protein, 83 aa, Glycine max
  Coding DNA Sequence Number=SeqID_27347
MQLNSVGLRGNHKFSSIHNDKEKGYNLIKREGHIYVIDCNSIMAVEVPCDGEGLKQTNQKRFDGGISCDILEISTRNFVNDAF

SEQ ID NO: 144126 - protein, 153 aa, Glycine max
  Coding DNA Sequence Number=SeqID_27348
  Gene Ontology: Mol. function=carboxypeptidase activity; Biological process=proteolysis
  Homolog annotation: Hit_ID=Q1S5P6; Match level="QueryCoverage=81%, HitCoverage=23%, E-value=4e-34, Identity=52%"; Hit description =Ankyrin
MVSREPLLSQPVIQDIFVDEDRGIETLNEDPMHIMINDAFGLSRLCANEESFPSSPEHSGGVKEEFDLLKDGEQPLYDGCTEYSKLSFLVKLYHMKVLCRVSDKAMTMIIELLHDAFKHANIPTSNYDANKLLNKFGLHYTKIHACPKGCMLY

SEQ ID NO: 144127 - protein, 38 aa, Glycine max
  Coding DNA Sequence Number=SeqID_27349
MIHQPLSGAQGGQTDIGIQKMDQIGPQQYLSSDVFNQK

SEQ ID NO: 144128 - protein, 116 aa, Glycine max
  Coding DNA Sequence Number=SeqID_27350
  Gene Ontology: Mol. function=transferase activity
  Homolog annotation: Hit_ID=Q9MAP9; Match level="QueryCoverage=79%, HitCoverage=21%, E-value=6e-24, Identity=56%"; Hit description =Highly similar to YUP8H12R.39
MTFGSMVGTLKKALARALISYYVFAGEVVPNNMGEPEVLCNNRGVDFVEAVADVELKCLNFYNPDDTIEGRFVPKKKNGVLAVQLFEIFWTSFDHESWVVASQNNPSSPDKKENPN

SEQ ID NO: 144129 - protein, 248 aa, Glycine max
  Coding DNA Sequence Number=SeqID_27351
  Gene Ontology: Mol. function=transferase activity
  Homolog annotation: Hit_ID=Q9MAP9; Match level="QueryCoverage=90%, HitCoverage=49%, E-value=6e-68, Identity=56%"; Hit description =Highly similar to YUP8H12R.39
  Pfam annotation: Domain name=Transferase; Domain location=1-237; Score=-140.9; E_value=0.0004; Accession=PF02458.6; Description =Transferase family
MYTPISEFPPPPASAATALLSRIYYVKAEQLHRMQFLAATRTKLECFSAFLWKMVALAASKEENGKRVVAKMGIVVDGRKRLGNGDKESEAMMECYFGNVLSIPFDGKPVQELVEKPLGFVAEAVHEFLMAAATEEHFLGLIDWVEDHRPVPGVAKIYYSNTKEGPAFVVSSGQRFPEDKVDFGWGKVVFASYHFPWAGEAGYVMPMPSPLENGDWVVYMHLAKKQLEIIESEAAHVFKPLTWDYLNQ

SEQ ID NO: 144130 - protein, 176 aa, Glycine max
  Coding DNA Sequence Number=SeqID_27352
  Gene Ontology: Mol. function=alpha,alpha-trehalose-phosphate synthase (UDP-forming) activity; Cellular component=cytosol; Biological process=trehalose biosynthetic process
  Homolog annotation: Hit_ID=P93653; Match level="QueryCoverage=65%, HitCoverage=14%, E-value=6e-44, Identity=67%"; Hit description =Trehalose-6-phosphate synthase
MEAIFLTNSSPTYTTFTTKNMLQLFHWPLFSANDVYILPVSYPDVALVTSLRDGMNLFAGAAQSLGAGAILVNPWNITEVATAISKALNMPSAEREKRHKHNYEHVKTHTAQEWAETFVSELNDTVVEAQIRTNQVPPRLPTETAVECYLQSNNRLLILMVSDDRSVESETDSVLI

SEQ ID NO: 144131 - protein, 298 aa, Glycine max
  Coding DNA Sequence Number=SeqID_27353
  Gene Ontology: Mol. function=alpha,alpha-trehalose-phosphate synthase (UDP-forming) activity; Cellular component=cytosol; Biological process=trehalose biosynthetic process
  Homolog annotation: Hit_ID=P93653; Match level="QueryCoverage=96%, HitCoverage=30%, E-value=1e-121, Identity=76%"; Hit description =Trehalose-6-phosphate synthase
  Pfam annotation: Domain name=Glyco_transf_20; Domain location=100 -298; Score=-42.0; E_value=1.2e-11; Accession=PF00982.11; Description= Glycosyltransferase family 20
  Subcellular localization annotation: CTP_CleavageSite=41; ConfidenceScore=5.20e-01
MVGFQSDHMPGNKCNGNSNSFPVPDRHERLMRGRELRKSSRASPDSNSISNVGSEIFEHDLRLREDNNSAAPIVERYLEEVAAAAAAARGERKDGRPFRQRLLVVANRLPVSAIRKGEDSWSLEISAGGLVSALLGVKEFEARWIGWAGVNVPDEIGQKALTKALAEKRCIPVFLDEEIVHQYYNGYCNNILWPLFHYLGLPQEDRLATTRSFQSQFEAYQKANQMFADVVNKHYEEGDVVWCHDYHLMFLPQCLKNYNHKMKVGWFLHTPFPSSEIHRTLPSRSELLHAVLAADLVG

SEQ ID NO: 144132 - protein, 72 aa, Glycine max
  Coding DNA Sequence Number=SeqID_27354
RQSKKWDAPKKIGGVSCRCGVASREGRRGRLEFFSKKENQETQQPLAGEGDVPEKNPHHATVVLPEKKHAVE

SEQ ID NO: 144133 - protein, 34 aa, Glycine max
  Coding DNA Sequence Number=SeqID_27355
MDMMVNHTAGENKNLESIIYGSFRSVLRAETRAS

SEQ ID NO: 144134 - protein, 82 aa, Glycine max
  Coding DNA Sequence Number=SeqID_27356
MTRSSRKYECLCVGVRTGEVQQFAGRERKMRGLCFEVSSKRGREKRKDLYRKGERECTFSSRHLCIVTNAFLLTGAEMGWGE

SEQ ID NO: 144135 - protein, 95 aa, Glycine max
  Coding DNA Sequence Number=SeqID_27357
MSFVKTIKVYFAFQRLSMSFVETIKVSFTLQRLQCLLISKEGQLSYPNFIRGLSFANVLILPCRIELFDTSCCARQKIIRHFGKECGKCWTLWPQ

SEQ ID NO: 144136 - protein, 37 aa, Glycine max
  Coding DNA Sequence Number=SeqID_27358
MGLHIKSTKPDTQFPVILYFRSHDSNTLYNRYYKGPL

SEQ ID NO: 144137 - protein, 116 aa, Glycine max
  Coding DNA Sequence Number=SeqID_27359
MCKIVGKKKIIKEKSDSNLVKPGECVKRSFALVTNQIFMSAPLSHTKQKEKGKQKGEKAKRREGLTSGVSLSEAYALSKALSSFSGLGNPRRGSVSDACAQCTASSPSESFVPSRA

SEQ ID NO: 144138 - protein, 304 aa, Glycine max
  Coding DNA Sequence Number=SeqID_27360
MERWRNIEFKEEEKVIFEALNESEDATDAEIGEAWFVGKVHTQGSFNSKAFMTTMAHILKVKGGVEIKEVGGNLFTFKFPSKSDTKKVLGREPWFFDPKLIVMNDMKPLKRSIRIQTEKNRSRRIFLGYERLGNLCFVCGCLNNTLRGCDKRDVDAKDEDVDNFPYGVWLKASPMEMNVVVGVKTEVSFSSARRKLSCDAMDKGSPGDHLARNEGELKNGKHSEREPQLIKVSEVLKSLVECHIEKEEQLSIIRVDERILGLKEAEKIVPKVVICSGELMINYVEKTKVVQGKKDDETVFKRKN

SEQ ID NO: 144139 - protein, 94 aa, Glycine max
  Coding DNA Sequence Number=SeqID_27361
  Subcellular localization annotation: CTP_CleavageSite=51; ConfidenceScore=5.26e-01
MSQNFTDCLTMGVKFLKAIKRRLHPTKQMLSRSVWGNAQVSNNLLGFLLVLAVQIATRLPWWHCRMKLPKNVQQLPLADMEKSTEQQQAKGRYR

SEQ ID NO: 144140 - protein, 422 aa, Glycine max
  Coding DNA Sequence Number=SeqID_27362
  Gene Ontology: Mol. function=transferase activity; Cellular component= chloroplast; Biological process=carotenoid biosynthetic process
  Homolog annotation: Hit_ID=Q9SSU8; Match level="QueryCoverage=86%, HitCoverage=88%, E-value=1e-150, Identity=72%"; Hit description =Phytoene synthase, chloroplast precursor
  Pfam annotation: Domain name=SQS_PSY; Domain location=109-409; Score =421.8; E_value=9.8e-124; Accession=PF00494.10; Description =Squalenephytoene synthase
  Subcellular localization annotation: CTP_CleavageSite=53; ConfidenceScore=5.21e-01
MSGVLLWVSCGPKENPISIVGLAGRGGRSQRRFGLCNGISFASFSPAVADPSRSSEERVYEVVLKQAALVKEKNKGTKRALNLDKPTVEGDLTHGDLLSAAYDRCGEVCAEYAKTFYLGTQLMTQERRKAIWAIYVWCRRTDELVDGPNASHITPKALDRWEQRLYDVFEGRPYDMYDAALSDTVSKYPVDIQLVMSKELVFYKISVELYNLEYLVFSYPFKDMIEGMRLDLRKSRYNNFDELYLYCYYVAGTVGLMSVPVMGIAPESKASTESVYNAALALGIANQLTNILRDVGEDARRGRVYLPQDELAQAGLSDDDIFRGKVTDKWRNFMKGQIQRARMFFDEAEKGVSELNSASRWPVWASLLLYRQILDSIEANDYNNFTKRAYVGKVKKLLSLPAAYGRALLGPQKLTKMVTRSM

SEQ ID NO: 144141 - protein, 201 aa, Glycine max
  Coding DNA Sequence Number=SeqID_27363
  Gene Ontology: Mol. function=nucleoside-triphosphatase activity; Cellular component=membrane
  Homolog annotation: Hit_ID=Q10NN1; Match level="QueryCoverage=74%, HitCoverage=14%, E-value=7e-16, Identity=36%"; Hit description =ATPase, AAA family protein, expressed
MDDMDMDIPLPEELEFLESNSHFAEQEQEEEDHHYYFPDLDPAAEFLESNSQQSPSPQDLAVPSAEPEFNGHKRSRPPSPEEKRAKVRVAVEEDFAVADEDWPRYSPPPAPPEQAMEEMMFEKEKTLSRFASEIDGECMPITAPSGNRVYAKLNRFQGEERVTKLDYNGYSAGTEVILLVLFLLELLLPVLVAPREMKLFN

SEQ ID NO: 144142 - protein, 361 aa, Glycine max
  Coding DNA Sequence Number=SeqID_27364
  Gene Ontology: Mol. function=translation elongation factor activity; Cellular component=intracellular; Biological process=translational initiation
  Homolog annotation: Hit_ID=Q67UI0; Match level="QueryCoverage=90%, HitCoverage=82%, E-value=6e-29, Identity=27%"; Hit description =Mitochondrial transcription termination factor-like
  Pfam annotation: Domain name=mTERF; Domain location=57-334; Score =67.4; E_value=4.5e-17; Accession=PF02536.5; Description=mTERF
SSTSGTSSDYELDGNQHKGDNFNVPYLINSCGVSPKLARKLSKKVNSKTPNGPNSVQDLLNNYGFDKTHLAKLVEKHPMVLVANAENTLLPKLKFFRSIGVSNTDMPKILLCNHVLLVSSLENYLIPRYEILRSVLRDDQEVVRALKNAPFGFTYGSFINSLVPNIKVLRQSGVPQASVSYLMIHSGAVVYSKHSRFVEAVNTAKEIGFNPLRISFINAIEMHLSRSKAVRESRFEVYEKWGWNGEMALQVFRKFPYVMKLPEETFTKKMSFLVKDMGWLSEDIAEYPQVLAYNLEKRIIPRFSVIKILKSKGLLEKNVHFSKIICVTEKLFLEKFVINYQKDLPFLPDFYNSLTNQQNVV

SEQ ID NO: 144143 - protein, 346 aa, Glycine max
  Coding DNA Sequence Number=SeqID_27365
  Gene Ontology: Mol. function=metal ion binding; Cellular component =integral to membrane; Biological process=ubiquitin cycle
  Homolog annotation: Hit_ID=Q8LG38; Match level="QueryCoverage=71%, HitCoverage=82%, E-value=8e-75, Identity=52%"; Hit description =Putative RING zinc finger protein
  Pfam annotation: Domain name=zf-C3HC4; Domain location=296-336; Score= 41.9; E_value=2.2e-09; Accession=PF00097.15; Description=Zinc finger, C3HC4 type (RING finger)
YEKLGRTNKRRKRKLVRRITPGKKESEEGYKRPCEGTRPAIITMSSPNSVPQSHAPLLLPRPDAAARLPILALLLGRRGHSAVVRETAARELEERRADWTYSKPVVALDITWNMAFVLVSAVMLACTVKENPNTPIRWWICGYALQCLVHVALVWLEYRRRNDAPRDEESAASLQYDDVNDSDEDDVGTSGSSSSSGLSVVFLAFDVFFAIFCVVLACLIGIALCCCLPCIIAILYAVAGQEGASESDLSILPKYRFQLLSNEETPGEGGGSMIPMETSNGYSVNERTLSPEDAECCICISSYEDGAELHVLPCNHHFHSTCIVKWLKMNATCPLCKYNILKGNEQ

SEQ ID NO: 144144 - protein, 403 aa, Glycine max
  Coding DNA Sequence Number=SeqID_27366
  Gene Ontology: Mol. function=translation elongation factor activity; Cellular component=intracellular; Biological process=translational initiation
  Homolog annotation: Hit_ID=Q6Z8L0; Match level="QueryCoverage=80%, HitCoverage=81%, E-value=7e-29, Identity=28%"; Hit description =Mitochondrial transcription termination factor-like
  Pfam annotation: Domain name=mTERF; Domain location=99-376; Score =96.8; E_value=6.5e-26; Accession=PF02536.5; Description=mTERF
  Subcellular localization annotation: CTP_CleavageSite=79; ConfidenceScore=5.33e-01
MSNFLLIARLTASSSFTRYKSTHIPLGSLLQHKHTASLFFFNSFTSATSSDSESDGNHHKGDTFTVSYLINSCGVSPTLARELSNRVNLKNPNGPNAVLDLLNNYGFSKTQLAKLVVRHPLVLVAKAKKTLLPKLKFFRSIGVSDTDMPKILIANHCILERSLEKCLIPRYEFLKSVLCDDREVVRALKSSPLGFVYGDLVNALVPNIKILRQSGVSQASISFLLTIALPAAYVEHSRFVEAVKTVKEIGFSPLKTNFVVAISVLTTMRKTVWNSRFEVYESWGWNREMALRAFRKFPGFMKFSGETFTKKMSFLVKDMGWPSEAIAEYPQVVAYSLEKRIIPRFSVIKILKSKGLLEKNMHFSSIICTAEEKFLEKFVVNFQKILPFLPDVYRGLINPSNVL

SEQ ID NO: 144145 - protein, 1450 aa, Glycine max
  Coding DNA Sequence Number=SeqID_27367
  Gene Ontology: Mol. function=structural constituent of nuclear pore; Cellular component=nuclear pore; Biological process=nucleocytoplasmic transport
  Homolog annotation: Hit_ID=Q5Z4E0; Match level="QueryCoverage=98%, HitCoverage=96%, E-value=0.0, Identity=61%"; Hit description =Putative Nuclear pore complex protein Nup155
  Pfam annotation: Domain name=Nucleoporin; Domain location=1-1438; Score=-109.5; E_value=0.01; Accession=PF03177.5; Description=Non -repetitiveWGA-negative nucleoporin
MALPFNNIAVADRFLKPWWPPLVEVVNTWELPPVLIERYNAAGGEGTAFCGIFPEIRRAWASVDNSLFLWRFDKWDGQCPEFSGEEQAICAVGLAKSKPGVFVEAIQYLLVLATPVELILVGVCCSGGADGSDPFAEVTLQPLPEHTIPSDGVTMTCVACTNKGRIFLAGRDGHIYEILYSTGSGWQKRCRKICITAGLGSVISRWVIPNVFSFGAVDPIVEMVFDNERQILYARTEEMKLQVYVLGPNGDGPLKKVAEERNLVNQRDAHYGARQSTGSRVSSRSPKPSIVCISPLSTLESKWLHLVAVLSDGRRMYLSTSPSSGSLTGFNTNHHKPSCLKVVTTRPAPPWGVSGGLTFGAMALAGRPPNEDLSLKVEAAYYSAGTLILSDASPSTMSSLLVLNRDSSSQSSPSGNLGTSTRSSRALRESVSSLPVEGRMLSVADVLPLPDTAATVQSLYSEIEFGGYESSMESCERVSGKLWARGDLATQHILPRRRIVVFSTMGMMEIVFNRPLDIIRRLLESNSPRSVLEDFFNRFGAGEAAAMCLMLAARIVHSENLISNVIAEKAAEAFEDPRVVGMPQLEGSNALSNTRSAAGGFSMGQVVQEAEPVFSGAHEGLCLCSSRLLFPLWELPVMVVKGSLGPSGTLSENGVVVCRLSVGAMQVLEQKLRSLEKFLRSRRNQRRGLYGCVAGLGDLSGSILYGNGSALGAGDRNMVRNLFGAYSRNMESNGGRTSNKRQRLPYSPAELAAMEVRAMECIRQLLLRSGEALFLLQLLSQHHVTRLIQGFDSNLQQALVQLTFHQLVCSEEGDHLATRLISVLMEYYTGPDGRGTVDDISRRLRDGCPSYYKESDYKFFLAVEALERAAMTIDAKDKENLAREAFNSLSKVPESVDLRTVCKRFEDLRFYEAVVRLPLQKAQAIDPAGDAYNDEIDATVREQALAQRGQCYEIIIGALRSLKGDTLQREFGTPIRSTASQSALDPASRKKYICQIVQLGVQSPDRIFHEYLYQAMIDLGLENELLEYGGPDLLPFLQSAGRNSLHEVRAVTATISPVGQSGAPMSSNQVKYYELLARYYVLKRQHMLAAHALLRLAERRSIDGVPTLELRCQYLSNAVLQAKNATNSDGLVGSGRSSIDSGFLDLLEGKLAVLRFQIKIKEELESVASRSDVLPATPDSAENGVVPEGSSTADANFANATREKAKELASDVKSITQLYNEYAVPFGLWEICLEMLYFANFSSDTDSSIVRETWARLIDQAISRGGIAEACSVLKRVGPRIYPGDGAVLPLDIICLHLEKAGLERLNSGVEAVGDEDVARALVSACKGAAEPVLNAYDQLLSNGAILPSASVRLRMLRSVLVVLREWAMSVYSQRMGSSAAGHSLILGGGFSSERTIASQGIRDKITSAANRYMTELRRLALPQNQTEHVYRGFRELEESFISQHSFDRF

SEQ ID NO: 144146 - protein, 175 aa, Glycine max
  Coding DNA Sequence Number=SeqID_27368
MAILLVFRMTASELGNLNQHTNSLVPVDQNLKLISDFITAFGVWDFHMFQNIMTPQILNVVTAMSPLSTCGTARSTRSHFEILQEITLVSSILLKLKYTTTHPAYGIVKMIPDFIDDGVHITWSRALREANQVVDCFANYAHSLGVQIRGLDFIPIFASNVLLADLTATAFPRDF

SEQ ID NO: 144147 - protein, 104 aa, Glycine max
  Coding DNA Sequence Number=SeqID_27369
MNHKGIPSFVFNDYNQEAMSTSCNESKSVINQEANPASCNEPKELILEGPDNITLEQAFKLNFKASNNQEEYETLIVGLKLAREVGAKKVRWQNQTREVGAKKL

SEQ ID NO: 144148 - protein, 46 aa, Glycine max
  Coding DNA Sequence Number=SeqID_27370
MTQPPQGHKKRVLTSIEKAETRRGKHRRDLHQWVSSNHISELHTTL

SEQ ID NO: 144149 - protein, 89 aa, Glycine max
  Coding DNA Sequence Number=SeqID_27371
MVWLWLDTFYEMVRPHPATPDGLRDCIFWNWVLGDLYTLYLYAAITPNYHPCGCARPPIPVRLSGIVRHYYVLSLTIYMLHLLLDIYGL

SEQ ID NO: 144150 - protein, 277 aa, Glycine max
  Coding DNA Sequence Number=SeqID_27372
  Gene Ontology: Mol. function=amino acid-polyamine transporter activity; Cellular component=integral to membrane; Biological process=amino acid transport
  Homolog annotation: Hit_ID=P0AAE5; Match level="QueryCoverage=99%, HitCoverage=64%, E-value=4e-53, Identity=63%"; Hit description =Putative arginine/ornithine antiporter
MAAVAGPAALLIGWLITGVGILFLSLAMLLLTRLRPELDGGIFTYARAGFGELTGFCSAWGYWLCAVIANVSYLVIVFSALSFFTDTPDRIVFGDGNTWQAMLGASVLLWLVHWLVLRGVQTAASINLLATLGKLVPLLLFVVLALLAFNYDRFRFDFDGAALDQPLWQQVKQTMLITLCRARHAASGAGRAAGLPAGDVAVAWRGAACGTGADAQSVDGRSDGTPAGSLGRCGDCGWPDYLSVRGLSQLDHYGGGRPVPCRAAGRVSAQHCPAEPP

SEQ ID NO: 144151 - protein, 76 aa, Glycine max
  Coding DNA Sequence Number=SeqID_27373
MAFMDNWAVGKEKEWQSQHGLLLHPTLFICPSFLICPSRMTKFASFQTHIDPFTSKDQIRKALKVRSPPFSIVEYW

SEQ ID NO: 144152 - protein, 153 aa, Glycine max
  Coding DNA Sequence Number=SeqID_27374
  Gene Ontology: Mol. function=binding
  Homolog annotation: Hit_ID=Q10PS3; Match level="QueryCoverage=90%, HitCoverage=19%, E-value=5e-58, Identity=80%"; Hit description=HEAT repeat family protein, expressed
MTQILVQRAGSPDEFTRLTAITWINEFVKLGGDQLVPYYADILGAILPCIADKEEKIRVVARETNEELRALKADPAEAFDVGAILSIARRQLSSELEATRIEALHWISTLLNNYRTEVLQFLNDIFDTLLKALSDPSDEVYRPPDVPCLHLFY

SEQ ID NO: 144153 - protein, 114 aa, Glycine max
  Coding DNA Sequence Number=SeqID_27375
MCASKEVGDLGVRDLRCFNYALLRKWRRRRIYGIRYWSVYMGRGMGRLWVMTLKTPVKYIKLNPDMGISVVLVSVSCHVGHRTPDTGHDKRPGCLCFLALKDPVCGSLMRVLGA

SEQ ID NO: 144154 - protein, 69 aa, Glycine max
  Coding DNA Sequence Number=SeqID_27376
MFPNNYDISSVQPIVAASEGTTVFGDQRNVREEPRTYLGVQKVTDKPIYIGLVRENDATKSERTIYLGE

SEQ ID NO: 144155 - protein, 79 aa, Glycine max
  Coding DNA Sequence Number=SeqID_27377
MGGTLEELDPWKIFLSDMLRHRRLLSNQLKRLPEYVEIIQLRVNHSQSVNCDFCGGEHFNDSCHLYSMENYWWEQELYP

SEQ ID NO: 144156 - protein, 232 aa, Glycine max
  Coding DNA Sequence Number=SeqID_27378
  Gene Ontology: Mol. function=transcription factor activity; Cellular component=nucleus; Biological process=regulation of transcription, DNA-dependent
  Homolog annotation: Hit_ID=Q6PQQ7; Match level="QueryCoverage=45%, HitCoverage=17%, E-value=1e-10, Identity=38%"; Hit description =AP2/EREBP transcription factor
  Pfam annotation: Domain name=AP2; Domain location=25-99; Score=31.6; E_value=1.5e-07; Accession=PF00847.10; Description=AP2 domain
MSTDMTQTDVVDSVRMLSYSFVKFISKYRGVIRDSSTAKWEAIFVTSSDDNKSLGLFGEVITPYILCNTEEEAARAYDVESIRLKGYDAITNFNIRFYNVEAILKGVTDPEKVIYQSQDTVPVEAMQPLEVLQNIIDQGSSKMLYGTTTDTFGSNVFQRPISGNTEEQENYVAFASQGRENDPNRNLSLVTEGQPLVYGRSGEDDGQGGSSASSMCFEDELTNAYKKFIKRS

SEQ ID NO: 144157 - protein, 424 aa, Glycine max
  Coding DNA Sequence Number=SeqID_27379
  Gene Ontology: Mol. function=oxidoreductase activity; Cellular component=mitochondrial outer membrane translocase complex; Biological process=aromatic compound metabolic process
  Homolog annotation: Hit_ID=Q1SA66; Match level="QueryCoverage=99%, HitCoverage=100%, E-value=0.0, Identity=85%"; Hit description =Pyridine nucleotide-disulphide oxidoreductase, class I; FAD -dependent pyridine ...
  Homolog annotation: Hit description=nucleotide-disulphide oxidoreductase
  Pfam annotation: Domain name=FMO-like; Domain location=26-424; Score=- 372.9; E_value=1.3e-06; Accession=PF00743.9; Description=Flavin -binding monooxygenase-like
  Pfam annotation: Domain name=Pyr_redox_2; Domain location=25-383; Score=-23.2; E_value=0.0073; Accession=PF07992.4; Description =Pyridine nucleotide-disulphide oxidor
  Pfam module annotation: Pfam domain module=FMO-like::Pyr_redox_2; Domain location=26-424::25-383
MENLFRLVDNEDLFSRRCIWVNGPIIVGAGPSGLATAACLREQGVPFMVLERADCIASLWQKRTYDRLKLHLPKQFCQLPKLPFPEDFPEYPTKKQFIEYLESYAKHFEINPQFNECVQSARYDETSGLWRVKTVSSSSGAARGEVEYICRWLVVATGENAECVMPEIEGLSEFKGDVIHACDYKSGERFRGKKVLVVGCGNSGMELSLDLCNHHSSPSMVVRSSVHVLPREVFGISTFELAVMLLQWLPLWLVDKILLILAWFVLGNIEKLGLKRPSKGPLEMKNRKGKTPVLDIGALERIRSGDIEVVPGIKRFNNGEVEFINGEKLDIDAIVLATGYRSNVPSWLQEGEFFSKNGYPKMPFPHGWKGNAGLYAVGFTKRGLSGASSDAVKIAQDIGQVWKNETKQKKQRTTACHRRCISQF

SEQ ID NO: 144158 - protein, 44 aa, Glycine max
  Coding DNA Sequence Number=SeqID_27380
MEGELGGNDDDMSSSSDSLGDDEVARKELSKMGGREDEARGVDE

SEQ ID NO: 144159 - protein, 125 aa, Glycine max
  Coding DNA Sequence Number=SeqID_27381
  Homolog annotation: Hit_ID=Q8H0H5; Match level="QueryCoverage=96%, HitCoverage=17%, E-value=1e-23, Identity=51%"; Hit description =Hypothetical protein A20
MVTVMVTKAGDTIIERRLSAESARSFPYVAEPVVYMAPSSANVAEKVAEAAGKSHLARNVSAVQRRGYTSDEELEELDSPLTFIIDKLPSSPTVTENGKGNNHKEQGGNPTTNARYQLLREVWSM

SEQ ID NO: 144160 - protein, 105 aa, Glycine max
  Coding DNA Sequence Number=SeqID_27382
  Homolog annotation: Hit_ID=Q6Z8K9; Match level="QueryCoverage=70%, HitCoverage=19%, E-value=7e-09, Identity=38%"; Hit description =Mitochondrial transcription termination factor-like
MVEVFGFNPLKTTFVMGIQAMGLPSEDIAEYPPVLAYSLEKRIISRFHVIKILKSKGLLDNSFHTGSFMTITEEKFLKKFVIDFQKDLPLLPDVYKDLIDYQKVM

SEQ ID NO: 144161 - protein, 88 aa, Glycine max
  Coding DNA Sequence Number=SeqID_27383
  Homolog annotation: Hit_ID=Q1SPJ5; Match level="QueryCoverage=88%, HitCoverage=4%, E-value=2e-32, Identity=88%"; Hit description=TPR repeat
MALVLHFHFSIAAINDTDSKSQWEPLAPTKEAHEFHLSQTYHEGLLKLQAKEYEKARELLESVLKYPLIANAQVDSSASDGHLLQLRF

SEQ ID NO: 144162 - protein, 590 aa, Glycine max
  Coding DNA Sequence Number=SeqID_27384
  Gene Ontology: Biological process=cell cycle
  Homolog annotation: Hit_ID=Q8H0H5; Match level="QueryCoverage=83%, HitCoverage=69%, E-value=1e-151, Identity=56%"; Hit description =Hypothetical protein A20
MKEIEKRKASRNSQTKGSRRTERRENKLHQDNSSKTLNEKGTESKTPQDSRPTANNFLSDSNTALENSETYENVVIHYVDDVNRSEEALAEMKVNENKNEVAGDRSSDLEKEQKEGNEEVSDTETVKDSVSSQGDSFTNEDERTEKASKDPKSKVKVNPSESNRGSKERSDRKTNKLQSKVSNSNQKKPMNSNKGPSKVTNKNTPSTNSKTVKVPVNVSSESSEGVDEKPVQEVKEPDVVDGSSNGAQSVGSEDEIHETVNAEENGEHEDDTAAELKIEEMELRIEKLEEELREVAALEVSLYSIAPEHGSSAHKVHTPARRLSRLYIHACKHWTQKRRATIAKNTVSGLILVARSCGNDVSRLTFWLSNTIVLREIISQAFGNSCQASPLKRLAESNAAGKRNDGKSMALKWKGSSSGKAGNGFMPLVEDWQETGTFTFALERVESWIFSRIVESVWWQALTPYMQSPVGNSSNKSIGKLMGPALGDHNQGNFSINLWRNAFQDAFQRLCPVRAGGHECGCLPVLARMVMEQCIARLDVAMFNALLRESALDIPTDPISDPIVDSKVLPIPAGDLSFGSGAQLKNSVCI

SEQ ID NO: 144163 - protein, 141 aa, Glycine max
  Coding DNA Sequence Number=SeqID_27385
  Gene Ontology: Cellular component=nucleus
  Homolog annotation: Hit_ID=Q6Z2I7; Match level="QueryCoverage=98%, HitCoverage=29%, E-value=3e-48, Identity=63%"; Hit description=SET domain-containing protein-like
  Pfam annotation: Domain name=SET; Domain location=1-139; Score=-4.8; E_value=0.0025; Accession=PF00856.18; Description=SET domain
ELWAMKLGLKLLQERAKVGSFWWPYITNLPETYTVPIFFPGEDIKNLHYASLLHQREVKRALVSLTPDKHPFGGQEVDASSLGWAMSAVSSRAFRLYGEKDPNGIRIDVPMMLPLIDMCNHSFNPNARIVQEQDTSDSKMK

SEQ ID NO: 144164 - protein, 122 aa, Glycine max
  Coding DNA Sequence Number=SeqID_27386
MENGTREGAVRVRKIGPPQGSHRTHSDNEKVDYDDRLYPVNFGHRHPFPVTLHDSLFRFKMRARSRTLFFFSHNSPEPLIERLNVTKTTQRKQQLQRCYSQGFFCLPSFLRTYHFNKTKPRV

SEQ ID NO: 144165 - protein, 93 aa, Glycine max
  Coding DNA Sequence Number=SeqID_27387
  Gene Ontology: Mol. function=hydrolase activity, acting on glycosyl bonds; Biological process=carbohydrate metabolic process
  Homolog annotation: Hit_ID=Q1SJ74; Match level="QueryCoverage=59%, HitCoverage=20%, E-value=3e-16, Identity=80%"; Hit description =Parallel beta-helix repeat
MMQSVQSSTRALFTTLQSPTAIKLGSASWFDFKHFVFDNIAIVDSHRGIGFQIRDGDLALKHRFEVFQLPCAGNARMPRVDKTQDCRDDDGAH

SEQ ID NO: 144166 - protein, 127 aa, Glycine max
  Coding DNA Sequence Number=SeqID_27388
  Gene Ontology: Mol. function=transcription regulator activity; Cellular component=nucleus; Biological process=regulation of transcription
  Homolog annotation: Hit_ID=Q1SJ77; Match level="QueryCoverage=52%, HitCoverage=20%, E-value=2e-27, Identity=83%"; Hit description=Helix- loop-helix DNA-binding
MDNNLPSMVTPLMWPEIPLNGNRQHYQQQWQLDAFHQPLWEREEVNHNFMTPENSLLSYDSSANSVSCDLSGLNSPDLAGFPCLLFVRGGWKPGFSLARNGSAAGLYCCLTLGSPQFYYETLLSSLD

SEQ ID NO: 144167 - protein, 125 aa, Glycine max
  Coding DNA Sequence Number=SeqID_27389
MWAHLTPHEVEVSMFQDLGSSFWGMVLILASTNLLTARIAAGCFIAALLIVLFIAKNWTLRGLCIGFIIFLGVIWILQETTKVRILRYIILFIGVYLVELTRKARGLISFVFLCGAVYLGAVILS

SEQ ID NO: 144168 - protein, 385 aa, Glycine max
  Coding DNA Sequence Number=SeqID_27390
  Gene Ontology: Mol. function=translation elongation factor activity; Cellular component=intracellular; Biological process=translational initiation
  Homolog annotation: Hit_ID=Q6Z8L0; Match level="QueryCoverage=82%, HitCoverage=78%, E-value=1e-27, Identity=26%"; Hit description =Mitochondrial transcription termination factor-like
  Pfam annotation: Domain name=mTERF; Domain location=81-358; Score =80.1; E_value=6.8e-21; Accession=PF02536.5; Description=mTERF
  Subcellular localization annotation: CTP_CleavageSite=47; ConfidenceScore=5.44e-01
MVRNFLLIARLTASSSFTRYKSTHIPLGSLLQLKHTASIFFFNSFTSASSSDSESDGNRHKAKELSNRVNFKNPDGPDAVIDMLSNYGFDKIQVAKLAKKQPLVLLEDAENTLLPKLEFFRSIGVSNTDMPKILIANRDILFRSLEKCLIPRYQILKSVVCDDGEAVTALINAPFDFTNGDMMNHLVPNIKVQRQSNVPPASISLLMVHFTGVAYMKHSKFVEAVNKAREIGCDPSKMVFMHAVRLLLTTSKTLWDSKFEVYERWGWNHEMALRAFVKSPNFMMLSEETYTKKMTFLVKDMGLPSEDIAHYPQVLTYSFEKRIIPRFSVIKILCSKGLLKKDLHFSSFMCLTEGNFLKKFVIKFQDDLPLLSDVYKGLFNHQNVV

SEQ ID NO: 144169 - protein, 651 aa, Glycine max
  Coding DNA Sequence Number=SeqID_27391
  Gene Ontology: Mol. function=DNA binding; Cellular component =chromatin; Biological process=DNA integration
MEAKVAALESEVASLCSVLVTMQSKAKENQAKLLTLLEERLSLNEGEKSVMKTSLNVIVDEFHQAVKKVELPLFIGEDPTRWIARVEIYFQIQETHLEIREFGPTMYRRLDDSFFQVVTGRQDKIHVEETQSRIARAEFKHLIAQVPCRPDDQYFGYFMHGLKEGIRGRDEGALDFEAEPGRVGPIKQTRILSPLAQIWAVNMGIIGERPMSTRTLVMVMLLGLGLVLQKDRFVTKIVTNPEIKCLDHQLRVMLIDDDDEEEGELQVFSAEGEVDTESNNECSVMHLGSLRVQKRWATSNAEDSRHHKRGSNSDSGTCKGVELKLGEITIPIDTLLFDLEGINIVLGISWLAFLGRILFGKPYHMVEGLLLCTELQISHSRPLGFDRDVLSDQPFSEITSLLDGYFKIFREPKGLPPQRGKKHVITLMEGQGAVNGRPYRYPRYHKNEIEKQVKQFMDNGMIRPNQSAFSSPAILVKKKDETWRSCVDYHALNKLTVPDKFSIPIIVELLDELHGAHYFSKLDLKSGSHILHLTAVLDVLKREQLVENWKKCYFGQTTVEYLGHINSKDGVAMDPNKVKSGIERPVPKNVKGVRNFLGLTGYYRKFIKDYGKIAHPLTDLTKKDEFKWGDSEQTASEFLSRNVIFVNIKSI

SEQ ID NO: 144170 - protein, 409 aa, Glycine max
  Coding DNA Sequence Number=SeqID_27392
  Gene Ontology: Mol. function=protein dimerization activity; Biological process=electron transport
  Homolog annotation: Hit_ID=Q1S735; Match level="QueryCoverage=70%, HitCoverage=88%, E-value=2e-60, Identity=52%"; Hit description =Probable transposase [imported]-Arabidopsis thaliana-related
  Pfam annotation: Domain name=DUF659; Domain location=101-204; Score =43.6; E_value=6.8e-11; Accession=PF04937.6; Description=Protein of unknown function (DUF 659)
  Pfam annotation: Domain name=hATC; Domain location=246-327; Score =36.7; E_value=8.2e-08; Accession=PF05699.5; Description=hAT family dimerisation domain
  Pfam module annotation: Pfam domain module=DUF659::hATC; Domain location=101-204::246-327
MDEDLVRVVEELRETPKPISFKSQKGKNTPYVDEYFMPRTTPGAQPCLKSVLQNKQIVEKCDKAIAKWMIDASIPFNAVNSTYYQPMINAISSMSPGYKAPNFYRICGPLLNMWVDEVRKLVESYKEVWKETGCTLMADGWTDHSRRTLINVLVYYPKGTIFLRLLEKEFLKVYWSPCAAHCINLMLQDFGKFEEGLDKPNFAKDSKAKKFVEQILDSGFWKWYTHGDLELQDKLNEGMRIYKIFEGDFAIQAAICKQNKVVLDQWWDCYGCNAPQLQKLAIRVLSQTCSASGCDRNWSIFEQIHSKRRNRLEHQKLNDLVYVLEESPSFLTREEVETLRNDLTNMFIQSTSYDIDKLNLDEYEDDDVSQPPNNTMKDVNPNESNIGEKFQSFDEEGLLEIDPTLAPWM

SEQ ID NO: 144171 - protein, 122 aa, Glycine max
  Coding DNA Sequence Number=SeqID_27393
  Subcellular localization annotation: CTP_CleavageSite=33; ConfidenceScore=5.32e-01
MYTLLFSVTTTQVDVPSTCSTKDVPSNVLRQSSQATVDGDKAPSTVDDVVALRGSLINAPRNLFTETSYSWQQWWQAPQRRRRRRTCSHNLLLTTTTNGNVGDVSNNNTKMAEVRKKKNKTL

SEQ ID NO: 144172 - protein, 148 aa, Glycine max
  Coding DNA Sequence Number=SeqID_27394
  Gene Ontology: Mol. function=electron carrier activity; Cellular component=mitochondrion; Biological process=electron transport
  Homolog annotation: Hit_ID=Q9FF87; Match level="QueryCoverage=93%, HitCoverage=29%, E-value=4e-18, Identity=36%"; Hit description =Arabidopsis thaliana genomic DNA, chromosome 5, P1 clone:MRO11
MFVEAVKVVVGTSKEAWEKRVEVYERWGWSNEMCLCAFRRYPQCMLMSEDKVMRTMRFLVKDMGWPAEDIFRTPGVLSPNLEKTIMPRSRVMKVLKERGLVKSDSRLSSAILITEKLFLEKFVGRFQDRVPGLMEVYKGHVDHLDSVL

SEQ ID NO: 144173 - protein, 172 aa, Glycine max
  Coding DNA Sequence Number=SeqID_27395
  Gene Ontology: Cellular component=mitochondrion; Biological process =response to cold
  Homolog annotation: Hit_ID=Q9FF87; Match level="QueryCoverage=54%, HitCoverage=20%, E-value=1e-09, Identity=33%"; Hit description =Arabidopsis thaliana genomic DNA, chromosome 5, P1 clone:MRO11
MGPCGTPTPLRCSTLGIKWLIKPRPDSAEDVVARNKAVLEAAFQEDGVSDEEFGEVGGGEADGEEELELGQNGLFGFDLEDYGEAFDKEGQLEFGESEGFEEVKDGVRLIGGFEVDPFRELEGPRGGQVAGVDEVGEGEVRIFGLGFGFGFGRKGVEENGWFQLSDAVIAIA

SEQ ID NO: 144174 - protein, 113 aa, Glycine max
  Coding DNA Sequence Number=SeqID_27396
AANSAFRSKGGYEILQMVQFAQFPFGPKAEPVSGIGVQDDAAVRNCVAMVVAVVGSMDENSGSDTGRDDNHTACAALCIIGRGAPMMTTSAYPQGQVPPGVAGNFLAGVVAVD

SEQ ID NO: 144175 - protein, 250 aa, Glycine max
  Coding DNA Sequence Number=SeqID_27397
SKPMINVKSTPEKKKLLAKLERSNRISIIVIKMIVFEHLLSDLPEKVTAKEFLYALGERYRVSDNVEFRCLMKQLMDMRYDNVNGLEVTDPIVLSNGVDTESSETVSFPLPIPSVGVSNVIPVENVVATEDIVGPRANDLIDPLTVNENEQPIEQHVELPEKYKAIGCKWFFKTKKDLDGNIERFKARLVPKGFTQKEGSLMYAQVCTRPDIAFMVGILGRYQSNPGNDHWVAATKLMILTENQGVYACV

SEQ ID NO: 144176 - protein, 76 aa, Glycine max
  Coding DNA Sequence Number=SeqID_27398
MARSPDKTKSIDGSKETLKLSVRISDLWECVLGDIPFRKYRFAGFADVVAGQFERGLLVDVIGVVDEAAFWQVSGK

SEQ ID NO: 144177 - protein, 40 aa, Glycine max
  Coding DNA Sequence Number=SeqID_27399
MTNGSTVAANPETVKGMLESLATMANGSVLDLSQTATERT

SEQ ID NO: 144178 - protein, 180 aa, Glycine max
  Coding DNA Sequence Number=SeqID_27400
  Gene Ontology: Mol. function=methyltransferase activity; Biological process=metabolic process
  Homolog annotation: Hit_ID=O80543; Match level="QueryCoverage=87%, HitCoverage=46%, E-value=2e-49, Identity=60%"; Hit description =Uncharacterized protein At1g22800
  Pfam annotation: Domain name=Methyltransf_11; Domain location=78-171; Score=29.8; E_value=9.7e-06; Accession=PF08241.2; Description =Methyltransferase domain
  Pfam annotation: Domain name=Methyltransf_12; Domain location=91-169; Score=10.1; E_value=0.054; Accession=PF08242.2; Description =Methyltransferase domain
  Pfam module annotation: Pfam domain module=Methyltransf _11::Methyltransf_12; Domain location=78-171::91-169
MRAVSLWLRRKHQLPLALAFRRFSTSNSKVKIFDRELKRTQRDRAAWLTPSHDPLLHTVAQNLLDRLQDCKKTFPTALCLGGSLQPITRSLSAPPAPGGVEKLIVMDASYDMLQACKNAHHNATVETHFLVADEDSVDLVVSCLGLHWTNDLPGAMIQSRLALKPDGLFLAAILGGETLK

SEQ ID NO: 144179 - protein, 157 aa, Glycine max
  Coding DNA Sequence Number=SeqID_27401
  Gene Ontology: Mol. function=transcription regulator activity; Cellular component=nucleus; Biological process=regulation of transcription
  Homolog annotation: Hit_ID=Q8S3F0; Match level="QueryCoverage=93%, HitCoverage=47%, E-value=1e-16, Identity=35%"; Hit description =Putative bHLH transcription factor
MTDKANVVREAVKYVKQLEERVNELENQKRKEGVNSIILTKKTPLSINNIDQAITHGCVDVEEEILELKVTVLDKELLIGIYSEKQRQTMLKILSLLDDLHLSITPLSITPTSVLPFGTSTLKITIIAQMDDEYNMIIHDLVKALRQRILKSQDMQK

SEQ ID NO: 144180 - protein, 1093 aa, Glycine max
  Coding DNA Sequence Number=SeqID_27402
  Gene Ontology: Mol. function=zinc ion binding
  Homolog annotation: Hit_ID=Q1SUW3; Match level="QueryCoverage=94%, HitCoverage=99%, E-value=0.0, Identity=63%"; Hit description=Zinc finger, RING-type; Zinc finger, CHY-type; RINGv
  Pfam annotation: Domain name=Hemerythrin; Domain location=137-198; Score=26.7; E_value=7.9e-05; Accession=PF01814.13; Description =Hemerythrin
  Pfam annotation: Domain name=Hemerythrin; Domain location=326-388; Score=27.0; E_value=6.6e-05; Accession=PF01814.13; Description =Hemerythrin
  Pfam annotation: Domain name=Hemerythrin; Domain location=38-99; Score=15.6; E_value=0.18; Accession=PF01814.13; Description =Hemerythrin
  Pfam annotation: Domain name=Hemerythrin; Domain location=391-458; Score=3.9; E_value=9.1; Accession=PF01814.13; Description=Hemerythrin
  Pfam annotation: Domain name=Hemerythrin; Domain location=641-702; Score=33.7; E_value=6.5e-07; Accession=PF01814.13; Description =Hemerythrin
  Pfam annotation: Domain name=Hemerythrin; Domain location=712-804; Score=16.3; E_value=0.11; Accession=PF01814.13; Description =Hemerythrin
  Pfam module annotation: Pfam domain module=Hemerythrin::Hemerythrin::H emerythrin::Hemerythrin::Hemerythrin::Hemerythrin; Domain location =137-198::326-388::38-99::391-458::641-702::712-804
MASPLDGGGVAVLPNSVNKVDSSSVLNGGLKCSKPESPILIFLFFHKAIRNELDALHRLAVAFATGNRSDIKPLSGRYHFLSSMYRHHCNAEDEVLIFLHLYVFGLVKSCNLISRCEKNGVESGDFIAALDIRVKNVAQTYSLEHKGESNLFDHLFELLNSSINNVESFPKELASCTGALQTSVSQHMAKEEEQVFPLLIEKFSLEEQASLVWQFLCSIPVNMMAEFLPWLSASISPDESQDLRNCLIKIVPEEKLLQKVVFTWMEGRSSINTVETCADHSQVQCSSRALTHQLEKVNCACESTTTGKRKHSGSMIDVSDTTGTHPIDEILLWHSAIKKELSEIAVETRKIQHSEDFTNLSAFNERFQFIAEVCIFHSIAEDKVIFPAVDGEFSFFQEHAEEESQFNDFRRLIESIQSEGASSNSDVEFYSKLCIHADHIMETIQRHFHNEEVQRVLPWLVGSLTEDEAKTFQRNMQLAATDSALVTLFCGWACKARNEGLCLSSSASGCCPAQRLSDIEENIVRPSCACASALSNRHCSVLAESGGNKRSVKRNILESHKNEDLPETSETENIQKQCCSARSCCVPGLGVSSNNLGLSSLSTAKSLRSLSFCSSAPSLNSSLFIWETESSSCNVGSTQRPIDTIFKFHKAIRKDLEYLDVESGKLSDGDETILRQFNGRFRLLWGLYRAHSNAEDDIVFPALESKEALHNVSHSYMLDHKQEEQLFEDISCVLSEFSVLHEALQMTHMSDNLSESNFGTSDANTSDDIKKYNELATKLQGMCKSIRVTLDQHLFREECELWPLFGRHFTVEEQDKIVGRIIGTTGAEVLQSMLPWVTSALTQDEQNKMMDIWKQATKNTMFNEWLSECWKESRVSTAQTETSDHSTSRRGAEYQESLDHNDQMFKPGWKDIFRMNQNELESEIRKVYRDSTLDPRRKAYLVQNLLTSRWIAAQQKSPKALSEGSSNSVEIEGLSPSFQDPEEHVYFGMLDALLAAEELPEEYKDRCQVSTFVSSLHSFRKLMTYSAMTVIGRALHASTGCITNVDFVALTIPGLSSVRRQTPAALSVLLLSGGDCSCSSNLEKFLYGMFLKV

SEQ ID NO: 144181 - protein, 44 aa, Glycine max
  Coding DNA Sequence Number=SeqID_27403
  Gene Ontology: Mol. function=electron carrier activity; Cellular component=mitochondrial respiratory chain; Biological process =electron transport
  Homolog annotation: Hit_ID=O22490; Match level="QueryCoverage=84%, HitCoverage=35%, E-value=5e-14, Identity=92%"; Hit description =Cytochrome C
MASFEEAPPGNSKNGEKIFKTKCAQCHTVDKGAGHKQGLKVTLY

SEQ ID NO: 144182 - protein, 495 aa, Glycine max
  Coding DNA Sequence Number=SeqID_27404
  Homolog annotation: Hit_ID=Q9SDN5; Match level="QueryCoverage=15%, HitCoverage=9%, E-value=4e-09, Identity=51%"; Hit description=FH protein NFH2
MALPTASFAMAMVAAVAEQSPESPSASSVAKGGVSDMSEIFQCFLCVAAAPKEPVLNPLNVPLSVSGDDNRAGDKGTDDKPDVRENAEDEEALDSLRGARGGDDDDDDDNASSFFSNVPSCNDDDDDAACACEHALNASFELCSVKTLSGVEHNEGEEGEDCTCLSGEAEEEEGHELEITLLPPVAKIRREADPVPPEPPNDEPLGDLSRKRRKRSELRRFHFPVAAGVGDVGAIFNYVRVNYSSEVKKLGAGGRRVPELASFHGGFGIAREQAEVGVGSDKFAVGSEGRAPATAVTDDGRDDYSKDRGGDGGESDGEEFVGGRIGFGGVRKNERGNIGREGGKVGVGIVVVVVEVVGMVDDGYLGFGFCLWLEGEGCGFGASEGGRVVKGTKGSWRILLLRKKGWDEAMREGSDLESEKVDFYDEMKNGESVNLGGFVLHTAKILLVVLFHYLKESRFHICTVPGPMQLLLSVGVFDLIHGNNNIIGDIDEDFL

SEQ ID NO: 144183 - protein, 796 aa, Glycine max
  Coding DNA Sequence Number=SeqID_27405
  Gene Ontology: Mol. function=actin binding; Biological process=actin cytoskeleton organization and biogenesis
  Homolog annotation: Hit_ID=Q9SE97; Match level="QueryCoverage=80%, HitCoverage=63%, E-value=2e-92, Identity=57%"; Hit description =Formin-like protein AHF1
  Pfam annotation: Domain name=Extensin_2; Domain location=3-384; Score= -142.8; E_value=0.1; Accession=PF04554.4; Description=Extensin-like region
  Pfam annotation: Domain name=FH2; Domain location=585-796; Score =90.7; E_value=4.6e-24; Accession=PF02181.13; Description=Formin Homology 2 Domain
  Pfam annotation: Domain name=Mucin; Domain location=1-150; Score= -15.0; E_value=0.1; Accession=PF01456.8; Description=Mucin-like glycoprotein
  Pfam module annotation: Pfam domain module=Extensin_2::FH2::Mucin; Domain location=3-384::585-796::1-150
MQTFFLYLFLFFLLCALHQLASSQPFFLNRRILHEPFVPLTTLPPSEAPKPQPSPSSHKQKPKPKYPSSTIPTTSTTTTTIPTPTTTTPQSPFFPLYPSSPPPPSPITFASFPANISSLILPHSPKPNSSSNKLLPVALSAVAAAVLAIIISAVVCYRRRRSPPLAADGKLIRSDTDLRLLPRNTETAVETRKLRHTSSTSSEFLYLGTVVNSHIIEDGADVSDAGGDRKMESPELRPLPPLARQASLPLPTYDEAGFTTAEEEEDDEEFYSPRGSSLGGSGGTGSASRRIFATGGRSVISSSCPSSSSASPERPHSIATASSSSRRTQPKSPENYNHQHVQSSPSSPSLCSTPDRVFTEHNSNEALSACSHAHAASSSSSLHEGTLEKNEDALSSSSSSSPPRAPRRLSNASSSSAFSLTSSLEKVTRNHTFDQSPRMSSVSDGLMLPGLSSVPLSPALLSSPETERGTFSGLRTGSFGAAATQRKHWNISDMSLTPPFDEIGTVPVPAPAPPPLPQRKHWEIPGSAPPPPPPLPWQRKQWGVPSPAMRPSTPVSRPPELVPPSRSFVLQNQGTNVELPASLGEIEEISKPKLKPLHWDKVRTTSDREMVWDQMKSSSFKLNEKMIETLFVVNTSNPKPKDATTNSVFPLPNQEERILDPKKSQNISILLKALNVTIEEVCEALLEGSTDTLGTELLESLLRMAPSKEEERKLKEHKDDSPTKLGLAEFFLKAVLDVPFAFKRIEAMLYIANFESEVEYLRTSFQTLEAACEELRHCRMFLKLLEAVLKTGNRMN

SEQ ID NO: 144184 - protein, 981 aa, Glycine max
  Coding DNA Sequence Number=SeqID_27406
  Gene Ontology: Mol. function=binding; Cellular component=membrane
  Homolog annotation: Hit_ID=Q9LV73; Match level="QueryCoverage=91%, HitCoverage=62%, E-value=0.0, Identity=49%"; Hit description =Arabidopsis thaliana genomic DNA, chromosome 5, P1 clone:MJE7
  Pfam annotation: Domain name=TPR_2; Domain location=157-190; Score =17.1; E_value=0.064; Accession=PF07719.7; Description=Tetratricopepti de repeat
MLEKKKEYDQRPKRKNPPFKISRQKMRIAEISSPELRSLHRDTEPNNRSLFQIETIVKQLETRSAEKPPPETVVSDLRQCLTQLSQLASFPNSLKLQIWKLSYRLWNACVDISNTTAIRSSSSATTESQAELRHIAADLLSIAGDVDGIPSPAIKSASFYHKTGQIWHSLRKFDLAAKCFERATDLVSKLEINSITDAGERKLLLDLNLARSRTAWEVRDPNLAVALLNRSKSFLFGACEHYTDLAKQFMAFGKRALSSGGGEDANREALKLMNEALECCEKGFGAARTREEKVEIRGLRWKALRFIAAIHLQKEEFESVIKCVKVLRDSADGGDEHPSLSVLAMKAWLGLGRHGEAERELRGMVIDKGIPEGVWVSAVEAYFVAAGTAGAETAKGVFLGLLGRCHVSAGSAVRVAHRVAGGGGEGGRLRAKVVAELVSDERVVALFAGQDAAKDRVAMHAVLWNWYCFLNHLFPNLLAVVPIIFNQKIMRPVRNSLKNQCYIFHMMQRTEYFEQRALEVLNSLLEFSVKYETLSMLFHACSLSLTLSVLFLRNGMRTYVEISFVLTQFKIYLQKNDHQGAINQIEAMTTCLDFQPDFLSLSAHEAVACHALPIAVASLSSMLKFYASGKSMPTAEVTVVRTLLTVLSQEPGNEQQVIKFLKHAHTRASEIGPDCFFGKEEVGRRERNWFAVTSWNFGTKSGQDKNYESSAVFLKLASDFYALIEGSDNENNVMVCKSLVLSVSSMIASEFERKTSMSETEVKQALYLLDRAGEMLKSISARNSVNSDQINTIEPELFFIYTFCYYDIQGRLNDLGSQLLNVKSFASSKACKPHHLLQIGLSASQGPRLNHEVACFALNECLSSFLSSAAPDYQNVALVMRKLISNASIHKGDADDDLVYSMYKQAYRIMVGLKEDEYPIEEGKWLAMTAWNRAAVPVRLGQIEVGKKWMTVGLDIAKHVPGMEAYKECMEEVLGNLKKEF

SEQ ID NO: 144185 - protein, 156 aa, Glycine max
  Coding DNA Sequence Number=SeqID_27407
  Gene Ontology: Mol. function=actin binding; Cellular component =phragmoplast; Biological process=actin cytoskeleton organization and biogenesis
  Homolog annotation: Hit_ID=Q9SE97; Match level="QueryCoverage=90%, HitCoverage=13%, E-value=1e-52, Identity=72%"; Hit description =Formin-like protein AHF1
MDSEVLNSDVLKLSKGIASIAEVVQLNQTMASDESSQKFTESMNKFIRMAEEEIPKIQAQESVTSTLVKEITEYFHGNLTKEEAHPFRIFLVVRDFLAVLDRVCKEVGMINERTMVSSAHKFPVPVNPMLPQSLPGLHERQQYNNSSDDDSSSSSP

SEQ ID NO: 144186 - protein, 457 aa, Glycine max
  Coding DNA Sequence Number=SeqID_27408
  Gene Ontology: Mol. function=transferase activity, transferring glycosyl groups; Cellular component=cytoplasm; Biological process =metabolic process
  Homolog annotation: Hit_ID=Q9M6E7; Match level="QueryCoverage=96%, HitCoverage=97%, E-value=1e-129, Identity=50%"; Hit description=UDP -glucose:salicylic acid glucosyltransferase
  Pfam annotation: Domain name=UDPGT; Domain location=7-449; Score= -46.4; E_value=2.8e-08; Accession=PF00201.9; Description=UDP -glucoronosyl and UDP-glucosyl transferase
IASMVHCVVLAYPAQGHINPMHNFCKLLQQQGVKVTLVTTLSYSKNLQNIPASIALETISDGFDNRGFAESGNWKAYLERFWQVGPKTLAELLEKLGRSGDPVDCVVYNSFFPWALEVAKRFGIVGAVFLTQNMSVNSIYHHVQQGNLCVPLTKSEISLPLLPKLQHEDMPTFFFPTCVDNSLLLDLVVGQFSNIDKADWILCNSFSEMEKEVTDWTKKIWPKFRTIGPSITSMILNKRLTDDEDDGVTQFKSEECIKWLDDKPKQSVVYVSFGSVVVLNEEQIEEIAYGLSDSESYFLWVLREETKLPKDFAKKSEKGLVIGWCSQLKVLAHEAIGCFVTHCGWNSTLEALSLGVPMVAMPNWSDQCTNAKLIEDVWKMGIRARVDEKKIVRGEVLKYCIMEIMNSEKGKEVKRNIMQWKALAARAVSEEGSSHKNIAEFVNSLFNLKQGIANYPD

SEQ ID NO: 144187 - protein, 329 aa, Glycine max
  Coding DNA Sequence Number=SeqID_27409
  Gene Ontology: Mol. function=transferase activity, transferring glycosyl groups; Cellular component=cytoplasm; Biological process =metabolic process
  Homolog annotation: Hit_ID=Q8S9A2; Match level="QueryCoverage=79%, HitCoverage=94%, E-value=1e-96, Identity=64%"; Hit description =Glucosyltransferase-7
  Pfam annotation: Domain name=Glyco_tran_28_C; Domain location=137 -292; Score=-14.5; E_value=0.01; Accession=PF04101.6; Description =Glycosyltransferase family 28 C-terminal domain
MFVNSIYYHVQQGKLRVPLTKNEISLPLLPKLQLEDMPSFLSSTDGENLVLLDLAVAQFSNVDKADWILCNSFYELEKEVNNWTLKIWPKFRTIGPCITSMVLNKRLTDDNDEDDGVTQFKSEECMKWLDDKPKQSVVYVSFGSIAALNEEQIKEIAYSLRDGENYFLWVVRASEETKLPKDFEKISEKGLVIRWCSQLKVLDHEAIGCFVTHCGWNSTLEALSLGVPVVAMPYWSDQSTNAKQIVDVWKMGIRATVDDEKKIVRREVLKRCIMEIMKSERGKEVKSNMVQWKALAARAVSEEGSSHKNIAEFVNSLFNLQQRIANYPD

SEQ ID NO: 144188 - protein, 172 aa, Glycine max
  Coding DNA Sequence Number=SeqID_27410
MAQSNSSRLGFPTLITALCMARGVTSDSLTFESLSPAINLAYIKKNCWNLDDPTASFPRTRKARARGSEGPSSITPQTSTAPAPIPSAPVPATSGPSAQSTDLMMAMLQSIHQGQYLVAWPRVWPSSHGGGEASAAQEPQPDPETTPAAQEDDSKATPPESFVPETDPEADP

SEQ ID NO: 144189 - protein, 50 aa, Glycine max
  Coding DNA Sequence Number=SeqID_27411
MEVFAGIMATIALLSRYGNMQQAGFVVDLGVDFVDNWVFLADRVVGNEKG

SEQ ID NO: 144190 - protein, 472 aa, Glycine max
  Coding DNA Sequence Number=SeqID_27412
  Gene Ontology: Mol. function=enzyme inhibitor activity; Cellular component=cell wall; Biological process=cell wall modification
  Homolog annotation: Hit_ID=Q1SUX5; Match level="QueryCoverage=93%, HitCoverage=83%, E-value=1e-133, Identity=58%"; Hit description =Pectinesterase; Pectinesterase inhibitor
  Pfam annotation: Domain name=PMEI; Domain location=2-88; Score=-3.8; E_value=0.03; Accession=PF04043.6; Description=Plant invertasepectin methylesterase inhibitor
  Pfam annotation: Domain name=Pectinesterase; Domain location=135-433; Score=705.3; E_value=4.3e-209; Accession=PF01095.10; Description =Pectinesterase
  Pfam module annotation: Pfam domain module=PMEI::Pectinesterase; Domain location=2-88::135-433
MDLNNFKDKRAKSAWEDCLELYEDTLYQLKRSMNSNKLNDRLTWQSASIANHQTCQNGFTEFNLPSHLNYFPSMLSNFSKLLSNSLSISKTMMMTLTTSSTKQSGGRRLLLSDGFPYWLSHSDRRLLQETTPKADVVVAQDGSGNYKTISEGVAAAAKLSGKGRVVVHVKAGVYKDSIDIKRTVKNLMIIGDGMGATIVTGNLNAQDGSTTFRSATFAVSGDGFIARDITFENTAGPQQHQAVALRSGADHSVFYRCSFMGYQDTLYVYANRQFYRDCDIYGTIDFIFGDAVTVLQNCNIYVRKPMSNQQNTVTAQARTDPNENTGIIIHNCRITAAGDLIAVQGSFKTFLGRPWQKYSRTVVMKSALDGLIDPAGWSPWSGNFGLSSLYYAEYANTGAGASTAGRVKWPGFRLISSSEAVKFTVGNFLAGGSWISGSGVPFDAEATQNVVVCFFFPYTVCYFLSTEGPNYG

SEQ ID NO: 144191 - protein, 51 aa, Glycine max
  Coding DNA Sequence Number=SeqID_27413
MACSMVTLRARSWKEEDEASRVDNVLVVSIYIIKLVRKEIDLGYYLRNACE

SEQ ID NO: 144192 - protein, 108 aa, Glycine max
  Coding DNA Sequence Number=SeqID_27414
MKNQVWHNHWPKRVQVVKEDLKALVRKLEIGSPMSKMKKSLEPSRSIKKDMQETVRCLKDWWRAIDVSSIGACRPMIFFINGFLYFLEDEWKWKGEGRERGDTTSRRR

SEQ ID NO: 144193 - protein, 75 aa, Glycine max
  Coding DNA Sequence Number=SeqID_27415
  Gene Ontology: Mol. function=pectinesterase activity; Cellular component=cell wall; Biological process=cell wall modification
  Homolog annotation: Hit_ID=Q1SUX5; Match level="QueryCoverage=93%, HitCoverage=15%, E-value=3e-19, Identity=63%"; Hit description =Pectinesterase; Pectinesterase inhibitor
  Pfam annotation: Domain name=Pectinesterase; Domain location=1-62; Score=-209.5; E_value=9.1e-06; Accession=PF01095.10; Description =Pectinesterase
MEEVGWFPWSGNFALSTLYYAEYGNTGAGAGTGGRVKWEGFRVISSTEAVKFTVGSFLAGGSWIPGSGVPFDAGL

SEQ ID NO: 144194 - protein, 102 aa, Glycine max
  Coding DNA Sequence Number=SeqID_27416
  Gene Ontology: Mol. function=ATP binding; Cellular component =chloroplast; Biological process=response to heat
  Homolog annotation: Hit_ID=Q1SF16; Match level="QueryCoverage=94%, HitCoverage=23%, E-value=5e-27, Identity=62%"; Hit description=Heat shock protein Hsp70
MLWPFKVVAGINDKPMIVVKYKGQEKHLCAEEVSSMCLLISMILSEKLLLLLLHMALTRGLIALERKTFSSLNLVVVLLTIKDKVFQDKATSGNTHLRWRGL

SEQ ID NO: 144195 - protein, 285 aa, Glycine max
  Coding DNA Sequence Number=SeqID_27417
  Gene Ontology: Mol. function=aspartate-tRNA ligase activity; Cellular component=cytoplasm; Biological process=tRNA aminoacylation for protein translation
  Homolog annotation: Hit_ID=O81892; Match level="QueryCoverage=67%, HitCoverage=30%, E-value=3e-74, Identity=70%"; Hit description =Putative aspartate--tRNA ligase
  Pfam annotation: Domain name=tRNA_anti; Domain location=93-178; Score= 86.9; E_value=6.3e-23; Accession=PF01336.15; Description=OB-fold nucleic acid binding domain
  Subcellular localization annotation: CTP_CleavageSite=40; ConfidenceScore=5.79e-01
MSLFLKALPLMAFRTRPSLVFLGRVSNTIPLSLSRTRTVYSASASTQPPPSACASETLTSSAKPPLPLSEPLEWVNRTAFCGELSSNDVGKSVQLCGWVALHRVHGGLTFLNLRDHTGIVQVTTLPNEFPDAHSAINDLRLEYVVAIEGVVRSRPDESINKKMQTGFIEVAANKVQLLNSVNSKLPFLVTTADDAKDSLKEEIRLRYRCLDLRRQQMNFNILLRHKVVKLIRRYLEDVHGFVEIETPILSRSTPEGARDYLVPSRIQLLLLKIMIMKFIQYISNH

SEQ ID NO: 144196 - protein, 409 aa, Glycine max
  Coding DNA Sequence Number=SeqID_27418
  Gene Ontology: Mol. function=aspartate-tRNA ligase activity; Cellular component=cytoplasm; Biological process=tRNA aminoacylation for protein translation
  Homolog annotation: Hit_ID=Q8GWM7; Match level="QueryCoverage=99%, HitCoverage=75%, E-value=0.0, Identity=79%"; Hit description =Putative aspartate--tRNA ligase
  Pfam annotation: Domain name=GAD; Domain location=136-235; Score =87.2; E_value=4.9e-23; Accession=PF02938.5; Description=GAD domain
  Pfam annotation: Domain name=tRNA-synt_2; Domain location=1-385; Score=484.4; E_value=1.4e-142; Accession=PF00152.11; Description =tRNA synthetases class II (D, K and N)
  Pfam module annotation: Pfam domain module=GAD::tRNA-synt_2; Domain location=136-235::1-385
MKPGTFYALPQSPQLFKQMLMVAGFDKYYQIARCFRDEDLRADRQPEFTQLDMEMAFTPYEDMLMLNEELIRKKSEGKENLRVFLEIKGVELPNPFPRLTYAEAMSRYGSDRPDTRFDLELKDVSDIFSGSSFKVFSDSLESGGVIKVLCVPSGTKKYSNSALKKGDIYNEALKSGAKGLPFLKVLDDGNIEGISALVSSMDPTTRGNLLRRCSSGPSDLILFAVGHHASVNKTLDRLRVYVAHDLGLIDLGRHSILWITDFPMFEWNDPEQRLEALHHPFTAPNPEDMNDLASARALAYDMVYNGVEIGGGSLRIYKRDIQQKVLEIVGISMEQAEAKFGYLLEALDMGAPPHGGIAYGLDRLVMLLAGANSIRDVIAFPKTTTAQCALTRSPSEVDPQQLKDLSITT

SEQ ID NO: 144197 - protein, 527 aa, Glycine max
  Coding DNA Sequence Number=SeqID_27419
  Gene Ontology: Mol. function=enzyme inhibitor activity; Cellular component=cell wall; Biological process=cell wall modification
  Homolog annotation: Hit_ID=Q1SUX5; Match level="QueryCoverage=99%, HitCoverage=100%, E-value=1e-159, Identity=58%"; Hit description =Pectinesterase; Pectinesterase inhibitor
  Pfam annotation: Domain name=PMEI; Domain location=16-168; Score =91.4; E_value=2.7e-24; Accession=PF04043.6; Description=Plant invertasepectin methylesterase inhibitor
  Pfam annotation: Domain name=Pectinesterase; Domain location=216-514; Score=709.7; E_value=2e-210; Accession=PF01095.10; Description =Pectinesterase
  Pfam module annotation: Pfam domain module=PMEI::Pectinesterase; Domain location=16-168::216-514
MDKLFFNYCFVGYCLLYSLLLVHGKQLSCNETPYPRVCKHYIETTNTLSALDAPPSYSFHDMALKVTMEQATEAYKLVSNMDLNNFKDKRAKSAWEDCLELYENTLYQLKRSMNSNNLNDRLTWQSASIANHQTCQNGFTDFNLPSHLNYFPSMLSNFSELLSNSLSISKAMTLTSFSSSPSTKQSGGRRLLSDGFPYWLSRSDRRLLQETASKADVVVAQDGSGNYKTISEGVNAASGLSGKGRVVVHVKAGVYKENIDIKRTVKNLMIVGDGMGATIVTGNLNAQDGSTTFRSATFAVDGDGFIARDITFENTAGPQKHQAVAVRSGADQSVFYRCSFKGYQDTLYVYANRQFYRDCDIYGTIDFIFGDAVTVLQNCNIYVRKPMSNQLNTVTAQGRTDPNENTGIIIHNCRITAAGDLKAVQGSFRTFLGRPWQKYSRTVFMKSALDGLISPAGWFPWSGNFALSTLYYAEHANTGAGASTGGRVDWAGFRVISSTEAVKFTVGNFLAGGSWIPGSGVPFDEGL

SEQ ID NO: 144198 - protein, 341 aa, Glycine max
  Coding DNA Sequence Number=SeqID_27420
  Gene Ontology: Mol. function=GTP binding; Cellular component=nucleus; Biological process=SRP-dependent cotranslational protein targeting to membrane
  Homolog annotation: Hit_ID=Q208U9; Match level="QueryCoverage=72%, HitCoverage=73%, E-value=2e-93, Identity=68%"; Hit description=CFM6
  Pfam annotation: Domain name=CRS1_YhbY; Domain location=184-268; Score=116.8; E_value=6.2e-32; Accession=PF01985.11; Description=CRS1 YhbY domain
SLFWLCCLVEHVPTIASCPTTTSYFWSFTPDKCIYQRTYRTPSHLSGVSSLASRSGFLLMQRSNIFGSHDILGSWLPARYISNESVELKTHNDVIRFSLGKSDDINNAKKSQLNKKFKMSRKAKLNELRFYRLKAKKKMNSPNPEVRIRYKLEKAKRKETWLIEKLRKFDVPKPPPETYDPEILTEEERHYLKRTGERKKHYVPVGRRGVFGGVVLNMHLHWKNHETVKVICKPCKPGQVHEYAEELARLSKGIVIDIKPNNTIIFYRGKNYVKPEVMSPPNTLSKAKALEKYRYEQSLEHTSQFIEKLEKELEEYHQHLAKFKKGKEDTAKDVSFGALAY

SEQ ID NO: 144199 - protein, 79 aa, Glycine max
  Coding DNA Sequence Number=SeqID_27421
MVFDEDPNYVKLISLFKSLIEPCTMLRLIRIDEALKVAMAKEENVQKAATDDSLSEASSSLNGWETLEEDKLEICTPST

SEQ ID NO: 144200 - protein, 362 aa, Glycine max
  Coding DNA Sequence Number=SeqID_27422
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q5K6L5; Match level="QueryCoverage=100%, HitCoverage=72%, E-value=1e-175, Identity=81%"; Hit description=Endo- 1,4-beta-glucanase isoform 01
  Pfam annotation: Domain name=Glyco_hydro_9; Domain location=1-362; Score=500.2; E_value=2.3e-147; Accession=PF00759.9; Description =Glycosyl hydrolase family 9
MAFSTTMLSWSVIDFEKSMGTELGNALKAVRWGTDYLLKATAKIGSGVVFVQVGDPYSDHNCWERPEDMDTLRTVFKIDGSHPGSDVAGETAAALAAASIVFRSRDPSYSTMLLNRAVAVFQFADKHRGAYSNSLHRAVCPFYCDVNGYQDELLWAAAWLHKASRRRQYREYIVRNEVVLRAGDTINEFGWDNKHAGINVLISKEVLMGRAEYFASFKQNADGFICSTLPGISHPQVQYSPGGLIFKAGGSNMQHVTSLSFLLLAYSNYLSHANKVVPCGETTATPALLKHLAKRQVDYILGDNPLGMSYMVGYGARYPQRIHHRASSLPSVAAHPAHIGCKAGSRYYFSPNPNPNVLLGAV

SEQ ID NO: 144201 - protein, 366 aa, Glycine max
  Coding DNA Sequence Number=SeqID_27423
  Gene Ontology: Mol. function=protein binding; Cellular component =membrane; Biological process=defense response
  Homolog annotation: Hit_ID=Q1SXP3; Match level="QueryCoverage=93%, HitCoverage=27%, E-value=1e-64, Identity=42%"; Hit description =Disease resistance protein; Peptidase aspartic, active site
  Pfam annotation: Domain name=NACHT; Domain location=193-345; Score= -33.2; E_value=0.022; Accession=PF05729.3; Description=NACHT domain
  Pfam annotation: Domain name=NB-ARC; Domain location=153-366; Score =77.0; E_value=5.8e-20; Accession=PF00931.13; Description=NB-ARC domain
  Pfam module annotation: Pfam domain module=NACHT::NB-ARC; Domain location=193-345::153-366
MPVGEAFLSAFLQVLFDRLASKNVIEVILAGDKSKILKKFQKTLLLLKAVLNDAEDNHLKNEAVRMWLVELKDVAFDAEDVLDRFATEVLKRRLESMSQSQVQTTFAHVWNLFPTSLSSSMESNMKAITERLATLANERHELGLSEVAAGCSYKINETSSMVNESYIHGRDNDKKKIIQFLMENRPSHGDEVLVIPIVGMPGIGKTTLAQVVFNDDEVNTHFELKAWVSVPYDFDVKVVTRKILESVTCVTCDFNNLHQLQVKLRAVLSGKKFLIVLDDVWNKNYNEWIKLVAPFRGAARGSSVIVTTRSAEVANMMGTVESHHVNQLSDKDCWSVFVQHAFRSKTIDANQAFAEIGNVSKVDRCI

SEQ ID NO: 144202 - protein, 1050 aa, Glycine max
  Coding DNA Sequence Number=SeqID_27424
  Gene Ontology: Mol. function=protein binding; Cellular component =membrane; Biological process=defense response
  Homolog annotation: Hit_ID=Q6QT45; Match level="QueryCoverage=70%, HitCoverage=99%, E-value=1e-149, Identity=41%"; Hit description =Resistance protein
  Pfam annotation: Domain name=FNIP; Domain location=729-770; Score =8.4; E_value=0.083; Accession=PF05725.3; Description=FNIP Repeat
  Pfam annotation: Domain name=LRR_1; Domain location=212-233; Score =5.7; E_value=25; Accession=PF00560.23; Description=Leucine Rich Repeat
  Pfam annotation: Domain name=LRR_1; Domain location=235-256; Score =9.1; E_value=5.6; Accession=PF00560.23; Description=Leucine Rich Repeat
  Pfam annotation: Domain name=LRR_1; Domain location=258-280; Score =9.7; E_value=4.3; Accession=PF00560.23; Description=Leucine Rich Repeat
  Pfam annotation: Domain name=LRR_1; Domain location=282-304; Score =11.6; E_value=1.9; Accession=PF00560.23; Description=Leucine Rich Repeat
  Pfam annotation: Domain name=LRR_1; Domain location=36-58; Score=0.7; E_value=2.1e+02; Accession=PF00560.23; Description=Leucine Rich Repeat
  Pfam annotation: Domain name=LRR_1; Domain location=415-436; Score =8.4; E_value=7.6; Accession=PF00560.23; Description=Leucine Rich Repeat
  Pfam annotation: Domain name=LRR_1; Domain location=497-520; Score =7.0; E_value=14; Accession=PF00560.23; Description=Leucine Rich Repeat
  Pfam annotation: Domain name=LRR_1; Domain location=623-642; Score =1.9; E_value=1.3e+02; Accession=PF00560.23; Description=Leucine Rich Repeat
  Pfam annotation: Domain name=LRR_1; Domain location=648-665; Score =2.0; E_value=1.2e+02; Accession=PF00560.23; Description=Leucine Rich Repeat
  Pfam annotation: Domain name=LRR_1; Domain location=671-695; Score =6.8; E_value=15; Accession=PF00560.23; Description=Leucine Rich Repeat
  Pfam annotation: Domain name=LRR_1; Domain location=713-741; Score =7.4; E_value=12; Accession=PF00560.23; Description=Leucine Rich Repeat
  Pfam annotation: Domain name=LRR_1; Domain location=761-783; Score =8.6; E_value=7.1; Accession=PF00560.23; Description=Leucine Rich Repeat
  Pfam annotation: Domain name=LRR_1; Domain location=785-807; Score =10.9; E_value=2.6; Accession=PF00560.23; Description=Leucine Rich Repeat
  Pfam annotation: Domain name=LRR_1; Domain location=809-832; Score =8.9; E_value=6.3; Accession=PF00560.23; Description=Leucine Rich Repeat
  Pfam annotation: Domain name=LRR_1; Domain location=833-855; Score =6.1; E_value=20; Accession=PF00560.23; Description=Leucine Rich Repeat
  Pfam annotation: Domain name=LRR_1; Domain location=857-880; Score =11.1; E_value=2.3; Accession=PF00560.23; Description=Leucine Rich Repeat
  Pfam annotation: Domain name=LRR_1; Domain location=930-953; Score =2.0; E_value=1.2e+02; Accession=PF00560.23; Description=Leucine Rich Repeat
  Pfam annotation: Domain name=LRR_1; Domain location=955-978; Score =8.5; E_value=7.4; Accession=PF00560.23; Description=Leucine Rich Repeat
  Pfam annotation: Domain name=LRR_1; Domain location=980-1003; Score =10.5; E_value=3; Accession=PF00560.23; Description=Leucine Rich Repeat
  Pfam module annotation: Pfam domain module=FNIP::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1; Domain location =729-770::212-233::...
  Pfam module annotation: Domain location=235-256::258-280::282-304::36- 58::415-436::497-520::623-642::648-665::671-695::713-741::761 -783::785-807::809-832::833-855::857-880::930-953::955-978::980-1003
MATTFGGILSSQKDARDWENVMDFEIWDLAEEESNILQTLRLSYNQLPSYLKRCFAYCSILPKGFEFEEKEIVLLWMAEGLLEQKSQKQMEDVGHEYFQELLSASLFQKSSSNRSLYVMHDLINDLAQWVAGESCFKLDNNFQSHKQKKKKISKMTRYASYVGGEYDGIQMFQAFKEAKSLRTFLPLKHRRLEEWSYITNHVPFELLPELRCLRALSLSGYFISKLPNSVSNLNLLRYLNLSSTDLRQLPESICSLCNLQTLLLRDCFNLEELPSNMSDLINLRHLDITRSHSLTRMPHGIGKLTHLQTLSNFVVGSSGIGELMKLSNIRGVLSVSRLEHVTDTREASEAMINKKVGIDVLKLKWTSCMNNQSHTERAKEVLQMLQPHKNLAKLTIKCYGGTSFPKWIGDPSYKSLVFLKLKDCAHCTSLPALGNLHALKELYIIGMKEVCCIDGEFCGNACLRPFPSLERLYFMDMEKWENWFLSDNNEQNDMFSSLQQLFIVKCPKLLGKLPENLPSLKHVIVKECEQLLVTISSLPVLYKLEIEGCKGLVLNCANEFNSLNSMSVSRILEFTFLMERLVQAFKTVEELKIVSCALDETVLNDLWVNEVWLEKNPHGLSSILRLIEIRNCNIMKSIPKVLMVNSHFLERLYICHCDSIVFVTMDQLPHSLKSLEISNCKNLRCLLDNGTCTSSSIIMHDDNVQHGSTIISHLEYVYIGWCPSLTCISRSGELPESVKHLFIWNCSELSCLSMKGQLPKSIERLEIQSCPKLESIANRLHRNTSLESIQIWNCENLKSLPEGLHFLVNLKEIKIIGCPNLVSFPEEGLPASSLSELSIMSCEKLVALPNSMYNLDSLKELEIGYCPSIQYFPEINFPDNLTSLWINDHNACEAMFNWGLYKLSFLRDLTIIGGNLFMPLEKLGTMLPSTLTSLTVQGFPHLENLSSEGFHKLTSLSSLTLRHLSNLTFLPFSGFKYLTSLEELSIYNCPKLLCLPEKGLPSSLLELYIQDCPFLKEQCRKDKGRDWLKIADVPYVEIDGKFIYDSDYED

SEQ ID NO: 144203 - protein, 498 aa, Glycine max
  Coding DNA Sequence Number=SeqID_27425
  Gene Ontology: Mol. function=argininosuccinate synthase activity; Cellular component=chloroplast; Biological process=amino acid biosynthetic process
  Homolog annotation: Hit_ID=Q9SZX3; Match level="QueryCoverage=99%, HitCoverage=99%, E-value=0.0, Identity=75%"; Hit description =Argininosuccinate synthase, chloroplast precursor
  Pfam annotation: Domain name=Arginosuc_synth; Domain location=102 -494; Score=704.5; E_value=7.6e-209; Accession=PF00764.9; Description= Arginosuccinate synthase
  Subcellular localization annotation: CTP_CleavageSite=54; ConfidenceScore=5.13e-01
MTQLKASPASACSSLAIAPSFHHASITTGHLLRHQFSKAKPLSLKELGLKTSVGANKLQGEIVLSQLQQFTGVIKAAARIDTEVVSETTKGGGLRGKLNKVVLAYSGGLDTSVIVPWLRENYGCEVVCFTADVGQGIKELDGLEAKAKASGACQLVVKDLKEEFVREYIFPCLRAGAVYERKYLLGTSMARPVIAKAMVDVAKEVGADAVSHGCTGKGNDQACVRFELTFFALNPKLNVVAPWREWDITGREDAIEYAKKHNIPVPVTKKSIYSRDRNLWHLSHEGDILEDPANEPKKDMYMMSVDAEDAPDEAEYVEIEIESGLPVSVNGKRLSPATLLTELNEIGGRHGIGRIDMVENRLVGMKSRGVYETPGGTILFAAARELEFLTLDRETIQVKDSLALKYAELVYAGRWFDPLRESMDAFMQKITETTTGSVTLKLYKGSVTVTSRKSPFSLYRQDISSFESGQIYDQADAAGFIRLYGLPMRVRAMLEQGI

SEQ ID NO: 144204 - protein, 289 aa, Glycine max
  Coding DNA Sequence Number=SeqID_27426
  Gene Ontology: Mol. function=calcium-dependent phospholipid binding
  Homolog annotation: Hit_ID=Q9ZTM8; Match level="QueryCoverage=84%, HitCoverage=91%, E-value=5e-41, Identity=58%"; Hit description =PGPS/D12
  Pfam annotation: Domain name=PLAC8; Domain location=233-289; Score =9.3; E_value=0.0007; Accession=PF04749.7; Description=PLAC8 family
  Pfam annotation: Domain name=PLAC8; Domain location=46-145; Score =184.7; E_value=2.2e-52; Accession=PF04749.7; Description=PLAC8 family
  Pfam module annotation: Pfam domain module=PLAC8::PLAC8; Domain location=233-289::46-145
  Subcellular localization annotation: CTP_CleavageSite=25; ConfidenceScore=5.40e-01
QQGSDPTKQSPATGFPVSYSNSTTYSTNEASYAPVPPPQPKPLVNWSTGLCDCFSECGNCCMTCWCPCVTFGRVAEIVDKGSTSCGASGALYTLICCVIGCGCLYSCFYRPKMRRQYGLKGNGCSDCLIHCFCEPCALCQEYRELQHRGFDMIIGWHGNVEQRSRGVAMTATTAPSVENGMSPSSDPRKPSAPATGFPVSYSTSTTEAEVYSYSYGPVVVPVPPPHPKPIVEWSTGLCDCFSDWGNSCMTFWCPCVTFGRVAEIVDRGSPCGGVAGAGAGYTLASTAPI

SEQ ID NO: 144205 - protein, 307 aa, Glycine max
  Coding DNA Sequence Number=SeqID_27427
  Gene Ontology: Mol. function=receptor activity; Cellular component =anchored to membrane; Biological process=protein amino acid phosphorylation
  Homolog annotation: Hit_ID=Q9ZU94; Match level="QueryCoverage=94%, HitCoverage=95%, E-value=9e-80, Identity=52%"; Hit description =Expressed protein
  Pfam annotation: Domain name=DUF26; Domain location=183-237; Score =59.9; E_value=8.1e-15; Accession=PF01657.8; Description=Domain of unknown function DUF26
  Pfam annotation: Domain name=DUF26; Domain location=79-133; Score =63.7; E_value=6e-16; Accession=PF01657.8; Description=Domain of unknown function DUF26
  Pfam module annotation: Pfam domain module=DUF26::DUF26; Domain location=183-237::79-133
  Subcellular localization annotation: CTP_CleavageSite=73; ConfidenceScore=5.39e-01
MPNANMLLLFLFLLALFSAMTTPSTSAIDTFIFAGCSQPKFTPGSAYENTVNSLLTSLVNSAAFANYNNFTVPASSDAVYGLFQCRGDLTNDQCSRCVSRAVTQLGTLCFASCGGALQVDGCFVKYDNATFIGVEDKTLVTKKCGPSVGLTSDALTRRDAVLAYLQTSDGVYKTFRTSGYGDFQGVAQCTGDLSPSECQDCLSDAIQRLKTECGPTNWADIYLAKCYARYSEGGTRSRGNNNVFNFACMLLLPTSKREKRVVDDSNHNDDEIEKTLAILIGLIAGVALIIVFLSFLSKVCEKHKGGK

SEQ ID NO: 144206 - protein, 492 aa, Glycine max
  Coding DNA Sequence Number=SeqID_27428
  Gene Ontology: Mol. function=molecular_function; Cellular component =cellular_component; Biological process=biological_process
  Homolog annotation: Hit_ID=Q9ZU93; Match level="QueryCoverage=93%, HitCoverage=94%, E-value=1e-131, Identity=53%"; Hit description =Expressed protein
  Pfam annotation: Domain name=UBX; Domain location=380-467; Score =13.4; E_value=0.0041; Accession=PF00789.11; Description=UBX domain
  Pfam annotation: Domain name=zf-C2H2; Domain location=110-132; Score =18.5; E_value=0.024; Accession=PF00096.16; Description=Zinc finger, C2H2 type
  Pfam module annotation: Pfam domain module=UBX::zf-C2H2; Domain location=380-467::110-132
  Subcellular localization annotation: CTP_CleavageSite=59; ConfidenceScore=5.78e-01
MDDVKGKVKGFMKKVNNPFSSSSSGKFKGQGRVLGSSSSSSPTNSNPTPRPHPNSQKPSSSATPYPKPSPQKTDPYRTTEKPRKDDGFDPFDSLVTNSNRSQNGYSLDVFECPICKQPFRSEEEVSAHVDGCLNNPVERGGDDGNGASESDGGSNTNSDSEFEVCVETYSSGKPSEGSVDVVLKLLRNIGREPANVKFRRIRMNNPKIKEAVGDVAGGVELLSFVGFELREENGETWAVMEVPTEEQIKIIKKAIVLLESQLVQQGPPKRDDSPSATSAEMGPKAEPKLVDRQVLLGGDLGFCGQLDIVKIGDMFGQNTSVKVFFAVPERVAAKIELPDSFYSLSAEEVNREAELRRKKIADSQLLIPKSLREKQAKASRKRYTKAIIRIQFPDGVVLQGVFAPWEPTAAIYKFVCSALKEPGLEFELMHPVLIQRRVIPHFPKAGENAKTIEEEDLVPSALIKFKPLETDSVVFTGLRNELLEISEPLVNG

SEQ ID NO: 144207 - protein, 554 aa, Glycine max
  Coding DNA Sequence Number=SeqID_27429
  Homolog annotation: Hit_ID=Q76B43; Match level="QueryCoverage=66%, HitCoverage=96%, E-value=2e-50, Identity=38%"; Hit description =Hypothetical protein PPS3
  Pfam annotation: Domain name=Zim; Domain location=191-226; Score =65.7; E_value=1.5e-16; Accession=PF06200.4; Description=ZIM motif
MERDFMGLNLKEPLAVVKEEMNNDGCKNSGMFQLLCFKKGRIAQWPFSNKVSALPHLMSFKASQDDKTKNTVSDTLSSSGFMSILSQEAFDTSQKRSAGEPQKSFNHDGQGDLHFSLTSYPVQHDVNHPHDVKMFSVPNQAISVSLGNPFLKNHFAAAGQKPLLGGIPVTTSHSVLPSAVAVAGMTESCNSVKPSAQLTIFYAGTVNIFDDISAEKAQAIMLLAGNSLSAASNMAQPNVQVPISKLGAGAGVPVSQPANTSPGSGLSSPLSVSSHTGVQSGSGLTSTDEFLAAKTTGVPNTPICNVEPPKVVSATTMLTSAVPQARKASLARFLEKRKERVMSAAPYNLNKKSEECATAEYAVRSISANLPNQFHQSHLLRSLSTWKFTDNATGNRQFNNSESPEESEQFGGNRGKYAQLDSIFEKFNQQGMARQRPGSVNGASSERMHDLEETYDTLTDGMDGKLMNAATYFEFDEDEIEKEDYAFRYDANFPLGSKYDVKGIKCFMSRLMFDAVINYTHVGWEGNTYYTKSCAQYSENREFSDLTKMVHSQQ

SEQ ID NO: 144208 - protein, 77 aa, Glycine max
  Coding DNA Sequence Number=SeqID_27430
MGEAKVSIEYWKLALGPNSTEQNQLVRITKPLPLRLQLRQPPEKPQLRLATRTKIKVAFQYKGKKGYPSHSCRKQTE

SEQ ID NO: 144209 - protein, 202 aa, Glycine max
  Coding DNA Sequence Number=SeqID_27431
  Gene Ontology: Mol. function=small conjugating protein ligase activity; Cellular component=nucleus; Biological process=protein modification process
  Homolog annotation: Hit_ID=Q45W76; Match level="QueryCoverage=77%, HitCoverage=86%, E-value=1e-64, Identity=78%"; Hit description =Ubiquitin-conjugating enzyme 2
  Pfam annotation: Domain name=UQ_con; Domain location=26-191; Score= -24.4; E_value=0.002; Accession=PF00179.16; Description=Ubiquitin -conjugating enzyme
MRAHKFASCRDEAGEECAVRVPRNFRLLEELERGEKGIGDGTVSYGMDDADDIYMQSWTGTIIGPPGQTLVFVYLILELIIVQSEWETVHEGRIYQLKLFCGKDYPDNPPTVRFQTRINMTCVNQETGVVEPHLFPMLANWQRECTMEDILMQLKKEMISPQNRKLAQPPEVVECMCSLQKELDLAAAFCFVEATRSGVEEV

SEQ ID NO: 144210 - protein, 73 aa, Glycine max
  Coding DNA Sequence Number=SeqID_27432
MRELKLFNLTPNPLRSQAKPLGFKNKETVRIMLFCESAPTMWDRHKLKGALKPDIYPESLNSEESVKEKNEGK

SEQ ID NO: 144211 - protein, 442 aa, Glycine max
  Coding DNA Sequence Number=SeqID_27433
  Homolog annotation: Hit_ID=P93422; Match level="QueryCoverage=24%, HitCoverage=15%, E-value=1e-09, Identity=35%"; Hit description =Histidyl-tRNA synthetase
  Pfam annotation: Domain name=PAL; Domain location=5-370; Score= -262.2; E_value=0.0034; Accession=PF00221.9; Description =Phenylalanine and histidine ammonia-lyase
  Subcellular localization annotation: CTP_CleavageSite=44; ConfidenceScore=5.32e-01
MAEASVTVGGKASSLSSSSVFAVATGLAHVRIDSSALDRLSKTTATETTSSQHRICVPDFLTLEESRAFLLVLLNNLVLSNAPSRIPLLLSQTLNSNPPTFQFLDADVTQPDLLTSSTLLAVSAILDRQSAALSAFADVAAAFSCEALKADITPFNLMDSGDGHASKAEVAVAADMRVLLNGSKSVGKENIRSVARVPKVHGSVREQAKAVHSRMRVELNSGVKGVVVGSEEAVCTVLLPLAAALKELGECSFARAKSNSEVIGGDGLRLGIGEVFGKECPTQDGLSSGLNKAVNLFLGKEYGKFAHEVFVMFGLVWKVVVWEAVTAVAVLEAAELNDVILGVKEMKVEGNTKVEEKKKKKKVVLGKGTSSILALIKERLLSGREIALGTWVADFLSLLDLAKPEFNEFLLKVKDVVESNESRRLPKIPKVCYSLLKFSTLL

SEQ ID NO: 144212 - protein, 167 aa, Glycine max
  Coding DNA Sequence Number=SeqID_27434
  Gene Ontology: Mol. function=transcription regulator activity; Cellular component=nucleus; Biological process=regulation of transcription
  Homolog annotation: Hit_ID=Q5FAM4; Match level="QueryCoverage=53%, HitCoverage=34%, E-value=3e-11, Identity=46%"; Hit description =Putative bZIPtranscription factor protein
MLEDQLRGKGWVANMYHLDYVSKFYGYNYHILAYYCVNDADIDNMEMQNLMMPFSCESFLGSPEAEFAGNLEENFPDHNEVPVLVPIINSVKNEIHEGQKRKATDIWEPSSANSTPAVFESGSKTKNSCGRGKRVKRNMIEDKKPNEVVHVRAKRGQATDSHSLAER

SEQ ID NO: 144213 - protein, 383 aa, Glycine max
  Coding DNA Sequence Number=SeqID_27435
  Gene Ontology: Mol. function=protein binding; Cellular component =nucleus
  Homolog annotation: Hit_ID=Q69JZ7; Match level="QueryCoverage=99%, HitCoverage=100%, E-value=1e-127, Identity=65%"; Hit description =Putative XAP-5 protein
  Pfam annotation: Domain name=XAP5; Domain location=109-381; Score =500.4; E_value=2.1e-147; Accession=PF04921.5; Description=XAP5 protein
MSGMGDGYVGTAQDAVRIRRLEKQREAERRKIQELKTKSTSAKGQPGLLQFGSSTSEILETAFKKETVGLVTREQYVEKRVNIQSKIEEEEKEKLQKQQQEEEELQLEKRKKRKIRGNSRLSFAEDVDNDPQDDEPHHSKGNACCFKLEFFFIYQCSGHVAKLKIQKKALNFAILLADNLEANRLRCGKLGKDPTVETSFLPDSEREAEEQAERERLRKQWLREQEQIRNEPLEITYSYWDGTGHRRVIQASKDLKLQVRKGDSIGEFLRAVQQQLAPEFREIRTTTVENLLYVKEDLIIPHQHSFYELIVNKARGKSGPLFHFDVHEDVRTIADATIEKDESHAGKVVERHWYEKNKHIFPASRWEIYDPAKKWERYTIHGD

SEQ ID NO: 144214 - protein, 85 aa, Glycine max
  Coding DNA Sequence Number=SeqID_27436
  Gene Ontology: Mol. function=transcription regulator activity; Cellular component=nucleus; Biological process=regulation of transcription
  Homolog annotation: Hit_ID=Q8GWK7; Match level="QueryCoverage=95%, HitCoverage=29%, E-value=1e-18, Identity=62%"; Hit description =Putative bHLH transcription factor bHLH050
MDLQTMGMAIMLDEIINYVQSLQHQVEFLSMKLNAASTYYDFNSESDVLETMQRARASEVKELDRYVREECEGVSCFEPTWSWPL

SEQ ID NO: 144215 - protein, 443 aa, Glycine max
  Coding DNA Sequence Number=SeqID_27437
  Gene Ontology: Mol. function=receptor activity; Cellular component =integral to membrane; Biological process=red or far red light signaling pathway
  Homolog annotation: Hit_ID=Q8S403; Match level="QueryCoverage=95%, HitCoverage=54%, E-value=0.0, Identity=71%"; Hit description =Putative phosphate transporter 1
  Pfam annotation: Domain name=EXS; Domain location=241-409; Score =219.0; E_value=1.1e-62; Accession=PF03124.5; Description=EXS family
MDEVESIFTKHFANNDRKKAMKFLRPQQHKDSHMVTFLFGLSTGCFVSLFCVYAILAHLCGIFSSSNEPAYMETVYPVFSVFTLLSLHLFMYGCNLFMWKNTRINYNFIFEFSPSTALKHRDAFLISTTLMTTVIGAMVIHLLLRAANFSPTEIDAIPGILLLFFIALLICPFDIFYRPTRYCFIRVICNIVCSPFYKVLLVDFFMADQLTSQIPLLRHLETAGCHIFARAFKTHHPDTCHSGRVYMEITYIISFLPYYWRALQCARRWFDDGDVNHLANMGKYVSAMVAAGARVTYSRQNDHLWFAIVLITSVVATMYQLYWDFIKDWGFLNPKSINPWLRDDLILKNKSIYYMSIVLNIVLRVTWVETIMHFKVGRAQSRLLEFLLAALEVIRRGHWNFYRLENEHLNNVGHYRAVKTVPLPFREMSYGHANQNRGMECKE

SEQ ID NO: 144216 - protein, 166 aa, Glycine max
  Coding DNA Sequence Number=SeqID_27438
MELAWDGAKFGLPNASNGFFITHADVTEIILGDKCLNISVLQLWMMFMNDWSTSIGFSPVYGFLEPQSIRCTKDTCEECQKAHWQLLVLCPRENIIVWFCSVRRKPDVHIKFAVNNAMKKICSNLQGKDNAPPPPPQWIEAKYFSDGTTLDTDTMTTYARNGQPIF

SEQ ID NO: 144217 - protein, 182 aa, Glycine max
  Coding DNA Sequence Number=SeqID_27439
  Subcellular localization annotation: CTP_CleavageSite=22; ConfidenceScore=5.03e-01
MEFMHKTPVPPWSLIVTVFGVSSTNSASRPSRDGLSTGRDKYPDFQGDISCRHWARLVTPMAKFDPEIVIEFYANAWPTEEGVRDMRSRDRISPGPLQGGSNVLPSDHNSDLPLPKCQLVHAILTQMSVHMAQVIADAIYLFAGMAPTRHPLDLEKSNRALGLPALITGLCQSYGVPITPSK

SEQ ID NO: 144218 - protein, 125 aa, Glycine max
  Coding DNA Sequence Number=SeqID_27440
PSLTYTSKRHFASVSFPLNKAKRVCALSPEFDKFKEELERRHWDEKLTDFSDSSIDIAIMKEFYTNLYDPEDKSPKQVRVRGGEFVYIFQISLSRPDPQELAAKLCIPRRGFELNADGKSLKTLR

SEQ ID NO: 144219 - protein, 64 aa, Glycine max
  Coding DNA Sequence Number=SeqID_27441
SMDDSSTIEETKVNSEYEEVWEAFNETHEEAQRLAVSINNLRSNLKLHITKLTSTQNELDKPRQ

SEQ ID NO: 144220 - protein, 244 aa, Glycine max
  Coding DNA Sequence Number=SeqID_27442
  Homolog annotation: Hit_ID=Q47522; Match level="QueryCoverage=15%, HitCoverage=45%, E-value=6e-14, Identity=97%"; Hit description=LacZ protein
VPPVQLLTGWCVTAKAPPDISAGKCSGRVPFAIQAAQLLGRAIGAGLFAITPAGERGMCCKAIKLGIRSAVVDNQKMTTINVARISTEAPNGLSVAKSGNGWLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 144221 - protein, 66 aa, Glycine max
  Coding DNA Sequence Number=SeqID_27443
  Homolog annotation: Hit_ID=Q2PMM5; Match level="QueryCoverage=46%, HitCoverage=1%, E-value=3e-09, Identity=96%"; Hit description =Protein ycf2
MDTNFWLLLSIGNRSEKVSKNMKFRYLYPVELGVLSSVVVDSAASPRFVMTNPDLRGRVTSLTLSD

SEQ ID NO: 144222 - protein, 77 aa, Glycine max
  Coding DNA Sequence Number=SeqID_27444
MGFSNSLFPEGNSLPWPPIFNCEGYLMEAPLELGGLGSSSSMDFFASWKKNGSEMEKEEREETPLQGEKESRKSSPP

SEQ ID NO: 144223 - protein, 78 aa, Glycine max
  Coding DNA Sequence Number=SeqID_27445
MFLLINVLKGVNDSQESKSKVAARWIVVKCNKQKGSTTCGYYVVHLMSTIVLGGFKDNSEMKINVNVQTFNIGSFNIG

SEQ ID NO: 144224 - protein, 56 aa, Glycine max
  Coding DNA Sequence Number=SeqID_27446
MEREDLYEFIDTAAQIAGLESEEDITEKWREWSYTSIKLIDTVDLEGGPGTSFCSL

SEQ ID NO: 144225 - protein, 172 aa, Glycine max
  Coding DNA Sequence Number=SeqID_27447
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=79%, HitCoverage=25%, E-value=5e-71, Identity=95%"; Hit description=NADH -plastoquinone oxidoreductase subunit 2
  Pfam annotation: Domain name=Oxidored_q1; Domain location=23-172; Score=-43.3; E_value=4.5e-05; Accession=PF00361.10; Description=NADH- Ubiquinoneplastoquinone (comple
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRVRNNESLYDKQIHFASSLLRVVPTKDRTNDVYNT

SEQ ID NO: 144226 - protein, 232 aa, Glycine max
  Coding DNA Sequence Number=SeqID_27448
MSPVCATYSEWHVCKNMFPKTRLENSLVNPPKGSQNLRSALSESHQFTPPCLQYFPLCKRHVCKSKQVRHQYMPSSASAMYAKTQHLHAHKTRQTQASGLLIFTSLQNPRPILGIHAYKKPKVCAWYSYLQNPRFALGTYSYKTQGTPLVRSHAATMTTIDKGPSSTKRTATPSLGKTFHQVEAHTHSSQSSEEYFCMSNQTSVSKIALFIKSNKHPSSFWHSGKSFVAFTL

SEQ ID NO: 144227 - protein, 254 aa, Glycine max
  Coding DNA Sequence Number=SeqID_27449
MPLRGRIASQWIPFDEDAINQFLGHPFFLDEGQRCEFSQRRSQASGLDEEAISQQLCVLGQDFARSVIRRRVWIMRSSMTTLTQIWITLFVSNILPIYHNSDLPLPKFQLVYAILTQVSVHMAQLISDVIYQFVGITPPKHPVDPEKSNRALGFLALITSLCPFYRVSHVTDQQAANHRGQVQLNESFYRYTLHQQSQDPSPFPWTTPEEFGATIAWPGDRPDFQEGAGLAGTPGDEDGAQKDDDMADVMDYFL

SEQ ID NO: 144228 - protein, 139 aa, Glycine max
  Coding DNA Sequence Number=SeqID_27450
  Homolog annotation: Hit_ID=Q1T2D5; Match level="QueryCoverage=82%, HitCoverage=7%, E-value=2e-33, Identity=54%"; Hit description=Chromo
MVDNTRMKELTGDVKRILEMMENRNKEYAARNVKIDFPILDGSDVLQWIFKADQFFNYHKTPGEQRLIIASIHLDKEVVPCYQMMTRENSFKTWIAFTRALETEFGPSPYECPRSQLFKLAQIGSVQSYYVQFTALANR

SEQ ID NO: 144229 - protein, 122 aa, Glycine max
  Coding DNA Sequence Number=SeqID_27451
MANSWYNANKANKKTEHHNIMLIKRGNVKQPNLIDYFKLGTFNSSFLSSSTGQLLKWREWKWDWKNKILIRRWFREKKISGCMDVKEKMTFCFLECGGHCHFKLTECTKGEAMCHFTSTSNY

SEQ ID NO: 144230 - protein, 152 aa, Glycine max
  Coding DNA Sequence Number=SeqID_27452
  Gene Ontology: Mol. function=DNA-3-methyladenine glycosylase I activity; Cellular component=cytoplasm; Biological process=base -excision repair
  Homolog annotation: Hit_ID=Q6ZBQ9; Match level="QueryCoverage=89%, HitCoverage=43%, E-value=2e-48, Identity=58%"; Hit description =Putative 3-methyladenine-DNA glycosylase
  Pfam annotation: Domain name=Adenine_glyco; Domain location=12-151; Score=116.5; E_value=7.4e-32; Accession=PF03352.4; Description =Methyladenine glycosylase
MLDNTGPTMYPFQNDKAYIEFHDECWGVPAYDDNKLFELLALSGLLMDYNWTEILKRKETLREVFAGFDANTVAKMEEKEIMETASNKALSLADSRVMCVIVKECGSFSSYIWGYVNHKPIINRYRYPRNVPLRSPKAEALSKDLVKRGFSA

SEQ ID NO: 144231 - protein, 76 aa, Glycine max
  Coding DNA Sequence Number=SeqID_27453
CTTGLSTLGGLVDNDHRREALRVRFTADVEADASEVGGGRGAEGDEGGGRGGGGGGVKAEKKEGNEQQFEGCTFRN

SEQ ID NO: 144232 - protein, 128 aa, Glycine max
  Coding DNA Sequence Number=SeqID_27454
MDFYSSWNLGNKFVNFRGHFRNLTKWEWNWRILNPKLNFLHPITLRNIYGLPQLDFYINVNVVLKVGDWQFQMRKCLILAIGNYMRIDMHYEEWKENENSPNYSKEPGGMMSVDNLTKGLILVSARDL

SEQ ID NO: 144233 - protein, 189 aa, Glycine max
  Coding DNA Sequence Number=SeqID_27455
  Subcellular localization annotation: CTP_CleavageSite=34; ConfidenceScore=5.28e-01
MANRTFSLFIPYTNICFLRTPTWRFLDSTITTLSTSMISTTTCTFALTRQTIHPLLRHAVIDVYIDLIHSYMNLRRIREVNDGSNDVNKDVVSIEAKFHDESKVIQRCFDDNNDDDKGDDKKLKDQSKNNSNESRTIQEFKIRIKKNSRTQEESLKTRIKIQGSRSQESRSRFKTQDSRIKRRLNQDKY

SEQ ID NO: 144234 - protein, 81 aa, Glycine max
  Coding DNA Sequence Number=SeqID_27456
  Subcellular localization annotation: CTP_CleavageSite=58; ConfidenceScore=5.20e-01
MNHYPFEGHQSDTSASKHSFGGVAKTYPNFSWPTMTASQQHDAPIATPNAPLGTTVPRAITDMDGLLGVDLRHQFSSEADQ

SEQ ID NO: 144235 - protein, 204 aa, Glycine max
  Coding DNA Sequence Number=SeqID_27457
  Gene Ontology: Mol. function=transcription factor activity; Cellular component=nucleus; Biological process=regulation of transcription, DNA-dependent
  Homolog annotation: Hit_ID=Q9SJR0; Match level="QueryCoverage=76%, HitCoverage=87%, E-value=1e-21, Identity=40%"; Hit description =Putative AP2 domain transcription factor
  Pfam annotation: Domain name=AP2; Domain location=38-102; Score =134.1; E_value=3.8e-37; Accession=PF00847.10; Description=AP2 domain
  Subcellular localization annotation: CTP_CleavageSite=73; ConfidenceScore=5.40e-01
MASLNHLRISLSTQLFIHIDTMYSGNASSSSSRGSSGSGKYRGVRRRTSGKWVSEIREPKKPNRIWLGTFPTPEMAAVAYDVAALALKGKDAGLNFPDSASSLPVPASLSARDIQVAAAAAAAAAGAANDAMRTQTANNNFSEAQENQTGMSNQFVDEDLIFDMPNVLVNMAQGMLLSPPPFDIGLEPNSPENTEQETNLWNFP

SEQ ID NO: 144236 - protein, 129 aa, Glycine max
  Coding DNA Sequence Number=SeqID_27458
MTRRRETVEAESYLYPQMVECGHGMYYTPPTFSQFSTQMYQYPFEGHQSDTSTSEHSVGGVAKTYPNFSWSTMTPSQQHDAPIPTLNAPLGTQWNVLIYVTNFLLRPDQVEAGAHWGRRNPDRQARRWE

SEQ ID NO: 144237 - protein, 185 aa, Glycine max
  Coding DNA Sequence Number=SeqID_27459
  Gene Ontology: Mol. function=DNA binding; Cellular component=nucleus; Biological process=regulation of transcription
  Homolog annotation: Hit_ID=UPI00000529F6; Match level="QueryCoverage =87%, HitCoverage=13%, E-value=3e-22, Identity=35%"; Hit description =transcription factor
  Pfam annotation: Domain name=JmjN; Domain location=1-39; Score=39.1; E_value=1.5e-08; Accession=PF02375.7; Description=jmjN domain
MKEFKYPLKYIASICSRAEPYGIFHIVPPTCWKPPCSLEKKNILEKSEFVAQIQRIDGHQVQHAQETMASAHGNTKTKRKRDVKVALDSQLGNRNTSIPNNQNVEKCDCKSEPGPKFSLKAFKKYDDIFKSQYFSYKDNKKIVGSNIKLAIRQLWEPSGENIEAASKSKNNLYQMLYIIIHPVVM

SEQ ID NO: 144238 - protein, 202 aa, Glycine max
  Coding DNA Sequence Number=SeqID_27460
MTEGCGEGFCLANLPGDAFSLWGNFFEAKKQMMADAKFAGLLGLGKPLVEILPPGQLRGFCPLLAWLGSAVLGYGPVLSFGLVGPLLPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERNGLRTGRRFPGRCQEDT

SEQ ID NO: 144239 - protein, 208 aa, Glycine max
  Coding DNA Sequence Number=SeqID_27461
  Gene Ontology: Mol. function=protein binding; Cellular component =integral to membrane; Biological process=xylan catabolic process
  Homolog annotation: Hit_ID=Q6JN46; Match level="QueryCoverage=96%, HitCoverage=30%, E-value=2e-41, Identity=42%"; Hit description=EIX receptor 2
  Pfam annotation: Domain name=LRR_1; Domain location=20-42; Score =10.7; E_value=2.9; Accession=PF00560.23; Description=Leucine Rich Repeat
  Pfam annotation: Domain name=LRR_1; Domain location=44-66; Score =14.4; E_value=0.43; Accession=PF00560.23; Description=Leucine Rich Repeat
  Pfam annotation: Domain name=LRR_1; Domain location=68-90; Score =14.3; E_value=0.45; Accession=PF00560.23; Description=Leucine Rich Repeat
  Pfam annotation: Domain name=LRR_1; Domain location=92-113; Score =11.6; E_value=1.9; Accession=PF00560.23; Description=Leucine Rich Repeat
  Pfam module annotation: Pfam domain module=LRR_1::LRR_1::LRR_1::LRR _1; Domain location=20-42::44-66::68-90::92-113
ETLVLVPKGDELEYRDNLILVRMIDLSSNKLSGAIPSEISKLSALRFLNLSRNHLSGGIPNDMGKMKLLESLDLSLNNISGQIPQSLSDLSFLSVLNLSYNNLSGRIPTSTQLQSFEELSYTGNPELCGPPVTKNCTDKEELTESASVGHGDGNFFGTSEFYIGMGVGFAAGFWGFCSVVFFNRTWRRAYFHYLDHLRDLIYVIIVLK

SEQ ID NO: 144240 - protein, 710 aa, Glycine max
  Coding DNA Sequence Number=SeqID_27462
  Homolog annotation: Hit_ID=Q2NWY9; Match level="QueryCoverage=43%, HitCoverage=99%, E-value=1e-143, Identity=83%"; Hit description =Dipeptide ABC transporter permease component
  Pfam annotation: Domain name=BPD_transp_1; Domain location=233-709; Score=16.4; E_value=0.0011; Accession=PF00528.12; Description =Binding-protein-dependent transport s
KIVTYEWGEYLKRAKAGEHQTVMMGWTGDNGDPDNFFATLFSCAAAKDGSNYSRWCYKPFEDLIQPARAESNHDKRIELYKQAQVVMHDQAPALIVAHSTVYEPVRKEVKGYVVDPLGAQQVCAPADQSPAYGRRIVQRHFILRRLGLVIPTFIGITLLTFAFVHMIPGDPVTIMAGERGISAERHAQLMAEMGLDKPLYQQYFSYVSNVLQGDLGTSLKSRISVWSEFVPRFQATLELGICAMIFAVLVGIPVGVLAAVKRGSVFDHTAVGISLTGYSMPIFWWGMMLIMLVSVQLNLTPPAADRLHADRHPDLGRAGRLRRRGDAHDPAGHRAGHHPAGGDRAHDPFLDAGGVGRRLHPHRARQGREPHAGDRRSRAAQRAAAGGDGDRAAGRHHAGRRHSDRNHLLLAGAGPLADRRAAAPRLPGGAGRGVAGRLRALRRGQPAYSPQEIRGALMSQITESAVKGAPKPMTPGRGRPGVYRSDAGDRARRRRAGAACAGGPVPRRAAQAAGVARGRQLAIYPRHRRRGPRRAVAPDVRCAPVAAGRLPGGGAVADHGRDIRPAGRLLRRRGGRDYHARRRHHAGPAEPAAGAGAGGGIRAVDRQRLAGADLRRPAALCASDARSGAGGGEPRLLTASRVAGAGALRLMFVNILPNCLAPLIVQASLGFSNAFWTWPLSVSGHGRAAAYAGVVHHALQRAAVRAKRLV

SEQ ID NO: 144241 - protein, 430 aa, Glycine max
  Coding DNA Sequence Number=SeqID_27463
  Gene Ontology: Mol. function=DNA binding; Cellular component=nucleus; Biological process=regulation of transcription
  Homolog annotation: Hit_ID=Q6Q6T0; Match level="QueryCoverage=98%, HitCoverage=73%, E-value=5e-72, Identity=38%"; Hit description =Trihelix transcription factor
MCEEHGYQRSGKKCREKFENLYKYYKKTKEGKAGRHDGKHYRFFRQLEALYGENSNTVSVPETNVVVGSIHFQGPSQTNQDNNKFQSHNNNNNRHCDSLSLTNSTNFDTSTSEGHDGNDHSMENESMEKRIKRKSGRSWKVKIKDFIDSQMRKLVEKQKEWLDKLVKTLEEKEKERMLREEEWRKQEANRLEREQKFWAKERAWIEARDAALMEALHKLTGREIMKVETDPEGTINVMTAAEVQNQNNEDESEILNSSNVIRGADSWQESEITRLEQLRAEMETRFPYSEISEEVSWDVVATKMADFGYERSALMCKEKWESINKEEKNSKNRKENLSRNCFYFKNNHEDQQQSSLYDQGSAYCDDDVNEQGKEIERLQTNNGSSSPSKSNIVGNVVPSDSCFPFLMGADQGGNLWENYGLKLNKENQNH

SEQ ID NO: 144242 - protein, 462 aa, Glycine max
  Coding DNA Sequence Number=SeqID_27464
  Gene Ontology: Mol. function=transferase activity, transferring glycosyl groups; Cellular component=integral to membrane; Biological process=cellulose biosynthetic process
  Homolog annotation: Hit_ID=UPI00005F903C; Match level="QueryCoverage =54%, HitCoverage=33%, E-value=1e-111, Identity=76%"; Hit description= COG1215: Glycosyltransferases, probably involved in cell wall biogenesis
  Pfam annotation: Domain name=PilZ; Domain location=80-177; Score =74.0; E_value=4.8e-19; Accession=PF07238.4; Description=PilZ domain
GKFNVTAKGGLVEEEHVDWVITRPYMFLVILNLAGLAFGVWRLAYGPTDEVMTVIISLVWVLYNMTILGGAVAVAVEAKQVRQAHRVEIAMPAAIARADGHLYPCTLRDYSDGGVGIEMRVENALKDGDRLSLLLKRGQQEYSFPCVVTRAFGNKVGVRLVDLSTREHIDFIQCTFARADTWALWQDGFPEDRPIESLRDVLALGFRGYVRMADYAPPLVRGLLVGVTSLTAWVVSFIPRGVGRDPTLGQQETVGISTLSQAETATAPTVAAQPPIAAAADTAIAPPPAAAPQDPNAPVRDVSLPFAQIAPPPGTFVLRGTRPDGQIEFGVRSDEVVSQAMLDMEFTPSPALIPVESHVKVYLNDELMGVTTIAKEQLGKPNRIQMAIDPRYITDFNRVRLVFVGHYQNICENPASTSLWLDVSKSSALKLRFQTLPVKNELSHFHEPLLDSRDNRPLTLPM

SEQ ID NO: 144243 - protein, 42 aa, Glycine max
  Coding DNA Sequence Number=SeqID_27465
MVSNTVLISKNYDHVFETWVSGHAHMGSGFNSSTSHLPTPPF

SEQ ID NO: 144244 - protein, 97 aa, Glycine max
  Coding DNA Sequence Number=SeqID_27466
MAMVRENCGDSTGRKEREAEKILSAMIVTTTTTAVITIMVVATTTTKIMMVMMMNMLVVVEVTMIIVMMVVTVDDDCGCSHDSCDKDSHSSGGHGRW

SEQ ID NO: 144245 - protein, 49 aa, Glycine max
  Coding DNA Sequence Number=SeqID_27467
MDFWKLFIVALLPVLKVLLITAVGTILAINRLNILGETARKNLNTLQVY

SEQ ID NO: 144246 - protein, 89 aa, Glycine max
  Coding DNA Sequence Number=SeqID_27468
  Gene Ontology: Mol. function=isomerase activity; Biological process =protein folding
  Homolog annotation: Hit_ID=Q1EPD1; Match level="QueryCoverage=78%, HitCoverage=35%, E-value=2e-18, Identity=87%"; Hit description =Peptidylprolyl isomerase, FKBP-type family protein
MAGWQLNKDGALTQPMTTKITMVIPIRLSLSLALARRVESYQNQCLGGIRRVIIPPSLGYQNTSQEPIPPNEYLNSPHLSPSRLPSPLD

SEQ ID NO: 144247 - protein, 252 aa, Glycine max
  Coding DNA Sequence Number=SeqID_27469
  Gene Ontology: Mol. function=structural constituent of ribosome; Cellular component=ribonucleoprotein complex; Biological process =translation
  Homolog annotation: Hit_ID=Q9FUL4; Match level="QueryCoverage=56%, HitCoverage=76%, E-value=1e-48, Identity=70%"; Hit description=60S ribosomal protein L24
  Pfam annotation: Domain name=Ribosomal_L24e; Domain location=94-162; Score=165.8; E_value=1.1e-46; Accession=PF01246.10; Description =Ribosomal protein L24e
MEGSVSIKRRNTWSPSEGTSPEPSRSSKALTPPELGISKNFDTGNFEEGKGEEEEGAGGGSEKMNAEKVVEMRERDKGLLVVEDDDAEQVANITELCRFSGAKIYPGKGIRFVRGDSQVFLFANSKCKRYFHNRLKPSKLTWTAMYRKQHKKDIAQEAVKKRRRAAKKPYSRSIVGATLEVIQKKRAEKPEVRDANREAALREIKERNKKTKDEKKAKKAEFAKSQKSQGKGNVSKGAMPKGPKLGGGGGKR

SEQ ID NO: 144248 - protein, 185 aa, Glycine max
  Coding DNA Sequence Number=SeqID_27470
MIMVETRGLDQALDRVIGRALGRDHVEHADDKVHEQPEEAVVDDVVPDAKGFLGGSHDTSVLMDYVYHLAPTERPELKLSSHGKKVEKFGRPALEIEGLVTGKRLIPLITCLLDTGDQGLMSAFVESFEPLHVGDVIFLLVKLLEVSSKEARAETSGSYAWGAAELVHMYENLNDALKSIARQLA

SEQ ID NO: 144249 - protein, 108 aa, Glycine max
  Coding DNA Sequence Number=SeqID_27471
MKLPTTFADPESLSYLYTLLQSSFDQMNDPTNNNNNNTSTTGRKRRRKNEDDDDDGGGDGDDGSSNNNNNKRSKKKKEELKGILTSILLLDEQEKLDQQQNNRVSEEE

SEQ ID NO: 144250 - protein, 266 aa, Glycine max
  Coding DNA Sequence Number=SeqID_27472
MKLLGDKKLKTKSKWLTNLYVAPVEETIVEQPETMKVNPPHPDVNLIKVEQENVVFDNAQSIEPNVTVPSTKDNKSPISKAKGEKESSQNDRSAKPFEESNMFELDDEDYTILHRWKSYETQTKVASEPNANQPNNVYEYQENIMPKSNKETLNAFNSIFSNGHASYRKFLVSKVETRRKMKEASSMKASYTKLKDSISALDKEEKDIEIQISILQTRMDDEREKKRKEVDKRNALIEKRRSQRPLEVLYLPPESSTKNEKDLGKR

SEQ ID NO: 144251 - protein, 126 aa, Glycine max
  Coding DNA Sequence Number=SeqID_27473
  Homolog annotation: Hit_ID=Q1SMF0; Match level="QueryCoverage=67%, HitCoverage=16%, E-value=9e-12, Identity=43%"; Hit description =Tetratricopeptide-like helical
MDEDEWMYEIMSERADMDYENAESCGANEPHVDCSEAFKTSQVFECREDVLRWARSVAHENGFVAVILRSDKNTGSRGRSTFELIGCERSGEYKCRKKEFIRRDTGTRKCGCPFKLRCKPVAGGEG

SEQ ID NO: 144252 - protein, 96 aa, Glycine max
  Coding DNA Sequence Number=SeqID_27474
MDELKDLIKQVAPRGIPPYGVDETQMVTRLFFRKPSHHEYSEKVIKFEIIELKTNEDVMKVLIESNYWKKIGPIEILVVFSKPLPQMEDELSLSQN

SEQ ID NO: 144253 - protein, 68 aa, Glycine max
  Coding DNA Sequence Number=SeqID_27475
MWVKAAIFSFGDVKDCGHDEANFLYLGFAIVALIIDPNNESQNGDNLNVHQPIRPPLIANYFLPKLQK

SEQ ID NO: 144254 - protein, 134 aa, Glycine max
  Coding DNA Sequence Number=SeqID_27476
MKQAKYSLKAQVEKDEGPSGEGQSPRVEKDEGPSNPCGVYPDLSSFTGSGVYPDLSSFIGSGVYPDLSSLTGSGVYPDLSSFTGSGVYPDLSSFTGSGVIQISVACIKRSTPTQVHINNFSLACPIQEHSVSRR

SEQ ID NO: 144255 - protein, 202 aa, Glycine max
  Coding DNA Sequence Number=SeqID_27477
TLAKEALDPDRGGAGGPTAEVGARRTRWQVRSTATHMHRGGTFKSLEQREGSLCYNSVFFTLCFIQSPSLGQSSAVAKSDSKSLSRNRDHVDGDGKSNGHVLRHFFDDWPRTLQEPDNGESNGSQNNNSGKCLSMSTPGIDPSDVSLKLTTGYGEDACQAASVGGPLAEALRSSTTSSTSSPTSVLLQLPPSSACETSFIST

SEQ ID NO: 144256 - protein, 233 aa, Glycine max
  Coding DNA Sequence Number=SeqID_27478
  Gene Ontology: Mol. function=hydrolase activity
  Homolog annotation: Hit_ID=Q3SC78; Match level="QueryCoverage=98%, HitCoverage=88%, E-value=2e-52, Identity=44%"; Hit description=ACI14
MSEPPKPRLVICMGDIHGFITKLQILWSNLEASLDRSEFETATLIFLGDYCDRGPGTRHLIEFLVSLPSRYLLGGVVQRGRVREYAASREKGTEYQGSIYDAGPTFESYGVLHASAVLLYPGLKGSSLNADLVKAVPDDHKKFLADLVWVHEEDDVFVNTDDGVKCCKLIAVHAGLEKGKDLKEQLKLLKARDTRVPKVEALSGRKSVWDIPEELTASPSPWETPRRRLKADH

SEQ ID NO: 144257 - protein, 863 aa, Glycine max
  Coding DNA Sequence Number=SeqID_27479
  Gene Ontology: Mol. function=protein serine/threonine kinase activity; Biological process=protein amino acid phosphorylation
  Homolog annotation: Hit_ID=Q9LFA2; Match level="QueryCoverage=99%, HitCoverage=100%, E-value=0.0, Identity=50%"; Hit description =Protein kinase-like
  Pfam annotation: Domain name=Pkinase; Domain location=479-810; Score =243.8; E_value=3.7e-70; Accession=PF00069.15; Description=Protein kinase domain
  Pfam annotation: Domain name=Pkinase_Tyr; Domain location=479-810; Score=-4.7; E_value=3.5e-12; Accession=PF07714.7; Description =Protein tyrosine kinase
  Pfam module annotation: Pfam domain module=Pkinase::Pkinase_Tyr; Domain location=479-810::479-810
MGSFSGTCEIVEAREDLNTEKDTGIYQSNSGYSLDEKFQKHPVQKLGYKGNLDDDINKLFESITLKSSSRDLGFIHGTSPKMKSALKKPIAVGASRSPRVGPSEPVTLKQALRDLCISKASEMASMKRLSKSTASPRISEVGKIHTLYNSVVVEGRRSEPSNVESKGSTSEISLVPEESNSLSLDNAYQSRSTVKSTSLSPNVQSSKIAVAIAITQNDTGASLMPSDLASSSSKVGVLSPSSEPAQIEKQTSESSSSSCNTNGSKLELPENASSPKKIGNKASASKNGRKGRLQTVSSSSTSVNGNRVCKLSRNAPRTVKSIIKNKNFGKKKVKQDSVSALFDPTCSEVNDKSVSGTTQLVCERCWCAIENNKGITSLDSISPGEGINSVNNSGAASAGCNSSREVTKVKKNTVLKEQLEFSQSSKSSQGDYSSSTSTSDESNLSGSSCGNRPHMSKDVRWKAIRHAQIQNGVLGLRHFNLLKKLGCGDIGTVYLAELIGKSCLFAIKVMDNEFLARRKKMPRAQTEREILRMLDHPFLPTLYAQFTSDNLSCLVMEYCPGGDLHVLRQKQLGRSFSEPAARFYVAEVLLALEYLHMLGVVYRDLKPENILVREDGHIMLTDFDLSLRCDVSPTLLKSSYVDPAKISGPCAQSSCIEPFCIEPACQVPCFSPRLLPPAAKARKLKNDLGAQLRSLPQLVAEPTDARSNSFVGTHEYLAPEIIKGEGHGAAVDWWTFGVFLYELLYGRTPFKGSNNEETLANVVLQGLRFPDTPFVSIQARDLIRGLLVKEPENRLGSEKGAAEIKQHPFFEGLNWALIRCAIPPELPDLCEFGVSEMTPQSQGKGVKYVECNAAGELVEFELF

SEQ ID NO: 144258 - protein, 239 aa, Glycine max
  Coding DNA Sequence Number=SeqID_27480
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=8e-38, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHALTFRGLHALTFRGLHVLAFRGLHALTFRGLHVLAIRGLHVLAFRGLHILAIRGLHALTFRGLHVLAFRGSCTFTFRGLHILAIRELHALTFRGLHVLAIRGLHALTLRGLHVLAFRGSCTFTFKGLHVLAFRGLHALTFRGLHVLAFRGLHVLTFIGLHALTFRGLDFLAFRGLHILAFRGLHVLAFRGLHALAVRGLHTLHFRGLHVLAFRGLHVLAFRGLNICTLREFRVVCP

SEQ ID NO: 144259 - protein, 93 aa, Glycine max
  Coding DNA Sequence Number=SeqID_27481
  Homolog annotation: Hit_ID=Q8L8A7; Match level="QueryCoverage=99%, HitCoverage=25%, E-value=7e-09, Identity=45%"; Hit description =Transcription activator
MDLQLKQWRNQHESEQEQEHYSPNMAKFLSQQQHPPPFPSALPLFVPEQPNTKVSTLSAFSDSTLPSSPRFPRMESCFSFAQWQELELQALIF

SEQ ID NO: 144260 - protein, 164 aa, Glycine max
  Coding DNA Sequence Number=SeqID_27482
MILEEGENFPVYSRFYRSKPEPQELAAQLCIPGRGFELNADGLPLKILRKNLTTLAQTRSILSLSNLVPTSHTSNITLDRARLIFGIIQKMDMKLGYIISAQISMIAQHDSFRFVFLALITALCKARGVISDSLTLESLGPSINVAYAKKNYWNLDDLSVTFRG

SEQ ID NO: 144261 - protein, 80 aa, Glycine max
  Coding DNA Sequence Number=SeqID_27483
MHKTPLTKTRSLPRPLTVEAQSVAASPQCLKSPNATRTEEEEDIFAHSLTMLDAPAILLGAPNNTHKITIRLGLIGLPIS

SEQ ID NO: 144262 - protein, 67 aa, Glycine max
  Coding DNA Sequence Number=SeqID_27484
MSKEVDMDDRNEQECSVNEQHVDCLDAFNTSQVFDTQDDVLQCARSVAHENGFVAIIMRSDIQTGSR

SEQ ID NO: 144263 - protein, 321 aa, Glycine max
  Coding DNA Sequence Number=SeqID_27485
  Gene Ontology: Mol. function=DNA binding; Biological process =regulation of transcription
  Homolog annotation: Hit_ID=Q9LS50; Match level="QueryCoverage=99%, HitCoverage=100%, E-value=1e-73, Identity=48%"; Hit description =Similarity to NAM
  Pfam annotation: Domain name=NAM; Domain location=5-131; Score=295.9; E_value=7.8e-86; Accession=PF02365.6; Description=No apical meristem (NAM) protein
MEEKLPPGFRFHPTDEELITYYLLRKVSDISFTSKAVAVVDFNKSEPWDLPGKASMGEKEWYFFSLKDRKYPTGLRTNRATESGYWKTTGKDKEIFGGGVLIGMKKTLVFYMGRAPRGEKSNWVMHEYRLENKQPYSSKEEWVICRVFQKSSAPKKPQQTSSSQPSQESPISMVNEFGDVDLPNLNSIANSSSSFTNNIAYNGDHPSNVNTNNMNLTMNWPSSTELVPSLPWPSGLLNPNLSVNSLLLKALQLRNTYQQRETTTSTSDHHFATYVPQGFSHHNIGTDKHHFPPNLSASSSSKALESCVPQQEQPFNMDSIW

SEQ ID NO: 144264 - protein, 136 aa, Glycine max
  Coding DNA Sequence Number=SeqID_27486
MVRIGGLGRALGKVIGKALGREDHHDSDDDAPDMTEDVPAHGVEAVDGAEGFVVDDAEGFLGEPRDPSMLIDYCDHVAERPELKLSSHGRKVHKFGRLAPEIEGLVAVTGLCPLIACSLATSDQELSPCPPIIGFP

SEQ ID NO: 144265 - protein, 123 aa, Glycine max
  Coding DNA Sequence Number=SeqID_27487
MGKGQGALKMNKESHLIKKSSSVNEAHQRPPVIIYTHSPKKLTGLYRADHDPEDADEADLKPPRKEEPKANEAASPEEVESSCCNCVAPLIPDYNNANNYAVFESDFNKPLLTFANPSFFFSG

SEQ ID NO: 144266 - protein, 444 aa, Glycine max
  Coding DNA Sequence Number=SeqID_27488
  Gene Ontology: Mol. function=structural constituent of ribosome; Cellular component=intracellular; Biological process=translation
  Pfam annotation: Domain name=DUF1666; Domain location=321-444; Score =67.0; E_value=6e-17; Accession=PF07891.2; Description=Protein of unknown function (DUF1666)
MPLCPKEEALVKLFYNVSSPFQLLFLILFSSAVFLVTFLTFTGRFPLIQRDQEYEYVYTEDEEEEEEETQEGYSCVDSTDRLEVTCGKETRVFLHNEGHQRTHSYSEEFISPEESLNEESEEKHYSETLSLHNSAQVSDFENEEAETVQVDFPARDPDSAQVERRTTSPINLTAYKRNKNRDDDHVSVEIIKNKKVQETNLARDERFFVFASTQLQSKKLMIEERDDESSKWKSSIIGRDSDTEDAFSSSSRRSCPKWESYTLFQKYDEEMAILDRISAQKHHETESLRSIQMSPRSMSERIVYKFQNVNKKPAEVGHNPYRELEAAYVAQICLTWEALSWNYKNFRSKHASRQDHDTGCSATVAQQFQQFQVLLQRYIENEPYEHGRRPEIFARMRLLAPNLLLVPEYQDLEEDQKDGGFQCKISSASFLKIMEDGIKTFMIF

SEQ ID NO: 144267 - protein, 727 aa, Glycine max
  Coding DNA Sequence Number=SeqID_27489
  Homolog annotation: Hit_ID=Q6ZCP9; Match level="QueryCoverage=30%, HitCoverage=35%, E-value=8e-21, Identity=32%"; Hit description =Pentatricopeptide (PPR) repeat-containing protein-like
  Pfam annotation: Domain name=DUF247; Domain location=31-701; Score =47.5; E_value=4.1e-12; Accession=PF03140.6; Description=Plant protein of unknown function
KAMVRSNANLDEKWAERIWDPRSATEGDSEENPRAVCICVVPESLRCSKREAFIPQFVGLGPYHNLSPDLILTKERKLAAAKRVLKDLLSDSMNLIQQRIISKFGSHTQTFYHPDFKSTNNDHTLSFIDDTLSLLLAVDGLFLLAFIRLLTSSSSTAGGDLDDAEFSNFLTGKIRMLLFNAAGVELTKNVLIREVFMLENQIPSLVLEQITGSAQGLGLGSNVVTFCKNHCPVLNLEELPNVDYVHLLDLMYHLIVPRAQSPPQPQEPEARPEAPLETESNDDEPQPEPGIGQYFPSIFGGGEWELIIVPLMFICVIPYIVVALIHLIIVNPFLPDPKPEPHPAEPDSETEPQSEPELEPETEPQQEPELEPETETQQDPELEPETQPQSEPELEPETEAQQEPEQEPETEPQPEPESEFQLFGSWESFGYVLVAEVFLPGYFIYLVAKLLLWVICSLIYRPIKRVFSYLFGLVKRAFRRRNFNSAFRWSHEALKNMGSRVNYPLVGSLTQAVAGLEELTQEQQSTDWDEGAPLAERIPPAKKLRSAGIYFQPAKSGAISSIDFVEESCIFYLPCIRMGVNSEVIIRNLVAYETLIKSDTPLVFTRYIELMRAIIVTSEDVKILVDSQIITSELTNQAVADFFNGMSNSIRPTKTEVLDKVIHKVKSKFDSTRKRNWAVIKHMSKTFFAVMGGLLLLAFTGLQTYCSFFGCSRTSKLGQLPENGEYY

SEQ ID NO: 144268 - protein, 85 aa, Glycine max
  Coding DNA Sequence Number=SeqID_27490
  Gene Ontology: Mol. function=structural constituent of ribosome; Cellular component=intracellular; Biological process=translation
  Pfam annotation: Domain name=DUF1666; Domain location=1-84; Score= -99.4; E_value=6.3e-05; Accession=PF07891.2; Description=Protein of unknown function (DUF1666)
MKKKRVKVKDLNHAGKCLRKRKLKVEKDMDILMALIDLKVVSRVLRMHDLSEEQLHWCEEKMSKVRIMEGKLQRDYSTPLFFPSH

SEQ ID NO: 144269 - protein, 218 aa, Glycine max
  Coding DNA Sequence Number=SeqID_27491
  Subcellular localization annotation: CTP_CleavageSite=53; ConfidenceScore=5.12e-01
MLTKGSISHHHVCVDHIHIAFFSLTTHKTTHHSGHNPRSQSSINVPQVRPYITASAPASTVALLSIHILSPCYTLFSLFCFFFLFSSRGVPSHSVTVAGSSAFLGFHLLKNKGPEKKVFLVKICGLVFGREQEKKEKMNSYSYYGYQEKNTLTSCEETRMESVICPKPRRLGLINHSSINTEVGPSRHPIIRKFSVLFSFWFFKQIGYKNYDFSVFVH

SEQ ID NO: 144270 - protein, 116 aa, Glycine max
  Coding DNA Sequence Number=SeqID_27492
MENLSKLGPILGYTHDNCYITSPPISGHENMLVSSLLDRDNNAWKKDVFDVLFSEEDAQKILKLSLLNTFDDDKLIWHLSQNKTLLVLAYAFEMNKEILSKQGPIISMESLETSRS

SEQ ID NO: 144271 - protein, 463 aa, Glycine max
  Coding DNA Sequence Number=SeqID_27493
  Homolog annotation: Hit_ID=Q8H612; Match level="QueryCoverage=42%, HitCoverage=41%, E-value=9e-09, Identity=25%"; Hit description =Pentatricopeptide (PPR) repeat-containing protein-like
  Pfam annotation: Domain name=DUF247; Domain location=35-376; Score= -136.6; E_value=0.00048; Accession=PF03140.6; Description=Plant protein of unknown function
MMSSNANLDSTQHNTDGNWVVHIWHTLSATEADLENSRVVCVCEVPESLRCSKREAFIPQFVGLGPYHHFRADLIMTPKKKLAAAKRVLKDLLPSDMNQFQLQISNLGSEVTTFYHPDVKSTYNDHTLSFLLTVDGLFLLAFITSSGHPDAEFSNFLTGNLMMLLFNAAESNGHEGLGSNVVNFCKQHCPVLVKVEVFANNTVHLLDLMYHLIVPRPQSPPQPLEPEEAQQNPVPEPQPATEPNHEPQPEPVFVNLCENIGRQFSGSWQSQILTILAVFIFVTPFLIVVDLVYLIVMKPFLPEPEPEPQPEPEPESQPEPESQPETDEFRFGSWKDLGYLIVGELILPAYFIYLILKLFWWVISSIIRTIIRALSYLFGLVKKAFRRSSFNSAFGWLHDALSNMEGRVNNPLLRPLTEALAHLKEMTEERQTRDSDEGAPLADQRIPSAMQLHNAGIFFKPIE

SEQ ID NO: 144272 - protein, 586 aa, Glycine max
  Coding DNA Sequence Number=SeqID_27494
  Gene Ontology: Mol. function=microtubule motor activity; Cellular component=microtubule associated complex; Biological process =microtubule-based movement
  Homolog annotation: Hit_ID=Q0WN69; Match level="QueryCoverage=92%, HitCoverage=54%, E-value=1e-152, Identity=52%"; Hit description =Kinesin-related protein
  Pfam annotation: Domain name=Kinesin; Domain location=151-443; Score =410.3; E_value=2.7e-120; Accession=PF00225.13; Description=Kinesin motor domain
SFGPSIQAEKIREEEKEADEKEIIRLMKEQEDKNLEISSLEQKSQEYEHRLDELRNKIKELEVSSDSKDQKWNMKMNQMQTVINFQLSSLQKLELSWECIKQNVMKEQTVYAEDCDRLGVYLKPLLHAAENYHTLLAENKKMFNEIQELKGKKEKQSIVKLIGENDLVVANPSKEGKDALRSFKFNKVFGSATTQAEVYSDIQSFIRSVLDGYNVCIFAYGQTGSGKTYTMTGPNGATSETIGVNYRALNDLFKIATSRESLIDYEIGVQMVEIYNEQGLAVPDASLFPVKSPSDVIKLMDIGLKNRAIGATAMNERSSRSHSVVSIHIRGKDLKTGSTMVGNLHLVDLAGSERVDRSEVTGDRLKEAQHINRSLSALGDVIFALSQKSPHVPYRNSKLTQLLQTSLGDQAKTLMFVQINSDVSSYSETLSTLKFAERVSGVELGAARSSKESKDVRELMEQVSSLKNAIFAKEEEIERLQLLKGSVGSIVKRNQISRSRSIKHYEAFNQQPMDDHIHQNEFLHQSELHGGNIGKNIAAIAETSRFTDSDFDEKSSDLSDSAVAPGTETDGSENSSLTERTTSSDK

SEQ ID NO: 144273 - protein, 149 aa, Glycine max
  Coding DNA Sequence Number=SeqID_27495
  Gene Ontology: Mol. function=RNA-directed DNA polymerase activity; Biological process=RNA-dependent DNA replication
MTIDKEYMLDKLPTITFSMKDVEGIKPHDDNPIVITVVTIGFNVKKEAPTSGQLERSNHWRKPRAKTKIGQSLPLIMEEELIRYLDNKRRTTKEEFGKLLAANFIREVEYSTWLENVIMVKNSNNKWHICIDYTNLNNAFPKDPYCCPG

SEQ ID NO: 144274 - protein, 68 aa, Glycine max
  Coding DNA Sequence Number=SeqID_27496
MEKRSRRKTPICRDRGLRKGGIPETTTGGTSYGRDNTMNCKIFLDTLRRMTIKWFSSLLRDPFLTFRS

SEQ ID NO: 144275 - protein, 260 aa, Glycine max
  Coding DNA Sequence Number=SeqID_27497
  Subcellular localization annotation: CTP_CleavageSite=79; ConfidenceScore=5.31e-01
AVHVSSTIESGAPQIYCLALFANSPFSTFIQSPMNLLPSAVHASSTHESGALPANLLPRVVRHFSILNLIRRPMNSLPSAVHVSSTNESEAPRIHCLALFANSPFSTLIRRPMNSLPSVVHVSSTIESGAPRIHCLALFANSPFSIFRRPMNSLPSAVHVSSVIKRRASERRRTDESRYRLITKRAGRTKSVSYLCFPLISDERYLAPFVAQYVKSRDVPEIKRKQAYAIREIPPTWAFQFLPPEGGCFWRKQPCSPGRA

SEQ ID NO: 144276 - protein, 154 aa, Glycine max
  Coding DNA Sequence Number=SeqID_27498
  Homolog annotation: Hit_ID=Q9FXS7; Match level="QueryCoverage=33%, HitCoverage=11%, E-value=5e-08, Identity=57%"; Hit description=EIG -I24 protein
VFGEHMVMGCSMLHVVPSCHSTSHAMPMYVMYVSGFGVRRMQSKGSKPQSALSHHHTDPNLHRHRPRPLPRHLLLPLPLLPPRHGRDSLLQFGTVRGCWAPGKFLRLEKGVLPYQQSVGGVAREYFRVKDECLDNFKSFLLDQSGLNFTVFEAL

SEQ ID NO: 144277 - protein, 286 aa, Glycine max
  Coding DNA Sequence Number=SeqID_27499
SHCHPEAAGPMTSRDQVWSFCTHDTRRYLMVIRTLLSSRGGGPDDKQRPKTKFGHSAPMIRGDTLWLFAPFCHPEAAGPMTSRDQVWSFCTHDTRRYLMVIRTLLSSRGGGPDDKQRPKTKFGHSAPMIRGDTLWLFAPFCHPEAAGPMTSRDQVWSFCTHDTRRYLMVIRTLLSSRGGGPDDKQRPKTDIVFCTFCSSGNNKSFTCGNFMVARDSRQPRGAKLVSYTDFRGPLLDDMRPFFGPCEERQVMVTHDSRQPRGARLVSYTDFRGPLLDDKRPFFGPCE

SEQ ID NO: 144278 - protein, 351 aa, Glycine max
  Coding DNA Sequence Number=SeqID_27500
MDQEDETLKCKRIGSDYSRRPIGRPCKMPYPKLVPQRGLGVAQLEKLRLEQEQKEKTAVIAAIASSSNSDIPYDKHPSSSVSIANSRGYNAGWHGALVLGHATGPQLRDPHDLEFGKKNIGMNPRLTFASTLPCESNTIMPFPNWVQQTQQHQQHPFSSTVGVSSRTSSTIVPHSSVEPYSNNQTYVSKRLDKIIGIKRPNPFSVKKTPLSSSNLKPFESNPIRPFHNWMHRTQQHPSSSMMIWTKRPNAFSLDIPPVSSSKFKPLSFPNPPVSSSNFKPLTFLDPMKASESISCSSGRRFNLDFGNSTIREIPSLSASNSELISKKNKKGKKNIGGDFHTVDPPTRCSCS

SEQ ID NO: 144279 - protein, 443 aa, Glycine max
  Coding DNA Sequence Number=SeqID_27501
  Gene Ontology: Mol. function=microtubule motor activity; Cellular component=microtubule associated complex; Biological process =microtubule-based movement
  Homolog annotation: Hit_ID=Q0WN69; Match level="QueryCoverage=55%, HitCoverage=23%, E-value=1e-62, Identity=54%"; Hit description =Kinesin-related protein
  Pfam annotation: Domain name=CH; Domain location=38-144; Score=33.4; E_value=7.8e-07; Accession=PF00307.21; Description=Calponin homology (CH) domain
MNSPPDDNNSEPRELGSPDASSNEIENFLSLYGEVEAKHRLLLVQWLTSLVPSLNLPINVTDGELRACLSNGTVLCQILNKLRHGTVNVVSEPDNFLPSQSENVKSFLKALDGMGLPRFEISDLEKGSMKAVVDCLLTLREKSLQNALGDNISVTNSNTVSPHGNAPFNFHCSPTFGGEQRKIAAGSMLQRVNSTPIIMAEPSVSLIHHVGHKFHEEFQLKPGSYADLPAAKISEMMKSNSIDNAPTQSLLSVVNGILEESVERRNGEIPHRVACLLKKVTQEIERRMSTQAEHLRTQNNLFKAREEKYQSRIRVLEALASGTRDESEICSSQVQQFKGEMIKEKEKKVDENEVVRLIKEQEDKNLEISALKVELETAKRTCEVQFSQLEEEANGFKATLTRKVQEYEHQLEELRNEVTVSYFAQKAIYWYTMRDRTRPRGFS

SEQ ID NO: 144280 - protein, 61 aa, Glycine max
  Coding DNA Sequence Number=SeqID_27502
MNPSTGTWFMEVVNPPLGMHQLILPHVMGLPFIRVVQNDPFGLAVPWWFGLAPCGPIVSGF

SEQ ID NO: 144281 - protein, 221 aa, Glycine max
  Coding DNA Sequence Number=SeqID_27503
  Gene Ontology: Mol. function=nucleoside-triphosphatase activity; Cellular component=membrane; Biological process=DNA integration
  Homolog annotation: Hit_ID=Q1S520; Match level="QueryCoverage=99%, HitCoverage=92%, E-value=2e-33, Identity=49%"; Hit description=AAA ATPase
MDNIIFVYVTYEQFLPYSVRNYIIKYVRKLTSHVHSYIHVSFPEFTGEQVLERKRSQAYIAIRTHLSVNSAQRAGRLKAEVVTDSQTLVVLGIDDNEENTFQGLTVWWSANHKSSNPSKENRFLKLTFHKRYWRLHPTCLQRRQGHCVSGQDAKAVHRQLQQWLNLMPKSIAQDSETCLKSLIESIEETKKKLLTQDEVKKANKDEKAHLKEEREKEPLAK

SEQ ID NO: 144282 - protein, 190 aa, Glycine max
  Coding DNA Sequence Number=SeqID_27504
MTEGCGEGFCLANLPGDAFSLWGNFFEAKKQMMADAKFAGLLGLGKPLVEILPPGQLRGFCPLLAWLGSAVLGYGPRAKFRIGWPPPPPREGRIKATRAESQWIVAAMPLCHLQYPVAYLSRLQRILPAARWELRFNASRRANPPHEGHQRHVPLGGRGPLLLVGKRTAGARVASSPDSDLEAFSHNPTH

SEQ ID NO: 144283 - protein, 133 aa, Glycine max
  Coding DNA Sequence Number=SeqID_27505
MQRHPTVICKLTFVTVTQEFGGMWRHLMVIRTHAFCYPVTRESSGMRRHPMVIRTHTFVTADLQSGNPYNTTSVGTDPYIMQQADLPDVMQQADLPSGNPYNTTSAGTDPRVMQQVDLPSGNPYNTTSVGTNP

SEQ ID NO: 144284 - protein, 98 aa, Glycine max
  Coding DNA Sequence Number=SeqID_27506
MENGGLHTFKLCRFGLRRRKDQSGSEKRQNAKTRANEEDEGETLAVTTIPTRPNFPSAQQCHYLANSSPSHPIIHKSHPQNSHKACLLTTRLMPKHRL

SEQ ID NO: 144285 - protein, 237 aa, Glycine max
  Coding DNA Sequence Number=SeqID_27507
  Homolog annotation: Hit_ID=Q47522; Match level="QueryCoverage=19%, HitCoverage=58%, E-value=2e-21, Identity=100%"; Hit description=LacZ protein
VLQWLLFLSAVPPVQLLTGWCVTAKAPPDISAGKCSGRVPFAIQAAQLLGRAIGAGLFAITPAGERGMCCKAIKLGNARVFPVTTLSLGGDMFGGSPILVICLLSGELYRESSVSGLCYVACQYVHAVMPMPEMHSSDRVVDQGWLDQAYRYRRPRGGARYQLLFPLVRVNFELGVIMVIAVSFGKPVVPAALMNRPTRGERRFAYWALAECILAYYVGTDEGVSEVLHVAGEKGCT

SEQ ID NO: 144286 - protein, 198 aa, Glycine max
  Coding DNA Sequence Number=SeqID_27508
  Homolog annotation: Hit_ID=O04892; Match level="QueryCoverage=46%, HitCoverage=17%, E-value=2e-23, Identity=65%"; Hit description =Cytochrome P450 like_TBP
MSRRARRSLQNPGREPGRSGRRCRSWCLPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDWERGPSGPLPRASNSQLRTGTDKGKSDCLIKTKHCDGPCGMLTQCDFWPSALNVKGEEIQPKRG

SEQ ID NO: 144287 - protein, 98 aa, Glycine max
  Coding DNA Sequence Number=SeqID_27509
THLLLEVASHLSLPFSITLPFILQEAKESIDEEDPRPTSSNAASITLFVATLLCTSSQCDLSLMPAMVMNYIDDKAPVKGLRYEANAKAENQEAKTRT

SEQ ID NO: 144288 - protein, 72 aa, Glycine max
  Coding DNA Sequence Number=SeqID_27510
  Homolog annotation: Hit_ID=Q1SB44; Match level="QueryCoverage=58%, HitCoverage=5%, E-value=4e-07, Identity=57%"; Hit description =Importin-beta, N-terminal
  Subcellular localization annotation: CTP_CleavageSite=49; ConfidenceScore=5.41e-01
MCLYSMPLLLPSMAPDPRNRRSFKSGIFCRTLKALIPSSFPCSCSVLLMATAATTYLTILICFTCHRPLNGI

SEQ ID NO: 144289 - protein, 91 aa, Glycine max
  Coding DNA Sequence Number=SeqID_27511
MGCIASRNGGLEGCIASRVSESHVEVCCQCKRRHSPLFSPTCNVTGTGSDGFIFVVSDYGGLSSLASDYNRFHSHNKSPPLILLKQTTIHK

SEQ ID NO: 144290 - protein, 200 aa, Glycine max
  Coding DNA Sequence Number=SeqID_27512
  Subcellular localization annotation: CTP_CleavageSite=39; ConfidenceScore=5.34e-01
MASSSASGLKDLLSPQADSNSMAITKPIMKPFQKLEEVSLGSNASLSTLISPPSSPSLQFSLSIASNIDMPLNHEGNYLGEKKEKLEIRKDNDERKLGKELEIIRMDCESYLEIKVGKKEMKDNKNNEFTPGKCFPPPISCLKKVKVGKPFKYLAYDKESETYVVEEIKIPEGSLFHATREEERLKLFADFLDEEESQEK

SEQ ID NO: 144291 - protein, 129 aa, Glycine max
  Coding DNA Sequence Number=SeqID_27513
  Gene Ontology: Mol. function=adenylate cyclase activity; Biological process=cAMP biosynthetic process
  Homolog annotation: Hit_ID=Q1SH04; Match level="QueryCoverage=60%, HitCoverage=40%, E-value=7e-22, Identity=70%"; Hit description =Adenylate cyclase
MRYMEHNEVLKMLSSVSWIAAAKIPLPRPITSVYPRKTLTALSLLSSPMEVEVKMRLANAHRYVTTLLSLFHVIIHRQQNLFFNGTASELSVRRIVLCLRFYGYDECCVASLKARAVLVDGVRKREKQG

SEQ ID NO: 144292 - protein, 117 aa, Glycine max
  Coding DNA Sequence Number=SeqID_27514
MLQPHGINISLKEHSNRMFLPPRPRLRRIHEGLTFLIQCHVCCYCSKLVPNDVVYCCCNILSVSSSSHTFKGGVVEAAGGEGASNCNGNSNAAAFKGGSVEDAVAAFFQSLLLLIHF

SEQ ID NO: 144293 - protein, 353 aa, Glycine max
  Coding DNA Sequence Number=SeqID_27515
AELERRNFHKRLTNLVDGCIDLAFVKEFYANFYSYEDHPPKHSRVRGHLVKIHADSLNKFLETPVVLAEGETLLAYSRYCRLPTDCREIVVALCIPGLGFILNSEGHPGKIFRKDLTTLAQVWSVLSYSNLAPTSHTSDLTMHRARLIFGLVSRLDMNIGALISGQMTFIVQSNTSRLGFPALITALCRARGLLSDSITFERLSPVINLVYIRKNCWNPDDLIVTIRRARRARTRPVEALSTSAAPPPACTLAAPSAPAPADFQCLEAMLQSIHQGQIILLQSLQIVAPPDSIPSVEQFNEWVAWPETQSSLHKEDEGPTAQVPQQIEDESSETTTCHTLISSGDYNLMIYNH

SEQ ID NO: 144294 - protein, 99 aa, Glycine max
  Coding DNA Sequence Number=SeqID_27516
MASKKRKAPSTPIQTRFDRSRFTSLEAWERYTNIVVLRKLLPERNVVVYYTEFDEFKEELERRHWDEKLTGFSDSSIDIDIVKEFYANLYDPEYKSPKQ

SEQ ID NO: 144295 - protein, 61 aa, Glycine max
  Coding DNA Sequence Number=SeqID_27517
MGSEICPEVHENPRAFFSHSSLILLKSSIQYPWGVRLHQYPSSYLHHVFPGQGEKGDFVKC

SEQ ID NO: 144296 - protein, 83 aa, Glycine max
  Coding DNA Sequence Number=SeqID_27518
METCTRQSLWRMHERKLIHGAPNKSGEWRIALGNHFAWLQTHWGSMHERQSIHGAPNKNGEWRMENCTRQSLRVAPDSLVEDA

SEQ ID NO: 144297 - protein, 81 aa, Glycine max
  Coding DNA Sequence Number=SeqID_27519
MSIFVERWHKETSGFHLLVGEGRSKTSSNFMLTTLSICWWNYSRSVLQRQELRRFNVMALMFGYRGYATCIRQKSRHVTGL

SEQ ID NO: 144298 - protein, 446 aa, Glycine max
  Coding DNA Sequence Number=SeqID_27520
  Homolog annotation: Hit_ID=Q5PJQ0; Match level="QueryCoverage=87%, HitCoverage=73%, E-value=1e-114, Identity=53%"; Hit description =Putative membrane protein
QQQAQKQVRAIELMLKGLIQQAWPDPVRLNNHLKTLFNADRVRRWLKLGEINDVLSGMMFSELAQMLVDKKEFSRYYASLFNDPAMLTLLVEPRKTLQTFLDDIRQIRNHLTVQKALSSAQIQLLDSYYTQISRPVQRAFEEGRTRVNPAGFMAVDASELHTFWEKAQKMDRVTGGDLFEVRDTIEKPTQRAPRTPEQREQLISGVLWGAVGVMVIAIVAGGFWLVTSSKPQPAVAKAAEAAPPQEMRETPSSRETLTRMGVTWDENNFRSAINRNDTRVAQLFLQGGMDWKLSWTEEAMSAGYDDVLEVMLRYRQNMVEEKPCRRFINTLSHAMANGESLTSVRKEYLKAFCTVPAVVKRQQHDLDMATRRAQSQPDASNKKWQSIQTAIYEGCRLMPDPIAWRNKLRVPRSGDLPPGARVARAVAIEPPWHVHWSCRYRVARNI

SEQ ID NO: 144299 - protein, 230 aa, Glycine max
  Coding DNA Sequence Number=SeqID_27521
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=93%, HitCoverage=28%, E-value=1e-103, Identity=82%"; Hit description =Photosystem I P700 chlorophyll a apoprotein A1
  Pfam annotation: Domain name=PsaA_PsaB; Domain location=1-230; Score=- 180.6; E_value=0.0012; Accession=PF00223.9; Description=Photosystem I psaApsaB protein
MLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMAFTVLVCIFIMIP

SEQ ID NO: 144300 - protein, 186 aa, Glycine max
  Coding DNA Sequence Number=SeqID_27522
  Gene Ontology: Mol. function=hydrolase activity, acting on ester bonds; Cellular component=cytoplasm; Biological process=lipid metabolic process
MGDRLKDMIRDLGQESFQQAHAPMYDTLQTDSKKPLYPGPDMDGVTKALVHYFNIKRFMLASMIAYCTYMNFKKCPRCGVSRYKVKDDDECSSDENSKKGPPSKVLWYLRYPPIIPRFKRLFANGDDAKDLTWHANGRNYDGMLRHPANSSLVLHEVKIHDIVYDGIGPKTARKDIDVYLSPLIED

SEQ ID NO: 144301 - protein, 140 aa, Glycine max
  Coding DNA Sequence Number=SeqID_27523
  Homolog annotation: Hit_ID=UPI000044A741; Match level="QueryCoverage =52%, HitCoverage=18%, E-value=1e-09, Identity=53%"; Hit description =PREDICTED: similar to Ac1147, partial
MGGGAWPFLVGGAICLVNSVNERDLSLLNSYVEIIAIVGLQRGIPSKRESSARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 144302 - protein, 69 aa, Glycine max
  Coding DNA Sequence Number=SeqID_27524
MTVSSPPTLTYYQTTSVPLTLYSCITKTGPRMTDVVVVDIQRHLEQRRCGARRRYRFSTDVEASFCSCE

SEQ ID NO: 144303 - protein, 102 aa, Glycine max
  Coding DNA Sequence Number=SeqID_27525
MPEIHPAKQKLLEIFDQLRLSQSSSKSPKQASKLNHQAKLATRPFDKSSKHQSRKLSKFNHQVETIPQSLTTWQKQRGLTIKSRSKTTIQCLTIHGKSLNNA

SEQ ID NO: 144304 - protein, 102 aa, Glycine max
  Coding DNA Sequence Number=SeqID_27526
  Gene Ontology: Mol. function=DNA binding; Biological process =regulation of transcription
  Homolog annotation: Hit_ID=Q5QMP4; Match level="QueryCoverage=86%, HitCoverage=24%, E-value=7e-11, Identity=39%"; Hit description=No apical meristem (NAM) protein-like
MHQYNLGSDEEEKGGEIVVSKVFYQTQPRQCGSLMKDSSAPPGKHMKGQSVHAEVMNNNKNNNNNGYVEYYHSSNFISFDQGGQNARVISHFPVHEGAPFIP

SEQ ID NO: 144305 - protein, 87 aa, Glycine max
  Coding DNA Sequence Number=SeqID_27527
MNVLSGATLYCKITHPSNIFMIHLHMESLGSDQGVPTNPKRIKVILEWPTPPSVEGRSPEFQEALDLMINPFQGEGDDAILPPKGTR

SEQ ID NO: 144306 - protein, 55 aa, Glycine max
  Coding DNA Sequence Number=SeqID_27528
MTLSSSVGLSAIEESDRASTSRPRAKREINALSATVVFNEAQRMTGAKLKSTYSR

SEQ ID NO: 144307 - protein, 75 aa, Glycine max
  Coding DNA Sequence Number=SeqID_27529
MAAINFAKELALILMITMIVMLVLEPQPVECAFAVPLNPCTLPECIAQCKKILHAKFMSASCTTGSQGNLCICLG

SEQ ID NO: 144308 - protein, 104 aa, Glycine max
  Coding DNA Sequence Number=SeqID_27530
  Subcellular localization annotation: CTP_CleavageSite=60; ConfidenceScore=5.35e-01
MMMMMLVVVAMTVMIDNSDDDSNVSGGVVVAVLVVATSSDSVVKVTQVVLLVVAAISVVMVMSVATMVTMMVVTPSGNGSGCDDIGGDFSGNDEGGGDGCIDIG

SEQ ID NO: 144309 - protein, 549 aa, Glycine max
  Coding DNA Sequence Number=SeqID_27531
  Homolog annotation: Hit_ID=Q5JKH1; Match level="QueryCoverage=78%, HitCoverage=85%, E-value=1e-48, Identity=55%"; Hit description =Putative BRI1-KD interacting protein 112
  Pfam annotation: Domain name=DEK_C; Domain location=470-523; Score =74.1; E_value=4.4e-19; Accession=PF08766.1; Description=DEK C terminal domain
MASEALEDNKPPLQDDNHAKSEIPEKDASSDAVAAKSENANAGDKDGGAAGNQEVEEEADAAEEKKEEIDEDGEEKDEQEEKEEEDEAEEKEKEKAKGKGKRRRSKKDPVTPAPSERPTRERKTVERFSVPSPAKSARSSASKGLIIEKGRGTQLKDIPNVAFKLSKRKPDDNLHMLHTLLFGKKTKAHNLKRNIGQFSGYVWTENEDKQRAKIKEKIDKFVKEKLLDFCDVLNIQVNKTNVKKEELSAKLLEYLESPHATTDILLADKEQKGKKRTRKSFPSKSPGEASTETPAKKQKQTSQSGKKQKQSSDDDEDDKAELSDAKGVSQEDEDVAVPNNESDDEESRSEEEEEKSKSRKRTSKKAVKESSVSKADRTSSVKKTPVKDAKSIEKTKKKPTSKKGVAEHDSASASVSKSKQPASKKQKTASEKQDTKGKAASKKRTDKSSKALVKDQGKSKSNKKAKAEPTKQDMHAVVVDILKEVDFNTATLSDILRQLGTHFGMDLMHRKAEVKDIITDVINNMSDEEEAENDGDTDKDDDGDDDDDA

SEQ ID NO: 144310 - protein, 454 aa, Glycine max
  Coding DNA Sequence Number=SeqID_27532
  Gene Ontology: Mol. function=transferase activity; Cellular component= nucleus; Biological process=flavonoid biosynthetic process
  Homolog annotation: Hit_ID=Q94CD1; Match level="QueryCoverage=92%, HitCoverage=92%, E-value=1e-169, Identity=68%"; Hit description =Putative N-hydroxycinnamoyl/benzoyltransferase
  Pfam annotation: Domain name=Transferase; Domain location=29-449; Score=320.4; E_value=3.3e-93; Accession=PF02458.6; Description =Transferase family
MKEMRDVYILGLLEGSYVMAIAGMSSIELNVKQQGEPTRVQPAQETEKGLYFLSNLDQNIAVPVRTVYCFKSGSRGNEDAAQVIKEALSKILVPYYPMAGTLMISLEGKLIVDNPGEGAVFVEAEADCDIEEIGDLTKPDPDALGKLVYNVPGARSILEMPLMTVQVTKFKCGGFTLGLCMIHCMKDGLCAMEFVNAWSETARGLDLKTPPFLDRTIIKARDPPKIEFQHNEFAQIEDISNTKKLYEEENMLYRSFCFDSEKLDMLKKKATEDGVLEKCSTFEALSGFVWRARTAALRMQPDQQTKLLFAVDGRSRFVPPIPKGYFGNAIVLTNSLCNAGELLKNPLSFSVGLIREAIEMVTDSYMRSAIDYFEVTRARPSLAATLLITTWTKLSFHTTDFGWGEPLCSGPVTLPEKEVILFLSHGQERKSVNVLLGLPSSAMEIFEALVMMQV

SEQ ID NO: 144311 - protein, 73 aa, Glycine max
  Coding DNA Sequence Number=SeqID_27533
MSMWPPSKHWNGKKRGPEGRVGPKKVPRGVVGQQQQAQASKSRERPIESRRHDIRRQVEGLLKVKEEFVRTIE

SEQ ID NO: 144312 - protein, 148 aa, Glycine max
  Coding DNA Sequence Number=SeqID_27534
  Gene Ontology: Mol. function=5-methyltetrahydropteroyltriglutamate -homocysteine S-methyltransferase activity; Cellular component =cytosol; Biological process=methionine biosynthetic process
  Homolog annotation: Hit_ID=Q71EW8; Match level="QueryCoverage=64%, HitCoverage=12%, E-value=4e-39, Identity=83%"; Hit description =Methionine synthase
  Pfam annotation: Domain name=Meth_synt_2; Domain location=2-141; Score=-115.5; E_value=8.6e-05; Accession=PF01717.8; Description =Cobalamin-independent synthase, Catal
MVWRLLSTLLLLHSAAIKIQKAKDSIDEEDPRPRSSNGATSNTHITAGKEASVTIENSRSDEKLLSVFHEGVKYGVGIGPGIYDIHSPRIPLTEEIAYKINKMLAMLKNNILWVNPDCGLMTCKHTEVKLALTNMVVVAKLIRNELAK

SEQ ID NO: 144313 - protein, 317 aa, Glycine max
  Coding DNA Sequence Number=SeqID_27535
  Gene Ontology: Mol. function=sugar porter activity; Cellular component=integral to membrane; Biological process=ion transport
  Homolog annotation: Hit_ID=Q51485; Match level="QueryCoverage=99%, HitCoverage=71%, E-value=7e-91, Identity=49%"; Hit description=Porin B precursor
  Pfam annotation: Domain name=OprB; Domain location=1-317; Score =277.8; E_value=2.1e-80; Accession=PF04966.3; Description =Carbohydrate-selective porin, OprB family
MLSSVQEVYGRGQTWRLTQFWLSKGLFDNTVNLKAGRVTVGEDFDNFDSKFQNLAFGSGQAGNWRGDRWFNWPVSQWGGRVKVNFTPEVFFQVGFYNQNSANYDRGDGFRLDTSNSEGNLVPVELGWKPTFGPANLPGNYRIGYYYSSANGDNYGSWRDGAYQSKDHAYGGYVLLQQQLTAQGGDASRGLGVTVQAVMNDHKTSKTDNYQSISFTWKGPFDARPQDEIGVGAARIHVNSAYTRSLRQQNDANGETDFDSPTYLPIQDGSEYNYEVYYNAQLTKWLQLRPNLQYVVAPGAVSEVKDAFVGGISANVNF

SEQ ID NO: 144314 - protein, 101 aa, Glycine max
  Coding DNA Sequence Number=SeqID_27536
  Homolog annotation: Hit_ID=Q5KQZ5; Match level="QueryCoverage=86%, HitCoverage=43%, E-value=6e-13, Identity=47%"; Hit description =AcidPPc, Acid phosphatase homologues
MDRPYTLYRATHSAKQIGAGEGLFQPGEVSGKTLEELLGGGDAAVAHQQQRNQKCHRHLHHAKPLQRGAALAQQERAAQGKAQHQSGQHFTYRVRMDHQAR

SEQ ID NO: 144315 - protein, 248 aa, Glycine max
  Coding DNA Sequence Number=SeqID_27537
  Gene Ontology: Mol. function=uridine kinase activity; Cellular component=membrane; Biological process=biosynthetic process
  Homolog annotation: Hit_ID=Q8ZFZ9; Match level="QueryCoverage=72%, HitCoverage=84%, E-value=3e-88, Identity=87%"; Hit description =Uridine kinase
  Pfam annotation: Domain name=PRK; Domain location=69-248; Score =130.5; E_value=4.6e-36; Accession=PF00485.8; Description =Phosphoribulokinase  Uridine kinase family
MAAETGKVITRAANAEAEKHNFRDADQQARQAKRQQPVPDGATVVAFPRQHQCDDHRSGDQQHTVAEIGASASGKSLIASTLYREIRDQVGDEHIGVIPEDAYYKDQSHLTMEERVKTNYDHPSAMDHDLLLQHLRALKAGEDIDLPVYSYVEHTRTDECIHLKPKKVIILEGILLLTDARLRQELNFSIFVDTPLDICLMRRMKRDVNERGRSMDSVMSQYQKTVRPMFLQFIEPSKQYADIIVPRG

SEQ ID NO: 144316 - protein, 581 aa, Glycine max
  Coding DNA Sequence Number=SeqID_27538
  Gene Ontology: Cellular component=periplasmic space
  Homolog annotation: Hit_ID=Q8ZNQ7; Match level="QueryCoverage=98%, HitCoverage=94%, E-value=1e-121, Identity=41%"; Hit description =Suppressor of ompF assembly mutants
  Pfam annotation: Domain name=AsmA; Domain location=1-487; Score =122.0; E_value=1.6e-33; Accession=PF05170.4; Description=AsmA family
MTALVLLVNPNDFRTYMVQQVKQRSGYQLEVSGDLRWHVWPQLSILAGRMSLTAPGASQPMVTADNMRLDVNLWPLLSHQLSVSQVMLKNAIIRATPDSAVQKPQGAPIEPGDSEPAIAASNGWTFNISKLRIADSLLIWQQPGGDEYNFRDLNLNLNQDDNRQASVELATRVSRNQRNLSLNLKGQMDVAHYPHRISGQLDELEYTLDGANLPPQGIKGTLSGRAQWDGDQQQFALNKLQLTANDSALDGSAEGRLALPQQLNLALHATSLNLDNLMASAPASDNSTTQQANVMRTPVIAEPRAHNNADSPLNSMDLQLTLDADSSVWRGLTLSNLQIDARNQRGLLTLNKLQGKFGDGHFSIPGSVDIRQPVTQVAFQPELSSIAIAPLLKALELPASLQGTVSLKGDISGAGLSVAEAKQNWQGNAELEATNLQLAQLNLQQMVRRAVARVSNRVSNDQPDDQGIEQLSGRISLKQGNVTLPDLQGGSSRLALQTHGNVDVVKQQLDVTINMILRGWQGDDRLAKVLNGQPIPLRMYGNWNNLQYSLPVDDVVRQQLQGEAKTRLNQWLDSQKSAPRQ

SEQ ID NO: 144317 - protein, 251 aa, Glycine max
  Coding DNA Sequence Number=SeqID_27539
  Gene Ontology: Mol. function=chitin binding; Cellular component =extracellular region; Biological process=chitin metabolic process
  Homolog annotation: Hit_ID=UPI000044A8F0; Match level="QueryCoverage =85%, HitCoverage=99%, E-value=5e-28, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTPLPSLQKGLQHLMSYLLEFGMTVPFNESISFFLIRGLHVLTFRGLHTLTIRGLHVLTLRGLHVLAIRGLQALTIRGLQVLAIKGLHVLAIRGLHALTFRGLHALAFRELHVVTIRGLHALTFRGLHVLTFRGLHVLTIRGLHVLTIRGLHVLAIRGLHALTFRRLHTLTIKGMHVLTFRGLHVHNLRGYRSSPSEGCTPSPSEDYTSSPLEDCTPSPSEDCTSSPSEGYTPSPSDNDTSSPSEDYMSLP

SEQ ID NO: 144318 - protein, 120 aa, Glycine max
  Coding DNA Sequence Number=SeqID_27540
  Gene Ontology: Mol. function=polysaccharide transporter activity; Cellular component=integral to membrane; Biological process =polysaccharide transport
  Homolog annotation: Hit_ID=Q46629; Match level="QueryCoverage=99%, HitCoverage=31%, E-value=2e-52, Identity=78%"; Hit description =Amylovoran export outer membrane protein amsH precursor
MKTKLIPLLVSATFLSGCTIEPGSHLSTSGKDVIEQQDSNFDIDKYVNVFPLTPRLVEQMRPKPLVAQANPLLQNEIQSYQYRVGIGDVLNVTVWDHPELTTPAGQYRSASDTGNWVQAD

SEQ ID NO: 144319 - protein, 357 aa, Glycine max
  Coding DNA Sequence Number=SeqID_27541
  Gene Ontology: Mol. function=transferase activity; Cellular component= integral to membrane; Biological process=polysaccharide biosynthetic process
  Homolog annotation: Hit_ID=O85804; Match level="QueryCoverage=99%, HitCoverage=77%, E-value=1e-171, Identity=83%"; Hit description =Undecaprenyl-phosphate galactose phosphotransferase homolog CpsA
  Pfam annotation: Domain name=Bac_transf; Domain location=161-357; Score=519.2; E_value=4.7e-153; Accession=PF02397.7; Description =Bacterial sugar transferase
MADVPFCLGINVDFSAGADSAGACYFQTRAESFRNRNAQEAWQALQSEEVMGFDVIAFFDVDGSCPQASISGVPVLHNEQELWQLTNSETQFIVAVEFEQSQHRDRWLKMLAMHNCRSVSVIPTLRGVPLYGTDMAYIFSHEVMILRVNNNLAKRTSRVLKRAFDIVGALSIIIALSPALLVLGFMVGRDGGPPIYGHERVGLNGRKFKCLKFRSMVINSKEVLEEVLRTDPVARAEWDKDFKLKNDPRITKVGHFIRKTSLDELPQLWNVVRGDMSLVGPRPVIEDELCRYAGDVDYYLMAKPGMTGLWQVSGRNDVDYETRVYFDSWYVKNWSLWNDIAILFKTVGVVLKRDGAY

SEQ ID NO: 144320 - protein, 312 aa, Glycine max
  Coding DNA Sequence Number=SeqID_27542
  Gene Ontology: Mol. function=transferase activity, transferring glycosyl groups; Cellular component=membrane; Biological process =polysaccharide biosynthetic process
  Homolog annotation: Hit_ID=Q46632; Match level="QueryCoverage=94%, HitCoverage=98%, E-value=1e-126, Identity=72%"; Hit description =Amylovoran biosynthesis glycosyl transferase amsB
MLPLREQVKVINRSGNRSSPREARLQLIDQAIDEVSAVITVGEEEVARKTDAGQQRIAIHFVAQRQLERFVGMDIARRQVRLHGVEPEEGVLHRLAFVFGTKFGHQMVGRQRFGDHHKFVAHAVGADAEVIILMANIARIKLDSGGIFAFQHDGTGLDKAVTAKQVLRHGLVFTRRLHRHHFEEAAVLMNIDLAEDDIARFTLRFQLADGIAHFQQLVRVPLVVGVEEADEVALRQFNTFVARAGTVEFDLRQLQFDVQILIPLAAYHLRQFRGISGFVIHDDDFKVAIGLRFDAIQRRDNRFRRVISGNYN

SEQ ID NO: 144321 - protein, 1154 aa, Glycine max
  Coding DNA Sequence Number=SeqID_27543
  Gene Ontology: Cellular component=periplasmic space; Biological process=polysaccharide biosynthetic process
  Homolog annotation: Hit_ID=Q46636; Match level="QueryCoverage=60%, HitCoverage=94%, E-value=0.0, Identity=57%"; Hit description =Amylovoran biosynthesis protein amsF precursor
  Pfam annotation: Domain name=Head_binding; Domain location=50-164; Score=53.3; E_value=8e-13; Accession=PF09008.1; Description=Head binding
  Pfam annotation: Domain name=PS_pyruv_trans; Domain location=741 -1146; Score=336.9; E_value=3.4e-98; Accession=PF04230.4; Description= Polysaccharide pyruvyl transferase
  Pfam module annotation: Pfam domain module=Head_binding::PS_pyruv _trans; Domain location=50-164::741-1146
MRPHDHGIVSMKRREVLQTAASSIVAALSVSAFSSYAAKSGQPALKAVDASSVPPGDVPILTPENVYTMPPQFWQNFEGKLWIGAAGKDASQAGNQIPVYLRDASGKVSQVSQPIALNKGNFAQFIHDNAALIANPAHSMVVEDNQGNTLFSISDVSRPNASNFSQRLAQPNGYQLIGEIPSVEELRKTRPLFAGAKIKLKSWHEGLEVGGGEFVGVYGEGEDDGGVIFSGNGFYWRRVVEDFNRLTLFDFGAIADGKTDTAPAIKAMYQWSLKANQQICVQFPAGTFFVTGCDFGDQQQRFFRISGAMVNFGYFPATTLVSDGRSEFLFQVNARWTEISNLIFNGQNDKRPNKQGLFRNTCPGGQFFRGACLRFNRVGGTSISLLDTLDCKIDQWYADTCTGDVIKASWSGQKQGAWDHSTAIELSNFNAQRCTGGMVLNLPRCSQSIIHNGWIEHSEHPGDISNGQWIIDALSLEDCKNPLNARNSRLNMRQTNLQSGSWIDNSLEGERWLNIWEMGSTRVESYGVAIDGSLKYNYITSRFRLTNNTNQATWFELGNFYSPTVGDSWEIELFGQSQFSNGSDKQPLLDVMGGKQTGGRAVIHLQRKTSKAEASWSAEGSSPVLEVRVDARSDTDSKVFVKLAGWTPTAVVLIKSTAKDRFLTGRCARVDATMAQGSPTSGSQPAPQRFSLHNGKAGIGGNEQGDLLLASRALKPEQVDTRQPKGFVSVVINGEQVTVQFIAEATAAASRAGQSAINCAATAARGDLDIDVISRYPTSSGYLLQQHIQQDSLFLHNSKAPKGLVSSLKRKVANRLMPDIMMAHLGKGGVYKSFSVPPHLAEFTRSLAKYDAIIQVGGSFFVDLYGVTQFDHALCALMAKKPLHMIGHSVGPFENPRVNALANFVFDRVDSLVLREEVSLDRLKQDGVTTSRVKKGVDTAFLVQAREVENPSHNLLHWQNIIQSRKTIAITVRELAPFDKRLGVTQKEYEAAFGRVINAMIAEGYQVVAFSTCTGIDSYAKDDRMVALTLRDHVEQPEHYHVIMDEFNDLELGILLSHCHLTIGTRLHSAIISMNFGTPAVAINYEHKSLGVMNQLGLPQMATDVQSLMDGSLIDKVQTVLADYDNVKQKVNTAVAQEREIGNRITEEILNVLG

SEQ ID NO: 144322 - protein, 210 aa, Glycine max
  Coding DNA Sequence Number=SeqID_27544
  Gene Ontology: Mol. function=transferase activity; Biological process= polysaccharide biosynthetic process
  Homolog annotation: Hit_ID=Q46637; Match level="QueryCoverage=99%, HitCoverage=50%, E-value=3e-84, Identity=73%"; Hit description =Amylovoran biosynthesis protein amsJ
  Pfam annotation: Domain name=PS_pyruv_trans; Domain location=2-202; Score=32.8; E_value=8.1e-10; Accession=PF04230.4; Description =Polysaccharide pyruvyl transferase
ARQVENPSHNLLHWQNIIQSRKTIAITVRELAPFDKRLGVTQKEYEAAFGRVINAMIAEGYQVVAFSTCTGIDSYAKDDRMVALTLRDHVEQPEHYHVIMDEFNDLELGILLSHCHLTIGTRLHSAIISMNFGTPAVAINYEHKSLGVMNQLGLPQMATDVQSLMDGSLIDKVQTVLADYDNVKQKVNTAVAQEREIGNRITEEILNVLG

SEQ ID NO: 144323 - protein, 342 aa, Glycine max
  Coding DNA Sequence Number=SeqID_27545
GSFVPHGRQDVLAAAIGRPEHPRRVRAAGAGVTIKQYFGSAPRTSHNASSLPPDELQQLTQQIWDQLEESITEKVTRQMQSQGLAVPPEPLVGPSGPRVSTNGSYVDPSRNDPETGDSDRCGLYIEADPARLVSMGRVYEGSIVVHNTPLLPGQVNVSTSHLPCLANTSGQVFITVVVSPAKPPPKPDPEVDDPLYLMTLTIPKLFLRPYQVRWDATVFGVFNPDFPNYIKHEDLSEIAHGGQCLSISVLQLHLTETSMRAGNFDLYGFLEPQSIQRSRQSQFEAESYIKSWMQSSKRDVYLGAYLNGGHWQMVAIVPKEHLVVWFCSLHNRLDNYLKGIIN

SEQ ID NO: 144324 - protein, 54 aa, Glycine max
  Coding DNA Sequence Number=SeqID_27546
MMLHSLNQRLLLGELSSRNNWEAYFNDPRPLEPERLKTLRIQWAQFYLRVRDQA

SEQ ID NO: 144325 - protein, 90 aa, Glycine max
  Coding DNA Sequence Number=SeqID_27547
MITSDTPGTEIAAETAAAMRSWLQLWKIRELLDANRVINLKVYNNKMKLNPSPRRRVNMLEVCDGRKRKRHYSTWSERGRVSERRARETE

SEQ ID NO: 144326 - protein, 277 aa, Glycine max
  Coding DNA Sequence Number=SeqID_27548
  Gene Ontology: Mol. function=hydrolase activity, hydrolyzing O -glycosyl compounds; Cellular component=membrane; Biological process =carbohydrate metabolic process
  Homolog annotation: Hit_ID=Q39811; Match level="QueryCoverage=93%, HitCoverage=61%, E-value=1e-155, Identity=100%"; Hit description =Alpha galactosidase
  Pfam annotation: Domain name=Melibiase; Domain location=2-277; Score=- 74.5; E_value=1.3e-11; Accession=PF02065.9; Description=Melibiase
MHNDQLLIIKFRWNSWNHFACNIKEDLIRETADAMVSTGLAALGYQYINIDDCWGELNRDSKGNLVPKASTFPSGMKALADYVHKNGLKLGIYSDAGNQTCSKTMPGSLGHEEQDAKTFASWGIDYLKYDNCENNNISPKERYPPMSEALANTGRPIFFSLCEWGSEDPATWAKSVGNSWRTTGDIQDKWDSMISRADLNDKWASYAGPGGWNDPDMLEVGNGGMTTEEYRAHFSIWSLAKAPLLIGCDIRALDATTKELLSNKEVIAVNQGMDRLN

SEQ ID NO: 144327 - protein, 392 aa, Glycine max
  Coding DNA Sequence Number=SeqID_27549
  Gene Ontology: Mol. function=calcium ion binding; Cellular component =nucleus; Biological process=regulation of transcription, DNA -dependent
  Homolog annotation: Hit_ID=Q6NPP4; Match level="QueryCoverage=97%, HitCoverage=37%, E-value=1e-49, Identity=34%"; Hit description =Calmodulin-binding transcription activator 2
  Pfam annotation: Domain name=CG-1; Domain location=1-50; Score=13.4; E_value=2.1e-06; Accession=PF03859.7; Description=CG-1 domain
MPVFSRVGSVDVLHCYYAHGEENENFQRRSYWMLELDMMHIVFVHYLDVKVFSGFFVFQVNKTNIGGKTYSDEVTSDSQKSSSLSSGFPRNYGSMPSGSTDSMSPTSTLTSLCEDADSDNHGQLPVSGAEYIPHVQGNKSRASDTTYIEGQRAHGIASWDNAMEQSAGKHADPSLVSSTSIPSSAMGNILDKNHTVPGNLLGHKIALTEVERGAQPVQSNWQIPFEDNTGELPNWGFTQSLGLEFGSDYGPEIDPELFTFNGELKEQYTHGQSQPALKSNSAYEVPGEASINYALTMRRGLLDGEESLKKVDSFSRWMTKELAGVDDLHMQSSPGISWSTDECGDVIDDTSLHLSLSQDQLFSINDFSPKWAYAESEIEFVFLFLYVVSISN

SEQ ID NO: 144328 - protein, 105 aa, Glycine max
  Coding DNA Sequence Number=SeqID_27550
MGKKQLRSLFFSEIVKGKAFGIEMQTATVIQTQFVADTYWLFSQLAHSTIHIYNNNSFYNSSSLKHILYPMQTNTNPKSKPFTPNRQSHIDAIKDASSFSPKNPN

SEQ ID NO: 144329 - protein, 311 aa, Glycine max
  Coding DNA Sequence Number=SeqID_27551
  Gene Ontology: Mol. function=guanyl-nucleotide exchange factor activity
  Homolog annotation: Hit_ID=Q93ZY2; Match level="QueryCoverage=75%, HitCoverage=40%, E-value=1e-48, Identity=49%"; Hit description=Rop guanine nucleotide exchange factor 1
  Pfam annotation: Domain name=DUF315; Domain location=1-194; Score= -54.2; E_value=4.4e-11; Accession=PF03759.4; Description=Domain of unknown function (DUF315)
MAINNGALAEMEVLSHTWKRFLSSSNIVDSLLNFQNGRSCLGDFIYHYITSEKFSPECLLDCLDLSSEHVALEIANRVEASIYVWRRRRAHSKPPPNPNRSTTKSSWEIVKDFMADGDKRELLAERAENVLLSLKQRFPGLTQTTLDTSKIQCNKDVGKSILESYSRVLESMAFNIVARIDDLLYVDGLTKHSDRFPLVPMTVSVSGTPHKAIGGTPKSFSPAPPLISPARGERSPFLRNNHNNIKPQCRGFGVRRVLSNYLGAESKETKIVSNSTVMNGSNPSSNKAEQPERQKKSHAMNGKTKLTSEVV

SEQ ID NO: 144330 - protein, 356 aa, Glycine max
  Coding DNA Sequence Number=SeqID_27552
  Gene Ontology: Mol. function=guanyl-nucleotide exchange factor activity
  Homolog annotation: Hit_ID=Q93ZY2; Match level="QueryCoverage=76%, HitCoverage=50%, E-value=1e-102, Identity=66%"; Hit description=Rop guanine nucleotide exchange factor 1
  Pfam annotation: Domain name=DUF315; Domain location=2-353; Score =455.7; E_value=5.8e-134; Accession=PF03759.4; Description=Domain of unknown function (DUF315)
METLGNKGENFQKKKDGVPSSASDSTHEAKGCSPPPLGWPIRKATLSKCRKSDEKENEPVSHLEDSKFTTVSSKMSGIDAMKERFAKLLLGEDMSGSGKGVCSALAISNAITNLCATVFGQLWRLEPIPCEKKEMWRREMECLLSVSDHIVELIPSWQTFPDGSKLEVMTCRPRSDLFMNLPALRKLDNMLLEILDSWKDMEFWYVDQGIVAQDADGSASFYKRIQRQEDKWWLPVPRVPPSGLSENSRKQLNHTRECASQILKASMAINNGALAEMEVPESYLETLPKNGRTCLGDFIYHYITSEKFSPECLLDCLDLSSEHVALEIANCVEASIYVWRRRAHSKPPANPNRSST

SEQ ID NO: 144331 - protein, 142 aa, Glycine max
  Coding DNA Sequence Number=SeqID_27553
  Gene Ontology: Cellular component=integral to membrane
  Homolog annotation: Hit_ID=Q402F0; Match level="QueryCoverage=98%, HitCoverage=63%, E-value=4e-31, Identity=42%"; Hit description =Tobamovirus multiplication 1 homolog 3
  Pfam annotation: Domain name=DUF1084; Domain location=1-142; Score =114.1; E_value=4.1e-31; Accession=PF06454.2; Description=Protein of unknown function (DUF1084)
MEVPGLLFFSTYTLLVLFWAEIYHQVCLWIYMSVSKTAAGLEAAKLLLAVISFFAALAFLLYGGRLFFLLRRFPIESRGRQKKLYELALSAFDENSDLDVLDHPILNLMYYLLVEIVPSALVLFILRKLPPRRVSDQYHPIK

SEQ ID NO: 144332 - protein, 514 aa, Glycine max
  Coding DNA Sequence Number=SeqID_27554
  Gene Ontology: Mol. function=calcium ion binding; Cellular component =nucleus; Biological process=regulation of transcription, DNA -dependent
  Homolog annotation: Hit_ID=Q6NPP4; Match level="QueryCoverage=95%, HitCoverage=49%, E-value=1e-153, Identity=54%"; Hit description =Calmodulin-binding transcription activator 2
  Pfam annotation: Domain name=Ank; Domain location=130-162; Score=1.3; E_value=20; Accession=PF00023.20; Description=Ankyrin repeat
  Pfam annotation: Domain name=Ank; Domain location=163-195; Score =28.9; E_value=1.8e-05; Accession=PF00023.20; Description=Ankyrin repeat
  Pfam annotation: Domain name=IQ; Domain location=339-359; Score=23.3; E_value=0.00086; Accession=PF00612.17; Description=IQ calmodulin -binding motif
  Pfam annotation: Domain name=IQ; Domain location=362-382; Score=28.5; E_value=2.4e-05; Accession=PF00612.17; Description=IQ calmodulin -binding motif
  Pfam module annotation: Pfam domain module=Ank::Ank::IQ::IQ; Domain location=130-162::163-195::339-359::362-382
EVPAEVLADGILCCQAPPHKIGRVPFYVTCSNSEMELHLRLVGLLSLNSMHTLNQVFEGDMDKRNLIFKLISLKEEEEYSSKEETTAEMDISQQKLKEHMFHKQVKEKLYSWLLHKVTETGKGPLVLDEEGQGVLHLIAALGYDWAINPIITAGVNINFRDVNGWTALHWAAFCGRERTVAVLVSMDAAAGALTDPCPEFPLGRTPADLASSKGHKGISGFLAESLLTSHLESLTMDENKDGRKETSGMKVVQTVSERTATPVLNGDIPDDICLKDSLNAVRNATQAADRIYQVFRMQSFQRKQLALYEDDEFGLSDQQALSLLASKACRSGQGEGLANAAAIQIQKKFRGWTKRKEFLIIRQRIVKIQAHVRGHQVRKQYKPIIWSVGILEKVILRWRRKGSGLRGFRPASQNKVPEQPSESPKEDDYDYLKEGRKQSEVKFKKALSRVKSMVQYPEARAQYRRVLNVVEDFRQTKGGNLNLINSEETVDGVEDLIDIDMLLDDENFLPIAFD

SEQ ID NO: 144333 - protein, 157 aa, Glycine max
  Coding DNA Sequence Number=SeqID_27555
  Gene Ontology: Mol. function=transferase activity
  Homolog annotation: Hit_ID=Q1RZ42; Match level="QueryCoverage=86%, HitCoverage=41%, E-value=3e-25, Identity=37%"; Hit description =Transferase
MDNASLAISPFLPSTDFLHEYCKVERESIARLKMSLMKESGNGESTEKKGFTNFETLAAYIWSGGETTLTGSFVPWIYGNAIVQAFVTLTVKELNERPLLEVVKLIKDSIKDWRHLAMLEKVDFGWKEAVNSMPVPCGAAMSKFKEEMKAHNSIKNA

SEQ ID NO: 144334 - protein, 314 aa, Glycine max
  Coding DNA Sequence Number=SeqID_27556
  Gene Ontology: Mol. function=caspase activity; Cellular component =nucleus; Biological process=proteolysis
  Homolog annotation: Hit_ID=Q75LQ6; Match level="QueryCoverage=63%, HitCoverage=50%, E-value=1e-57, Identity=55%"; Hit description =Putative metacaspase
  Pfam annotation: Domain name=Peptidase_C14; Domain location=100-314; Score=99.0; E_value=1.5e-26; Accession=PF00656.12; Description =Caspase domain
MASRQVRCNQCGSVLMVPAAAVRVVECRVCHGMNQIRPSTGPWSQVYNSFHQFGGRLRSFVNTIMPGSVNRNPGYYYGTTPQLGYYPQPLRPSYNVFGPKRAVLCGIRYHGQDSQQLNGTVNDVKNMNMFLVKYCGFPRESILILTDDMEERDPLKFPTKYNIQMAMRWLIEGSQSGDSLVFHFAGHGAQEPDMSGDELDRSDEVICPVDSREQGNILDDEINATIVRPLPRGAKLHAVIDSCHSGTVLDLAYVWSLREGYWTWDYQYYRVRRPNKDTSGGVAICISGCHDDQSSKETPVCLKWWLCVYWRLYL

SEQ ID NO: 144335 - protein, 119 aa, Glycine max
  Coding DNA Sequence Number=SeqID_27557
MNGVLTYLFTKTIREYPGITYGGLLEKMHDEIKKINRSRCNNRILQHIFNRRIAQVGFHHHLLSLISNICIQFQAQHQWLWYRRISGFYYTKNELIRVHSRPILILVDSTMVINADVVV

SEQ ID NO: 144336 - protein, 472 aa, Glycine max
  Coding DNA Sequence Number=SeqID_27558
  Gene Ontology: Mol. function=transferase activity; Cellular component= nucleus; Biological process=paclitaxel biosynthetic process
  Homolog annotation: Hit_ID=Q1RZ42; Match level="QueryCoverage=97%, HitCoverage=96%, E-value=1e-125, Identity=52%"; Hit description =Transferase
  Pfam annotation: Domain name=Transferase; Domain location=6-463; Score=302.4; E_value=8.1e-88; Accession=PF02458.6; Description =Transferase family
MAYENATLTVANREVIFIKPSKPTPRTILSLSSIDNDPENNIFMQTLYVYQSPNYNSPNTTKLDPAKVIKEALSKALTYYYPLAGKLVKHADGKLRINCNTEGVPFIEAICNCNLSSLRYLDGNDVEIAKHFGIDFPSQDEFGNQYPLVFKVIKFLCGGFIFVVGCSHAVCDGTGLSQFLRAVAELASGKAEPSVKPVWERERLVGTFTSQPLRNPESYISTYHVHELPDVGLFLTPTTDYSHECCKVDGESITRLKMSLMKESDHGESTEKKGYTTFETLAAYIWRSRARALKLSYYGEAMLTIIVGARPHLKDPLPLGYYGNTTVEACVTLTVKELNERPLLEVVKLIRKTLKEVAFSSDYMRHSINSMEMKPMKFNYESGAILTLTDARHLGMLEKVDFGWKQPVNTMPVPCDMFGISGVWSIMAPSNLDPSMRASGGAKVYVCLPSATMPKFKEDMKALTRIQKRSSL

SEQ ID NO: 144337 - protein, 205 aa, Glycine max
  Coding DNA Sequence Number=SeqID_27559
  Gene Ontology: Mol. function=caspase activity; Cellular component =cytoplasm; Biological process=proteolysis
  Homolog annotation: Hit_ID=Q7XJE6; Match level="QueryCoverage=84%, HitCoverage=47%, E-value=3e-52, Identity=54%"; Hit description =Metacaspase 1
  Pfam annotation: Domain name=Peptidase_C14; Domain location=39-205; Score=54.0; E_value=5e-13; Accession=PF00656.12; Description=Caspase domain
MMTSSVNINQGYYGTTNQFGYYPQPPQSLRPSYHIYGSKIAVLCRIRYHGKSYRLKGSVNDVKCMKYFLIKEFGFLSDSILMLTDDRDERNQLRTPTKYNIQMTMRWLIEGSQSGDSMVFHFSGHGTLEMNMYGDEIDGFDEAICPVDYEEQGKILDDEINAAIVRPLPRGAKFHAFIDACHSGTVLGLAFVCKMNRSVLGMLAL

SEQ ID NO: 144338 - protein, 195 aa, Glycine max
  Coding DNA Sequence Number=SeqID_27560
VRYQQVRTEQVLKQQCGSVWGRQEKANWATQQHHQPQVQNRVRDLREFGYDYEAVKCTHVLPHSAWHPLQVKNQNTQQVPYFGSGSRPGLQGGSGVTKRGCAGTGVFLPRQYGAPPPESRKQTAAPVLVPAKVIHALNLKIDDLNSQPRFLGAFDVDYDALLARRNALLLQQKLSMLREEAANYEALSLPQEWTY

SEQ ID NO: 144339 - protein, 410 aa, Glycine max
  Coding DNA Sequence Number=SeqID_27561
  Gene Ontology: Mol. function=carbohydrate binding
  Homolog annotation: Hit_ID=Q10NJ9; Match level="QueryCoverage=96%, HitCoverage=97%, E-value=1e-109, Identity=51%"; Hit description =Lipase, putative, expressed
  Pfam annotation: Domain name=DUF620; Domain location=122-359; Score =523.1; E_value=2.9e-154; Accession=PF04788.3; Description=Protein of unknown function (DUF620)
MKKLCPNLTREDGLETVLEVPIPEEIFTIKSGTSRAWHNMKSWMKPNVESSRSSSLFGGQNTDIQLLLGVVGAPLIPLPITSHNQPITIKSHNTEASMAKYIVKQYVAAVGGESALNSVESMYAMGEVRVGSEFSAGEECVSSKKMGKKKPELWCLELVVSGYKISAGSDGKVAWRQTPFHHSHASRGPPRPLRRLLQGLDPRSTGNLFNNSICIGEKTVNNEECFILKLEADSNSLRTRSSSNVEIIRHTVWGYFSQRTGLLVQLEDSHLLKLKSNASDAIFWETNMESLIQDYRTVDGINIAHGGKTWVALSRFGEGPESHSRTRIKEVWQIEEVDFNIKGLSMDCFLPPRDLMRDEEKRVEECRVVASNSKLPYKIQSASSFKISVSKVAAVNVDDSSASETDDEDV

SEQ ID NO: 144340 - protein, 112 aa, Glycine max
  Coding DNA Sequence Number=SeqID_27562
  Gene Ontology: Mol. function=ATPase activity; Cellular component =integral to membrane; Biological process=transport
  Homolog annotation: Hit_ID=Q6K376; Match level="QueryCoverage=89%, HitCoverage=18%, E-value=5e-13, Identity=37%"; Hit description=ABC transporter-like protein
DDEKCFHKTVPKEVVDILVEFYKSSEISNQVQKEVAIIGESEIGFMERNRTRTAFLTQCHILMRRSSLHLFRDVSNYWLRLAMFVLAAISLGTIFFDVGSGDASIEVKQNST

SEQ ID NO: 144341 - protein, 58 aa, Glycine max
  Coding DNA Sequence Number=SeqID_27563
MIYAKELKDEDVIMQDATNILILIGIENGSPWPWPLVVAGYRATRAMWSDFISDYWSS

SEQ ID NO: 144342 - protein, 82 aa, Glycine max
  Coding DNA Sequence Number=SeqID_27564
MRFQGLEFIQSPFYVRLNCIFKAPPPSHLVKVPRALSAITPVEAKLHDESRFIQRCFDDNKDDHKGDDKNLKGQRMSSRCSR

SEQ ID NO: 144343 - protein, 329 aa, Glycine max
  Coding DNA Sequence Number=SeqID_27565
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=7e-42, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TTRPRLQRATRPRLLRATRPYHQKATRPRLAFRGLHIFAIRGLHVLAFRGLHALAFRRLHVLAFRGLHLHAFKGLHLLAFRGLHILAIRGVHILAFRGLHVLAFRGLHAHTFTVRHVLTFRGLHAFALRGPHILAFRGLPMLAIRELHVPAFRGLQVLAFRGLHVVLAIRGLLALAFRGLHVLPFRGLHVLAIRVLHALALRALHILAFRGLHALAFRGLHVVAFRELHVLAFRGLHVLTFRGLHVLAIRGLHALAFSGLHVLAFRGLHVLTFIGLDVLAFRGLHALTFRGLHALAFRGLHVVALRELHVLAFRGLHVLTFRGLHVLAI

SEQ ID NO: 144344 - protein, 346 aa, Glycine max
  Coding DNA Sequence Number=SeqID_27566
MKRGIEIVGVQCLENGENMTLGSECGPQEEDATNGMEGRSNGVQEQPISGDNGVLTMIEEFKTPFDVTNVVLEESEDQAMEGDIEEEQLQRETKGLLEKIRDEGRTDMAQERGEYVEGICGGKNESDKKFGSAVEDMEMEVAWEDTHSGIIEGNEEDLGKEEDPNVCEEMLHSKNDESKDTMLEGKESDNTNDSLVEPMAEPSELQIPAEPIRDLPIEALVYNISVDEDSSEVISENIGIPRSLRRIVLLHCPMRKSQLHELNEGMYPLDAEAREIANESALDLFDGNQIDHDEYAYTIDLNEGSSNVVRHTNSMQVLVSSVEEESRPSKCSSAENHVCPSQEVRI

SEQ ID NO: 144345 - protein, 598 aa, Glycine max
  Coding DNA Sequence Number=SeqID_27567
  Gene Ontology: Mol. function=DNA binding; Cellular component=beta -galactosidase complex; Biological process=DNA integration
  Homolog annotation: Hit_ID=Q1SDN3; Match level="QueryCoverage=95%, HitCoverage=43%, E-value=0.0, Identity=59%"; Hit description =Polynucleotidyl transferase, Ribonuclease H fold
  Subcellular localization annotation: CTP_CleavageSite=82; ConfidenceScore=5.48e-01
MSVDHSQLDSSNTSSNPLNSPIIVPPRRSNRDRTRPKKFQDFHTTFTLAVTGQSSGIHYPLAYVLSYKNLSPTYHSFIMVVSSETEPKSFKEASQSDKWIKAMNAEIEALKANHTWILTDLPPNKSAIGCKWVYKIKHKADGSMERYKARLVAKRYTQIEGQDYLDTFSPVAKITIVRLLLVLAAVNNWHLQQLNVNNAFLHGDLNEEVYMALPPGMHSTKSDQVCRLQRSLYGLKQTSRQWYARLSTFLISHGYRQCFSDHSLFIKQYLQSFTALLVYVDDIVLPGNDLLEIKSITQLLDQVFKIKDLGDLKFFLGLEVARSKQGINICQRKYILDILHDAGMLGSKPVSTPIDYAVRLHQQSGIPLDDTTASSYRRLIGRLIYLTNTRSDITYAVQHLSQFVAHPSLAHQQAAYRILRYLKAAPGSGIFFPASSTLQLKAFSDSDWAGCVNTRQSITGYSVYLGNSLISWKSKKQATVSRSSSEAEYRTLASATCELQWLTHLLNDFGIVYTQPTLLFCDNRSALHIAANPVFYERTKHIEIDCHIVREKLHSGLIKLLPIASAQQLADIYTKALPPGAFHFLQCKLGMSDIHSPA

SEQ ID NO: 144346 - protein, 386 aa, Glycine max
  Coding DNA Sequence Number=SeqID_27568
  Gene Ontology: Mol. function=ubiquitin thiolesterase activity; Cellular component=intracellular; Biological process=ubiquitin -dependent protein catabolic process
  Homolog annotation: Hit_ID=Q6K6Z5; Match level="QueryCoverage=88%, HitCoverage=97%, E-value=1e-130, Identity=73%"; Hit description =Putative ubiquitin C-terminal hydrolase
  Pfam annotation: Domain name=Peptidase_C12; Domain location=77-260; Score=278.2; E_value=1.6e-80; Accession=PF01088.11; Description =Ubiquitin carboxyl-terminal hydrolase, family 1
VECGRTLNYRLTVQKQNLNPTGPGIKGREESNKVASNSLESCLGAPLSPIPGSRSVLFDIDADWYILLDFDFASFSSQVEELYSLDLDSLNSLRPVYGLIFLFKWRPGEKDDRVVIKDPNPNLFFASQVINNACATQAILSILMNSPDIDIGPELTKLKEFTKNFPPELKGLAINNSEAIRTAHNSFARPEPFVPEEQKVASKDDDVYHFISYLPVDGVLYELDGLKEGPISLGQCSGGQGDMEWLKMVQPVIQERIERYSQSEIRFNLLAVIKNRKEMYTAELKELQKRRERILQQLAASKSDRLVDNSSFEALNNSLSEVNAGIEAATEKILMEEEKFKKWRTENIRRKHNYIPFLFNFLKILAEKKQLKPLIEKAKQKTSSPR

SEQ ID NO: 144347 - protein, 303 aa, Glycine max
  Coding DNA Sequence Number=SeqID_27569
  Gene Ontology: Mol. function=protein kinase activity; Cellular component=cytoplasm; Biological process=protein amino acid phosphorylation
  Homolog annotation: Hit_ID=Q5QLZ5; Match level="QueryCoverage=95%, HitCoverage=84%, E-value=9e-85, Identity=69%"; Hit description =Putative kinase-like protein splice variant 1
MFKFLKEVVSGSGTGLKDLPYNTGEPYASAWGSWLHFRGTSKDDGSPVPIFSLSGSKAQDGHLAAGRNGVKSLRTVRHPNILSFLHSTEIETVDAGSPKVTIYMVTEPVMPPLDKIKELSLEGTQRDEYYAWGLHQIAKAVSFLNNDCKLVHGNVCLASVVVTQTLDWKLHAFDVLSEFDGSNEASSGQMLHRFLGMRLKGPECPYSLADQTVDTPSTAPVGVSSTPDFAEHPVPTSPTSTDVWGELENGLDEERENDKDGWDDLEPLEEIKPAPALAKIQAAQRRPVPQPDSQLKTRYWLFN

SEQ ID NO: 144348 - protein, 136 aa, Glycine max
  Coding DNA Sequence Number=SeqID_27570
MNSLSEHAALSESILIVCKRFSEELAKRAYRAKRMSSKKRKSISARPTAQYDTRRFHYFEAWTRYTDNVLGRYILAKRKVQIYHMELDEFKAELERHNFHKRLTNFADSSIDLALVKEFYANLYSPKGPSPKQVRI

SEQ ID NO: 144349 - protein, 114 aa, Glycine max
  Coding DNA Sequence Number=SeqID_27571
  Homolog annotation: Hit_ID=Q1R9V0; Match level="QueryCoverage=100%, HitCoverage=65%, E-value=9e-28, Identity=52%"; Hit description =Hypothetical protein yehS
  Pfam annotation: Domain name=DUF1456; Domain location=3-70; Score =124.5; E_value=2.9e-34; Accession=PF07308.3; Description=Protein of unknown function (DUF1456)
MTNNDVLRSVRYMLDLSDSKVVEIFALAGSEVPREDVQAWLKKDDDETFRKLPDVLMGYFLNGLIFYRRGKSEDAPAPSVERRMNNNIFLKKLRIAFALKTTDIPDILLKANFK

SEQ ID NO: 144350 - protein, 122 aa, Glycine max
  Coding DNA Sequence Number=SeqID_27572
  Pfam annotation: Domain name=DUF947; Domain location=2-122; Score= -32.8; E_value=0.00072; Accession=PF06102.2; Description=Domain of unknown function (DUF947)
MLKDSCSDLYHSAYQEVSRFRKRYNFLYENDLPAERQALKKELKKYKDPKRVNEIEERISWIDKQVKSDSAKHIDAEISAKHKKKEREAAKQGKRPFYLKKCQSSSFLALSFPPLFLPICRK

SEQ ID NO: 144351 - protein, 87 aa, Glycine max
  Coding DNA Sequence Number=SeqID_27573
MSRELHPLRAWHSRQIERMRPCQEICTSVYKCHTLVHIVLVDRPDATPITISIATFLGDLHLVDNWVVNKDRGDHTNMTSEEEEVYH

SEQ ID NO: 144352 - protein, 41 aa, Glycine max
  Coding DNA Sequence Number=SeqID_27574
MVYPSGTRHESLKHVVKGLNPDECIYGENLVEREIPLMSAN

SEQ ID NO: 144353 - protein, 75 aa, Glycine max
  Coding DNA Sequence Number=SeqID_27575
MRLFRSLVRKTLTSSGKVQMTTALTACYQTLSLMDSERVCVGYHIGRLRVPTDSQVTIAKGGAVDKSEAFAPTYP

SEQ ID NO: 144354 - protein, 69 aa, Glycine max
  Coding DNA Sequence Number=SeqID_27576
MRFWIFSISLLNGHLEETLGSTKIEENHSKCIDLTQGKDGHSHPGSVGLASGSGIKGMSHIISMTHMQQ

SEQ ID NO: 144355 - protein, 103 aa, Glycine max
  Coding DNA Sequence Number=SeqID_27577
MAKVSTEAIASLTQYYDQPLRCFTFGDFQLTPTNFQNSQNLDTGIEPGEESRKWGGWSTKEMFGSKGKNLGKSRAWASWAATTFLFSPINRGKRAEQKCSALL

SEQ ID NO: 144356 - protein, 127 aa, Glycine max
  Coding DNA Sequence Number=SeqID_27578
  Gene Ontology: Mol. function=RNA-directed DNA polymerase activity; Biological process=RNA-dependent DNA replication
MMGEMCEDFKIQHHNSTPYRPKMNGAVEVANKNIKKIIQKMIVSYKDWHEKLPFALHVRMRRFSEGDLVLKKVSQALKDNRGKWAPNYEGPFVVKRAFSGGALVLTNMDCEELPSPVNSDVVKRYYA

SEQ ID NO: 144357 - protein, 165 aa, Glycine max
  Coding DNA Sequence Number=SeqID_27579
  Homolog annotation: Hit_ID=Q6K4D4; Match level="QueryCoverage=84%, HitCoverage=16%, E-value=2e-33, Identity=52%"; Hit description =Proliferating-cell nucleolar protein-like
SAHEEVFKAVSEENVDDAEPNTEDLEVGPVTCEEQNSKETQEPDNVQNTAKRVPGKRKLQIQGKWRGVDPVVFFKDETIINSIRDFYGIDERFPFNGHLVTRNSDTNHVKRIYYISKSVKDVLELNFKVGQQLKITSIGLKMFALKTDLGKGDKFSQNLISKSDV

SEQ ID NO: 144358 - protein, 515 aa, Glycine max
  Coding DNA Sequence Number=SeqID_27580
  Gene Ontology: Mol. function=tRNA (cytosine-5-)-methyltransferase activity; Cellular component=nucleus; Biological process=ribosome biogenesis and assembly
  Homolog annotation: Hit_ID=Q6K4D4; Match level="QueryCoverage=92%, HitCoverage=59%, E-value=1e-180, Identity=61%"; Hit description =Proliferating-cell nucleolar protein-like
  Pfam annotation: Domain name=Nol1_Nop2_Fmu; Domain location=107-396; Score=26.0; E_value=2e-09; Accession=PF01189.8; Description =NOL1NOP2sun family
MGGGGRGGRSRTQRKHFRQSRENVWKRSKSDPDPSSTENNPAWTPFATENAAFDFYYKEQGIVDLQYWDQFVPLLRTPLPATFRINSSSRFYDDLRSQLENDFVHSLRDEVVEGGETEAIRPLLWYPGNFAWHSNFSRMQLRKNQTLERFHEFLKLENEIGNITRQEAVSMVPPLFLDVHSDHFVLDMCAAPGSKTFQLLEIIHQSSKAGSLPDGMVIANDLDVQRCNLLIHQTKRMCTANLIVTNHEAQHFPGCRLNRNYERMELDHDIGQLLFDRVLCDVPCSGDGTLRKAPDLWRKWNTGMGHGLHSLQVLIAMRGLSLLKIGGRMVYSTCSMNPIENEAVVAEVLRRCGGSVKLLDVSSELPQLIRRPGLRRWKVYDKGTWLVSYKDVPKYRRSVILSSMFPSGRGHHDLVDSSCSVDPEGVTNGINGNAGDGVQAVENPVMSESGAEVCDFPLERCMRIVPHDQNTGAFFIAVLQKVSPLPGSFSYDHILFLSLWSVNRIVMNILVNIGQ

SEQ ID NO: 144359 - protein, 221 aa, Glycine max
  Coding DNA Sequence Number=SeqID_27581
  Gene Ontology: Mol. function=kinase activity; Cellular component =nucleus; Biological process=regulation of progression through cell cycle
  Homolog annotation: Hit_ID=Q39877; Match level="QueryCoverage=99%, HitCoverage=63%, E-value=4e-91, Identity=76%"; Hit description =Mitotic cyclin a1-type
  Pfam annotation: Domain name=Cyclin_N; Domain location=84-213; Score =208.1; E_value=2.1e-59; Accession=PF00134.13; Description=Cyclin, N -terminal domain
MQTRAAAKRKANADTVVVTVEKQHPKKQRVVLGELTNIPNLILPETQSPRKEKLQCRKNPNVKKPSPTNNTLSSPHIDEPYVSDINDYLCAMEMQRKRRPMFNYMDRVQHVVTENMRGILVDWLVEVAVEYKLLSETLHLSVSYIDRFLSVNPMGKSRLQLLGVSSMLIASKYEEVNPPRVDKFCSITDNTYKKAEVVEMEAKILAALNFEIGNPTAITFL

SEQ ID NO: 144360 - protein, 121 aa, Glycine max
  Coding DNA Sequence Number=SeqID_27582
MASIYSLSVTLSDPNFVRRLSFMDILILASRNELFDTNYRARRKIILCFGQGCEDRGKRVFLGFFLDPNSPRLAWAPKWLRAEVTNSPGQARLLQSEASAHLGELQVHQVPFFAINRCDGG

SEQ ID NO: 144361 - protein, 286 aa, Glycine max
  Coding DNA Sequence Number=SeqID_27583
  Gene Ontology: Mol. function=kinase activity; Cellular component =nucleus; Biological process=regulation of progression through cell cycle
  Homolog annotation: Hit_ID=Q39877; Match level="QueryCoverage=94%, HitCoverage=83%, E-value=8e-75, Identity=53%"; Hit description =Mitotic cyclin a1-type
  Pfam annotation: Domain name=Cyclin_C; Domain location=195-286; Score= 31.7; E_value=2.6e-06; Accession=PF02984.9; Description=Cyclin, C -terminal domain
  Pfam annotation: Domain name=Cyclin_N; Domain location=65-193; Score =210.6; E_value=3.5e-60; Accession=PF00134.13; Description=Cyclin, N -terminal domain
  Pfam module annotation: Pfam domain module=Cyclin_C::Cyclin_N; Domain location=195-286::65-193
MESRAAKRRANQSQNEPLTKRRVVLGELSNLPNLILPQPAVTDKTLTVHNGVSAESNVNAPIVSDIYNYLRTIEMEKRRPMVDYIENVQKEVTTIMRAILVDWIVEVAEEYKLLSDTIFLSVSYIDRVLSINPVSKPRLQLLGISSMFIASKYEEISPPHVEEFCFITDNTYDKTEVVSMEADILKALNFELGNPTVKTFLRRFTGIACENKKASSLQFEFMSYYLAELSLLEYCCLKFLPSLVAASVVFLARFIIWPDLQPWSCQIKACGLRLLEVVVIIVTTIL

SEQ ID NO: 144362 - protein, 346 aa, Glycine max
  Coding DNA Sequence Number=SeqID_27584
  Gene Ontology: Mol. function=kinase activity; Cellular component =nucleus; Biological process=regulation of progression through cell cycle
  Homolog annotation: Hit_ID=Q39877; Match level="QueryCoverage=99%, HitCoverage=100%, E-value=1e-156, Identity=80%"; Hit description =Mitotic cyclin a1-type
  Pfam annotation: Domain name=Cyclin_C; Domain location=212-339; Score= 174.8; E_value=2.2e-49; Accession=PF02984.9; Description=Cyclin, C -terminal domain
  Pfam annotation: Domain name=Cyclin_N; Domain location=83-210; Score =216.2; E_value=7.3e-62; Accession=PF00134.13; Description=Cyclin, N -terminal domain
  Pfam module annotation: Pfam domain module=Cyclin_C::Cyclin_N; Domain location=212-339::83-210
METRAASKRKANAATIVIVEKQHPKRQRVVLGELSNLPNIIVPETQNPRKEKLQCRKNPNMKKPSLTNNTLSFPQIDESYDFEIFEYLHAMERKRRPMIDYVEKVQKQVTTTMRAILVDWLVEVAEEYKLLPDTLHLSVSYIDRFLSVSPVSKSRLQLLGVSSMLIAAKYEEVDPPRVDAFCNITDNTYHKAEVVKMEADILKTLKFEMGNPTVNTFLRRFADVASENQKTPNLQIEFLIGYLAELSLLDYDCLIFLPSILAASAIFLARFIIWPEVHPWTSSLSECLGYTPADLKECVLILHDLYLSRKAVSFKAVREKYKQHKFKYVANLPSPPHVPSYYFEEQ

SEQ ID NO: 144363 - protein, 162 aa, Glycine max
  Coding DNA Sequence Number=SeqID_27585
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=19%, E-value=9e-14, Identity=47%"; Hit description=Chromo
MTSAEMQLRRERGLCFTCDDKFSPSHRCPNKQYFVPQWEEEDEPALQPDPPDEVLVGNGNAFTAEGLIQDLEMKIQGHTLKLPVYLLPVSGADLVLGAAWLATIVPDLSDYSTLTLKFYLGLPPRRTHNHSIPLVEGAGPVKVKPYRYPHSRKDQIEVINDS

SEQ ID NO: 144364 - protein, 401 aa, Glycine max
  Coding DNA Sequence Number=SeqID_27586
  Gene Ontology: Mol. function=protein binding; Cellular component =integral to membrane; Biological process=protein amino acid phosphorylation
  Homolog annotation: Hit_ID=Q1ST34; Match level="QueryCoverage=98%, HitCoverage=95%, E-value=3e-65, Identity=40%"; Hit description =Leucine-rich repeat
  Pfam annotation: Domain name=LRR_1; Domain location=114-136; Score =8.5; E_value=7.3; Accession=PF00560.23; Description=Leucine Rich Repeat
  Pfam annotation: Domain name=LRR_1; Domain location=12-34; Score =12.3; E_value=1.4; Accession=PF00560.23; Description=Leucine Rich Repeat
  Pfam annotation: Domain name=LRR_1; Domain location=138-160; Score =15.3; E_value=0.22; Accession=PF00560.23; Description=Leucine Rich Repeat
  Pfam annotation: Domain name=LRR_1; Domain location=162-184; Score =11.4; E_value=2.1; Accession=PF00560.23; Description=Leucine Rich Repeat
  Pfam annotation: Domain name=LRR_1; Domain location=191-212; Score =11.5; E_value=2; Accession=PF00560.23; Description=Leucine Rich Repeat
  Pfam annotation: Domain name=LRR_1; Domain location=214-235; Score =9.0; E_value=5.8; Accession=PF00560.23; Description=Leucine Rich Repeat
  Pfam annotation: Domain name=LRR_1; Domain location=238-260; Score =8.8; E_value=6.4; Accession=PF00560.23; Description=Leucine Rich Repeat
  Pfam annotation: Domain name=LRR_1; Domain location=262-284; Score =5.6; E_value=26; Accession=PF00560.23; Description=Leucine Rich Repeat
  Pfam annotation: Domain name=LRR_1; Domain location=291-312; Score =8.5; E_value=7.3; Accession=PF00560.23; Description=Leucine Rich Repeat
  Pfam annotation: Domain name=LRR_1; Domain location=314-336; Score =11.4; E_value=2.1; Accession=PF00560.23; Description=Leucine Rich Repeat
  Pfam annotation: Domain name=LRR_1; Domain location=338-361; Score =9.9; E_value=4; Accession=PF00560.23; Description=Leucine Rich Repeat
  Pfam annotation: Domain name=LRR_1; Domain location=363-383; Score =9.0; E_value=6; Accession=PF00560.23; Description=Leucine Rich Repeat
  Pfam annotation: Domain name=LRR_1; Domain location=37-59; Score=9.4; E_value=4.9; Accession=PF00560.23; Description=Leucine Rich Repeat
  Pfam annotation: Domain name=LRR_1; Domain location=61-83; Score=7.5; E_value=11; Accession=PF00560.23; Description=Leucine Rich Repeat
  Pfam annotation: Domain name=LRR_1; Domain location=91-112; Score =19.0; E_value=0.017; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1; Domain location=114-136::12-34::138-160::162 -184::191-212::214-235::...
  Pfam module annotation: Domain location=238-260::262-284::291 -312::314-336::338-361::363-383::37-59::61-83::91-112
MILQWLSNVTSNLVELDLSYNLLEGSTSNHFGRVMNSLEHLDLSYNIFKADDFKSFANICTLHSLYMPANHLTEDLPSILHNLSSGCVKHSLQDLDLSDNQITGSLPDLSVFSSLKSLFLDQNQLRGKIPEGIRLPFHLESLSIQSNSLEGGIPKSFGNSCALRSLDMSGNNLNKELSVIIHQLSGCARFSLQELNIGGNQINGTLSDLSIFSALKTLGLSRNQLNGKIPESTKLPSLLESLSIGSNSLEGGIHKSFGDACALRSLHMPNNSLSEEFPMIIHHLSGCARYSLERLYLSMNQINGTLPDLSIFSSLRGLYLEGNKLNGEIPKDIKFPPQLERLDMQSNSLKGVLTDYHFANMSKLDHLELSDNSLVTLAFSQNWVPPFQLRFIGLRSCKLGP

SEQ ID NO: 144365 - protein, 128 aa, Glycine max
  Coding DNA Sequence Number=SeqID_27587
  Gene Ontology: Mol. function=zinc ion binding
  Homolog annotation: Hit_ID=Q2HRJ4; Match level="QueryCoverage=80%, HitCoverage=28%, E-value=6e-27, Identity=54%"; Hit description=Zinc finger, RING-type
SITLRYGYYGDSCILLGPASSRLMKTSSVFVKQLQVSNEDNNQVILHAFNEEPELSSQTNWTVSNFFLVEAYKSKGSTIRMRWEAHTTSSLDQLHGMVIKGEKKFELLQPKQTSFLNAIALRKTVNGN

SEQ ID NO: 144366 - protein, 173 aa, Glycine max
  Coding DNA Sequence Number=SeqID_27588
MVWTADSSGLLWVSWAYRALLDLQYPSEHSVLSAIWKLNVAPKIKFFIWRIALNRVATGELEKEGTSATLSHGGCASRIDQHIWMLCGPQDMLAISGAGQHVSEGDISIRRDMVDFEGLTMESHASCCKCKGNSLRASESDGFSLPLRAFLCHCKVNVVLRTVRTDTNLGIRF

SEQ ID NO: 144367 - protein, 476 aa, Glycine max
  Coding DNA Sequence Number=SeqID_27589
  Gene Ontology: Mol. function=transporter activity; Cellular component= integral to membrane; Biological process=iron ion transport
  Homolog annotation: Hit_ID=Q9C6B2; Match level="QueryCoverage=91%, HitCoverage=83%, E-value=0.0, Identity=80%"; Hit description=Metal transporter Nramp2
  Pfam annotation: Domain name=Nramp; Domain location=79-442; Score =709.8; E_value=2e-210; Accession=PF01566.9; Description=Natural resistance-associated macrophage protein
MSAPSREEESEANRLLEEAASSWEEEVAYEAGEKILVADLEFDRVDDGSAPPPFSWKKLWLFTGPGFLMSIAFLDPGNLEGDLQAGAIAGYSLLWLLMWATFMGLLIQLLSARVGVATGRHLAELCRDEYPNWARLVLWFMAELALIGADIQEVIGSAIAIQILSRGFFPLWAGVLITASDCFFFLFLENYGVRKLEAAFAVLIAVMGLSFAWMFGDAQPNREELLMGILVPRLGSKTIRQAVGVVGCVIMPHNVFLHSALVQSRKVDPKKIGRVQEALNYYSIESSAALAVSFMINLFVTTVFAKGFYGTKQADSIGLVNAGQYLEEKYGGGVFPILYIWGIGLLAAGQSSTITGTYAGQFIMGGFLNLRLKKWLRALITRSFAIVPTIIVAIVFNRSEGSLDVLNEWLNVLQSMQIPFALIPLLTLVSKEQIMGTFRVGPVLELEISISLVKNGFVTLSSLAARVNLIIKSRFI

SEQ ID NO: 144368 - protein, 135 aa, Glycine max
  Coding DNA Sequence Number=SeqID_27590
  Gene Ontology: Mol. function=zinc ion binding
  Homolog annotation: Hit_ID=Q2HRJ4; Match level="QueryCoverage=68%, HitCoverage=25%, E-value=1e-19, Identity=50%"; Hit description=Zinc finger, RING-type
  Pfam annotation: Domain name=zf-C3HC4; Domain location=75-114; Score =17.6; E_value=0.0024; Accession=PF00097.15; Description=Zinc finger, C3HC4 type (RING finger)
LKFLEVHEGGDQNSHAAVDVTYRTSNVVARQTETQPLMQVETNRLTYGTNAKDDEEEDSGASSSSSEELYDEKLCCICYDEQRSSFFVPCGHCATCYDCAQRILDEESIVCPICRRLIHKGNELLILWLGQSSSN

SEQ ID NO: 144369 - protein, 137 aa, Glycine max
  Coding DNA Sequence Number=SeqID_27591
  Gene Ontology: Mol. function=transition metal ion binding; Cellular component=endoplasmic reticulum; Biological process=electron transport
  Homolog annotation: Hit_ID=Q9M5B0; Match level="QueryCoverage=79%, HitCoverage=77%, E-value=3e-27, Identity=57%"; Hit description =Cytochrome b5 DIF-F
  Pfam annotation: Domain name=Cyt-b5; Domain location=15-78; Score =30.2; E_value=7.3e-06; Accession=PF00173.18; Description=Cytochrome b5-like HemeSteroid binding doma
MVSKLLMVGRLSSDSIKKSDRQAMEGVLDVTKFLEEHPGGEEVILEVAGKDATKEFDVIGHSKAAQNMVLKYQVGVLQGATVQEVDLKDVVDKESNTKEMSAFVIKEGARSKSLAFYEFFVPLLVAGLYFGYRCLTY

SEQ ID NO: 144370 - protein, 155 aa, Glycine max
  Coding DNA Sequence Number=SeqID_27592
  Subcellular localization annotation: CTP_CleavageSite=67; ConfidenceScore=5.06e-01
MKVIRQVQLKTQSSVGMPLNLLGLGAGGGCGVGVGLGWGFGAAFGSKYRSSRVTFQGVDFDRKEKVNSTELSKPSTEVREACGDSNCDFRVSIIVLSNRSTTVLVAALISWIMVALGKQFDMHASFGAREISGNRDEIGNGVFDGVEFGNKKEKV

SEQ ID NO: 144371 - protein, 603 aa, Glycine max
  Coding DNA Sequence Number=SeqID_27593
  Gene Ontology: Mol. function=binding
  Homolog annotation: Hit_ID=Q6L4Y6; Match level="QueryCoverage=87%, HitCoverage=90%, E-value=1e-151, Identity=50%"; Hit description =Putative tetratricopeptide repeat (TPR)-containing protein
  Pfam annotation: Domain name=Arm; Domain location=136-177; Score =22.9; E_value=0.0011; Accession=PF00514.13; Description =Armadillobeta-catenin-like repeat
MKSQMKKKRVNPIPNTPCNVAEGSCRGHLCIKPCCFFCSMREPDASLRRAGIATCFREMPQAQGENHHEHVLVLSGLWHIAMSQPNDSEFPSLGIFKCMASLIHKGINDRNWLLTNQNIYIPYYAAHIIGSYTMNKEEFAQKAVQSGVIPPLLDLLSGKISWVEQRVAVRALGHLASYKSTFESVAQHEQEVVKLALKLASTCLQVVYVDFVALKENKRLEYHRNLMTRGVGDLEMENRKAEEWASQLQCWSLYLLNCFACKDRSLDLICKKVFLKDLCDMWGGLISHTSPAGVGLIRILCYSKVGRKNIAELPKVVNTLGNLSRSSDDWQYIGIDCLLLLLKDPDTRYKVLDVAASYLVDLIELRSLGDKSNVGETISKVLLNLKPNREKVGAALLQEVVDRRNKDKLLSEEKLEETRVLVSLIKQQANHMFRLGEVEEALLKYSEALGVCPLRFRKERMVIYSNKAQCHILLKNADSAISDSTRALCLSNPANTHRKSLWRRSQAYDMKGMAKESLMDCIMFINMTMRVKIPYHAARMISKHMEATWLFATARSKVEKTTQELNQVGGDNENGGNHEEQPRDHEAKMMMMENRYNNLLHGN

SEQ ID NO: 144372 - protein, 137 aa, Glycine max
  Coding DNA Sequence Number=SeqID_27594
MTPSYNEKVYNLISVGSDFCHSYFHFTDQIVLLLLPDFYCVAVAVTAPRHFQQVALVCSRFQTQRWRLSTIFVPVGPNPTSYMTTAMQHQRYSLSRENFHSKCKLISIANVNHLNNQGEIQGMQSMDLPDGDDQKKN

SEQ ID NO: 144373 - protein, 885 aa, Glycine max
  Coding DNA Sequence Number=SeqID_27595
  Gene Ontology: Mol. function=transcription initiation factor activity; Cellular component=transcription factor TFIID complex; Biological process=transcription initiation
  Homolog annotation: Hit_ID=Q6SJR0; Match level="QueryCoverage=98%, HitCoverage=100%, E-value=1e-140, Identity=38%"; Hit description =TATA-binding protein associated factor 4b
  Pfam annotation: Domain name=TAF4; Domain location=580-877; Score =347.7; E_value=1.9e-101; Accession=PF05236.4; Description =Transcription initiation factor TFIID component TAF4 family
MDPSIVKLLEDDEDESMHSGADVEAFQAALNRDIGGDTSTSQLSGSDTGSNNSLSQSLPKWPTSSHDNQSDCHNQEPKVVQHQEQRHSSEMEQKPQQPLVEQLHNVASKDAINLPSSQKQSQDESVQGHTVQAPHQNSQTNGIQNSEKDPVFNHEAVNTHNSNHGSQYAKLQQMSNQQATVNEQPGSQVNRNKQKDEMPKDQFVRLMKGIVGDQMLRLALTKVQLQTRSNPGPAGQQHPPVRMPNVNSGATKFNDPHALAQLHQRSMNAAADQSNNTSSAVQVKNEPTYPTMEINAKKSQKLDVQVESEGVQLNQLPSSSSNAVSQEMERSSLHLQGLNKEQQQHLHFPSAYGSSGGNYNPFSGSTSSSTSSLRPQPLDSHMRQIPHQSISPNQLGGTTQGLIGLTKLDQQNSFNDPKRMPGGFVSPMVNNTASQLTTNSWQPSANKEQNSASFSSVPYVKKEPNDLSTEQQHRHNVSNQGTLKEEFSRGLPASTSMLHTTSSSLLPLNSSSPSVSQLDPSATLSSQIPSNTSVINARTPLKKPSPGQKKPIEALGSSPPPPSKKQKVSGASLEPSIEQLNDVTAVSGVDLREEEEQLFSGPKEDSRASEAFRRVVQEEEERLILQKAPLQRKLIEIITECGLKSMSDDLERCLSLCVEERMRGVISNVIRMSKQRVDLEKTRHRTVVTSDVRQQILTMNRKAREEWEKKQAETEKLRKLNDVDCNAGIDGDKEKDEGRTKAMKVNKEVDDKMRTNAANVAARAAVGGDDMLSKWQLMAEQARQKKRGGGMDASSGSQPAKDVSHRSSSTSGRSTKDNQAREKKGPTSGAGRKFGRSHATTPQTSIARSISVKDVIAVLEREPQMSKSSLLYRLYERIHSDTSTE

SEQ ID NO: 144374 - protein, 185 aa, Glycine max
  Coding DNA Sequence Number=SeqID_27596
  Homolog annotation: Hit_ID=Q0PN09; Match level="QueryCoverage=60%, HitCoverage=48%, E-value=6e-37, Identity=66%"; Hit description =Lateral organ boundaries domain protein
  Pfam annotation: Domain name=DUF260; Domain location=19-124; Score =91.8; E_value=2.1e-24; Accession=PF03195.5; Description=Protein of unknown function DUF260
MVFLYDKDSPRQQKRKSMSCNGCRVLRKRCSERCSLRSSLNWIDCPHAQAHATLFLAKFFGRSDLMFFISSVPLNNRPALFQSLLFEACGRTVNPVNGAVGLLLSGNWHVCQAAVHTVLAGGVLRPLSEVVAPSESMFSHQFQSLASDSLKRSSDATAPVMSTMVSGESEICSSDDGKKLLNLFV

SEQ ID NO: 144375 - protein, 87 aa, Glycine max
  Coding DNA Sequence Number=SeqID_27597
MVGTDDRNKEKITTFDIMGVCERKRKKKGNCSDDVDSNSVEKVVAMWEMRLSLKLLLAALNGKDSAVAMCRFCRLMGTTSAELLLNR

SEQ ID NO: 144376 - protein, 256 aa, Glycine max
  Coding DNA Sequence Number=SeqID_27598
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=7e-29, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TLTGRGPRVLPFRWLHALTFRGLHVLAFRGLHALAFRGLHAFTFRGLRVLTFRGLHDFVFRGLHVLTFKRLHVLVFRGLHILVFKGRHSLAFRGLHILAFRGLHALAFRGLHALTFKGLRVLTFRGFHDLAFRGLHVLTFRGLYVLTFRGPHILTFKRLHVLIFRGLHVLVFNGRHALAFRGLHVLTFRRLHDLAFRGLHVLTFRGLRVLAFRGLHVLTVGGLHVLTFRGLHVLTFQGLLVLTFKRAARPHLQRTT

SEQ ID NO: 144377 - protein, 256 aa, Glycine max
  Coding DNA Sequence Number=SeqID_27599
  Homolog annotation: Hit_ID=Q10Q92; Match level="QueryCoverage=71%, HitCoverage=17%, E-value=5e-33, Identity=46%"; Hit description=CUE domain containing protein, expressed
  Subcellular localization annotation: CTP_CleavageSite=73; ConfidenceScore=5.60e-01
MSNRSSQGRQHDNNNNKGFAKTHNQKKFVPKNQSQNPNPNPTPTLSTSLRQTQPNRGQKGNFVKYLPQDEAVAAGLGAEDGALDPLESQRVVDLLNTQLSRLLKLKPKQFWTQVATDTSLHELLDSFLQFRSRWYDFPHRGVQGIVAGVIVGELELSRRVFMVLYRISSNKDPGARPVDALSLRDHEVPNRPYNWLVVDKSGQLQAKVEKKLLELPKLLDICAIYHHENEELTRSLVHNQPTDMTFSVEWTEPLLS

SEQ ID NO: 144378 - protein, 553 aa, Glycine max
  Coding DNA Sequence Number=SeqID_27600
  Gene Ontology: Mol. function=nucleic acid binding
  Homolog annotation: Hit_ID=Q10Q92; Match level="QueryCoverage=88%, HitCoverage=53%, E-value=1e-102, Identity=41%"; Hit description=CUE domain containing protein, expressed
  Pfam annotation: Domain name=CUE; Domain location=205-247; Score =40.3; E_value=6.6e-09; Accession=PF02845.6; Description=CUE domain
MDSFVSVYEPAAVFFSCPVEMSYGNEELLSLLARLHDSLIPSLQKGFRVIFADKQDDTVSNVLVSLKMLKIRLVKFGWQLLHLCYLSDEVFRDSIPLPAATKMFPANVEDPVIRADILVQTFREINSISLHSQESHLKETFLQDVERNFNILSRIERLRDGGWIFIDDEQFQYISGMLSSVYKEPYSASTPAPNQTLLMDEDAAISESNISQIRDLFPDYGKGFLAACLEVYDQNPEEVIQRILEGTLHEDLQNMDTSLETLPPAKSTTVGGNDKGKGKLIDSTPASSNPEVVRGKQQAEGPVMSSSASLGKFVRKSRADLPDRSILDKKDEKDTSRTAAMILQYEYEDEYDDSFDDLGLSVADSGVEENETLGDQINAKSGNSWATGSGNSVKNAPDSKWGSRKKPQYYVKDGKNYSYKVAGAVAVANSDEASLITQAQKELIHGLGRGGNLPLDAVKKVTDSYKEDDNQSQVSEMEGRGISGNSFGRGRKEGGKQVSSHQQQEKQSDDSEVDSNNQRGRGRGRGRGRGGGRNNHYQKDRAMKKHFSGMSGY

SEQ ID NO: 144379 - protein, 312 aa, Glycine max
  Coding DNA Sequence Number=SeqID_27601
  Gene Ontology: Mol. function=cyclin-dependent protein kinase regulator activity; Cellular component=nucleus; Biological process =regulation of progression through cell cycle
  Homolog annotation: Hit_ID=Q1S7L6; Match level="QueryCoverage=84%, HitCoverage=80%, E-value=6e-55, Identity=42%"; Hit description =Cyclin, N-terminal
  Pfam annotation: Domain name=Cyclin_C; Domain location=171-298; Score= 9.2; E_value=0.0074; Accession=PF02984.9; Description=Cyclin, C -terminal domain
  Pfam annotation: Domain name=Cyclin_N; Domain location=50-169; Score =66.1; E_value=1.2e-16; Accession=PF00134.13; Description=Cyclin, N -terminal domain
  Pfam module annotation: Pfam domain module=Cyclin_C::Cyclin_N; Domain location=171-298::50-169
MDDLSSSLLCQENETCLEEGGEELEYQFVGSQHDCGVSEDEHVGILIEREIVLGFKKDETMVIGDWVKRARMEAINWVLKTRATLGFRFETAYLSVTYFDRFLFRRSIDSEKSWAIRLLSIACLSLAAKMEECIVPGLSEFKLDDYSFEGKVIQKMELLVLSTLEWKMGIITPFDFLSYFIRKICKESPPSPIFSKTMQLIFTTMKEVNLMDHKPSVIAAAATLVAMDQQLTIDAVELKMSSIPQHRLLESKDVFEYYNLIQRLYEENTKSDTHTPIEMTESSRVTSSAAMAKRRRLAFSDDEGSSHGKGPG

SEQ ID NO: 144380 - protein, 359 aa, Glycine max
  Coding DNA Sequence Number=SeqID_27602
  Gene Ontology: Mol. function=protein binding; Cellular component =nucleus; Biological process=regulation of transcription, DNA -dependent
  Homolog annotation: Hit_ID=Q39090; Match level="QueryCoverage=93%, HitCoverage=80%, E-value=2e-11, Identity=21%"; Hit description =Protein UNUSUAL FLORAL ORGANS
  Pfam annotation: Domain name=F-box; Domain location=4-51; Score=34.2; E_value=4.6e-07; Accession=PF00646.23; Description=F-box domain
  Pfam annotation: Domain name=Kelch_2; Domain location=232-282; Score =17.3; E_value=0.054; Accession=PF07646.5; Description=Kelch motif
  Pfam module annotation: Pfam domain module=F-box::Kelch_2; Domain location=4-51::232-282
  Subcellular localization annotation: CTP_CleavageSite=101; ConfidenceScore=5.09e-01
MDPRIWSKLPPDVVEHILLLLPLKTLLNLRPTCKAFTSLLFSPSFVSKHSSSSSSPFSSYLLISHPQCPHYFRLYDSNLCSWRTLSLSLSNSLHLSASFTLVSSSGGLFCLYNPTSSSFLVHNLFVRSSRKIESPITRSRHLGHVTFVTTPLGYYIVLLCSKSTSNTSVFVYDSSKLSWRCFEGFNVVFSDSFHQQGTFFDGGLYFTTPEPFSVVFFDLESGEWERYVAELPQQVTFVRLVSDEEGKLYLLGGVGNDGISRSIKLWELIKGERVWVEVVGLPEIMCRKFVSVCYHNYEHVYCFWHEGMICVCFYMWPEILYYSVLRRTWDWLPRCPYLPLKFSCGFKWFSFVPKLYASV

SEQ ID NO: 144381 - protein, 90 aa, Glycine max
  Coding DNA Sequence Number=SeqID_27603
MLKVYFLIVNNRCRMKGRHSTSVIGTTDVEWLRKIDILRWFVANNRCGMSSFLHRFYLITDVECSPFCIGLITVIEGRETFNIVFYDDAS

SEQ ID NO: 144382 - protein, 343 aa, Glycine max
  Coding DNA Sequence Number=SeqID_27604
  Gene Ontology: Mol. function=transcription regulator activity; Cellular component=nucleus; Biological process=regulation of transcription
  Homolog annotation: Hit_ID=Q1SL31; Match level="QueryCoverage=86%, HitCoverage=90%, E-value=4e-55, Identity=46%"; Hit description=Helix- loop-helix DNA-binding
  Pfam annotation: Domain name=HLH; Domain location=249-296; Score =26.5; E_value=9.5e-05; Accession=PF00010.16; Description=Helix-loop -helix DNA-binding domain
MGPGVGAFPDGERDCFGKMLANEAHYCSPQLLEEDDGNVGMQSMFCSTLDVGGNKNMFYSFDSHNSSLQYISQESSHNNSTCCGHSVFMANPEDHTNYHFGHVDHVLANSTSMDFCMIDEKNPGSFVQSDIVMKENASLNEDEGSDKSENVFPAKHLKFKRMSDHMPELKVHVEDKINSHGNGNKKPRVSKDEQHCMKNQKLDKIGNQAEEINAGSDGHSSSSYTREDDNASALNFKGKTKASKGSATDPQSLYARKRRERIDDRLRILQNLVPNGTKVDISTMLEEAVQYVKFLQLQNKLIMDLTSYSISILRVLHLCDLINIARDVEVPLNWGIKGKLEGM

SEQ ID NO: 144383 - protein, 237 aa, Glycine max
  Coding DNA Sequence Number=SeqID_27605
  Homolog annotation: Hit_ID=O21999; Match level="QueryCoverage=21%, HitCoverage=33%, E-value=7e-22, Identity=100%"; Hit description=LacZ- alpha
GDTPGIFIVLSGFATSDLSVDFCDARQGVGAYGKTPATRPFYGSWPFAGLLLTCSFVRYPLILWITVLPPLSELIPLAAAERPSAAIGVVPSTLHQKLKFVVEGHLIIVSGEEDILVSCPSSTPYVEVAEESLETAFQALEVVSNAHVESPQVQLPSSDAALMVARVMLGHGYEPSMGLGWNEDGMQAWHWPSFYNVVTGKTLALPNLIALQHIPLSPAGVIAKRPAPIALPNSCAA

SEQ ID NO: 144384 - protein, 126 aa, Glycine max
  Coding DNA Sequence Number=SeqID_27606
MDILFFIVMGLIVLVFGIYPMARFLYQDFYPYLKDSFTHSEVLQSGIAVNADIIAAHQTSAWSGSKPIYRITFKFKTREQVEVQASLNHTLNFSDIERFKPGNGTTIKYDPANPQRIALYDRPLFL

SEQ ID NO: 144385 - protein, 219 aa, Glycine max
  Coding DNA Sequence Number=SeqID_27607
  Gene Ontology: Mol. function=NADH dehydrogenase (ubiquinone) activity; Cellular component=organelle inner membrane; Biological process=electron transport
  Homolog annotation: Hit_ID=P77179; Match level="QueryCoverage=58%, HitCoverage=57%, E-value=3e-56, Identity=83%"; Hit description =Electron transport complex protein rnfE
MRIHGDSRPAKRGVQHHDPAGLNDVLGFAVKQADGFDIGLHAFHAQLQHGFWRIGDRIEQGCGFIDAHIGRLRREQHRDQQLKRGGKVQLRRRMRNATLGRAALTFLINQVFYRQHHAKANKRARGQHCQQEWRIGVEHFNAQRFGPAAQQRICAVKQRTVTEDLAQRAQHEHGAGGAHSNGKTIQRRHGGAVFHRERFRTANDDTVGDDKGNKDPERL

SEQ ID NO: 144386 - protein, 41 aa, Glycine max
  Coding DNA Sequence Number=SeqID_27608
MDLHGGSLSTVSTGAQAIPGHSTRDDGHCKFWYCIDGFSDR

SEQ ID NO: 144387 - protein, 41 aa, Glycine max
  Coding DNA Sequence Number=SeqID_27609
MDLHGGSFSTVSTGAQAIPGHSTRDDGHCKFWYCIDGFSDR

SEQ ID NO: 144388 - protein, 93 aa, Glycine max
  Coding DNA Sequence Number=SeqID_27610
MSNEELKLQDPRCRIQCPDILPENTGVAAQCISQDKMSNEALKLQDPRCRIRYFQENDRSHPAQAVAAQKRTLLYNHEGCTSSVPSPGLKSYL

SEQ ID NO: 144389 - protein, 150 aa, Glycine max
  Coding DNA Sequence Number=SeqID_27611
  Pfam annotation: Domain name=Transposase_23; Domain location=45-110; Score=-9.4; E_value=0.012; Accession=PF03017.5; Description =TNP1ENSPM transposase
  Subcellular localization annotation: CTP_CleavageSite=28; ConfidenceScore=5.02e-01
MQSHLQSQIQSQGLALPPKPEVGPSAARVSTKGSCVDPSTTNLDTGDSDKCGLYIEKNPSRLVALGRVYEGSTIVHNIPLLNGQVKVFVEEVKHAYAPVPVPTSEVAMYPAKPANGSDPQVTWDATVFEVFDEDFPLYIKHEDLSEIAHD

SEQ ID NO: 144390 - protein, 54 aa, Glycine max
  Coding DNA Sequence Number=SeqID_27612
LVAHSLAPPGIRTIPPSPKWLSTSHGCIEAHLTDNSEPVGFIITKIDEFWQLKQ

SEQ ID NO: 144391 - protein, 134 aa, Glycine max
  Coding DNA Sequence Number=SeqID_27613
  Gene Ontology: Mol. function=iron-sulfur cluster binding; Cellular component=membrane; Biological process=electron transport
  Homolog annotation: Hit_ID=Q1Q5P1; Match level="QueryCoverage=90%, HitCoverage=20%, E-value=4e-23, Identity=40%"; Hit description =Similar to NAD(P) oxidoreductase, FAD-containing subunit
MGQRHAESDHDAVISDTAIPLRFQTAEVGVDWLQCNIECQEGCPVNTNCRGYLMLAAEGRFEEGYILARDPNPVAAICGYVCSAPCEKACRRADIDKPLAIRAMKRFLVDWHYGNNMPDNVVVQAPTGKSVAVI

SEQ ID NO: 144392 - protein, 113 aa, Glycine max
  Coding DNA Sequence Number=SeqID_27614
  Homolog annotation: Hit_ID=Q1SM20; Match level="QueryCoverage=69%, HitCoverage=20%, E-value=6e-08, Identity=35%"; Hit description =Nucleic acid-binding, OB-fold
MEIILLYPSLGFVKKKLRFKLRMTVFVWVWDYKFMARVADKIKLIDGSREALKLSIRITDLWYIGIPGKTEQVEMVVIDSDGDEIDVVCKQDQLKSRKADLKENLTYVMHNFK

SEQ ID NO: 144393 - protein, 210 aa, Glycine max
  Coding DNA Sequence Number=SeqID_27615
MGEAEEVQEQMKADMEVMKAQMATMMEAMMSMKKIMEANAVAVATTSAVAKYEWPHDVQIQNELAFPPYGLPPNYTPPNVAYTPKEDVNNSTPILIESRQPHHVHVSQLMGETHEIPHHNLADSEPCLGYATEGQAVGGIPLQNTLEGPQFRPQPQPFYGKMVGYTPSSFADLVFTGQRIKMESIVARSVKFRNMPEIKRKHCYAIREVP

SEQ ID NO: 144394 - protein, 86 aa, Glycine max
  Coding DNA Sequence Number=SeqID_27616
MTLAALANLRQADDESLRKFIGKFGRTVVQIRNLNPEIKLHSMLLALHPSKFVDNLCKKLPGSMDEPHERAKGYIQIEEMSKFWNE

SEQ ID NO: 144395 - protein, 82 aa, Glycine max
  Coding DNA Sequence Number=SeqID_27617
MRPTGGVLHTESFDEGVEAIYGSWKASKCSSGSVVSSYRSRLSDFHPKGMSTSITRSIKGCQWTVCVVGRCMRETRIVCSVA

SEQ ID NO: 144396 - protein, 100 aa, Glycine max
  Coding DNA Sequence Number=SeqID_27618
  Subcellular localization annotation: CTP_CleavageSite=57; ConfidenceScore=5.57e-01
MALKRASYTPAVGARTKPPMSRRARRSLQNPGREPGRSGRRCRSWCLPTLETAQPEVGSSGWKSTARRVVSGAPPAALENPEDRVPPTPGRTHNRIRSPR

SEQ ID NO: 144397 - protein, 148 aa, Glycine max
  Coding DNA Sequence Number=SeqID_27619
MAFDEAGMEIKLQLQELEETRLEAPENSKIYKEKLRLKMKLPAKSSKRTVTNSSFFIIAPKWRRNLWWTCLWSCQFYVMMCLEWNLRSFLPFSFICCLFVCVATYPSVGGRHVTRGFVSHERNTRGVATNVYLRKTSEKTGKDMIYEP

SEQ ID NO: 144398 - protein, 144 aa, Glycine max
  Coding DNA Sequence Number=SeqID_27620
MLMCNDQFSCVGPIELLCTVGRTPDEVINLLERTTTPTHDALLYYNGRWNMPPQNKFVGCAFIGKNPKKFEIPSGCILDELKDLIKQVAPKGIPPHGIHESQAVRRLFFRQPERFEYSDKVVKYEINELKTNDEVLKVLAQPNY

SEQ ID NO: 144399 - protein, 93 aa, Glycine max
  Coding DNA Sequence Number=SeqID_27621
  Gene Ontology: Mol. function=receptor activity; Cellular component =membrane; Biological process=heparan sulfate proteoglycan biosynthetic process
  Homolog annotation: Hit_ID=Q5Z8V4; Match level="QueryCoverage=59%, HitCoverage=15%, E-value=2e-17, Identity=71%"; Hit description =Putative Reg receptor
MVLSKAAFFHKKYFNIYTNEMPSSIREYVTKNRNCEDIAMSFLVANATGAPPIWVKAEKLRLGDGFESITAYNDPPICKVRLRIMTLSHTLAQ

SEQ ID NO: 144400 - protein, 71 aa, Glycine max
  Coding DNA Sequence Number=SeqID_27622
  Homolog annotation: Hit_ID=Q9LZ20; Match level="QueryCoverage=52%, HitCoverage=6%, E-value=5e-07, Identity=63%"; Hit description=Amino acid transport-like protein
MKLHCKNCDDESDEQNDGDSDEVYFVEAFGKRRHREAPFGGGDSDCGAKVHRQASGDGDIGKHGPKGAKAG

SEQ ID NO: 144401 - protein, 163 aa, Glycine max
  Coding DNA Sequence Number=SeqID_27623
  Homolog annotation: Hit_ID=Q1RUD8; Match level="QueryCoverage=43%, HitCoverage=14%, E-value=1e-08, Identity=43%"; Hit description=IMP dehydrogenase/GMP reductase
MDILALLIFGVVLFPNVDGLVDWAAIDAFLAFYDRKESLVVAILADLYDTFDRRCEKSNARIVCCTPTLYVWWLKAYAQGLDWLPNLRTTKVVEGEAPKEDEQVQALKTKLERAQTGKEKFKSVTVRIRKGNAELRDINIAITKALEQETKRARKEEHGRNKF

SEQ ID NO: 144402 - protein, 100 aa, Glycine max
  Coding DNA Sequence Number=SeqID_27624
MEVLSYSFVSTKSRVGDKRTRTADIRHRDPATGEPGTESFPRPPFFSARLFALKNTGFYGRSATPGCRRRPWGDLVVPTGEIVHQAVRKGQLDPLPQDPK

SEQ ID NO: 144403 - protein, 229 aa, Glycine max
  Coding DNA Sequence Number=SeqID_27625
  Gene Ontology: Mol. function=ATPase activity, coupled to transmembrane movement of substances; Cellular component=integral to membrane; Biological process=transport
  Homolog annotation: Hit_ID=Q94IH6; Match level="QueryCoverage=92%, HitCoverage=63%, E-value=2e-52, Identity=46%"; Hit description=CjMDR1
  Pfam annotation: Domain name=ABC_membrane; Domain location=2-203; Score=-31.8; E_value=0.025; Accession=PF00664.13; Description=ABC transporter transmembrane region
VACWVSTEERQAARIRGLYLRAILWQDISFFDKETNTGEVVGRMSGDTLLIQEALGEKCVACFLGRLVIAFIKGWLLTLVLLCCIPPLVISGSMMSFTFAKLPSHGQAAYSEAATVVERTIDSIRQVASFTGESQAIAQYNQSLTKAYRTAVQDGVVAGLGLGIKENIAYGKDGATNEEIRAATEVANAAKFIDRFPHTTTASGTRKSELFVADVNTQLKNKNITTDIK

SEQ ID NO: 144404 - protein, 368 aa, Glycine max
  Coding DNA Sequence Number=SeqID_27626
  Homolog annotation: Hit_ID=Q1T132; Match level="QueryCoverage=53%, HitCoverage=34%, E-value=4e-11, Identity=26%"; Hit description=IMP dehydrogenase/GMP reductase
  Pfam annotation: Domain name=DUF1723; Domain location=195-244; Score =25.9; E_value=0.00014; Accession=PF08330.1; Description=Protein of unknown function (DUF1723)
MSILALGRKQKKKVSNQKSGRKQKEKIPNQRLRESKKERKENSQSRIERKQKKYAERSLDQTTSDKYRVVTKKHRDYFSLTVIQNYVCVSSSLRIRRSKSLAFVGHPTIFVILTLRSCDVQRQIMGFPGGPQDTLVLTSYVNHVVAKVWAREEHTELKLVSRRRKVKKLGKPTLEIEGLVAGTSLSSLNTCSLDIEDRGLLYTFADKWHKETSSFHMLIREISITLNDVASVLHLPIIGVFHTYDAIDVDQIVELLVELLGVTTQKEVDEIQQCKGACVRLAWLQDIYRTKCLTRQWTLATKAYLLHIKGCSLFVNKSSTHIGVVGEPLRHPPMVQHHTIVMPHLPVLPDDTVAPIDVEMPQLCHIHL

SEQ ID NO: 144405 - protein, 102 aa, Glycine max
  Coding DNA Sequence Number=SeqID_27627
MEMSVHFPACDVAIVLGCRHPPLPSLAMIMPHLSMLADDTTTMPHPPIAAPVDAKMPQHAVVVCQKIAKRLQDMLDMRMVIVGVSLSTKMFMFGQDEYTGEK

SEQ ID NO: 144406 - protein, 74 aa, Glycine max
  Coding DNA Sequence Number=SeqID_27628
  Gene Ontology: Mol. function=iron-sulfur cluster binding
  Homolog annotation: Hit_ID=UPI00005FA708; Match level="QueryCoverage =100%, HitCoverage=22%, E-value=8e-27, Identity=81%"; Hit description= COG1509: Lysine 2,3-aminomutase
MAQLRLAGVTLLNQSVLLRDVNDDADTLAALSNALFDAGILPYYIHVLDKVQGAAHFMVSDDEARAIMQALLSK

SEQ ID NO: 144407 - protein, 83 aa, Glycine max
  Coding DNA Sequence Number=SeqID_27629
MPKSSPNMHVKQEVSTRVKPRLLCKQSMGKNTPNKIDDDGSNSHQGEKQGFQFTKCQETPISKTITNYLYITYNSKRNMQCCT

SEQ ID NO: 144408 - protein, 57 aa, Glycine max
  Coding DNA Sequence Number=SeqID_27630
MTSSGESLHMENSQLRLQSKGVQCSSNSCYDDGNFENEFIFSWTVPRPNASGKLNCH

SEQ ID NO: 144409 - protein, 129 aa, Glycine max
  Coding DNA Sequence Number=SeqID_27631
  Subcellular localization annotation: CTP_CleavageSite=38; ConfidenceScore=5.51e-01
MSQLATYYVSNSTTVSKKRRRSSTGGISVIKGFRTTTFAATRRRHPAVVAIPTHYFFSDKDHRLRQPPSRVRCVSFRLKPPPTKALGCCWLSSSWSTLYCLRKISWFHKRFSGVYVGLVDEADLRAVSE

SEQ ID NO: 144410 - protein, 213 aa, Glycine max
  Coding DNA Sequence Number=SeqID_27632
  Homolog annotation: Hit_ID=Q1RZH8; Match level="QueryCoverage=48%, HitCoverage=10%, E-value=1e-35, Identity=72%"; Hit description =Adaptin, N-terminal
  Pfam annotation: Domain name=F-box; Domain location=15-70; Score =20.4; E_value=0.0065; Accession=PF00646.23; Description=F-box domain
SVHELQDQPPVIQNSRWASLPLELLGDVINRLEASESTWPGRKHVVACVAMCKSWREMCKEIVSSPEFCGKITFPVSLKQDKWLPLHTLAACGEFYLLDSLLKHNVDINVLKNEDSGPLKESTSLIEHRKWDGLYCLPSEKSEIVSDEYLPTNDPKSNNNINDEAAELVKLTEQSLLLKKRTNQTKPRPIVVRLDDGDVAPISVKRPEPMDDI

SEQ ID NO: 144411 - protein, 103 aa, Glycine max
  Coding DNA Sequence Number=SeqID_27633
  Gene Ontology: Mol. function=polygalacturonase activity; Cellular component=cellulose and pectin-containing cell wall; Biological process=carbohydrate metabolic process
  Homolog annotation: Hit_ID=Q1S5D1; Match level="QueryCoverage=91%, HitCoverage=21%, E-value=3e-24, Identity=64%"; Hit description =Polygalacturonase
MALRHLWCQLGIHFLCAKQDSEVPANLKNLIFSKFNCLRMQIMGNLLAPTKDAWKKCSGPWLYFLDVRGMTVHGSGVINGQGRDWWGKPYGTGACSHMPTVRT

SEQ ID NO: 144412 - protein, 201 aa, Glycine max
  Coding DNA Sequence Number=SeqID_27634
NTETFSSLTSYPELRRSEFLIGGYVGARASLLSTTPPFVAITQELVARGDTLRLSAPRHSVTPSVIDEQRPMWSSGLFRRCQHFPMETFQVSQVIQNYVGHVTCTHDTRRYLMVIRTLLSSRGGGPDDKQRPKTKFGHSAPMIRGDTLWLFAPFCHPEAAGPMTSRDQVWSFCTHDTRRYLMVIRTLLSSRGGGPDDKQRP

SEQ ID NO: 144413 - protein, 95 aa, Glycine max
  Coding DNA Sequence Number=SeqID_27635
MEVSVGLCRPDIGIAPTRHPMDPEEPNRALGFPALVTGLYLSYKVPVPPSKGSRPQDTSGPEEVQQGLGVVSSDYGPLSVLQSASRPQQGHQDPY

SEQ ID NO: 144414 - protein, 200 aa, Glycine max
  Coding DNA Sequence Number=SeqID_27636
  Gene Ontology: Mol. function=DNA binding; Cellular component=nucleus; Biological process=response to salicylic acid stimulus
  Homolog annotation: Hit_ID=Q0PJB3; Match level="QueryCoverage=95%, HitCoverage=92%, E-value=3e-82, Identity=78%"; Hit description=MYB transcription factor MYB149
  Pfam annotation: Domain name=Myb_DNA-binding; Domain location=62-109; Score=44.0; E_value=4.9e-10; Accession=PF00249.21; Description=Myb -like DNA-binding domain
DGIMLFGVRLTVSDNNPTTLRKSASMNNLSQYDSQPPHDPNAGYASDDVVHPSRHTRERKRGVPWTEEEHRLFLLGLQNVGKGNWRGISRNFVMTRTPTQVASHAQKYFLRCHRQNRRRRRSSLFDITTNSVMEPWPEKEEEQAAAPSTRLKPVLPVPQSSKMAELDLNGKSLSLKLSVSKPPISNENFGGGGDSISSVA

SEQ ID NO: 144415 - protein, 281 aa, Glycine max
  Coding DNA Sequence Number=SeqID_27637
  Gene Ontology: Mol. function=RNA-directed DNA polymerase activity; Biological process=RNA-dependent DNA replication
MVAWFVELFEFGLKFKAHGPIKAQCLADFIVELSPSTDPSSIDGGDWWMFYIDKACNTKGSGAGITLEGPGDISLEQPLRFDFKTFNNQVEYEALIACLKLENEEDNDRVDVLSRLTSSKRQGLHRTCIQETLAAPSIDSWMNVIWKYLVNDQLPSDNSEARKEEEAWQLGSSKLVTIGRHCKLTTWSIRRNGMDILGAFSIAKGQETPFRLTHGTNAIIPVEVDEPLIRRTHFDEALNNENLAFELYMIDKVRNHAYIEEEVCKRRATQKHGSKLKRGEF

SEQ ID NO: 144416 - protein, 346 aa, Glycine max
  Coding DNA Sequence Number=SeqID_27638
  Gene Ontology: Mol. function=RNA-directed DNA polymerase activity; Biological process=RNA-dependent DNA replication
MDELGHRAIGSIQMEELFEYHDKVRGEEEVAVEVVTRVAMQEDVVITTNNKSRKANKDNKKTPKEKGYTNSSRKCHLRALKSINFVQTEETPCQSLPAIMFTNANFIGSKVDMLTTFGSNKFSQSLMVPYELVDADTSYNVLLKIPFLNIIGAIISTMHLTMIFPSLTGEIIIVKANQVDVRECYVKSCKIELYSVREDVSKASTSSVNAFISALEDLDPCVDFEDRLSLWPRENAKLERKDYTDLNRACPKDAYRLLSNGRLVDGASNLCYKVMPFGLKNADDMVVKSSFPNQHAGDVAKIFTELKKHNMRLNLKKCTFRVEREKAKSFFKLLKKSQDEFDWNEE

SEQ ID NO: 144417 - protein, 367 aa, Glycine max
  Coding DNA Sequence Number=SeqID_27639
  Gene Ontology: Mol. function=solute:hydrogen antiporter activity; Cellular component=integral to membrane; Biological process =regulation of pH
MVILFSYSKDTQYVEKLLNKFGYYDLNLVNTPYDANSQLKKNTGNIVDQTQLSRYNHSPNQDHQEALVRLMRYLRSTMEYGIKYSGFLALLEWYSDANWISDSYEIKFTSGYVFTLGGGANRRAHCCWNQWQAYVFSSSSILELDLVTIRRSGKRALSPAVGKMSLPYIFGIGLALILRKTVAGINEFGFSRFLIFMGVTISIIPFPVLACILTELKLLTPRVGDTAMAVAAFNDVDAWILLALAIALAAVDVNSHIHKSPFVSLRVLLSSMAFVAFMMIIIWLGDLTKPDGGEIKKKGFYIPHAITELAASGKFESEDGWKWESVVIGCATSMGANACFPCFAYGIIIIELGKLFPNFEFFNRYMR

SEQ ID NO: 144418 - protein, 70 aa, Glycine max
  Coding DNA Sequence Number=SeqID_27640
MSHERIHFPLLCRMPVQQLNHKQKVLTIIFSLELWRANKQNIHVSMLQLLQRDENWQWLVNGSYLKWNGL

SEQ ID NO: 144419 - protein, 501 aa, Glycine max
  Coding DNA Sequence Number=SeqID_27641
  Gene Ontology: Mol. function=binding; Cellular component =intracellular; Biological process=metabolic process
  Homolog annotation: Hit_ID=Q9FND6; Match level="QueryCoverage=99%, HitCoverage=91%, E-value=1e-157, Identity=47%"; Hit description =Selenium-binding protein-like
  Pfam annotation: Domain name=PPR; Domain location=122-156; Score =35.0; E_value=2.7e-07; Accession=PF01535.11; Description=PPR repeat
  Pfam annotation: Domain name=PPR; Domain location=20-54; Score=11.4; E_value=0.34; Accession=PF01535.11; Description=PPR repeat
  Pfam annotation: Domain name=PPR; Domain location=223-257; Score =25.7; E_value=0.00017; Accession=PF01535.11; Description=PPR repeat
  Pfam annotation: Domain name=PPR; Domain location=258-292; Score=8.5; E_value=0.74; Accession=PF01535.11; Description=PPR repeat
  Pfam annotation: Domain name=PPR; Domain location=294-328; Score=8.5; E_value=0.74; Accession=PF01535.11; Description=PPR repeat
  Pfam annotation: Domain name=PPR; Domain location=360-394; Score=4.4; E_value=2.2; Accession=PF01535.11; Description=PPR repeat
  Pfam module annotation: Pfam domain module=PPR::PPR::PPR::PPR::PPR::PP R; Domain location=122-156::20-54::223-257::258-292::294-328::360-394
MGSTPDAQKLFDEMPHKDSISWNSLVSGFSRIGDLGNCLRVFYTMRYEMAFEWNELTLLSVISACAFAKARDEGWCLHCCAVKLGMELEVKVVNAFINMYGKFGCVDSAFKLFWALPEQNMVSWNSMLAVWTQNGIPNEAVNYFNMMRVNGLFPDEATILSLLQACEKLPLGRLVEAIHGVIFTCGLNENITIATTLLNLYSKLGRLNVSHKVFAEISKPDKVALTAMLAGYAMHGHGKEAIEFFKWTVREGMKPDHVTFTHLLSACSHSGLVMDGKYYFQIMSDFYRVQPQLDHYSCMVDLLGRCGMLNDAYRLIKSMPLEPNSGVWGALLGACRVYRNINLGKEAAENLIALNPSDPRNYIMLSNIYSAAGLWSDASKVRALMKTKVFIRNAGCSFIEHGNKIHRFVVDDYSHPDSDKIHRKLEEIMRKIKEVGFVSETESILHDVDEEVKTDMINKHSEKIALAFGLLRSVQSLSEIQSDFTTFQMDYALVLIIGSDL

SEQ ID NO: 144420 - protein, 240 aa, Glycine max
  Coding DNA Sequence Number=SeqID_27642
  Gene Ontology: Mol. function=nucleic acid binding; Cellular component= intracellular; Biological process=mRNA processing
  Homolog annotation: Hit_ID=Q94C11; Match level="QueryCoverage=79%, HitCoverage=41%, E-value=7e-44, Identity=51%"; Hit description =Splicing factor 4-like protein
  Pfam annotation: Domain name=Surp; Domain location=66-111; Score =60.9; E_value=4.3e-15; Accession=PF01805.10; Description=Surp module
MEKEEWFKLRFLCVYVQNFPCRYLAYSPSTYQEMVYWQACYKTILHSLVHALAPHSPSDPTVKKVADKLASFVAKNGRQFEDVTRQKNPGDTPFKFLFDERCAEYKYYEYRLAQEENALVQSRESQFNVLVLILLLIMVKEKGGTSTSSSKQTNGHQRSSQQHTYQIPASALYESADNPRASGFSIQTSSVGSSEEPSGSSNADSLALMEFYMKKAAREEKYKQPKHSKDEMPPPASLLG

SEQ ID NO: 144421 - protein, 70 aa, Glycine max
  Coding DNA Sequence Number=SeqID_27643
MWTPVIHIKLNPDTGVGVVSDTGHGKGLGRPCFIDGICFENLPEIIQEKLHLSHLSPRFFCLHNFTSRSF

SEQ ID NO: 144422 - protein, 90 aa, Glycine max
  Coding DNA Sequence Number=SeqID_27644
MVSLNELTNNQSETKAKINSQIKLCPQKSLKTVLRSNALKGPLCFYRLTWTVQKHKINTSLYFLLRELHRSDFLFDGGYVGAKAPLLSTS

SEQ ID NO: 144423 - protein, 119 aa, Glycine max
  Coding DNA Sequence Number=SeqID_27645
MSEIEEVQEQMKADMGAMKEQMTTMMEATMSMRKMMEVNTTTVVAANTATEVDPTRPSGLNQVNPPVSDMVGQGGEALGSTGDPILWKFRTSIPSHHMACLQNIHHPMSPTLPMRTVIP

SEQ ID NO: 144424 - protein, 195 aa, Glycine max
  Coding DNA Sequence Number=SeqID_27646
  Gene Ontology: Mol. function=nucleic acid binding
  Homolog annotation: Hit_ID=Q1SU57; Match level="QueryCoverage=58%, HitCoverage=61%, E-value=3e-10, Identity=36%"; Hit description=Zinc finger, CCHC-type
  Pfam annotation: Domain name=zf-CCHC; Domain location=89-106; Score =12.8; E_value=0.0077; Accession=PF00098.13; Description=Zinc knuckle
HGYFMVKFDSMEDSHEWWSVVVVQPLLNREDMIVGVHYGVFGKPIKVDLNTLNAEYRRFARVYVEVNLNKSVVGRINIRRGTSTMLSTRVCTSYGHYGHRSRECTHKPQVETMAANSNARLAVAEAKNNHFCNGKNPISTNQGIVKWDRVLSSLAEPHSNTPLTPAKGNFINGSTKGKGVAATTLQTSTEPFRLS

SEQ ID NO: 144425 - protein, 340 aa, Glycine max
  Coding DNA Sequence Number=SeqID_27647
  Gene Ontology: Mol. function=RNA-directed DNA polymerase activity; Biological process=RNA-dependent DNA replication
METLSLHIQQLVNEGIWKPIVVSRGGPAISHLLFTDDIFLFCKVQESQAHLITTTLDTFCSESGWKVNLHKSTMMSSKGIPNRMKNIFKDVCGIASVSNLGRYLGYSGCLSQSMPPLIEKLTTSFGLLLVYEGLESCELGPVTRPKQMGALGIRIARNTNTSLLGKLVWNMVERKDTLWVRVLIHKYLIHSFFMSAKARQVHGNWCVNHVYTMLSEDFLSRLASIDCNICPPVSKIDGCGLIAPMRCTQLRRATLGTTVAILTPPRPTSNGFGSLSFQRRLEPSFGLFSLPTNDVRYRHYLATWAACHDCSHPQEDTLHCLRDCSHAREIWTHLGFLAQQ

SEQ ID NO: 144426 - protein, 87 aa, Glycine max
  Coding DNA Sequence Number=SeqID_27648
MASVDEIQELGLPYWKELIAMNFRGVNYLVEITQQQSRVNRALTQLMEIRPKKLTLSKSWMRIHSITHPRNRRLHNSKGDGLMKTVN

SEQ ID NO: 144427 - protein, 178 aa, Glycine max
  Coding DNA Sequence Number=SeqID_27649
  Gene Ontology: Mol. function=RNA-directed DNA polymerase activity; Cellular component=nucleus; Biological process=RNA-dependent DNA replication
  Homolog annotation: Hit_ID=Q1SL01; Match level="QueryCoverage=95%, HitCoverage=14%, E-value=4e-39, Identity=47%"; Hit description =Ribonuclease H
MATFDIRHFPTLSHEAREALTGLVSKEEVKHALMCMKSHKLPNLDGFQFVFFKKYWDTIQNNIWQLFRKAFVEGYSKEKLVETLVVLIPKLDHTKQFRDFLPISLCNILHKLISKVLVHRLCPYLEEIINPLQGSFVFGRGTTDNAIMAQEVVHHMHRSKANEGIMAFKFNWKRTMTE

SEQ ID NO: 144428 - protein, 170 aa, Glycine max
  Coding DNA Sequence Number=SeqID_27650
  Gene Ontology: Mol. function=nucleic acid binding; Cellular component= membrane; Biological process=DNA integration
MALVAHFDLEVHQIDVKTTFLNGDLEEVYMAQPMGFESEKDQCICLKVSGGYGEASYVIGIEIHRDRSIRTLRLSQKAYIEKVLKRSNMENCSSIVTPIVKGEKISLNQCPQTTLEQEGMKRIPYASAIGSLMYVQVSTRPDIAFVVGMQGRHQKDSSMEHWKALKKVMR

SEQ ID NO: 144429 - protein, 218 aa, Glycine max
  Coding DNA Sequence Number=SeqID_27651
MSVMYSPVLNYSDVEYQLWKNQDMDSSIGHPQQHCHQSNSGLLRYCSAPSSMLASLIDNTIHGCVNEEPFTSENQQQQQHYLPSTSSEMETMLSKMPPSNIGWSNSEPLQEFGGKPVKQEIGQSVPQGPPKQNGYSYGGSQLIYQSQQIQGLPNGSSIASISAFDGSFGAVNSMASEDSIQSKMGVRNCSNLFRQKSSPAGFFSIENELTTPCKILIC

SEQ ID NO: 144430 - protein, 237 aa, Glycine max
  Coding DNA Sequence Number=SeqID_27652
  Gene Ontology: Mol. function=transcription regulator activity; Cellular component=nucleus; Biological process=regulation of transcription
  Homolog annotation: Hit_ID=Q8S490; Match level="QueryCoverage=39%, HitCoverage=63%, E-value=2e-18, Identity=50%"; Hit description =Transcription factor RAU1
  Pfam annotation: Domain name=HLH; Domain location=162-210; Score =36.5; E_value=9.2e-08; Accession=PF00010.16; Description=Helix-loop -helix DNA-binding domain
  Subcellular localization annotation: CTP_CleavageSite=32; ConfidenceScore=5.40e-01
LAALREVGSFKDNDVSNGQATASTSGLHSSLTFSSRSSSCLKQMPPQIAENGNESLEENYDQSRNLVNDNGSSKCYIPSFTNEFWESSAFNAPKTENEDEIMFSTSNGLESQETDFSYQNHGLTHHLSLPSSSTKMSSIEMFLQIQGSVPYKIRAKRGFATHPRSIAERERRTRISERIKKLQDLFPRSEKPTSTADMLDLAVEHIKDLQQQVQILSDRKAKCKCTRNEKHYTRTCA

SEQ ID NO: 144431 - protein, 120 aa, Glycine max
  Coding DNA Sequence Number=SeqID_27653
  Homolog annotation: Hit_ID=Q43496; Match level="QueryCoverage=63%, HitCoverage=73%, E-value=5e-32, Identity=77%"; Hit description=5B protein precursor
  Pfam annotation: Domain name=Tryp_alpha_amyl; Domain location=36-110; Score=37.7; E_value=3.9e-08; Accession=PF00234.12; Description =Protease inhibitorseed storageLTP f
  Subcellular localization annotation: CTP_CleavageSite=66; ConfidenceScore=5.44e-01
MRSNSMMKFSSYKAVSLLWFLLIMAGLVAQVQSSPCTSTFFSALVQLIPCRAAVAPFSPIPPSDSCCNALKALGQPCLCVLVNGPPISGVDRNMASQLPDKCTANFEPYSFFLHSSLAKK

SEQ ID NO: 144432 - protein, 723 aa, Glycine max
  Coding DNA Sequence Number=SeqID_27654
  Gene Ontology: Mol. function=binding; Cellular component=membrane; Biological process=photosynthesis
  Homolog annotation: Hit_ID=Q6ZGV8; Match level="QueryCoverage=94%, HitCoverage=48%, E-value=0.0, Identity=58%"; Hit description =Eukaryotic translation initiation factor 3 subunit (EIF-3)-like
  Subcellular localization annotation: CTP_CleavageSite=28; ConfidenceScore=5.14e-01
MSTLLLPTLKPSNIFLYCAFLIKPVSPSATMLNRKGANHRRDAARAENALTLLYGNEPIGMQRDWNEELQSCREFPHTSPQERILRDRALYKVTSDFVDAAINGAIGVISGCIPPINPTDPECFHMYVHNNIFFSFAIDADLEKLPKKRVDANSKSWSSSTLQSSSDKDSIPLHGESQVPNGGKDDSSSSEDLNGTEITQDVSPEAQLAENEQATYASANNDLKGTKAYQEADVPGLYNLAMAIIDYRGHRVVAQSVLPGILQGDKSDSLLYGSVDNGKKICWNEDFHSKVSEAAKCLHLKEHLVLDGSGNLFKLAAPVECKGIVGGDDRHYLLDLLRVTPRDANYTGPGSRFCILRPELITAYCQAQAAEALKSKEKNFQEANSLATESQNAAEADQLVNDSQNAADADKLDSTKEEKAEDVKELASVIAKASDGCEDIVFNPNVFTEFKLAGSPEEIAADEDNVRKVSQYLTDVVLPKFIQDLCTLEVSPMDGQTLTEALHAHGINVRYIGRVAGGTKHLPHLWDLCNSEIVVRSAKHIIKDLLRETEDHDLAPAVSHFLNCLFGSCQAPSGKEHAGQRSPGKHSKGLARWKGRASLRKTQPLYASISSEALWLDIQEFAMVKYKFELPADARSRVKKISLIRNLCLKVGITVAARKYDLSSATPFQTSDVLDLRPVVKHSVPACSEAKELVETGKLQLAEGMLSEAYTLFSEAFSILQQA

SEQ ID NO: 144433 - protein, 125 aa, Glycine max
  Coding DNA Sequence Number=SeqID_27655
MCGATCTRCLSGITLRATKIKVVTFLGGLRPFFFGCKYKPITSLTSLELHPPSLRTKHHPYISLHPLRFPVTVDGDVEAMSREAGGEALVGSRGVVLGDRSLLPKNGIQVRASELRSVTQVELYF

SEQ ID NO: 144434 - protein, 428 aa, Glycine max
  Coding DNA Sequence Number=SeqID_27656
  Gene Ontology: Mol. function=heat shock protein binding; Cellular component=mitochondrial matrix; Biological process=protein folding
  Homolog annotation: Hit_ID=Q1RSQ5; Match level="QueryCoverage=91%, HitCoverage=89%, E-value=1e-145, Identity=66%"; Hit description=DnaJ central region
  Pfam annotation: Domain name=DnaJ; Domain location=73-135; Score =134.7; E_value=2.6e-37; Accession=PF00226.21; Description=DnaJ domain
  Pfam annotation: Domain name=DnaJ_C; Domain location=290-411; Score =183.8; E_value=4.1e-52; Accession=PF01556.9; Description=DnaJ C terminal region
  Pfam annotation: Domain name=DnaJ_CXXCXGXG; Domain location=197-277; Score=90.6; E_value=4.6e-24; Accession=PF00684.9; Description=DnaJ central domain (4 repeats)
  Pfam module annotation: Pfam domain module=DnaJ::DnaJ_C::DnaJ _CXXCXGXG; Domain location=73-135::290-411::197-277
MALGSFDRCPKNSSATPTNPLYFFGVVFVDLLPPYPIAVGNGGNLKNYLLFGAANTYWGTSRSIHGSASLARDYYEVLGVSKNASSSEIKKAYYGLAKKLHPDTNKDDPEAEKKFQEVSMAYEVLKDEEKRQQYDQVGHDAYVNQESTNGFGGNSGFNPFEQMFRDHDFVKSFFHQNIGGEDVKTFIELSFMEAVRGCNKTITFQTEVLCNTCGGSGVPPGTRPETCKRCKGSGVTYVQTGIFRMESTCGTCKGTGKIVSNFCKSCKGTKVTKGTKSVKLDIMAGIDNNETIKVYRSGGADPDGDNPGDLYVTIKVRDDPVFRREGSNIHVDAILSITQAILGGTIQVPTLTGDVVLKIRPGTQPGQKVVLKKKGIKTKNSYTFGDQYVHFNVSIPNNLTERQRELIEEFAKEEQGDFDKQRVASASG

SEQ ID NO: 144435 - protein, 259 aa, Glycine max
  Coding DNA Sequence Number=SeqID_27657
  Gene Ontology: Mol. function=RNA-directed DNA polymerase activity; Biological process=RNA-dependent DNA replication
  Homolog annotation: Hit_ID=Q1T5K4; Match level="QueryCoverage=81%, HitCoverage=24%, E-value=1e-25, Identity=28%"; Hit description=RNA -directed DNA polymerase
MGQMTQYAGSFSCLRQGDPLAPFLFNIVAEGLTDDTVFFGTTSMENVKAIKVMLRCFELVLGLKINFAKSSFGAFGTTEKWINNAASYLNCRRLQAPFSYLGIPIGANPGHSETLDAVVKKCVEEGGRQVGKATEVVLVGRKPRSADHQGELGNNMHAKYEGWQDLRKFNYALLGKWSWNLFHHQGELWAQVLNSKYEAEEGSWFNSDIKWKIGSGSKVLFWKDAWKEEGVSLKGEIVSAANFMDDIQGSVVQTQQQDT

SEQ ID NO: 144436 - protein, 100 aa, Glycine max
  Coding DNA Sequence Number=SeqID_27658
MIRRVVSPTRLLSYTIVADSSAGTTQPGVSPPQCPYLVVVLLLAPRLVLLLLMLKLLCGSYWNNYIVKDPAKEPCQQQEKIKARLRSQQREPPAEGGTCE

SEQ ID NO: 144437 - protein, 810 aa, Glycine max
  Coding DNA Sequence Number=SeqID_27659
  Gene Ontology: Mol. function=transferase activity, transferring glycosyl groups; Cellular component=integral to membrane; Biological process=response to oxidative stress
  Homolog annotation: Hit_ID=Q1S9Y9; Match level="QueryCoverage=99%, HitCoverage=100%, E-value=0.0, Identity=83%"; Hit description=C2
  Pfam annotation: Domain name=C2; Domain location=234-316; Score=76.2; E_value=1.1e-19; Accession=PF00168.20; Description=C2 domain
  Pfam annotation: Domain name=C2; Domain location=398-492; Score=81.3; E_value=3e-21; Accession=PF00168.20; Description=C2 domain
  Pfam annotation: Domain name=C2; Domain location=71-152; Score=98.1; E_value=2.7e-26; Accession=PF00168.20; Description=C2 domain
  Pfam annotation: Domain name=PRT_C; Domain location=655-810; Score =429.8; E_value=3.7e-126; Accession=PF08372.1; Description=Plant phosphoribosyltransferase C-terminal
  Pfam module annotation: Pfam domain module=C2::C2::C2::PRT_C; Domain location=234-316::398-492::71-152::655-810
MISIKRRQRGAPVTMHSVGPQVHPSSQDEDYNLRETDPQLGGDRWPNARRGWIGGERFSSTYDLVEQMFYLYVRVVKAKDLSPSTLTSSCDPYVEVKLGNYKGRTKHIEKKTNPEWNQVYAFSKDRIQSSVLEVIVKDKEMLGRDDYIGRVAFDLNEVPTRVPPDSPLAPQWYRLEDRRGEGKVRGDIMLAVWMGTQADEAFSEAWHSDAAAVSGEGVFNVRSKVYVSPKLWYLRVNAIEAQDVIPSDRNRLPEVFVKAQMGSQVLRTKICPTRTTTPLWNEDLVFVAAEPFEEQLTITVEDRVHPSRDEVLGKIILPLTLFEKRLDHRPVHSRWFNLEKFGFGMMEADRRNELKFSSRIHLRISLEGGYHVLDESTLYSSDQRPTARQLWKQPIGVLEVGILGAQGLLPMKMRDGRGTTDAYCVAKYGQKWVRTRTILDNFSPKWNEQYTWEIYDPCTVITLGVFDNCHLGGGEKATAGTAARDSRIGKVRIRLSTLEAHRIYTHSHPLLVLHPHGVKKMGELQLAVRFTSLSLANMVYIYGQPLLPKQHYLRPFIVNQVENLRYQAMSIVAVRLGRAEPPLRKEVVEYMLDVDSHMWSMRRSKANFFRIMSLFSGIITMGQWFSQVCHWKNPITSILVHILFLILICYPELILPTLFLYMFLIGLWNYRFRPRHPPHMDTKLSWAEVVHPDELDEEFDTFPTSRPHDVVKMRYDRLRSVAGRIQTVVGDIATQGERFQSLLSWRDPRATSFFVVFSLCSAVVLYATPPKVVAMVTGLYYLRHPKFRSKLPSVPSNFFKRLPARTDSML

SEQ ID NO: 144438 - protein, 97 aa, Glycine max
  Coding DNA Sequence Number=SeqID_27660
MVPIDRPDVIPITIDHFRYCFIPWGFRSRQQLSGALLCSRIHSNPVRFDVRVVTTEEDNEIKEDLEMLEEEWRNNSWWGASPKSRLACGGKQSGGSR

SEQ ID NO: 144439 - protein, 163 aa, Glycine max
  Coding DNA Sequence Number=SeqID_27661
  Gene Ontology: Mol. function=protein serine/threonine kinase activity; Cellular component=membrane; Biological process=protein amino acid phosphorylation
  Homolog annotation: Hit_ID=Q39886; Match level="QueryCoverage=99%, HitCoverage=37%, E-value=1e-55, Identity=59%"; Hit description =Protein kinase
  Pfam annotation: Domain name=Pkinase; Domain location=1-138; Score =1.0; E_value=1.3e-08; Accession=PF00069.15; Description=Protein kinase domain
  Pfam annotation: Domain name=Pkinase_Tyr; Domain location=1-138; Score=-35.4; E_value=2.7e-10; Accession=PF07714.7; Description =Protein tyrosine kinase
  Pfam module annotation: Pfam domain module=Pkinase::Pkinase_Tyr; Domain location=1-138::1-138
MEYIHAQGIIHRDLKPENVLVDGEIRLKIADFGIACEASKCDSLRGTYRWMAPEMIKGKRYGRKVDVYSFGLILWELVSGTVPFEGLSPIQVAVAVADRNSRPIIPSHCPHVLSGLIKQCWELKPEKRPEFCQIVRVLEQLDQGCSFLPPKKLKQHPLSLRKW

SEQ ID NO: 144440 - protein, 203 aa, Glycine max
  Coding DNA Sequence Number=SeqID_27662
  Gene Ontology: Mol. function=binding; Cellular component =intracellular; Biological process=metabolic process
  Homolog annotation: Hit_ID=Q1SCU6; Match level="QueryCoverage=61%, HitCoverage=57%, E-value=2e-51, Identity=82%"; Hit description =Tetratricopeptide-like helical
  Pfam annotation: Domain name=PPR; Domain location=117-151; Score =21.1; E_value=0.0041; Accession=PF01535.11; Description=PPR repeat
  Pfam annotation: Domain name=PPR; Domain location=154-188; Score =10.7; E_value=0.41; Accession=PF01535.11; Description=PPR repeat
  Pfam module annotation: Pfam domain module=PPR::PPR; Domain location =117-151::154-188
MDKEEIPSSCSKRCYAPKLSPIVLPLLVSLVPVWGKMGHFNIVQLFMLMSSSGAMILTILYSLAVLLQGRQVQSVVIKMGSERNVFVASALIDMYSKGGDIDEAQCVLDQTSKKNNVLWTSMIMGYAQCGGSSEAVELFDCLLTKQEFIPDHNICFTAVLTACNHAGFLDKGVEYFNKMTTNYGLSPDIDQHACLIFYAETEI

SEQ ID NO: 144441 - protein, 340 aa, Glycine max
  Coding DNA Sequence Number=SeqID_27663
  Homolog annotation: Hit_ID=Q1SDS1; Match level="QueryCoverage=59%, HitCoverage=44%, E-value=1e-07, Identity=25%"; Hit description=IMP dehydrogenase/GMP reductase
VPRRQSEGYGQSRRLGPVYGCVSFANFWGCPLSKRRWLVDLAAIDAFLAYHHSKESPVVAVLADLFDTFNRRCKKSSARIICCLLALCVWLVSHLFQQDTRHPCPLQSHRSCTEKRRIDWDQLLAGIRGRTINWFPRWKEGKEGVLFSCGGYPKHSADRNEGDFGAQNFKAIQRIRKAWETPLRKDQEPRGIRNGIIGGYHEWLKVHIRGLDWLAKLKVVSEESFEAPEEDEEVQALKSELGKAKLAKEKFKLAATHIRKECAGLREENATTAKALEQEAKRAHKEEYGRNKFRGALSKRSLSQRLCETKTNMLAIIAKYQEELGLATAHEHRVAEEYAQ

SEQ ID NO: 144442 - protein, 47 aa, Glycine max
  Coding DNA Sequence Number=SeqID_27664
MTVSYKDWHKMLPFALHDAQGRVRAGTRLMVSRSSSCDWLRMLRRPC

SEQ ID NO: 144443 - protein, 72 aa, Glycine max
  Coding DNA Sequence Number=SeqID_27665
GLVGACAPSATLDRLACISEFRLSAHLLAQWMDSSGALSGMSPHSANMHSSSFFQILPRAQPKEWCIQWMAR

SEQ ID NO: 144444 - protein, 227 aa, Glycine max
  Coding DNA Sequence Number=SeqID_27666
  Gene Ontology: Mol. function=RNA-directed DNA polymerase activity; Cellular component=intracellular; Biological process=RNA-dependent DNA replication
MAPEDMEKTTFITLWGTFCYKVMSFGLKNTGATYQWAMVALFHDMMHREIEVYVDDMIAKSKTKEEHLVNLWKLFERLRKYKLRLNPTKCTFRVKSGKLLGFIVSQKGIEVDPEKVKAILEMPEPHTEKQVQGFLGRLNYIVRFISQLTATCEPLFKLLHKDQSIRWNDDFQEAFERIKQCLMNPLVLMPSVAGRPLFLYMTVLDESMGCMLGLHDESGKENGLSTT

SEQ ID NO: 144445 - protein, 287 aa, Glycine max
  Coding DNA Sequence Number=SeqID_27667
  Gene Ontology: Mol. function=chitin binding; Cellular component =extracellular region; Biological process=chitin metabolic process
  Homolog annotation: Hit_ID=UPI000044A8F0; Match level="QueryCoverage =78%, HitCoverage=99%, E-value=4e-33, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DGPLGTSTLTFRGLYVLVIRGLHALTFRGLHVLAFRGSCTFTFRGLHVLAFRGLHALTFRGLHILAFRGSCTFTLSGLHVLAIRGMHTLTFRGLHVLAFRGSCTFTFRGLHVLAFRGLHDLTFRGLHVLTFRGLHALTLRGLHILTFIGLHALNFRGLHVLTFIGLHALTFRELHVLAIRGLHALTFRGLHVLTLRGRHALTFRGLHVLAIRGLHALTFRGLHVLAFRGSCTPSPSEDYASSPSEGCTPSPSKDYMSSPSEDYTSSPSEGCTPSPSEDYTSWPLEGH

SEQ ID NO: 144446 - protein, 171 aa, Glycine max
  Coding DNA Sequence Number=SeqID_27668
MCLSSPLQFQVVSRRRRPRPTPRLVTRNGQFPLLGTTRIRPLYHHQIETIIVQAPIWTKHDYEHTPSKAFKAIPIDSIVHLRPPQWTRPMQPNIIKMSPHWLTPAGAHCLVGRSCFVLLMLMMPGPSRNRLCGWTPKNPPRMVMMEVTMLSITMSFKCYILLGSTILMMRV

SEQ ID NO: 144447 - protein, 107 aa, Glycine max
  Coding DNA Sequence Number=SeqID_27669
  Gene Ontology: Mol. function=O-methyltransferase activity; Biological process=lignin biosynthetic process
  Homolog annotation: Hit_ID=Q84KK4; Match level="QueryCoverage=93%, HitCoverage=27%, E-value=3e-27, Identity=68%"; Hit description=S -adenosyl-L-methionine: 2,7,4'-trihydroxyisoflavanone 4'-O- methyltransferase
MLELEFSIVLKWVLHDWNDELSVKILKNCEEAISGKGKGKGKEGKVIIIDIAIDEVGDDCEMTELKLDYDLVMLTMFNGKEIVGETNLRGRIQQLQNYSYMWIQISH

SEQ ID NO: 144448 - protein, 63 aa, Glycine max
  Coding DNA Sequence Number=SeqID_27670
MVAIVPTKIPQPPFSRGYNLNATCAYHGGVSRHSTEHLTYAPELISKSVQSEIARSTRLVGVS

SEQ ID NO: 144449 - protein, 64 aa, Glycine max
  Coding DNA Sequence Number=SeqID_27671
  Homolog annotation: Hit_ID=Q1S7C5; Match level="QueryCoverage=92%, HitCoverage=4%, E-value=4e-09, Identity=53%"; Hit description =Integrase, catalytic region
MDKDNHISSHMVGGYKLTKLGSKDFTDPSLYKSIVRASDPDDRRSTFDAVIFLGPNLISWWSKK

SEQ ID NO: 144450 - protein, 83 aa, Glycine max
  Coding DNA Sequence Number=SeqID_27672
MADGGSTEAEDECLGMESLPLEKRRNRKYKAAIKHIRNGKLKRALAGRRNIVVPNSNGVCPFCGLVEESTDHVLLWCKELWEN

SEQ ID NO: 144451 - protein, 78 aa, Glycine max
  Coding DNA Sequence Number=SeqID_27673
MTRMVEEDTKEKKSKGFALKSSTPSSDESDEENAEGFESENLTLLVRKFKKYLNKKNPKGRSFQRKKNFKKNDSTSLT

SEQ ID NO: 144452 - protein, 116 aa, Glycine max
  Coding DNA Sequence Number=SeqID_27674
MAPKKLPAKKARKDATGEGSSTAPQGWSFLKESQVQLREGEYAEFQEEIAKRQWTQLAAPMAKYDPEIVMEFYANAWSTKEGFRGKHSWVWGQWIPFDEDVINQFLGHPLILEEGQ

SEQ ID NO: 144453 - protein, 56 aa, Glycine max
  Coding DNA Sequence Number=SeqID_27675
MTQASHHRGGVAYARQSDLDTCCLVFLSVSAMWARSSYFLTNGTTLHLRVEVRWQQ

SEQ ID NO: 144454 - protein, 108 aa, Glycine max
  Coding DNA Sequence Number=SeqID_27676
MAHKALAAGCNLDKEQPPPRKKACKGGRGGGCKELEDICSGHLSFYLRSSLELVVTIDPQIIAMISLEGFGFLGLHSKQKQVILVRAPKAQNQQQILEGKIAKNEDKS

SEQ ID NO: 144455 - protein, 315 aa, Glycine max
  Coding DNA Sequence Number=SeqID_27677
  Gene Ontology: Mol. function=RNA-directed DNA polymerase activity; Biological process=RNA-dependent DNA replication
  Homolog annotation: Hit_ID=Q1S4N5; Match level="QueryCoverage=63%, HitCoverage=48%, E-value=4e-28, Identity=34%"; Hit description =Peptidase M, neutral zinc metallopeptidases, zinc-binding site
MAFVSGLIDFETKGGHVTWRKNIQNGVHIRKKLDRCLANPKWLLLFPHSMEKLLVSNNSDHNPILVHCLKSPSQRKEAFHFQAAWMNHPDYPPLIDHVWRGTPGDAICKLDEGFIVNWIILSPQTLPDRKGCFKMNISRNKIMGLFIDDIWCSDLGTFVKETLFFSKDLFQSDDACAPHSFPYNALGPDGFQPIFYRSYWHIVGKEIDFEKVYERVNGDFLMLTLTEFRFPDQTIQLIMNCTMPSNLSLKWKSILESFTPTGDLRQAGRTKKEDFAHVVDMINNRLDGWKSKLLSRAERVTLAKSVLAAIPTYTM

SEQ ID NO: 144456 - protein, 128 aa, Glycine max
  Coding DNA Sequence Number=SeqID_27678
  Homolog annotation: Hit_ID=Q1SZM6; Match level="QueryCoverage=42%, HitCoverage=18%, E-value=1e-07, Identity=36%"; Hit description =Ribonuclease H
MAMLGKKAWSMLHEPDKPWVAILKDRYIPNQSILSAKNIPSSSYTWNLKECGSVSTSLKNQTLITKTSRSGYGYLQSSRMSNSMLQLVGNCGSLVTIASSTTRIGHCGTLLLQGNNYVLLSPLHIPNS

SEQ ID NO: 144457 - protein, 90 aa, Glycine max
  Coding DNA Sequence Number=SeqID_27679
MVILPRLSGHESANWEKWEKKGGSVLQSKSLARTCSNRKERRVFKKEFPGSKEYLRSTKLRQERGLRVMGQFELVYGRVEVEAARVLDLA

SEQ ID NO: 144458 - protein, 173 aa, Glycine max
  Coding DNA Sequence Number=SeqID_27680
  Gene Ontology: Mol. function=nucleic acid binding
  Homolog annotation: Hit_ID=Q1SKJ3; Match level="QueryCoverage=51%, HitCoverage=10%, E-value=4e-22, Identity=51%"; Hit description=Zinc finger, CCHC-type; Endonuclease/exonuclease/phosphatase
MAGCIIKLLAKSLGYNFMREKLRRLWKLKAGFEMLDIGNSFFTIKFDIEEDRIKVNQEDPWMIFDHYLTVRAWSGDLISQEAKIDTTMSWAQDNKQTHAKNKRPRQSLNPSEAGVAQMMKNDDINKDTNKPCVYDIGNGAKSTVNMQPVSTNSYVFVNEEKEDSEGMDMIVSS

SEQ ID NO: 144459 - protein, 62 aa, Glycine max
  Coding DNA Sequence Number=SeqID_27681
MTVNFMTVKNHHNRPYKTIIEGLICSSALSSRIFGVSQKLSWLSMGIRSNKGGLVSYNVLMN

SEQ ID NO: 144460 - protein, 67 aa, Glycine max
  Coding DNA Sequence Number=SeqID_27682
LSQQGQGFAPFACPTSEQFRAEVAWPEDWPEAQAGEVPAGSPGDVEEARMDEEMTNFLGFLGGSGAT

SEQ ID NO: 144461 - protein, 84 aa, Glycine max
  Coding DNA Sequence Number=SeqID_27683
MSNEELKLQDPRCRIQCPDILPENTGVAVQCKIKIFQKKIDLLQHQGVAAQNRTRLYNHGGCTSSVPSPGLKSYFVSFWDLSLL

SEQ ID NO: 144462 - protein, 109 aa, Glycine max
  Coding DNA Sequence Number=SeqID_27684
  Gene Ontology: Mol. function=catalytic activity; Biological process =metabolic process
MIDVLPKGRILMQHRESQGNRDTTTYTTIPDHNIQSTAQSMAQALPTNEHLHREIGNDDCSPDWRVQFYVSPYVRTQSTLCDLRRCLLKKRIISVREESRIRERDFEIF

SEQ ID NO: 144463 - protein, 97 aa, Glycine max
  Coding DNA Sequence Number=SeqID_27685
MVARKCVMNSCTLVVACVVMQLCVMEDGLMAYDCGSENLEGPYPIKCGGMRVEYSERIFNREHERKMMVMRNTLAWNIWLHRSNVIFKNEGVDANKA

SEQ ID NO: 144464 - protein, 636 aa, Glycine max
  Coding DNA Sequence Number=SeqID_27686
  Gene Ontology: Mol. function=ATP binding; Cellular component=nucleus; Biological process=apoptosis
  Homolog annotation: Hit_ID=Q9AUH6; Match level="QueryCoverage=98%, HitCoverage=96%, E-value=0.0, Identity=67%"; Hit description=F-box containing protein TIR1
ENHPSTNSEDDHRSSLLDLARAEITESSNSKTRTCGSGLGSGSGTSEPQAPFPDQVLENVLENVLHFLSSRRDRNAASLVCRSWYRAEALTRSELFIGNCYALSPTRATARFTRARSVTVKGKPRFADFDLMPADWGAHFSPWASALSQAYPWLEKLHLKRMLLTDADLALIADSFAAFRELVLVCCEGFGTPGLAVVVSKCRLLRVLELVESEVEDDEEVDWISCFPESQTNLESLVFDCVDVPINFEALEGLVARSPRLKKLRLNRYVSMAELYRLLLRAPQLTHLGTGSFSATEAGAVGDQEPDYQEPDYAAAFEACRSLVCLSGFREIWADYLPAIYPVCTNLTSLNLSYADVNTDQLKSVIRHCHKLQIFWVLDSIRDEGLQAVAATCKDLRELRVFPVDAREETDGPVSEVGFEAISQGCRKLESILFFTQRMTNAAVVAMSKNCPDLVVFRLCIIGRYRPDPVTEEPMDEGFGAIVMNCKKLTRLAMSGLLTDRVFEYIGMYGKLVRTLSVAFAGDTDVGLKYVLEGCPNLQKLEIRDSPFGDGALRSGLHHYYNMRFLWMSSCKLTRQACQEVARALPNLVLEVINNNNEENAGDEEENAGDEVETLYMYRSLDGPRDDAPRFVTILQ

SEQ ID NO: 144465 - protein, 339 aa, Glycine max
  Coding DNA Sequence Number=SeqID_27687
  Pfam annotation: Domain name=Transposase_23; Domain location=80-143; Score=-15.3; E_value=0.054; Accession=PF03017.5; Description =TNP1ENSPM transposase
MTNGDFVPQVREDIRNTAIGRTYHRGHVRAAGSGVTISQYYGRTSRASSARVSTKESNAEITVNLSGEEHVGHVTPPMGLYVQREHCIKLVALGKIYDGPSTIHCVAYADDVVRVSVEKVIDGEAEVPFPTSEIKYVRQALNTFIAWSTPLVIVVSDEDSTITPNKVAKVGELNNDVAEQDPLRELIKTLVDIYDKPVEFVWDVSQFGIPNVDSSLFLTYTDINEITSSDKCLNIAILQLWTMYMNEWSNSLGQQSVYGFLEPQSIHNAKDRRGQYEEYIEKYLKESQRQLYLGAYLNQAHWQMVVLCPKDNVVVWFCSVRRRPDVHIKTAINKLSNIF

SEQ ID NO: 144466 - protein, 185 aa, Glycine max
  Coding DNA Sequence Number=SeqID_27688
MVGYTPSNFADMVFRIEVGLKRGKFGHPTLIKTGADEEDENEGETHAVAAIPIWPSFPPTQQCHYSANNNPSPYPPPIYPQRSSLNQTTKRTYHTTNANTTSSTNQKHQRRKEFCSEKAYRIHPNSAITPTKIPQPPFLREYDSNATCACHGEAPGRSFEHCRALKHKVQGLIDAGWLKFEENCM

SEQ ID NO: 144467 - protein, 93 aa, Glycine max
  Coding DNA Sequence Number=SeqID_27689
MWLPWRSPNLLIKAVENDSQSESGLFWLQMCRTNFMGRRNFLYLKEFFNPGIPTNWVCPPMNAGNSTFLAQICASSISNTGFPSKIQQVGPIC

SEQ ID NO: 144468 - protein, 95 aa, Glycine max
  Coding DNA Sequence Number=SeqID_27690
LANITLAILFGKLQEHEMELMRLNQHEENDKKKKGIALKASSSTQEERDKEDLNEIEEDDDFRLFVKRFNINFLETKEIKRDQTSIQRRKEKIPP

SEQ ID NO: 144469 - protein, 240 aa, Glycine max
  Coding DNA Sequence Number=SeqID_27691
  Gene Ontology: Mol. function=hydrolase activity, acting on ester bonds; Cellular component=cytosol; Biological process=one-carbon compound metabolic process
  Homolog annotation: Hit_ID=P36591; Match level="QueryCoverage=86%, HitCoverage=43%, E-value=5e-13, Identity=26%"; Hit description =Dihydrofolate reductase
  Pfam annotation: Domain name=FSH1; Domain location=5-240; Score= -31.9; E_value=2.5e-05; Accession=PF03959.4; Description=Serine hydrolase (FSH1)
MGSDGVRKPRFLCLHGFRTSGEILKTQLHKWPQSVLDNLDLVFVDAPFPCLGKSDVEGIFDPPYYEWFQFNKEFTEYTNFDECLQYIEECMIKYGPIDGLLGFSQGSILSAALPGLQEKVVFYTCLLDIGPYSPYGHSRSNIGVALTKVPKVKFLIIVGGAKFRSPSVMDKAYSSSISCPSLHFIGETDFLNKYGAELLESCVEPVVIHHPKGHTIPRLDDKSLKTMMDFIERIKKDVSK

SEQ ID NO: 144470 - protein, 198 aa, Glycine max
  Coding DNA Sequence Number=SeqID_27692
MAKFGRPAPEIEGLVAASGLSPLIVCSLDMGDQGLMPTFVECWHKETSSFHLPSLLHLLVVGTFHNFKLLHVDDAIDMLVELLENESYAWGTTALLHMYDNLNNASKSMTRQLVGYITMLQCWIYEHVSSVGVVVPVEDYNEKRPRACRWTPDKALPVNTYRRRLDKLTPDVMCISNRWWQRHLMRQTMMCIMFDMQW

SEQ ID NO: 144471 - protein, 345 aa, Glycine max
  Coding DNA Sequence Number=SeqID_27693
  Gene Ontology: Mol. function=transporter activity; Cellular component= mitochondrial inner membrane; Biological process=transport
  Homolog annotation: Hit_ID=Q10MX0; Match level="QueryCoverage=91%, HitCoverage=93%, E-value=1e-144, Identity=78%"; Hit description =Mitochondrial carrier protein, expressed
  Pfam annotation: Domain name=Mito_carr; Domain location=142-237; Score=94.1; E_value=4.2e-25; Accession=PF00153.17; Description =Mitochondrial carrier protein
  Pfam annotation: Domain name=Mito_carr; Domain location=245-339; Score=112.8; E_value=1e-30; Accession=PF00153.17; Description =Mitochondrial carrier protein
  Pfam annotation: Domain name=Mito_carr; Domain location=48-137; Score= 77.4; E_value=4.5e-20; Accession=PF00153.17; Description =Mitochondrial carrier protein
  Pfam module annotation: Pfam domain module=Mito_carr::Mito_carr::Mito_ carr; Domain location=142-237::245-339::48-137
MSPLIILLVYLCCHILLKLEGEQIKSPSIMKQDVAQDNTNSYPKKSIPPYMKAISGSLGGIMEASCLQPIDVIKTRLQLDRSGNYKGILHCGATISRTEGVRALWKGLTPFATHLTLKYSLRMGSNAVLQSAFKDPETGKVSGHGRFLSGFGAGVLEAVIIVTPFEVVKIRLQQQRGLSPELLKYKGPVHCARMIIREEGFCGLWAGVAPTVMRNGTNQSAMFTAKNAFDVLLWKKDEGDGRVLQPWQSMISGFLAGTAGPICTGPFDVVKTRLMAQSREGGGVLKYKGMIHAIRTIYAEEGLLALWKGLLPRLMRIPPGQAIMWGVADQIIGLYERRYLQLSTL

SEQ ID NO: 144472 - protein, 81 aa, Glycine max
  Coding DNA Sequence Number=SeqID_27694
MEKEKKNAMKKNQQQPYEGVIIQTTSQDITYLEGEPMNLTEARTQEREEAPKRRSPMEQEAGSRTGGRRSVYSVGNNDSYG

SEQ ID NO: 144473 - protein, 324 aa, Glycine max
  Coding DNA Sequence Number=SeqID_27695
  Gene Ontology: Mol. function=RNA-directed DNA polymerase activity; Cellular component=chromatin; Biological process=chromatin assembly or disassembly
MVESTRSKSNLDYLEDAIAKLAATQASMSTKLNDLHQKLAIMEYIHHSPISSSTHSPASSISLSMQPYRMKLEVSCFNGFDPVCWLFKINQFFDYHAMLNHEGLTIASFYMDRPTLAWYQCMSRNNHITLWPGFLQALESRFAPSHFDDPTGSLFKLIQQADDDELSPEDMPSIEAFPIAQEPDDPPPTQISFYAISGHMAPKMLRVIGSIFDQKVLILVDEVLGVQWLKSLGPVLTDYVDLTMKFKHHNRTIELHDGIDAFFHIRLMNPELPSNQQTQPLTQDSTIISLLHRHHSLFQPPTTLPPPRDITHTINLQIPPFSKA

SEQ ID NO: 144474 - protein, 104 aa, Glycine max
  Coding DNA Sequence Number=SeqID_27696
MAPSLVEDFHGLHNEVVGEFEDFLNVEHMVTMVAESFKDFLNIEHRATTVAESTFQIFLMGENPDPNFYSTKQSINDRPVNMHEAQHGRPQRKVTPPQHFHDYV

SEQ ID NO: 144475 - protein, 72 aa, Glycine max
  Coding DNA Sequence Number=SeqID_27697
  Gene Ontology: Cellular component=endoplasmic reticulum; Biological process=ER to Golgi vesicle-mediated transport
  Homolog annotation: Hit_ID=Q8VXX9; Match level="QueryCoverage=82%, HitCoverage=47%, E-value=2e-16, Identity=72%"; Hit description=Bet1 -like protein At4g14600
MAANSHRLGSSYGGAAPYRSRDGLSTRPVGASEEIQLRIDPLDLDDEITGLHRQVRRLKHSKVLKICLQPQF

SEQ ID NO: 144476 - protein, 160 aa, Glycine max
  Coding DNA Sequence Number=SeqID_27698
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=56%, HitCoverage=6%, E-value=1e-14, Identity=52%"; Hit description=Chromo
MARGVSNERQGGYVSPPEEEACKPQVKGLEKLSRHSTGAELTASYKVFLGQEMNQRGCYGSISFDETSIKTCETQKSPQGFKGGGSWPLLNGKYLVRNGLNTGFMYVVLAHKYLVIPMQQIEFSKPACATKLIQQLINRSSGFMRRMWKKASMPSVKSSV

SEQ ID NO: 144477 - protein, 445 aa, Glycine max
  Coding DNA Sequence Number=SeqID_27699
  Gene Ontology: Mol. function=protein serine/threonine kinase activity; Cellular component=flagellin-based flagellum; Biological process=protein amino acid phosphorylation
  Homolog annotation: Hit_ID=Q6YXH1; Match level="QueryCoverage=90%, HitCoverage=86%, E-value=1e-115, Identity=55%"; Hit description =Putative calcium-dependent protein kinase
  Pfam annotation: Domain name=Pkinase; Domain location=86-333; Score =272.4; E_value=9.1e-79; Accession=PF00069.15; Description=Protein kinase domain
  Pfam annotation: Domain name=Pkinase_Tyr; Domain location=86-331; Score=10.9; E_value=3.8e-13; Accession=PF07714.7; Description =Protein tyrosine kinase
  Pfam module annotation: Pfam domain module=Pkinase::Pkinase_Tyr; Domain location=86-333::86-331
MKKKRKESEASGWSSNLPEISKSHHSLERRSRLNKRCREDRGVATVPPSRGASLLLTPSRGLKRKIGCIDKATQMGRSMRIEDDYVTGGSAIGQGKFGSVTVCRARANGAEHACKTLRKGEETVHREVEIMQHVSGHPGVVTLEAVYEDDERWHLVMELCSGGRLVDRMKEGPCSEHVAAGVLKEVMLVVKYCHDMGVVHRDIKPENVLLTGSGKIKLADFGLAIRISEGQNLTGVAGSPAYVAPEVLSGRYSEKVDIWSSGVLLHALLVGGLPFKGDSPEAVFEEIKNVKLDFQTGVWESISKPARDLVGRMLTRDVSARIAADEVLRHPWILFYTERTLKMLPFKSKLKLQNAAASAPESGLGGNKIDDDGSLDEDYSSPFSSSESCNSENHEDCVWIDALSTAVSRVRISETKRTKLWGPTTTSPLDQQGSSNMKTNLCKAF

SEQ ID NO: 144478 - protein, 63 aa, Glycine max
  Coding DNA Sequence Number=SeqID_27700
MREGVSEAAILSNWMVVLFWCGLDYDKISLWALMILAARVNAWRCGGIRRLRDVAFLLWSDGK

SEQ ID NO: 144479 - protein, 70 aa, Glycine max
  Coding DNA Sequence Number=SeqID_27701
MTTTTSLFLLHEVLLRTYTRALYGILLSLWSLKFWEMALDFSNIQSFGYLQKEVQHLSQISNSRRDEHNK

SEQ ID NO: 144480 - protein, 209 aa, Glycine max
  Coding DNA Sequence Number=SeqID_27702
MDRARLVYGLVMKIDMDLGSIISDQISQIARSNSSRLGFPALITALCLARRVVSDSLTFESLSPIINLSYIQKNCWNLEDPSITFPGSRKAKARAPLDASVSAPTPPTPVSALAGPSVPNIDLIVPMLQKHEKPISATTDHDHARVSSASGLTRSPAFLFGGGEAPKAQDAQGTLEDKEAVEDTPEAAEDLGAAEVGVDVDYVADVTTA

SEQ ID NO: 144481 - protein, 104 aa, Glycine max
  Coding DNA Sequence Number=SeqID_27703
MLLKGSLNEPDWLSETHPLSEEVSSLSENKTLENVEPQSSTLSMQPARLVRMLSLLALARPSPLSAQPLILAQRDMLAERTFVLSIGKCLKSLELGRAARSLHF

SEQ ID NO: 144482 - protein, 293 aa, Glycine max
  Coding DNA Sequence Number=SeqID_27704
  Gene Ontology: Mol. function=phosphoribosylaminoimidazolesuccinocarbox amide synthase activity; Cellular component=chloroplast; Biological process=purine nucleotide biosynthetic process
  Homolog annotation: Hit_ID=Q07463; Match level="QueryCoverage=88%, HitCoverage=69%, E-value=1e-109, Identity=79%"; Hit description =Phosphoribosylaminoimidazole-succinocarboxamide synthase, chloroplast precursor
  Pfam annotation: Domain name=SAICAR_synt; Domain location=103-293; Score=136.9; E_value=5.6e-38; Accession=PF01259.9; Description =SAICAR synthetase
  Subcellular localization annotation: CTP_CleavageSite=48; ConfidenceScore=5.64e-01
MGDFTVALNPPKTFRSDNLLSTTNRISPAARGFQTSLAFKPRVFRGIRASVMPREGQPQQQQQQASSLGDALVNSPRRNDVVEAIGRTASLSNCLSETNLHATVPGLESKTRGKVRDIYDAGDYLVLVTTDRQSAFDRILASIPFKGQVLNQTSLWWFERTKHIVSNAVVSAPDNNVTIARKCSVFPVEFVARGFVTGSTDTSLWTVYNKGVRNYCGNVIPDGMVKNQKLPKNILTPTTKAADHDVPITPDEIFGKTPYLVPGTVLIIERGLMTRADYVEASEKALSLFEYGQ

SEQ ID NO: 144483 - protein, 365 aa, Glycine max
  Coding DNA Sequence Number=SeqID_27705
  Gene Ontology: Mol. function=heat shock protein binding; Cellular component=mitochondrion; Biological process=protein folding
  Homolog annotation: Hit_ID=Q38813; Match level="QueryCoverage=82%, HitCoverage=67%, E-value=1e-80, Identity=52%"; Hit description =Chaperone protein dnaJ 1, mitochondrial precursor
  Pfam annotation: Domain name=DnaJ; Domain location=47-107; Score =54.4; E_value=3.7e-13; Accession=PF00226.21; Description=DnaJ domain
  Pfam annotation: Domain name=DnaJ_C; Domain location=261-364; Score =2.6; E_value=1.1e-06; Accession=PF01556.9; Description=DnaJ C terminal region
  Pfam annotation: Domain name=DnaJ_CXXCXGXG; Domain location=172-248; Score=37.6; E_value=1.5e-09; Accession=PF00684.9; Description=DnaJ central domain (4 repeats)
  Pfam module annotation: Pfam domain module=DnaJ::DnaJ_C::DnaJ _CXXCXGXG; Domain location=47-107::261-364::172-248
MIVHRDIIVTIIKDKIIENLVRWYGYMQRWPLKALVRRVDCMVFSFVKRDGGRLRMTLEEIINRDFKLAKKYHPDANKNNPSAKRKFQDIREAYETLRDSKKRAEYDQMRTRGSEDIEYDRDDAERFRNAYRSHFSDSFHKVFYEIFEEATTQFSSNIEVEMSLTFSEAARGCTKHVSFDASVPCDHCNGQGYPLDAIPKVCPTCRGSGRVTIPPFTSTCITCKGSGRIIKDSCITCGGSGVVEGVKEVKVTIPAGVDSGDTIHVPEGGNAAGSGGQPGSLYIKIKAIFCPNILTLTCATCWVNVHFGHPKLHVAEDSIFVRDGADIYVDSNISFTQAILGGKVEVPTLSGKMQLKVRQDLLFQY

SEQ ID NO: 144484 - protein, 47 aa, Glycine max
  Coding DNA Sequence Number=SeqID_27706
MSSMNHKENGLDLKLEFRIPYLHPRSFGSRCSSPSKLVLWVARHSRI

SEQ ID NO: 144485 - protein, 98 aa, Glycine max
  Coding DNA Sequence Number=SeqID_27707
MVGGDQGNNNDKSGSDNDGNGGCGGDNGNENGGSSNGEKNSDRMVMTIVMWSDGNNDSGGGGGGCSDNNGDDSDGNSSNDDDNNNEMVMIMVVMTIMQ

SEQ ID NO: 144486 - protein, 115 aa, Glycine max
  Coding DNA Sequence Number=SeqID_27708
  Gene Ontology: Mol. function=ribonuclease H activity; Biological process=RNA-dependent DNA replication
  Homolog annotation: Hit_ID=Q1S3X4; Match level="QueryCoverage=87%, HitCoverage=57%, E-value=5e-10, Identity=36%"; Hit description =Ribonuclease H
MLMEVPLATLRCGALNKVFRIVQCESDSLVALDLINHDQPPWHPYVALLNTILSFKDRPRFLSFNHVYGEENQCSDWLARMGSSSADVFTILDSSPHPLATFLLADAMRVSFSRL

SEQ ID NO: 144487 - protein, 40 aa, Glycine max
  Coding DNA Sequence Number=SeqID_27709
MIYGHGRWNPSLASVVQLAEESYSSHALFPISPSLATSKP

SEQ ID NO: 144488 - protein, 347 aa, Glycine max
  Coding DNA Sequence Number=SeqID_27710
  Gene Ontology: Mol. function=phospholipid binding; Cellular component= coated pit; Biological process=endocytosis
  Homolog annotation: Hit_ID=Q7X9S1; Match level="QueryCoverage=87%, HitCoverage=88%, E-value=2e-44, Identity=38%"; Hit description=Fiber protein Fb19
  Pfam annotation: Domain name=ANTH; Domain location=31-298; Score= -62.4; E_value=0.00023; Accession=PF07651.6; Description=ANTH domain
  Pfam annotation: Domain name=ENTH; Domain location=31-162; Score= -27.3; E_value=0.0074; Accession=PF01417.11; Description=ENTH domain
  Pfam module annotation: Pfam domain module=ANTH::ENTH; Domain location=31-298::31-162
  Subcellular localization annotation: CTP_CleavageSite=60; ConfidenceScore=5.13e-01
MSLRKRLRNLGHNLKDKASVIAASLSLKRHVSSVRIHVLHATTHRLSAPPSTSQIAAVLSAGKGSYLLSRTCIDTIMDRLHRTRSATVALKCLFTLHNIVSERKGPLTLKDNLSHYPSNGGRNALNVSTFRDDTDVETMELSAWVRWYANVLEHVLTVSRVLGYYLINSNDGTREVFSSVELFREIRGLVDFVEQVSHAPESLHLQKIELVFNVVRLVCEDYGRVQREILRRVEEGGNRVEDLDVGELREFVRCMKRLEGCREKLVVLFVNRKRNDAFWDLIGKVKYKGVEVMEEMEGKWLMVVKKGMNELAESTRFTNPFLEPGEFMYSGPTGWRVATCQPVPTVG

SEQ ID NO: 144489 - protein, 229 aa, Glycine max
  Coding DNA Sequence Number=SeqID_27711
  Subcellular localization annotation: CTP_CleavageSite=35; ConfidenceScore=5.07e-01
MSLPSEDYTSSPSEGRTPSPSEDYTSSNFRGLQVLVVKGSCTFTFVGLHALTFRVLHVLAFRGLHVLAIRDYMSPIFKGRHAFTFRGLHVLAIIGLHSLRHGLCHHDIGIAPTKTPSGPGEVQQGPGVSSSGCGPLSVLQGAHSPSEESLSQRHPVDPEKSNRALGFLAQGSRLQDTQWTRRSPTGSWSCQALITGLCQFYGVPVTSSKGIRPLTNRAFIKKYCVPRQA

SEQ ID NO: 144490 - protein, 153 aa, Glycine max
  Coding DNA Sequence Number=SeqID_27712
MANTKANQSESSEISPNETSKRQRMSPASVEECPRLIPNLPDDLSLQIIARLPRICYYHISHPSTDCKIKNNLTPTVVSQCHHLLIPIVMAITQIGMNTTTSTQPTQQQDNDDEVHVETNLSSFVWQLQEQLFEMRRQHAQEISTLRQENVEL

SEQ ID NO: 144491 - protein, 126 aa, Glycine max
  Coding DNA Sequence Number=SeqID_27713
  Subcellular localization annotation: CTP_CleavageSite=99; ConfidenceScore=5.88e-01
MTNASNAMVSINRSNVMTSTNASNATTPILISSMTTSTPVSNMMSTTSMLLYSNVNLVSNTRLEQISPFITMPTMGPGTSYQGGQTFNNNNNGTPLNLREMLITMGQKKYKVQVGMKKVNPYLHRF

SEQ ID NO: 144492 - protein, 78 aa, Glycine max
  Coding DNA Sequence Number=SeqID_27714
MARKRKFICGALIIIRHDIRRRIAGNYVINLPIENWDKKEEHLEEYLEEVDKSMWLKRMKKRQTLLAYWNLLALVRKK

SEQ ID NO: 144493 - protein, 88 aa, Glycine max
  Coding DNA Sequence Number=SeqID_27715
MSSHRGLSFRTKGLFSKIDWALEAVKLFGNCQNSDDFFGNYQNSNDFLVTIKILTTIRISMTFYKLNFPTIFPIAFKYRGGGCASTSK

SEQ ID NO: 144494 - protein, 197 aa, Glycine max
  Coding DNA Sequence Number=SeqID_27716
  Gene Ontology: Mol. function=hydrolase activity; Cellular component =cytoplasm; Biological process=flavonoid biosynthetic process
  Homolog annotation: Hit_ID=Q1SGA8; Match level="QueryCoverage=89%, HitCoverage=48%, E-value=6e-49, Identity=54%"; Hit description=2OG -Fe(II) oxygenase
  Pfam annotation: Domain name=2OG-FeII_Oxy; Domain location=41-140; Score=139.5; E_value=9.4e-39; Accession=PF03171.10; Description=2OG -Fe(II) oxygenase superfamily
QTLEEYITKGRELIAELLKGISLSLGLEENYIHKRMNVDLGSQLLVINCYPPCPKPELVMGLPAHTDHGLLTLLMQNELGGLQIQPNGKWIPVHPLPNSFFINTGDHMEILSNGKYKSVVHRAVANTKGIRFSVGIAHGPELDTIVGPAPELVGDDDPAAYRAIKYRDYMQLQQNHELDELSGGLIFCITYTLLYKD

SEQ ID NO: 144495 - protein, 177 aa, Glycine max
  Coding DNA Sequence Number=SeqID_27717
MPSISQGPKNGRMSSSKGPRMKLGIRPCNACFILLVLDLVIGPPIPCKGSLDRLHGHMIFCTTKAIGIEEEIKNMVKGDSISKVHCFNKKETSSDALKMLPITFTTIDLKVIDLVQDNLAIIIVEITNCVVKETLVDQDSSTDIKCSNSWKSSKRSFYHMMNPRLDSLGKNNHKGVD

SEQ ID NO: 144496 - protein, 217 aa, Glycine max
  Coding DNA Sequence Number=SeqID_27718
  Homolog annotation: Hit_ID=Q17U57; Match level="QueryCoverage=64%, HitCoverage=56%, E-value=1e-07, Identity=37%"; Hit description =Receptor protein kinase, putative
  Pfam annotation: Domain name=B_lectin; Domain location=60-172; Score=- 0.1; E_value=0.0024; Accession=PF01453.15; Description=D-mannose binding lectin
MANTCKQGKSHLFLVLGYSWLWWTTCNVVAARTQILKPGDTLNSITKLCSESSKYFMKFSETGSGAGAYLFINQPVDADSVVLSLDLSGQLKIESNNTKTIILYSSPPPSNNIVATSLDIGNFLLQHHRSDVTESELWKSFDYPTYTLLPGMMDHGCVFHGRKMRGVATNVYLRKTSEKPERCSLRSLIVKGSGVVFTHGEGISTPRLRHKGRQPLT

SEQ ID NO: 144497 - protein, 172 aa, Glycine max
  Coding DNA Sequence Number=SeqID_27719
MAASSASTQGCVLPITSFATELVEFNGKCFAPSPGLEAETKKLWETQVMIPFSLAEKQLAFAEFPVETPGEQAKLIEIWTCFLTWDILVVGLNVKDVAFYPYHLQLFSHQFGLSQLKPYPIMKKLPNLEDFVVTEDNRWNNFYSKEFITAPRNSIIGGTTSIRKGPFHLRIA

SEQ ID NO: 144498 - protein, 179 aa, Glycine max
  Coding DNA Sequence Number=SeqID_27720
  Gene Ontology: Mol. function=oxidoreductase activity; Biological process=flavonoid biosynthetic process
  Homolog annotation: Hit_ID=Q1SGA8; Match level="QueryCoverage=82%, HitCoverage=42%, E-value=2e-31, Identity=43%"; Hit description=2OG -Fe(II) oxygenase
MFSVKELVDSNSLRSVPSNYICLNNPEDSILYNETENIPTIDFSQFTSSNPNERSKAIQQLGNACRDWGFFMLINHGVSETLRDEVIRASQGFFDLTEKEKMEHSGRNLFDPIRYGTSFNVTVDKTLFWRDYLKCHVHPHFNAPSKPPGFRYHSPHSLFFYFVLYHSWKKERYIKRKVG

SEQ ID NO: 144499 - protein, 89 aa, Glycine max
  Coding DNA Sequence Number=SeqID_27721
MNLRFVFEKLDAASLDLNSKRTGSYPFASCLAGLEWLWAGDWLGRWWWFTEEEGVAEWWLVVAWLFRHSDCSYSPLTRTVINAAFKGQN

SEQ ID NO: 144500 - protein, 417 aa, Glycine max
  Coding DNA Sequence Number=SeqID_27722
  Gene Ontology: Mol. function=transferase activity, transferring phosphorus-containing groups; Cellular component=integral to membrane; Biological process=two-component signal transduction system (phosphorelay)
  Homolog annotation: Hit_ID=P0AEC8; Match level="QueryCoverage=96%, HitCoverage=75%, E-value=1e-117, Identity=54%"; Hit description =Sensor protein dcuS
  Pfam annotation: Domain name=PAS; Domain location=224-319; Score =14.4; E_value=0.018; Accession=PF00989.14; Description=PAS domain
  Pfam annotation: Domain name=PAS_4; Domain location=230-324; Score =10.5; E_value=0.019; Accession=PF08448.1; Description=PAS fold
  Pfam module annotation: Pfam domain module=PAS::PAS_4; Domain location=224-319::230-324
MKEAELQPPARKRARSLKLSTAVTLMIGSVIGAVLLLVYALWFMQISHATRDGLKETALAVARTMADMPQVKRGLGEPPQSNIIQPLAQSITRRNDLLYAIVTDMRGIRYSHPDSAIIGKPFIGEDIRPTLAGRENVAINHGVLAPALRVFTPVFNEQHQQIGVVVVGISLSKVDEQIANSRWDVLLTILFSALVCAIGTWSLVRGLKRILLGLEPQDISTQFQQRQAMLHSLKEGVIAVDSSGQVTLINPAARGMLLSGPDKSIDRTPLLADLQEVLRSGEPIYDRALGCNGLLLISNTVPVRSQNAIVGAISTFRDKTEMSQLVQRLDGMMSYVDALRTTSHEFMNKLHVILGLLNMKSYDKLEEYVLQTAHAYQADIGEIQHRIKSPVVAGFLIGKIQRAKERGFTLNLAEESL

SEQ ID NO: 144501 - protein, 133 aa, Glycine max
  Coding DNA Sequence Number=SeqID_27723
  Gene Ontology: Mol. function=RNA-directed DNA polymerase activity; Biological process=RNA-dependent DNA replication
MENCSILLFSQKGIEVDPDKVKAILEMLESRTEKQVLGFLGRLLHKNQSVKWDNDCRVAFKRIKRFLRNPPVLIPPVPGRPLIMYMTVLDELMECVLGQHDCRNLPFGGRATRDSLDACSTKGIRAESPPTFI

SEQ ID NO: 144502 - protein, 110 aa, Glycine max
  Coding DNA Sequence Number=SeqID_27724
MSLPGAVHVSSTFEFGAMLHDCLSVDPQHGASGDWEICFSVIFRIAKKEGVETRIVITERAERTKSVSYLCLPLIFDERYLAPFVAQYVKSRDVPKIKRKQAYAIRENSV

SEQ ID NO: 144503 - protein, 51 aa, Glycine max
  Coding DNA Sequence Number=SeqID_27725
MGFPLPAVIYLAENLSGFSIRHLLSLEEISLCFASEERMRILFYRPRFNKV

SEQ ID NO: 144504 - protein, 78 aa, Glycine max
  Coding DNA Sequence Number=SeqID_27726
MCEDMMQMRKSATEGRTTSNNMLSKRKTLDEGSLLSSKSETQHDHRFTSTPYVPMDPGIGPLCNSPCVQIVLVFVCIK

SEQ ID NO: 144505 - protein, 166 aa, Glycine max
  Coding DNA Sequence Number=SeqID_27727
KLSYVKGDCLMSGVVALTLVCQAPKYGQELFGVESDNLNKRENCKSVKLVKPPTLDKRVRHTRNTLAYVSLVECTRTGDAIRGLRVLHRIGGGISHLRGRVQPSTTSLAGEPVPVTVILPPSIFGGARRSGGRDAKASLACDVKLENPEDSYKIVIQACGSDDFPF

SEQ ID NO: 144506 - protein, 274 aa, Glycine max
  Coding DNA Sequence Number=SeqID_27728
  Gene Ontology: Mol. function=RNA-directed DNA polymerase activity; Biological process=RNA-dependent DNA replication
MREKGAIIILEGANNVTLKQALKLNFKASNNQAKCEALIAGLKLAKEGEQHQSRPALKAGNTKMTGHLKIIIQDTLQTPTINTEEMRMKLEPATISSLMVSYSKEDIPRTTPDNRHNLSSPWPFTMWGMNILGPLPKTPGAVKYLLVAINYFTKWIEARPLRQVIANEALCTRLDKSTGLCDAILPRKGPVTRAMSKRLQEDWARAAEEGPRVLMNLRSTKFRALLFLSLHSSPSSSKLLSMASYGEAKESIDEEDPRPTSSNGAYITIEGGTP

SEQ ID NO: 144507 - protein, 139 aa, Glycine max
  Coding DNA Sequence Number=SeqID_27729
MVRAIDVLGLFFNIRPSVLVRLTGVTMPLSVVALATREWGQPVVEVGHIGGIVEVSLNALSFILAKRKQDDGAGVSGRNKSRAPLSLHTLRQATGLMPGLGCSSSLQDLPLAPSIVEASAPDAVVVVVVPAPPTPPTDE

SEQ ID NO: 144508 - protein, 235 aa, Glycine max
  Coding DNA Sequence Number=SeqID_27730
  Pfam annotation: Domain name=Transposase_23; Domain location=150-220; Score=-1.4; E_value=0.0016; Accession=PF03017.5; Description =TNP1ENSPM transposase
MAEKTKKRLDEVAQSGSTKGVIDRPSPIRRHVKWKMARTKKSGQTTSEAAKKIAEKIDVLTAALGRPEHPGRVHAAGVGVTIKQYFGSAPRTSRSSSSLPPEDLHMQSQFQSQMQSQELALPLEPEVGPSDARVSTKESCVDPLGNNPETGKSNKCGLYIEENPSRMVSLGRLYEGSTAVHNIPLLHDQVKVGVEEVKDEEARIPVPTDKVTLVGQTLNTLLAWPTHHVKRLSEQ

SEQ ID NO: 144509 - protein, 247 aa, Glycine max
  Coding DNA Sequence Number=SeqID_27731
  Gene Ontology: Mol. function=oxidoreductase activity; Cellular component=membrane; Biological process=metabolic process
  Homolog annotation: Hit_ID=Q5F4T6; Match level="QueryCoverage=98%, HitCoverage=98%, E-value=4e-86, Identity=67%"; Hit description=YgfF
  Pfam annotation: Domain name=Epimerase; Domain location=4-238; Score=- 40.7; E_value=0.0017; Accession=PF01370.11; Description=NAD dependent epimerasedehydratase family
  Pfam annotation: Domain name=KR; Domain location=5-192; Score=-19.9; E_value=3.4e-06; Accession=PF08659.1; Description=KR domain
  Pfam annotation: Domain name=adh_short; Domain location=2-175; Score =114.3; E_value=3.6e-31; Accession=PF00106.15; Description=short chain dehydrogenase
  Pfam module annotation: Pfam domain module=Epimerase::KR::adh_short; Domain location=4-238::5-192::2-175
MDLALVTGGSRGIGRATSLLLAQAGYRVAINFRQRAAEALQVVADIEAQGGSAFALQADIADEAQVVRMFRQLDQQPGALRVLVNNAGILFSQCRVEDLDAARIQRVLATNVTGTFICCREAVKRMSTAHGGQGGAIVNVSSAAARTGSPNEYVDYAASKGAMDTLTRGLSLEVAAQGIRVNSVRPGLIYTDMHADGGEPGRVDRLASSLPMQRGGQAEEIAAAIAWLASDAASYVTGSFIDASGGR

SEQ ID NO: 144510 - protein, 71 aa, Glycine max
  Coding DNA Sequence Number=SeqID_27732
MEKNPLTNLMRKSMRLFFLKTLWKMKMEVFRIRALHLKMNPKLKSFNKAKKSLPHLLKTSQENGELKETSH

SEQ ID NO: 144511 - protein, 63 aa, Glycine max
  Coding DNA Sequence Number=SeqID_27733
MKGIGFGSILGRIDFLLTESVANSDDEWSADLRTNPLQKGGDDAILPRRGPVTEVMARRLQED

SEQ ID NO: 144512 - protein, 203 aa, Glycine max
  Coding DNA Sequence Number=SeqID_27734
  Gene Ontology: Mol. function=oxidoreductase activity, acting on paired donors, with oxidation of a pair of donors resulting in the reduction of molecular oxygen to two molecules of water; Cellular component=endoplasmic ...
  Gene Ontology: Cellular component=reticulum; Biological process=fatty acid biosynthetic process
  Homolog annotation: Hit_ID=Q949X0; Match level="QueryCoverage=83%, HitCoverage=43%, E-value=4e-63, Identity=64%"; Hit description =Palmitoyl-monogalactosyldiacylglycerol delta-7 desaturase, chloroplast precursor
  Pfam annotation: Domain name=FA_desaturase; Domain location=1-175; Score=-12.3; E_value=1.3e-05; Accession=PF00487.14; Description =Fatty acid desaturase
MAVVLVPLVPDVPNNPTRNHANIQALCECGFWFSHMSWLFDTTSILERCGEANNVGDLEKQSFYRFLRSTYLAHPFALGALLYAAGGFPFLVWGMGVRIVWVYHITWFLNSACHVWGIKHGTPGTFGNWFEFLYIHYNLRWVALLAFGEGWHNNHHAFEYSARHGLEWWQLDMTWYVVRFLQAIGLATDVNLPRESEAENGIQ

SEQ ID NO: 144513 - protein, 313 aa, Glycine max
  Coding DNA Sequence Number=SeqID_27735
  Gene Ontology: Mol. function=RNA-directed DNA polymerase activity; Cellular component=chromatin; Biological process=chromatin assembly or disassembly
MLEHNTRQATLDRLEEAVHRLTQAQATLSQNHANLTQTQTSMTTKLDFVLEHLAALIIPTPSPQPPPHTTSPPPPTPKPHMKLDAPRFDGQDPVGWIFKISQFFDYQGLPDHKRITVASFYMDGPALSWYQWMTRNGFISSWPALLQALESKFAPTFFEDPQGALFELQQRSSVNDYLTEFERLANRIIGLSSPSLLSCFISGLYPELRREVQALQPMSLPQAVALAKLQEEKLQDRRWPPRAQPFTQSQVSRPATSSSLVPSTVRPQIKRLTVGELVVRRDKGLCYHCDKKWIVGHRCRPRLHLLIADEEDD

SEQ ID NO: 144514 - protein, 348 aa, Glycine max
  Coding DNA Sequence Number=SeqID_27736
  Gene Ontology: Mol. function=chromatin binding; Cellular component =chromatin; Biological process=chromatin assembly or disassembly
  Homolog annotation: Hit_ID=Q1SAV4; Match level="QueryCoverage=79%, HitCoverage=96%, E-value=3e-60, Identity=37%"; Hit description =Integrase, catalytic region
  Pfam annotation: Domain name=rve; Domain location=104-252; Score=7.5; E_value=0.0014; Accession=PF00665.16; Description=Integrase core domain
MLHNIMQCPTDHPGFTVKNGMIFSQDKLWLPAGHDLSKVLMDEYHHTSTGSHMGVEKTFRRINQYFCWPKMRHDIKQYIGHYGICQMTKQPNLKPAGLWQPIPLPSSFWVDLSMDFITGLPPSQSYTTILVVVDRYSKSIHIGPLPQHYTAHKVVILFLDIVCKHHGFPRSIISDRDLIFLSAFWRDLFLPHGTGLSQFEVMFGKPPPVLPFYCVGTSPVEAVDSILTSRETIHSTLTRRLQKYQANMKRVADAPRWDICFNIGDWLPSSSKIHPVFHISLLKPHHGPPPPEAPNLPAFTVDHHPLVQPLRLLDWKMDESTMPPTPMTLVQWARLPPEETTWENWPQL

SEQ ID NO: 144515 - protein, 476 aa, Glycine max
  Coding DNA Sequence Number=SeqID_27737
  Gene Ontology: Mol. function=nucleoside-triphosphatase activity; Cellular component=membrane; Biological process=cell division
  Homolog annotation: Hit_ID=Q66FW2; Match level="QueryCoverage=43%, HitCoverage=65%, E-value=2e-94, Identity=80%"; Hit description=Cell division protein
  Pfam annotation: Domain name=ABC_tran; Domain location=1-162; Score =166.4; E_value=7.1e-47; Accession=PF00005.17; Description=ABC transporter
MAFLTGHSGAGKSTLLKLICGIERPSAGQIWFSGHDISRLRHSEVPFLRRQIGMIFQDHHLLMDRSVYDNVAIPLIISGASGEDIRRRVSAALDKVGLLDKAKSYPIQLSGGEQQRVGIARAVVNKPAVLLADEPTGNLDNALSEDILRLDVCTEATMVNKRNKRPAAPKAAKQPSKSKALKGGWQEQWRYAWRGTLSDMYRQPLATLLTVMVIAISLTLPSVCYMVWKNVSQAAAQWYPAPQLTVYLDKALDDTAAENVTAELKKLDGVDKVNYLTREEAQSEFRNWSGFGGAMDMLEQNPLPAVAIITPKLNFQNSDTMANLRDRVAKVQGVDEVRMDDSWFARLAALTGLVGQVASMIGLLMVVAVFLVIGNSVRLSIFARRDTINRCGAVADSVGSAGAAPAVGGGAGRLRLRSAAAVNRGHHRLDCRLAGDGATFTSFYAAVTHSNDFLIYSSSAADDLGAEDFSDFPRRH

SEQ ID NO: 144516 - protein, 122 aa, Glycine max
  Coding DNA Sequence Number=SeqID_27738
  Subcellular localization annotation: CTP_CleavageSite=36; ConfidenceScore=5.19e-01
MFHTPDNSAKPSEAVKYASFQALHESRSHVDDKKVTSMLSPSPSRLMLRPRSSRVTLDLLSIMEEPVTTIRILGIEIQPYLPPPPGSVRILGVELRPYLPPPGPLLEIDAPVSNANMKPQPS

SEQ ID NO: 144517 - protein, 98 aa, Glycine max
  Coding DNA Sequence Number=SeqID_27739
  Homolog annotation: Hit_ID=Q2QMW0; Match level="QueryCoverage=58%, HitCoverage=12%, E-value=5e-12, Identity=56%"; Hit description =Expressed protein
MVKLVTLAKGNTTWQKGRFGENTIISNIDTGFVGNVGSCTKINRPVDIITVVGGQGYSLHADIQYLDARWEVLVVLPLRDCFAQEINMLCRLDGFVVL

SEQ ID NO: 144518 - protein, 131 aa, Glycine max
  Coding DNA Sequence Number=SeqID_27740
MGSNIPTHPHRPIDLMGVVLQTISPYRSVLKDITRGCCFLRDFHAACKPNRHARWRFHEGRPVVIATSIGESYVDTSRWVDWRVQSTYVHRLGLGRHRGAGGAGVAEGITIVTSDLRFGYRHCWRFALREL

SEQ ID NO: 144519 - protein, 76 aa, Glycine max
  Coding DNA Sequence Number=SeqID_27741
MVDSLLAQFLAVPQNILKKATLYTTQPGEAPLPRSLLTLDLHVSDVEVEVTTLILGPPGSEKEAIEKAKLDLHLKI

SEQ ID NO: 144520 - protein, 100 aa, Glycine max
  Coding DNA Sequence Number=SeqID_27742
MHRLKNGREKEKLRKCFSTGTRKNEEMSSLYIGSETLFNDGDDNTEVTLWSSKSINFMVSLNVVELSSVILVVMDSQTTSATNLMCWECKLGKRALDVFG

SEQ ID NO: 144521 - protein, 77 aa, Glycine max
  Coding DNA Sequence Number=SeqID_27743
MTKKDAKKMADRVPGNGHFDDGDGGHQCRFWVREEVAAIGFGRRDCGNGGVWFEGFEQLREGTKVFERARGRNDQIE

SEQ ID NO: 144522 - protein, 70 aa, Glycine max
  Coding DNA Sequence Number=SeqID_27744
MCLPGKGKETLGSAKIEENHSKCINLTQCKANKSPKHKILGKVYGELGLWLKACRTDGHDICQGVGLVQG

SEQ ID NO: 144523 - protein, 110 aa, Glycine max
  Coding DNA Sequence Number=SeqID_27745
  Gene Ontology: Mol. function=hydrolase activity, acting on ester bonds; Biological process=lipid metabolic process
  Homolog annotation: Hit_ID=Q9AYM5; Match level="QueryCoverage=100%, HitCoverage=43%, E-value=2e-52, Identity=86%"; Hit description =CPRD49 protein
  Pfam annotation: Domain name=Lipase_GDSL; Domain location=9-109; Score=5.4; E_value=0.00064; Accession=PF00657.12; Description=GDSL -like LipaseAcylhydrolase
MVGPMRPKIVLFGSSIVQMSFDNGGWGAILANLYSRKADIILRGYSGWNSRQALDVLDEVFSKDAHVQPSLVIVYFGGNDSVHPHPSGLGPHVPLQEYVANMRKIANHLK

SEQ ID NO: 144524 - protein, 145 aa, Glycine max
  Coding DNA Sequence Number=SeqID_27746
MGYVKLTWCGGIDGSHKVNNCNGDSGTRDTNVANSGVGGISCNVCSGDDDNNNNENSNDDNDVNNSRASGGDRDNSGNGANIVNSGVGGGSSNVCDDDSSNNDNGVGSDDNGGKNNDVNGDGSNTSDNNNNSNDDDNVNDCSGNN

SEQ ID NO: 144525 - protein, 102 aa, Glycine max
  Coding DNA Sequence Number=SeqID_27747
  Gene Ontology: Mol. function=hydrolase activity, acting on ester bonds; Biological process=lipid metabolic process
  Homolog annotation: Hit_ID=Q9AYM5; Match level="QueryCoverage=97%, HitCoverage=39%, E-value=4e-47, Identity=86%"; Hit description =CPRD49 protein
MELCDEMNIKAINLWSAIQTRDDWLDVSFTDGVHLSAEGSKVVVKEILKVLREVDWKPSLHWMSMPTEYAEDSPYYPPNPDGTTTINVSYCISRKWLQWDDL

SEQ ID NO: 144526 - protein, 63 aa, Glycine max
  Coding DNA Sequence Number=SeqID_27748
MSPRPTATPIAVAMGPSPGTQRDLVMLCMMHPRVAHEAYSHDRRQSLPAVSHCKTWRSCTLID

SEQ ID NO: 144527 - protein, 45 aa, Glycine max
  Coding DNA Sequence Number=SeqID_27749
MPGQTAERHAAPGWLHTQGPVALNASDAAARAAAASALTSLVGAV

SEQ ID NO: 144528 - protein, 155 aa, Glycine max
  Coding DNA Sequence Number=SeqID_27750
  Subcellular localization annotation: CTP_CleavageSite=35; ConfidenceScore=5.30e-01
MRIGRRPGRPQGVRVGRFINAAGTTGFPTGKRAVSATQLMSTLEDPTHTSQSACMTSMFCSEIQQAGTVSGHEREGPIATAIGVAVGLGLIEQSHGRCQECAILCGLKQPDSCPGKLIMESSGRVQLGMCFQTCKIESLTDTGSCMKLYMHASGT

SEQ ID NO: 144529 - protein, 138 aa, Glycine max
  Coding DNA Sequence Number=SeqID_27751
  Gene Ontology: Mol. function=protein-tyrosine kinase activity; Biological process=protein amino acid phosphorylation
  Homolog annotation: Hit_ID=Q1SX72; Match level="QueryCoverage=56%, HitCoverage=7%, E-value=6e-21, Identity=66%"; Hit description =Tyrosine protein kinase, active site
MRKEKIPHQAPFAIQAAQLLGRAIGAGLFAITPAGERGMCCKAIKLELAYTREENEKCDVFSFGVLCLEIMMGKHPGDLISSLFSGSASNLLLKDVLDQRLPHPEKPDVEEVILIAKIAFACLTEIKSMFSPKHGTSA

SEQ ID NO: 144530 - protein, 177 aa, Glycine max
  Coding DNA Sequence Number=SeqID_27752
MASRKRAKIYDIPSPSTPAPSSAIIEPDVQSSQTLVPMLQSLFQGQVIIMHSLRELAHQRPIITMEQFLEQVARPGALPSMVRPNEAASPEPTPARVEPVPADPQSPAANSPSPKLEVVPPSPPIIIISDSPSGESVAPPDSPAGEAADLSGSLSGEVVALSDSPIFHLIDEEEAQT

SEQ ID NO: 144531 - protein, 640 aa, Glycine max
  Coding DNA Sequence Number=SeqID_27753
  Homolog annotation: Hit_ID=Q6YH14; Match level="QueryCoverage=46%, HitCoverage=88%, E-value=1e-130, Identity=78%"; Hit description =Putative heterogeneous nuclear ribonucleoprotein
  Pfam annotation: Domain name=RRM_1; Domain location=297-368; Score =94.0; E_value=4.4e-25; Accession=PF00076.12; Description=RNA recognition motif. (a.k.a. RRM, R
  Pfam annotation: Domain name=RRM_1; Domain location=377-451; Score =21.5; E_value=0.0015; Accession=PF00076.12; Description=RNA recognition motif. (a.k.a. RRM, R
  Pfam annotation: Domain name=RRM_1; Domain location=474-547; Score =40.9; E_value=4.4e-09; Accession=PF00076.12; Description=RNA recognition motif. (a.k.a. RRM, R
  Pfam module annotation: Pfam domain module=RRM_1::RRM_1::RRM_1; Domain location=297-368::377-451::474-547
MPPKTAKRGSASSFSKRGGRGGRGTLKASQNQQQHEPAEETVKVEEKQQPVVVVVAEEEQHTVVVEEENPAVEEKRLVVEEKESVVVVEDKAIDMNQMAPEAVEEASHAANGLSVAKRFWLCLHLVVIKVLNGNCGFGFIVILYIAGNWNKCGQGGHLRLQFRHGNVVANSRKAIAQYDEEEVKESIDEYEKDERLDLEDNDPEYEPEEYGGVDYDEKELEQDEGHEVGNEVEEEVAEDNVGEEGDTGEEEVEDVHDELEGEEEHEHEHEHPDFADVEEEEHREVVKERRKRKEFEVFVGGLDKDATESDLRKVFGEVGVVTEVRLMMNPQTKKNKGFAFLRFETVEQAKRAVAELKNPVINGKQCGVTPSQDSDTLYLGNICKTWTKEALKEKLKHYGVTNVEDLTLVEDTNDEGKNRGFAFLEFPSRSEAMDAFKRLQRRDVVFGVDKLAKVSFADSFIDPGDEIMAQVKTVFIDALPPSWDEDYVRDLLRKYGEIEKIELARNMPAARRKDYGFVTFGTHDAAVKCADSITGTELGEGHKKAKVRARLSRPLQRGRGKHSSRGDYRSSRGSGMMTRPSWGRPAPHSFPSRSVRGVGSRTPPVRSVSVRDRRPMMSIPARSRPVPPPSRSYDRRPVGM

SEQ ID NO: 144532 - protein, 121 aa, Glycine max
  Coding DNA Sequence Number=SeqID_27754
MAKETKKLENMDYARTSTLTQVVSFQRVSVEGRLFGDYEEASKQLSDDTVEGGGSKAMEWLEGKRQVGQNAFNVNVEGQGKETKGGDEVIEKQQNPENPTTIRPKEKARRGMKKLCQERIA

SEQ ID NO: 144533 - protein, 214 aa, Glycine max
  Coding DNA Sequence Number=SeqID_27755
  Gene Ontology: Mol. function=DNA binding; Biological process =regulation of transcription
  Homolog annotation: Hit_ID=Q8LFS2; Match level="QueryCoverage=54%, HitCoverage=30%, E-value=3e-23, Identity=42%"; Hit description =Regulatory protein
MDNLKQALGSFTVVTLLFAGVLLLYNWSSSFSNELVLSQKEPLCEQSNFTTTNVEAYGDGLDTALAKTSMENKTVIIAIVNKAYVEQDVESDTTMLDIFLGSFWLGEGTRSLIDHLLIVTVDRTAYDRCQFLRLNCFRLETDGVDFEGEKIYMSQDFIKMMWRRTRFLLEVLKRGYNFVFTIYRHAARISDLIKSVYQLANFSKLDTNVQWSWV

SEQ ID NO: 144534 - protein, 379 aa, Glycine max
  Coding DNA Sequence Number=SeqID_27756
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-55, Identity=32%"; Hit description= UPI00006A17C9 related cluster
  Subcellular localization annotation: CTP_CleavageSite=46; ConfidenceScore=5.78e-01
RTARPRLKRAVRLRLQRTTRPRFKRTTRPRLKRSAQPRLQRASRPRLQRTTSPRFQRATRLRLQKIHVLAFRGLHVLTFRGIHFFAFRGLHVVAFRELHALAFRGLHALAFRGLHILAITGLHVLPFTGLHVLAFRGLHILSLRGLHVLAFRGLHVLAFRGLHVLAFSGLHVLAFRGLHVLALRGLHVLTFRRLHVLTFRGLHVLAFRGLHVFAFRGLHVLAFRGLHVLAFRGIQVFAFRGLHVVAFKELNALAFRGLHALAFRGLHVLAFRGLHALPIRGLHVLAFRGLQVLPFKGLYALAFKGLHVLPFRGLHVLAFRGLHVLPFRGLHALAFRGLHALAFRGLHVLTFRGLHVLALRGLHVLAFRGLHVLAFRGLQ

SEQ ID NO: 144535 - protein, 117 aa, Glycine max
  Coding DNA Sequence Number=SeqID_27757
MEVEEPWQGLWLPLHYQVVFRHWACGKQASLVADLGMAFMDDWTHFDPFFEEDQIRKALKVCNPPFFHRRVVVGGEIKAPPKCFVGVYHQLFSLQWHIQGKARSRLDYGREFHVSPP

SEQ ID NO: 144536 - protein, 92 aa, Glycine max
  Coding DNA Sequence Number=SeqID_27758
MDEPVQVVSSQWVDARVSCSDNVEKIKPKRQVFLGKEKSDSRNPTTEGHNEKPLAKERPMEEDPIEEKPRGDQTAMVVSERDIMFILCFFAL

SEQ ID NO: 144537 - protein, 271 aa, Glycine max
  Coding DNA Sequence Number=SeqID_27759
MGKSDSGGSIQQPLMEREVIPIGDSSLEETRSEAFDSRSSSFERVEPSTAPLDEEPILDTTILLSSPSVAIGRNIGGEVRVSPHNQCRRSTGAPSFLLPSSLAMNGISKKMFEFDSNVFRMFKDHFFRVMATDIVAGEFPLMHDQNGEPYFSFYWQLSPTRFKSFDECQMSLEERVDKSILEQFPTLLDAGAIPSLLSVGDPRTILDGIMGQLEARFDLNEDEVIEATGLVFDLSCLSPTIPQGSSSDLLVVQATIATAAVSNPLVPPVTP

SEQ ID NO: 144538 - protein, 54 aa, Glycine max
  Coding DNA Sequence Number=SeqID_27760
MTTGGRREPLLLAAEPPHEEEHFNQSGILLKDLVEKIPLILYFTASLRVFLHFL

SEQ ID NO: 144539 - protein, 67 aa, Glycine max
  Coding DNA Sequence Number=SeqID_27761
MKSQSNMYWSLLLMALVTGPFLGRIASVSKAKSVRDDSWKLGRIICEAAKSTHTRRRCTGGILRISV

SEQ ID NO: 144540 - protein, 152 aa, Glycine max
  Coding DNA Sequence Number=SeqID_27762
  Homolog annotation: Hit_ID=Q1S9I4; Match level="QueryCoverage=56%, HitCoverage=7%, E-value=3e-07, Identity=34%"; Hit description =Integrase, catalytic region; Zinc finger, CCHC-type
  Pfam annotation: Domain name=zf-CCHC; Domain location=80-97; Score =25.8; E_value=5.4e-05; Accession=PF00098.13; Description=Zinc knuckle
  Subcellular localization annotation: CTP_CleavageSite=39; ConfidenceScore=5.60e-01
VLIPSSSVNTTPELRIFFLTGLPSVFPTFSSNKRWWRLRAYSFRGTRIPRVTRRPPAKGHVATHPNFNNGRRSQEDSQILRCYKCNQLGHIKGNCPSNEEWPKKSDKKRYEERRTKKAYIAWDDNDSSNGSEKEINLLTKDYESDENISQED

SEQ ID NO: 144541 - protein, 187 aa, Glycine max
  Coding DNA Sequence Number=SeqID_27763
MGPVVSFYQFLGHPLILEGDPTVRAQPEREAITQLLCIPGQDFTRAAAKRRVRVMRTNMTTLTQIWMTLLLSNIPPDDHNVDLPPMEVSVGLCRHDIGITPTRHLGDPEKSNRALGFPALVTGLCQSYRVPIPPASSCHRDIGITPVRHSVDPEKSNRVLGFPALIMGLCQFYGVPVTPQQGHQAPY

SEQ ID NO: 144542 - protein, 247 aa, Glycine max
  Coding DNA Sequence Number=SeqID_27764
MNVGYLISHQISLIAQDDTSRLGFSALIIALCKARGVQSDLRSLESLSPTINLAYIKKNCWNLVDPIVTFRGPRKARGKRSEAPSTSASSKAPVPSSSTLPPSSSTEILVIPPAPLEIPLPAPISTGPVDFIFTPQMLHSMLQSIHRGQSIIMQSLQGLGLPFIMNMEEFDAQVSWPGDQPSSSGGGGASTAQEPVTEEPPAAAAATKDEDELTPPKPFDFDVVVEPEQTIQDSLAAPTLDLNEDQP

SEQ ID NO: 144543 - protein, 51 aa, Glycine max
  Coding DNA Sequence Number=SeqID_27765
MNFLNPSFSTNLKIQVVVLALIVVEFHVLVILKELLSFAVVELEYDMEREC

SEQ ID NO: 144544 - protein, 319 aa, Glycine max
  Coding DNA Sequence Number=SeqID_27766
  Gene Ontology: Mol. function=catalytic activity
MPVGHPGGCTADSVTTPRSMPACNAIDPGACGAGACPQCARIDRRGEATAGDPVQPQRPPHRAAHAGGVSADGRPGWRATVAARAAASGRRALWLLWITDCRCVEDGPALSRRVPQFIRDPPKGLLGTIPIEAMEADVQVLRAGRPIELVEATLRHDHRPALRVRAWLMRPNDTQAIAGTPIAAIAAPESMPAWDPGTVWPGGFIKSVEIRRHDQGPGRATYWARAKHALLDGEPVSPLARAATLFDLSNGMAVRADPKEVAFPNLDLTAHLFGMPEGEWLGFDTSVSFGHQGLGLTSTVLHDARGPIGMLGQALTVRP

SEQ ID NO: 144545 - protein, 194 aa, Glycine max
  Coding DNA Sequence Number=SeqID_27767
  Gene Ontology: Mol. function=RNA-directed DNA polymerase activity; Biological process=RNA-dependent DNA replication
MGAYSRDEKLLMHFFQESLARAVVTWYTNLEASRICSWKDLITAFIRQYQYNTDMALDKTQLQNMSKREHESFKEYAQWWRDLAAQVLVGYMPYSFANLVFAGKRIEVGLKRGKFDYVAPAGMNNRRFKASGAKKKEGDAHTVTQLLLGRSPNKPLTTLPICPTSTKLFSPHRKLFQSGARLAKGTRSTTKGPH

SEQ ID NO: 144546 - protein, 115 aa, Glycine max
  Coding DNA Sequence Number=SeqID_27768
MVQRKDKELRRSSNGIFGDYHKWLKARTQELDWLPKLKVSSEEEVETPEESEEVQALKAELERVQAVKERFKTMAIKRAQASKGRERPVKRRGHNIRGLVEGFSKVKEEFVRTIE

SEQ ID NO: 144547 - protein, 222 aa, Glycine max
  Coding DNA Sequence Number=SeqID_27769
MLVIEEKVRGLETRAKDVEDVVQSHAKEVERLKADLATTKKERDVERSEKVQIEQKAYNEAYEAYESSFKHCLRQVLFHYELVLIDDILKDAPPSGEQPTTPPSKTFLDDEWMALPVPSNLASMMEFIFGLVEPLIMSSSVSSSMYYLRMREGTPLKEHLDESNFVLMEFCDIDVNIKDEDLKMILLACLPPSYENFVNSFSVGKDSNTLEEAKSSLYSREL

SEQ ID NO: 144548 - protein, 203 aa, Glycine max
  Coding DNA Sequence Number=SeqID_27770
MASRKRKSTASRPQAQYDTRRFHSLDAWNRYTDNILGWNILPERNVQIYHTEFDEFKVELERRNLHKGLANLQDGSIDVAVVKEFYANLYTTEEQAPKQAKIEARLCIPRKGFVLNAEGQPWKLLRKDLMTLAQTWSVFFYSNLAPTSHTSDLNMDRARLVYGLVTKMDMTIGALISGQISLIAQSNSTRLRFPALITALLRS

SEQ ID NO: 144549 - protein, 102 aa, Glycine max
  Coding DNA Sequence Number=SeqID_27771
MVSWDLGSRLVERMDMIYIRALVAWMRAHTAYSRLTTSNVSNKKCGDLGHVAPLPPKKPSRPIISSSMWDSFASPGDPAGSSLAWASGQSSGHATSAPNCSG

SEQ ID NO: 144550 - protein, 111 aa, Glycine max
  Coding DNA Sequence Number=SeqID_27772
MVWVPKGSLVKTNIQGPKKIWVPKSKYDSMNDGLLEAKLMVVIIKKGENVNVNHAGILPKTNYFQEIKGTGNRLPGIAIDYQRQDCKWFFKRVLKFESCNRLPITTFQKTL

SEQ ID NO: 144551 - protein, 830 aa, Glycine max
  Coding DNA Sequence Number=SeqID_27773
  Gene Ontology: Mol. function=RNA-directed DNA polymerase activity; Cellular component=chromatin; Biological process=chromatin assembly or disassembly
  Pfam annotation: Domain name=Chromo; Domain location=692-746; Score =38.6; E_value=2.1e-08; Accession=PF00385.14; Description='chromo' (CHRromatin Organisation MOdifier
  Pfam annotation: Domain name=RnaseH; Domain location=139-258; Score= -18.6; E_value=0.0031; Accession=PF00075.14; Description=RNase H
  Pfam annotation: Domain name=rve; Domain location=389-545; Score =121.2; E_value=3e-33; Accession=PF00665.16; Description=Integrase core domain
  Pfam annotation: Domain name=zf-H2C2; Domain location=330-371; Score =15.5; E_value=0.0032; Accession=PF09337.1; Description=His(2)-Cys(2) zinc finger
  Pfam module annotation: Pfam domain module=Chromo::RnaseH::rve::zf -H2C2; Domain location=692-746::139-258::389-545::330-371
MPFGLMNAPATFQATMNDIFRPFLRQFVLVFFDDILVYSKNEQDHLNHVKLVLEVLVKHCFVANKKCSFGCSQVDYLGHIISAVGVSVDPSKVKCIMEWPEPKTVKGVRGFLGLTGYYRKFVKDYVMTTSPVLALPNFDVAFEVECDAAGRDIGAVLMQNRQPIAYFSKALSENNLAKSVYEKELMALVLSIQHWRHYLLGKEFVVYTDHKSLKHFLQQKISSPDQQCWLAKLLGYQFEVKYKPGLENKAADALSRCYDDCELAVMAYSPVWIGRQQLLKDVENDVSVQELLKKVVENPDKYPGFVIHQGIFDLYIKGYCCIMTLLKECHETPMGGHSGFLRTYKRVAENLYWIGMQKTVRDYVRACDVCQRQKYAATTPGGLLQPLPIPNAIWEDLSIDFITGLPKSRGYEAILVVVDRLSKYSHFILLKHPYTAKTIAEIFVKEVIRLHGIPMSIVSDRDPLFISHFWREIFKLQGTSLKMSSSYHPETDGQTEVINRCLESYLRCFVAEQPKTWSYWVSWAEYWYNTTYHESIGKTPFEVVYGRQPPKLIRFLSNETKVAAVALELQERDEALSQLKAHLLRAQQQMKTYADKKRRDVKFEVGEWVFLKLRPHRQQSVVKRINQKLAARFYGPFKIIKKIGAVAYKLQLPDQSKIHPIFHVSLLKKAVGEYHVQNELPKDLEVIMHEEIYPVRVLGTRIIMKNGSSVPQSLIQWKDKSIDDVTWEDDVVIRGQFPKFNLEDKVLIEEGGIDRNADELVGIDEGPRPKTHYETLYWMTKDEWKWIQMRIGLRQQKNQEEPERELEGGIWESEGAGATKGGDRSGLRLK

SEQ ID NO: 144552 - protein, 898 aa, Glycine max
  Coding DNA Sequence Number=SeqID_27774
  Gene Ontology: Mol. function=RNA-directed DNA polymerase activity; Cellular component=chromatin; Biological process=chromatin assembly or disassembly
  Pfam annotation: Domain name=RVP_2; Domain location=397-511; Score= -22.3; E_value=5.5e-05; Accession=PF08284.2; Description=Retroviral aspartyl protease
  Pfam module annotation: Pfam domain module=RVP_2::RVT_1::Retrotrans _gag; Domain location=397-511::630-799::108-198
MGDRIEALETQMGNVTTTLQELALQMSQHAQQMQQQSLVLTELSKQIGQKGATQEGEAFVGDSSQNESRLAGKKVKLPLFEGEDPVAWITRAEIYFDVQNTPEEMRVKLSRLSMGGSTIHWFNLLMETEDDLSWEKLKKALIARYGGRRLENPFEELSTLRQTGSVEEFVEAFELLSSQVGRLPEEQYLGYFMSGLKAPIRRRVRTLNPANRMQMMRIAKDVEEELREEDDDENRASMKKNVGRSEYGPRSKFRTGSNLTQKEITRFSKSGWTNPSRKTVSIGSTSNTTSSLSSTGRKHEGDRRGGTNDRWRGISSEEMEERRAKGLCFKCGGKYHPTQHKCPERSLRVLILGDGESLNDDGEIVAMEGEESEEEEMTEAECKLIGVLGKMGESQTMKIEGKLEHVNVGVLIDSGASHSFISPELVTALGLKVTPTTVKSIKLGDGHKVLSEGVCRRVRLVLGSNEFEIDALVLGLGGLDVVLGVSWLSTLGKVVMDWKDLTMQFWHNGEMMTLKGQGGRQLVQGCLHTYLEGKDRAMSPIELWSLEEKLLDSNVKIQGNIGDLLTTFPEVFTEQLSLPPIRSQVHQINLIPNYGPVNMRPYKYPHHQKEEIEKQVAELLQAGVIRPSMSAFSSPVILVKKKDGSWRMCVDYRSLNKATVPDKYPIPVVDELLDELFGSTVFSKIDLKSGYHQIRVHEQDIHKTAFRTHNGHYEYLVMPFGLMNAPATFQATMNDIFRPFLRQFVLVFFDDILVYSKNEQDHLNHVKLVLEVLVKHCFVANKKKCSFGCSQVDYLGHIISAAGVSVDPSKVKCIMEWPEPKTVKGVRGFLGLTGYYRKFVKDYGKIARPLTDLTKKDNFLWNESAREAFQKLKTVMTTSPVLALPNFDVAFEVECDAA

SEQ ID NO: 144553 - protein, 150 aa, Glycine max
  Coding DNA Sequence Number=SeqID_27775
  Gene Ontology: Mol. function=3'-5'-exoribonuclease activity; Cellular component=exosome (RNase complex); Biological process=RNA processing
  Homolog annotation: Hit_ID=Q2PYZ2; Match level="QueryCoverage=80%, HitCoverage=40%, E-value=3e-38, Identity=65%"; Hit description=3'-5'- exoribonuclease/RNA binding protein-like protein
MAGVVISGEDEWVQINQLERRKRETREVQIPAVAMNDDGKIVLVSGEDGQKPVNKEKRKLTLRSIPFSLTCILHKNYILADPTAEEESIMETHVTIVLDTSGQLISLYKPGGPALAYTSAIQDCVGLTGQRVKELKSYLDKENSAMEVVV

SEQ ID NO: 144554 - protein, 83 aa, Glycine max
  Coding DNA Sequence Number=SeqID_27776
  Gene Ontology: Mol. function=beta-pyrazolylalanine synthase activity; Cellular component=chloroplast; Biological process=cysteine biosynthetic process from serine
  Homolog annotation: Hit_ID=Q43317; Match level="QueryCoverage=77%, HitCoverage=20%, E-value=1e-17, Identity=64%"; Hit description =Cysteine synthase (EC 2.5.1.47) (Beta-pyrazolylalanine synthase) (Beta-PA/CSase) (EC ...
  Homolog annotation: Hit description=2.5.1.51) (L-mimosine synthase) (EC 2.5.1.52) (O- acetylserine sulfhydrylase) (O-acetylserine (Thiol)-lyase)
MGPSHSHYVQAQEWAKKVHYETTGPEIWEGTGGKDDALVSGIGIGGTIMGVGKFLKEKNPNINLYGMEPAESPILSGGEPGEL

SEQ ID NO: 144555 - protein, 49 aa, Glycine max
  Coding DNA Sequence Number=SeqID_27777
MGPMTKSRTKQSEDTFQQMVSDILNKAQVENDEGPEALPRILIVAEGPN

SEQ ID NO: 144556 - protein, 190 aa, Glycine max
  Coding DNA Sequence Number=SeqID_27778
  Homolog annotation: Hit_ID=Q1RTH1; Match level="QueryCoverage=45%, HitCoverage=24%, E-value=5e-24, Identity=75%"; Hit description =Peptidase C19, ubiquitin carboxyl-terminal hydrolase 2; Zinc finger, FYVE/PHD-type
MWAGDIFENKPAATLTRSSSSLPRPLPSSLRKRERGGDFFQKKNDGDDDGVKRSGGNNGNKNARTCLACDMDAMFSFVFSGDRAPYSPAKFLYRSVYGDGVTLQTLPLMNNRMHMIFSFPCLMESIRRWRRYQREEAKIQAWVNLENAKAEARYQREEAKIQAWWKLLWLLCAFHSTVEAAVTSNMYGWN

SEQ ID NO: 144557 - protein, 156 aa, Glycine max
  Coding DNA Sequence Number=SeqID_27779
  Subcellular localization annotation: CTP_CleavageSite=60; ConfidenceScore=5.02e-01
MLQPYEISIGLKEHSNPVTPKAYTQKSPSGPLPPDSDRDSSISNGFLRFFQFFPLTAPIEFSNVRETDKGLKPPLVLSWCDSFVSLRKHYLTNPNDRFGFLRERKRLRCERYFSQLKHDIEIPNGENARNWVANMVLKFHDDLTVNESEIVIFLRQ

SEQ ID NO: 144558 - protein, 262 aa, Glycine max
  Coding DNA Sequence Number=SeqID_27780
  Gene Ontology: Mol. function=RNA-directed DNA polymerase activity; Biological process=RNA-dependent DNA replication
MLKANEKTKVMSMQLKHMKVKAVKDIGKKIEDLTSEKKTTEEELGTTRGEIAEMKKTFGKMKSELQGREIAKLDEAKRLIVLNHQEGFKKAQRQVKVWLPSFDSAQLDVNCDIVDDEINGEYNGTPIGCSGARLPTGPWGLLIMPDTKWHEEFFIVFFDKLSFIVNYNGLSNKEELDLAFCSGKWFEYVRSLHDKMPRGRDVVECLGWCVVAIVEFLAFLIGFNVLSTIFPQGRPIVTNADDPWCHAPTSDLYSANSPEHLV

SEQ ID NO: 144559 - protein, 213 aa, Glycine max
  Coding DNA Sequence Number=SeqID_27781
  Gene Ontology: Mol. function=aspartic-type endopeptidase activity; Cellular component=intracellular; Biological process=proteolysis
MVEDKIINKILVDGGASLNILPRSMLWRFGRNVEDLIPHNIVVADFCGKPLDSKGAICLDVFVGSKRRPTEFLVISSLANFNMLLGKEWIHKVVAIKSPVHQKLFFWNEDGILEMVEADQSSYGIYVAFAYESDQAMAIIAPFKIEDLFYVNNKSEAYSSFMARLSTYIADNKKQTTTVVVEIGDMTTVAVKIKEAAIVIFEIKDKKKRWILK

SEQ ID NO: 144560 - protein, 53 aa, Glycine max
  Coding DNA Sequence Number=SeqID_27782
MVEKPKRRSVNFEDKGSGVVYAWGRFILIANKKSFKALDLEIMFYILKSRENC

SEQ ID NO: 144561 - protein, 131 aa, Glycine max
  Coding DNA Sequence Number=SeqID_27783
  Gene Ontology: Mol. function=nucleoside-triphosphatase activity; Cellular component=integral to membrane; Biological process=transport
  Homolog annotation: Hit_ID=Q93YS4; Match level="QueryCoverage=90%, HitCoverage=16%, E-value=2e-20, Identity=49%"; Hit description=White- brown complex homolog protein 23
  Subcellular localization annotation: CTP_CleavageSite=70; ConfidenceScore=5.01e-01
MEKANTSLVRTKSDQLVESMVAALKSPASSDHSANGVVEGGGTISRKSSRRLTGASPGRGGKNTHIRKSRSAQISQMKLELDDVSSGAALSRASSASLGLSFSFTGFTMPPEEIADSKPFSDDDIRKYMTI

SEQ ID NO: 144562 - protein, 87 aa, Glycine max
  Coding DNA Sequence Number=SeqID_27784
MGENDIIIDKQEFKTPVTGHPAGFLDPKYPPHLSNVAQEWLEEWSSVPGLVWQGSLEYQEGLLASKEKIDPPLERVDLLKSMVISLE

SEQ ID NO: 144563 - protein, 140 aa, Glycine max
  Coding DNA Sequence Number=SeqID_27785
MGSGVARFKEAYNNDEERWEFTEKELLKDEPRFEAEFMGESSKRSKVSVSSGYLPSSSLGTPIEVEEYDMASMSRPIGQKAAKRKNKGKGDASASNNFDLSAIESVMKEKNVNTAKLIELKESQEKRLQEQEKHLEYGIL

SEQ ID NO: 144564 - protein, 80 aa, Glycine max
  Coding DNA Sequence Number=SeqID_27786
MDKRSVIVPPSLHAPSSQPLPHAITIAAPPSCNHHRCPSIWGIWLWLGSSVFHFQILVQLVHQNILRDFIEQLGVGCLER

SEQ ID NO: 144565 - protein, 192 aa, Glycine max
  Coding DNA Sequence Number=SeqID_27787
  Homolog annotation: Hit_ID=UPI000038CAEF; Match level="QueryCoverage =93%, HitCoverage=20%, E-value=6e-08, Identity=25%"; Hit description =COG2319: FOG: WD40 repeat
  Subcellular localization annotation: CTP_CleavageSite=75; ConfidenceScore=5.25e-01
MNCVFVHASSTHEFGAMRSDCLVQFSILNLFRSPMNCVFVHASSTFKFGAIRSDCLVQFSILNLFRSPMNCVFVHASSTFEFGAMRSDCIVQFSILNLFRSPMNCVFVHASSTFEFGAMRSDGLVQFSILNLFRSPMNCVFVHASSTFEFGAMRSDCLVQFSILNLFRSPMNCIFVHASSTFEFGAMRSDGL

SEQ ID NO: 144566 - protein, 48 aa, Glycine max
  Coding DNA Sequence Number=SeqID_27788
MLSPPKPNSSSLDSPLSEREWTRTKWRHENDTVSGGAETERKRHERFY

SEQ ID NO: 144567 - protein, 173 aa, Glycine max
  Coding DNA Sequence Number=SeqID_27789
  Homolog annotation: Hit_ID=O49581; Match level="QueryCoverage=97%, HitCoverage=100%, E-value=8e-36, Identity=46%"; Hit description =Auxin induced like-protein
  Pfam annotation: Domain name=Auxin_inducible; Domain location=38-133; Score=127.4; E_value=4.1e-35; Accession=PF02519.5; Description=Auxin responsive protein
  Subcellular localization annotation: CTP_CleavageSite=57; ConfidenceScore=5.22e-01
MSSVDLKKSNKIREIVRLKEILKKWRKIANSSKSTTTIATATSTTSKSMKFLKRTLSLSEREGGSSNVVPKGYLAVCVGEELKRFTIPTEHLGHQAFQILLREAEEEFGFQQTGVLRIPCEVAAFESILKMVEGKEDMFSSQECRLSIEEMMIEYCSENQLAYSHHPQSPLCR

SEQ ID NO: 144568 - protein, 313 aa, Glycine max
  Coding DNA Sequence Number=SeqID_27790
RGFELNADGHPLKILRKNLTTLAQTWSVLSFSNLIPTSHTSDVTLDRAKLIYGIIVKMDTNVGYLISHQISITAQHDSSRLGFPALITALCKARGVQSDSRSLESLSPAINLAYIKKNCWNLDDPTVTFRGPRKTRVKKSEVSTTSTAPKTAAPSSSTAPAPPISTPAQTPTILAPSAHIPLPAPLSFGPSDFLFTPQILHSMLHSLHRGQAIIMQSLQGLGLPSIMSMDEFDTQVAWPGVQPSPSGGGEASVAQEPEPEELAAATEGEDELTSPEPFYFDADPSPAPIPDDSMPSAPASELEQPISQDSPAA

SEQ ID NO: 144569 - protein, 86 aa, Glycine max
  Coding DNA Sequence Number=SeqID_27791
MVFGMRESIGAPMRLPSPPLCRSVDGSYCWKIRRKRGKGRWKAEAGRWNKYDNGKGPPGTSLQQCVSPDHPTESEIEKYLLVFPAS

SEQ ID NO: 144570 - protein, 133 aa, Glycine max
  Coding DNA Sequence Number=SeqID_27792
  Gene Ontology: Mol. function=phosphogluconate dehydrogenase (decarboxylating) activity; Cellular component=mitochondrion; Biological process=pentose-phosphate shunt
  Homolog annotation: Hit_ID=Q9FFR3; Match level="QueryCoverage=81%, HitCoverage=22%, E-value=1e-20, Identity=47%"; Hit description=6 -phosphogluconate dehydrogenase
MGGRVVACVVFAARDAHAEVEEAFVSNKVHVVLDVLVPLIIVVDDAIVGVEVVEEGGDGVVNGGTGLDKDDDRSRTLEGDNEVARGVLAREREGAFIVCTIYDLHLEGDGLVGQSLHSGKRKGERRSGGSVEW

SEQ ID NO: 144571 - protein, 322 aa, Glycine max
  Coding DNA Sequence Number=SeqID_27793
MSYRFIYYLCESIHLSTVQHNTHITFDESCKDKPFMSNYNMGAQFKVSTIVKTYLMLECYYGTIVGTLINCSYDCHVRTQGKISIKTTLPPRNLTYPLGSSVRRALKKPKINTQLYMSSVPKFKTKHNPNPEMNIRPSGVHEKPRPIANANVGNGEVVPKPIADMKLTVEEAHVYAYIFNSKLDPNGSEIGFRTGNNFGTRRHFESLCPNKTIAHEGSIKSCVLAIVFEKLDISWGIEDMDHWDILQPRGIPNWGSSDNSTLWVLEWMQMEESFVTILYGPLDDKYVRIKLAMTLLLGPHNNKSTIVSATELNWDEFIQGNH

SEQ ID NO: 144572 - protein, 205 aa, Glycine max
  Coding DNA Sequence Number=SeqID_27794
MDNVEVLGFCLTWINIRGVPLQFWNNECFTKILNIIGSLVSVDKQTSSFVNLDRARILVRTMWMEFINQHRRIQINKKVCNIMVLEENGGYDEGREMCVKGGWWGKMVTSEEPFPVVDGKGLSNSMVNLVIRVCDSGQGYKGTNNEFESFSSQQGEQNEKADKSDEGGDTSKKNDNVGNSVEAQRDPLPKGGRPGKERNLKSRGS

SEQ ID NO: 144573 - protein, 92 aa, Glycine max
  Coding DNA Sequence Number=SeqID_27795
MFGYVDFDGNVDDDEDITSKGEDDEYDEDVDGSGDQVEEYEEYEDDDEMHSMNIEDVARLSFSDLEIAYQFYCWYGRIVGFFIGAVPGSHEW

SEQ ID NO: 144574 - protein, 73 aa, Glycine max
  Coding DNA Sequence Number=SeqID_27796
MEEDDGECLLQPLNPKSLCFHEAQTLLVALKPMSLAWPICLAKRVINNFNLLFFGLQTELDSTLGHKNGVSTL

SEQ ID NO: 144575 - protein, 111 aa, Glycine max
  Coding DNA Sequence Number=SeqID_27797
MENRMLTKGYPCCCLCRAKVPKNLDVDTSSGDFILQNNVEKGPWETPLFLSKSLGNMMMLPEKMLLVQELCKRIGKQIRDFNFYNVQTLETKVQTLKDANMQLKLQLAILE

SEQ ID NO: 144576 - protein, 227 aa, Glycine max
  Coding DNA Sequence Number=SeqID_27798
MFFNVKNTISMPLLSKFCQTTLETPFPPPTTIAGHHEPLLLNAELPYGVEHFNRSGILRIHLKDSVENKLSILSFIAILRATTHTVWRVKRPKVANPIVSFVEAVKSNNQLCFKEREKNLAGKAWLKESESRLEKSELRAAREREAINELEENLIIYKKEVGEQHEKGFNKAIRQAEFFTKDLDFGLFYPFKDVKEAVLLNEEDIAAEEEDIGEEQNAKEQGNAANV

SEQ ID NO: 144577 - protein, 77 aa, Glycine max
  Coding DNA Sequence Number=SeqID_27799
MVGKIQNDSDDMTRYGRERRKGANASLAPKPPDGAFGDKSSREKLMGKPAQLSESRDLIKEGLMTVNYDGGNRLLNP

SEQ ID NO: 144578 - protein, 57 aa, Glycine max
  Coding DNA Sequence Number=SeqID_27800
MPKPGKRTQTRVLSTFVSEAEKTGPKDALLAREQQQRYDDYGVRRGPLKRHGIRPKS

SEQ ID NO: 144579 - protein, 49 aa, Glycine max
  Coding DNA Sequence Number=SeqID_27801
MSPLPLKTSQSLKKTPSKLFKMPPLALYGNPIGGLSLSANLALSLEDDG

SEQ ID NO: 144580 - protein, 271 aa, Glycine max
  Coding DNA Sequence Number=SeqID_27802
  Gene Ontology: Mol. function=RNA-directed DNA polymerase activity; Cellular component=intracellular; Biological process=RNA-dependent DNA replication
MKFPTLMREVVTVAPYPPTREPAKLHPTMDGTTQVMSMDKRDLTSHEHRRIADVLHRNTNLFAWKPFDMPRIHPSIIYTSSPFVPRPNRYHKRRERWENNDIKRSEKKWTSLSKPTSSERLGIPPSSPTSLCIDRLIDGASEFQVLSFLDVYSEYNQIWMHTLDEEKKTFITEDDNFCYRVYIDDMVVKSHSIAQHMIELEEALCSHIPDKCTTILEMHSPTNIQEVQMLNSRLASLSTFIPKLVEKAKPFYKLLKKIEPFLGTRLANKLS

SEQ ID NO: 144581 - protein, 82 aa, Glycine max
  Coding DNA Sequence Number=SeqID_27803
MVSGETSSLWNVFQYKMSVELSSSMRALDTMKLAITMDTTIGSSWLMRLIPLKSLSMKVHFPDVAEVIDRVFLGGVFVFLDL

SEQ ID NO: 144582 - protein, 145 aa, Glycine max
  Coding DNA Sequence Number=SeqID_27804
MRRGCRTLSVPTTPIATAIVDEVVIANSRNSAMQDESRFPDESRDSSPAAGLAILHPAKTHRRVESLDREDECVSASLFSQPWQGVKGWLGSDMTRVVGFRSRRDSVCMRGGDGVGQSHEARWSIVMMVAQFKSRLEESEGKRKG

SEQ ID NO: 144583 - protein, 218 aa, Glycine max
  Coding DNA Sequence Number=SeqID_27805
  Gene Ontology: Mol. function=translation initiation factor activity; Cellular component=mitochondrion; Biological process=translational initiation
  Homolog annotation: Hit_ID=Q9FH50; Match level="QueryCoverage=77%, HitCoverage=45%, E-value=1e-29, Identity=42%"; Hit description=APO protein 3, mitochondrial precursor
  Pfam annotation: Domain name=DUF794; Domain location=6-217; Score= -38.2; E_value=5.2e-13; Accession=PF05634.2; Description=Arabidopsis thaliana protein of unknown function (DUF794)
MSTCNELPRKLNKSERKPPVTSFNDLKRQARLKKKERQKVHENTLQPPENGLLVDHLIPIAHEVYAARCELISSVSTLVNYTAIYTCSLCGEVHVGHAPHKIRTCDVRGSPSSKEHSWAKVGVEHVLPLVDSFHLYDRIGRAVSHNEMLEVDRIPAIVELCVQAGPSPVYTVAGRIIDFEKRFPKEISLGEDIEAHGFWLMDVNTNSMAMQSDDIQGL

SEQ ID NO: 144584 - protein, 113 aa, Glycine max
  Coding DNA Sequence Number=SeqID_27806
  Gene Ontology: Mol. function=RNA-directed DNA polymerase activity; Biological process=RNA-dependent DNA replication
MKVEQLFDCHHISEERKVPLATFSFQGDPPVDYWNDLKSALGKRHIPSYYERKLMEIQRRRQGSMSVEEYRQQMELLLLRDGLREKEKISIASFPSGLIWKRGTRLNSFHIGT

SEQ ID NO: 144585 - protein, 191 aa, Glycine max
  Coding DNA Sequence Number=SeqID_27807
MGLLIETASASEAPSKVKRLIHGILFNIEKPRIESKDYVMIGEKVNLLEVIFYYKLQAFKDKFSQKSKKNPIPYGMFFTYIKRYVRVAPSIVTTQLKRITFVKIGIAKNFPEYVKQHIKKKAKNEPMEEPQSMVGQIVGTQDQPVDCKSTTTSQHTKGEHAQPKPELALRLNIANPYSNYPPKEKTNLLNL

SEQ ID NO: 144586 - protein, 124 aa, Glycine max
  Coding DNA Sequence Number=SeqID_27808
MAPPLTSSPLSFAATPWQKKSLVATRKKAKFDKSLDKKEAIDMEQGILPLVEALSSEEHRKKVVEDARQVGFASKDSKENTNDVVLESLNTFCTKEVMRKVAKEATIMDMDGEPVPEAIILESA

SEQ ID NO: 144587 - protein, 90 aa, Glycine max
  Coding DNA Sequence Number=SeqID_27809
MVVAYMDPAEIEALVEAMLIYVIEAFLRDQDNDIVEADVERFYPWPVFEDDEQIVTTALSDEMDEDILRRMEDEYGEKEFYLFSVIIFWC

SEQ ID NO: 144588 - protein, 182 aa, Glycine max
  Coding DNA Sequence Number=SeqID_27810
  Gene Ontology: Mol. function=nucleic acid binding; Biological process= DNA integration
  Homolog annotation: Hit_ID=Q1S9I4; Match level="QueryCoverage=98%, HitCoverage=17%, E-value=1e-28, Identity=40%"; Hit description =Integrase, catalytic region; Zinc finger, CCHC-type
MARSMLCEKSLPKKFWVEIVNITCYFQNRILIRHLIKRTAYELWRIGSSVAPKVDEVKKYDEILPQTRRFSDKQPQIRDKKFVHFHPQDHTIGDHVEGVKTRSLFKDLASDALVSKIESKTIDEALIDDGLIIAMEEELYHLTRNNVWVVVLKPNNKSIIGTRLVFKKKFDEQGKMVETRIG

SEQ ID NO: 144589 - protein, 234 aa, Glycine max
  Coding DNA Sequence Number=SeqID_27811
MIASKPMKADELFKEENLCLMANTTIEELESKQEEEVDFNNPESLKQAYHELLSNSFILSKAYNCLKKDFKKFSRDHIEFQEKHEAIVNKSLAVTTQERWTLVKFKIIPKRRRPYYHNTNRRGPKNIWVPKDMILPIIDILDSRKETPIMLHPSSMSSNNEDLESTIPKIDTINIFKEGEPMIRIEHFFDIGYLEYRGLSFHETILNCGIQSYFIEPQTIHLEPTKMFWRNAEF

SEQ ID NO: 144590 - protein, 86 aa, Glycine max
  Coding DNA Sequence Number=SeqID_27812
MTLQFADGSKKKALWKVLNMTIKDIEDQQVPINQGRSFMRTAHVTINVSKGVYTLKEGKKQMLYYIQGIGDFPNEFAHQQHHHMAP

SEQ ID NO: 144591 - protein, 248 aa, Glycine max
  Coding DNA Sequence Number=SeqID_27813
  Gene Ontology: Mol. function=oxidoreductase activity; Cellular component=membrane; Biological process=metabolic process
  Homolog annotation: Hit_ID=Q8PBR2; Match level="QueryCoverage=95%, HitCoverage=100%, E-value=1e-115, Identity=87%"; Hit description =Oxidoreductase
  Pfam annotation: Domain name=Epimerase; Domain location=20-233; Score= -53.9; E_value=0.013; Accession=PF01370.11; Description=NAD dependent epimerasedehydratase family
  Pfam annotation: Domain name=F420_oxidored; Domain location=19-190; Score=-49.6; E_value=0.041; Accession=PF03807.7; Description=NADP oxidoreductase coenzyme F420-dependent
  Pfam annotation: Domain name=KR; Domain location=20-181; Score=-96.1; E_value=0.086; Accession=PF08659.1; Description=KR domain
  Pfam annotation: Domain name=adh_short; Domain location=18-176; Score= 79.2; E_value=1.3e-20; Accession=PF00106.15; Description=short chain dehydrogenase
  Pfam module annotation: Pfam domain module=Epimerase::F420 _oxidored::KR::adh_short; Domain location=20-233::19-190::20-181::18 -176
MHTKKSHVEMQMSVFKDKQVLVLGGSRGIGAAIVRRFADEGASVTFTFSGSPEAAEKLAHETGSAAVHTDSSERDAVIATVRDSGPLDVLVVNAGIALFGDALEQDSDAVDRLFRINIHAPYHAAVEAARQMPAGGRIIIIGSVNGDRMPIPGMASYALSKSALQGLARGLARDFGPRGITINVVQPGPIDTDANPENGPMKDLMHSFMAIKRHGRSEEVAGMVAWLAGPEAGFVTGAMHTIDGAFGA

SEQ ID NO: 144592 - protein, 78 aa, Glycine max
  Coding DNA Sequence Number=SeqID_27814
MTATGRAYDRLRFLPQTTGYRHAGTIGCGTKMDEEINAASAQAALRRLADIRHEEHMTEHAFATGSVFSAVVSALFRH

SEQ ID NO: 144593 - protein, 161 aa, Glycine max
  Coding DNA Sequence Number=SeqID_27815
MGFKHFSEDNIVVDVLHNAFVLHHFTFKSIEENLGQFKGTALYQMIQNELGAILPWHVGPIGSLEGVPNLVFKFIALIVYELGSSSHTPNGFGNGFSIWLHWYTNNLPCKVSFNNLIVLDFGCSPKLMDEFRHHHHLGVLEEVVDVAQHKIDFYSKNGHSC

SEQ ID NO: 144594 - protein, 114 aa, Glycine max
  Coding DNA Sequence Number=SeqID_27816
DGGGGFNDGDFGGEGGGTGIGTWILDIVGVKVRASGGRRGWTIGGNLCCISILMLKRTESLKDLSKASNMCNISCILSLNILIEARAVQGVISHGVLEVLTVARESSTMGWEET

SEQ ID NO: 144595 - protein, 78 aa, Glycine max
  Coding DNA Sequence Number=SeqID_27817
SAKHNTHGLSARKTLEEDELYKFAKRTASVHPLSEKSALSKNSLMFAKQLCMSRDSGERKVQVPNSFERFCYVKICRD

SEQ ID NO: 144596 - protein, 120 aa, Glycine max
  Coding DNA Sequence Number=SeqID_27818
  Homolog annotation: Hit_ID=Q2A9Z4; Match level="QueryCoverage=56%, HitCoverage=10%, E-value=2e-07, Identity=45%"; Hit description=Zinc knuckle family protein
MHHHNHLVKKDLVIGIPKPKFEKDKLCEACQKGKQVKNSFQNSLSKFDANADKAISLGYSLQSKTYRVFNRRTLSVEECVHVVCEENNSIVQDNSLEDEDTSFQDRDSALEDETKVEELE

SEQ ID NO: 144597 - protein, 90 aa, Glycine max
  Coding DNA Sequence Number=SeqID_27819
MGNQQRQGYTQGRFSGFQQGPYNQQGQWGTHPDNQFNKDQGGSSNTLTHPNIFQRRTKLEETLTQFMQVGQLAKQIADKSSNSFWSKYGK

SEQ ID NO: 144598 - protein, 86 aa, Glycine max
  Coding DNA Sequence Number=SeqID_27820
GPLLTVKSTLENGGFNRENNKDHISQSRGSALDGEEHVGEWRIPIGKITKITFPSHEGSALDGEDHIGEWRNPIGKITKITFSSQD

SEQ ID NO: 144599 - protein, 371 aa, Glycine max
  Coding DNA Sequence Number=SeqID_27821
  Gene Ontology: Mol. function=transcription factor activity; Cellular component=nucleus; Biological process=regulation of transcription, DNA-dependent
  Homolog annotation: Hit_ID=Q9CA27; Match level="QueryCoverage=91%, HitCoverage=79%, E-value=1e-17, Identity=28%"; Hit description =Putative AP2 domain transcription factor; 68130-67156
  Pfam annotation: Domain name=AP2; Domain location=113-164; Score =58.4; E_value=2.4e-14; Accession=PF00847.10; Description=AP2 domain
MPECQKQPASRPKQKLHSLQESKAMRKLRIICDDPDATDSSDDDSKRIQNPRIVKRSMCEISLLPLLHTFTTLETSSCELNNKKNTMRVSTKGQPQSKKRVLTHTPSTRRKTPGKYRGVRQRKWGKWASEIYNPFQNNRIWLGTFNTAEEASQVYEARRLELEAMAKAQAYKTGSGSAGEPLATTSDKSNCCNSSAAAAAADVSVSEKFSTTSDDIEESVLPHNSPPSVIEKGNVSTEEAIEANYLVDDLAGLEIPDLSLLNLPPPPSVIEKGNVSTEEAIEANYLVDDLAGLEIPDLSLLNLPPPPSTAGAAVPSGIEPNSGLDFDWLSFDDYEQVFDDFGGLEDIHISGFDDNEPSELPDFDFGDFDAD

SEQ ID NO: 144600 - protein, 66 aa, Glycine max
  Coding DNA Sequence Number=SeqID_27822
MVVDGDTEEGLVTFTRIEKFKSPKWCVQISEFVKRECGDRKGVRSSLEKRKEKMEIKNILVTAILD

SEQ ID NO: 144601 - protein, 169 aa, Glycine max
  Coding DNA Sequence Number=SeqID_27823
MASGADLVVDVVGLGGVADLGGGAIASTNLDGGLELVGPTSLALKRSPTAIVVGVLWELDSLQPQHCFAALWRVKAPSKVIMFAWRGCYVWLGFQPFLASQWGMASHLRFRDDGWLFGLLFSCPYGCIRTLWCLKGKGCVYRSLVQLPLVGGAFGLGCWWLLFEDVGLA

SEQ ID NO: 144602 - protein, 216 aa, Glycine max
  Coding DNA Sequence Number=SeqID_27824
MLQPLLVVNLLSVVNSRHHELLPLLRTQALSLAISSSSSAVSQENIETHLSLWLAILLSRHNESVPLRQTKKDLIWEDIQDVRKKAHAYQKQNTTSHVLSRGGYDFLEQKLMEEKKNKLLEEAAQFGSTNIVVDPPYPIRQHDSLEKQALQGSFAAHEHQDVVTATIGQPEHPGCVRAAGVDVMIKHYFGPASRGSCTSSSMVPDDLEQLIQKIRD

SEQ ID NO: 144603 - protein, 70 aa, Glycine max
  Coding DNA Sequence Number=SeqID_27825
  Subcellular localization annotation: CTP_CleavageSite=35; ConfidenceScore=5.01e-01
MAPMRCPPVLGRPTAPRPIGRECGSVCRNGPMMSVATYLMTRRRKKIKGVFISCEENPWESPPTFIQGKR

SEQ ID NO: 144604 - protein, 299 aa, Glycine max
  Coding DNA Sequence Number=SeqID_27826
  Gene Ontology: Mol. function=RNA-directed DNA polymerase activity; Cellular component=chromatin; Biological process=RNA-dependent DNA replication
MNWRGKLSRCLMLDADMIRPSHSPFSSPVLLFKKKDESWCCCVDYRALNAVTINDRFPMPTIDELLNKIGRASWFSQLDLRQGFHQIRMNEADIQKTSFRTHHGHYEFKVMPFRLCNAPSIFQATMNDLLRPFLQKFVIVFFDDILNTLKQLCGAFFLCLSKCILAKQQLSYLGRIVSPPGVALDPDKIQAMVDWPIPASPSKLRSFMSLIGFYRKFIRSYAAIAAPLTTLLCKDKFSWSPTAQEAFQQLKTIMTQAPALTTPDFTIQFTIETDASGTAIGAVLLQNSHPIAKQLCPRL

SEQ ID NO: 144605 - protein, 128 aa, Glycine max
  Coding DNA Sequence Number=SeqID_27827
  Gene Ontology: Mol. function=chromatin binding; Cellular component =chromatin; Biological process=chromatin assembly or disassembly
  Homolog annotation: Hit_ID=Q1SAV4; Match level="QueryCoverage=62%, HitCoverage=26%, E-value=1e-11, Identity=40%"; Hit description =Integrase, catalytic region
MAAREVIIESTTSTVEEPGSYNGREDGGLPYVNLNGEKPVPACTKDPVKDFNLVVGLWVFSPECTNENRVAIEHQAAWEVVELTNGVQEQHLNFVSCEIWGELRGADVSGGKVPDMRNSPDMLDEIVP

SEQ ID NO: 144606 - protein, 66 aa, Glycine max
  Coding DNA Sequence Number=SeqID_27828
MSAERGQQFDWRVVHTRDGGGFGGSGVDGKSIKMIKDGIHLTVYCGLGLREGGMVLCKGSLALSQS

SEQ ID NO: 144607 - protein, 134 aa, Glycine max
  Coding DNA Sequence Number=SeqID_27829
MKTQVDAHRRDMEFAIGDWVYVKLRPYRKTFVQPTYSKLSKRYYGSSLHKVEGSLKMMFDCQHLARLGHGMPSSLSNQLAWGKGFRGWQLKEQKEKCKEKEKKKKAKPRCCKIKPWIVSYILSLASLVPYATIG

SEQ ID NO: 144608 - protein, 213 aa, Glycine max
  Coding DNA Sequence Number=SeqID_27830
  Homolog annotation: Hit_ID=Q7XIR7; Match level="QueryCoverage=35%, HitCoverage=19%, E-value=1e-11, Identity=50%"; Hit description =Myosin-like protein
MSFPLPIKPLLPLFSFHPHFPFSSTIITIRLPQPAARAGPGPAWAYPAAPCGYHRGAPCGPYHLEVKSCGVQDKGLWGMLKPMLEEFYKILIFIVIEYGLDGGYVGCLKAAIDYEKKGFVENYEHGHVMEKKLVAMAWEMKKLRAEIANAEERAWAVATAGNPGQGYNANYGNVDAGYAGNPYPYNMHLVWIKTEEKCIFHFLYSNPEDYLEF

SEQ ID NO: 144609 - protein, 105 aa, Glycine max
  Coding DNA Sequence Number=SeqID_27831
  Homolog annotation: Hit_ID=Q09HM7; Match level="QueryCoverage=47%, HitCoverage=12%, E-value=3e-13, Identity=72%"; Hit description =Putative F-box and leucine-rich repeat protein
MDQNKIDTTRKKKGTSIVAVEEGLGDEDNEEPLSVVTSSLLMEAAIVKREELQPIMLRDDELRSILERVESEKDSETFRLVCKQWLQVQSTERKKLAACAGPHML

SEQ ID NO: 144610 - protein, 62 aa, Glycine max
  Coding DNA Sequence Number=SeqID_27832
MKMKRHLKKSRVFSIEDEDMVKPKQQKKLYQKKQPHPQSEISVGCIASFMVSFRGGICVVLY

SEQ ID NO: 144611 - protein, 83 aa, Glycine max
  Coding DNA Sequence Number=SeqID_27833
MSWKHYGSASAWKLLCPLSLIYRGKEGGGCRPARLGELDCFHQKAPPSVGTPWKAQNFTDCATMLPFVFRNVAELHGLPNNGC

SEQ ID NO: 144612 - protein, 233 aa, Glycine max
  Coding DNA Sequence Number=SeqID_27834
MNNQQKKKKTRKQSQREEKEHKLIAREHRTKKRHEQSSASIPTHPAEEKSIPQRKRSWPNLLLLQKKAKVAKPTPTSKEVVILSTIPRRVKTRAIKANPKIGDKKWSISFTDTKETTASSSLDNDSIEDTLSPPSQVSIFSTQTSPTSIPHSLRKIQETSATEGSFNRCLEENRSSKTSSMFKLLSGQGMTMCTHHQKPSKLYNRIHSSSRTSSVDAFSIVSSHQDATTFISG

SEQ ID NO: 144613 - protein, 101 aa, Glycine max
  Coding DNA Sequence Number=SeqID_27835
MAIATIHTDNEPSIHVEHFFDIQELENVGLKLNENFFFYGARDFFDETHIIYQKLIRMFWKNVEFANNKVSKVLGTKVVLSNGSIAKAPWCLREGSIYQEE

SEQ ID NO: 144614 - protein, 124 aa, Glycine max
  Coding DNA Sequence Number=SeqID_27836
MMITIRPSGVVHALQLSKTLKEKVNLWALIAKLLPDHPAYLDFTLAYYSMLGGLHAQMYVRSQAITHPPKLHISKVIEIKVVAAKECPRLPIWDVAKKKGFKLYYNEEMPSRKMKAEVMNNSRN

SEQ ID NO: 144615 - protein, 81 aa, Glycine max
  Coding DNA Sequence Number=SeqID_27837
  Subcellular localization annotation: CTP_CleavageSite=27; ConfidenceScore=5.00e-01
MDKFDEVMSAIRHGLTSSSSSSDEASSSSSDSSSEESSTLRAFDELLEACSLNDETFLSFWLLRARDFFLFGPSSYWSSCS

SEQ ID NO: 144616 - protein, 156 aa, Glycine max
  Coding DNA Sequence Number=SeqID_27838
  Gene Ontology: Mol. function=nucleic acid binding; Biological process= DNA integration
  Homolog annotation: Hit_ID=Q1SVD1; Match level="QueryCoverage=68%, HitCoverage=11%, E-value=1e-12, Identity=40%"; Hit description=Zinc finger, CCHC-type
  Pfam annotation: Domain name=zf-CCHC; Domain location=23-40; Score =15.7; E_value=0.0025; Accession=PF00098.13; Description=Zinc knuckle
MSLRIDLVMDMREIFMFMMKTLFFCYFCGKVGHMTFKCKDQLRIDVIDNRQKTLIMIPEQWLLTKHYKRKVYVPMRDSSSWWNRLFQRESKWKNKGNGMSVSSNVRISPSYSLLIEKITSIRSDWESCQIKKYHAYCLSKKIIDYGIKNSVMQVGD

SEQ ID NO: 144617 - protein, 189 aa, Glycine max
  Coding DNA Sequence Number=SeqID_27839
MRRVVTCFTKDEDIYSVIKRLLGLPTIQHFNDVCRCLTKINEQELVAHEQAATIEAEALLKLWTTTLCGRSLLCVDDEVRLHSKRVLKCEGETVFRSLQSDSISVLHVLVGVLWNVVCDNGYEKVRKVMGLVFLYLKFVTFLQDLKKGNMEAWRCCLSRRLWSRHVTASEVTVVVREKDRDNPGNTKKI

SEQ ID NO: 144618 - protein, 161 aa, Glycine max
  Coding DNA Sequence Number=SeqID_27840
  Homolog annotation: Hit_ID=Q6K1Z7; Match level="QueryCoverage=35%, HitCoverage=22%, E-value=2e-11, Identity=56%"; Hit description =Isochorismatase hydrolase-like protein
MSRCFPFPPPGYTNKGYEKEGYNRGRGITDKGYENSNDVFPIYIGDDRTDEDAFRVAFARDILERNFKHESATLLEQLRLHGKLLLFETGSILVAGMCTDICVLDFVSSVLFLSARNSGFLPPLENVIISSQACATYDLPLHLAFGATLDYLNVALLEFIS

SEQ ID NO: 144619 - protein, 68 aa, Glycine max
  Coding DNA Sequence Number=SeqID_27841
GSRNSKQGDSSLSMEIADLCDFYEISDPGDKINCSLLKRHEEEDWAKKNSGRIGEGVVVVGGGGEEET

SEQ ID NO: 144620 - protein, 69 aa, Glycine max
  Coding DNA Sequence Number=SeqID_27842
MAEVEHLIAELVDIGDDVNEIFSKVLGEDGSCAEQRNSDNEGEHGVLATATVVGGGEQGGDEFRGKKDT

SEQ ID NO: 144621 - protein, 170 aa, Glycine max
  Coding DNA Sequence Number=SeqID_27843
  Gene Ontology: Mol. function=small conjugating protein ligase activity; Cellular component=synaptonemal complex; Biological process=protein modification process
  Homolog annotation: Hit_ID=Q70I24; Match level="QueryCoverage=99%, HitCoverage=100%, E-value=1e-85, Identity=85%"; Hit description=SUMO E2 conjugating enzyme SCE1
  Pfam annotation: Domain name=UQ_con; Domain location=9-163; Score =221.3; E_value=2.1e-63; Accession=PF00179.16; Description=Ubiquitin -conjugating enzyme
MSGGIARGRLTEERKSWRKNHPHGFVAKPETLPDGTVNLMVWHCTIPGKTGNLVPKAQAPETDWEGGYFPLTLHFSEDYPSKPPKCKFPQGFFHPNVYPSGTVCLSILNEDSGWRPAITVKQILVGIQDLLDQPNPADPAQTEGYHLFIQDAAEYKRRVRQQAKQYPPLL

SEQ ID NO: 144622 - protein, 106 aa, Glycine max
  Coding DNA Sequence Number=SeqID_27844
MILDGSARGTIMSKSPKEEIVIIDSIEATDYQSHHDRALVQRKVIMEPDTQNNQGIPQQTLRGGSGPSNNSYASPLNRGPQQQVQLDKMSKMEDTLIQYMQMSITS

SEQ ID NO: 144623 - protein, 236 aa, Glycine max
  Coding DNA Sequence Number=SeqID_27845
  Gene Ontology: Mol. function=protein dimerization activity
  Homolog annotation: Hit_ID=Q1T3H7; Match level="QueryCoverage=79%, HitCoverage=36%, E-value=9e-23, Identity=33%"; Hit description=Zinc finger, BED-type predicted; HAT dimerisation
MLEVALKYKNGFEELELRDKQYRGIAPEYSDWEFVRLIFPFLKIFHDVTLRISGLAYVTRTMYMSVAFGIGSKIKQMSTSRDVSVSVRLIHDSMKKKYDKYWGSKIMNWLIVESFDGKLSKLSCELRDKVEFSLISLFEKYVGSENQFEGSSQKARLSEGGHDDPYDKYLEEALDMNLGDSDVLDWWKIKGPPSPFPSNENEEFSEFERVEEAYIVAKVARSKKQLATIKVNSLQT

SEQ ID NO: 144624 - protein, 167 aa, Glycine max
  Coding DNA Sequence Number=SeqID_27846
  Gene Ontology: Mol. function=protein binding; Biological process =proximal/distal pattern formation
  Homolog annotation: Hit_ID=Q2HW56; Match level="QueryCoverage=76%, HitCoverage=25%, E-value=6e-56, Identity=82%"; Hit description =BTB/POZ
MRVPAPSLAAIGPGLVLLRHDGDLPAVQELQQQQEHLVPHRVHRDHAGGTRRRPGVVRSRRAGGVEAGRRVRSAEEFPEEEAARGQDAAVPVDQTALDLESDVAEGLAVDEEVEVVHGERSLRLFLGHGDDDDVAVATVREYFLFFCERAIWVAIMGGWGFKKELSN

SEQ ID NO: 144625 - protein, 315 aa, Glycine max
  Coding DNA Sequence Number=SeqID_27847
  Gene Ontology: Mol. function=protein binding; Biological process =proximal/distal pattern formation
  Homolog annotation: Hit_ID=Q2HW56; Match level="QueryCoverage=99%, HitCoverage=67%, E-value=1e-114, Identity=68%"; Hit description =BTB/POZ
  Pfam annotation: Domain name=Ank; Domain location=116-149; Score =17.4; E_value=0.051; Accession=PF00023.20; Description=Ankyrin repeat
  Pfam annotation: Domain name=Ank; Domain location=151-183; Score =34.4; E_value=4.1e-07; Accession=PF00023.20; Description=Ankyrin repeat
  Pfam module annotation: Pfam domain module=Ank::Ank; Domain location =116-149::151-183
MVEKASIDDVMKVLIASRKQEMQQLWSTCSHLVAKSGLPPEVLAKHLPIDVVAKIEELRLKSSLARRSLLPGHHQHHHDLTPGMEDQKIQRMRRALDSSDVELVKLMVMGEGLNLDEALALHYAVENCSREVVKALLELGAADVNFPAGPAGKTPLHVAAEMVLPEMVAVLLDHHADPNVRTVEGVTPLDILRTLTSDFLFRGAVPGLTHIEPNKLRLCLELVQSAALVLSREEGNNVNNDHNNNASASATAIYPPMSSEDHSSGNSDSRLVYLNLGATPPMGEDDGSQREAMNRHGSQGGRCDPPSMYHHSHDF

SEQ ID NO: 144626 - protein, 261 aa, Glycine max
  Coding DNA Sequence Number=SeqID_27848
MDIMTTWGTYLVTTQVDIKHIWTPTMEKLSSQHEMKDDGGDVTMVFMMIKLDGEATNKSFELKRPTTCALWVDGYSWYLRYRGENQDGPWGSKMASSCDTSMRLGDSHSRLDNLNNHREHNRVMEWRPISRMSIRPLDGQWNHDLWFKEDHFANNYPMPNYMRVPSTSFSSPSYSSSLASSMADIMMMLEEIFAQPILKEYVLPSPSSNEIPLSAYFPYDLVTQTGFLLPKLLIDWSFFLDDYVDGSSDEEEDPSSGCEQH

SEQ ID NO: 144627 - protein, 97 aa, Glycine max
  Coding DNA Sequence Number=SeqID_27849
  Subcellular localization annotation: CTP_CleavageSite=73; ConfidenceScore=5.16e-01
MRGYLMVIHTFGQPGANEPVDARGLTSSSAPFSVLTREGYLMVTRTFRQPGANEPVDTLRLISSSTPFENLTRANEPDDARRITSSSAPFVVLTREV

SEQ ID NO: 144628 - protein, 45 aa, Glycine max
  Coding DNA Sequence Number=SeqID_27850
MANSHKSRRRILFEVEMIHPQIKSHLIIRRSITTIRKLTLKASEL

SEQ ID NO: 144629 - protein, 76 aa, Glycine max
  Coding DNA Sequence Number=SeqID_27851
MVKEVIHDRNYVAPRLHSSSSPSSFMFSHCFLLFEPFFLFPYMAIYRKSHLVQGNLPRRAAYLGLKVSAHPGEWLA

SEQ ID NO: 144630 - protein, 143 aa, Glycine max
  Coding DNA Sequence Number=SeqID_27852
MVRNRTYSRLPICDEGKKKGFKIYFNIEMPNREQKKTLFRGNKLVCKLDSFDARTSWNQIVWFDTPKASTPSSNVKDLSDHKDSIQVLCPTKVYNFDDAVEASKKKVEALYKVEKVAKKTKIVANMKVEEKKKQQAEVAAKIT

SEQ ID NO: 144631 - protein, 69 aa, Glycine max
  Coding DNA Sequence Number=SeqID_27853
  Subcellular localization annotation: CTP_CleavageSite=64; ConfidenceScore=5.12e-01
MAKEVIHGHNSAAPRLRSSSFPSSYAFSLCFLSPEPFFLFPYMTIYRKSHLVQGKLAQVSGLLRAKAFS

SEQ ID NO: 144632 - protein, 91 aa, Glycine max
  Coding DNA Sequence Number=SeqID_27854
  Gene Ontology: Mol. function=3'-5'-exoribonuclease activity; Biological process=RNA processing
  Homolog annotation: Hit_ID=Q2HRD9; Match level="QueryCoverage=75%, HitCoverage=33%, E-value=5e-15, Identity=63%"; Hit description =Peptidase S8 and S53, subtilisin, kexin, sedolisin; 3 exoribonuclease
MEGKTNPLRVIRGWRPKLLPCAINAACAALVDAGIPLKHLADSGCIILDPTKDEEEKMKAFANLVFPNTIVSVLPERDHCKWVVSLWKMES

SEQ ID NO: 144633 - protein, 103 aa, Glycine max
  Coding DNA Sequence Number=SeqID_27855
  Gene Ontology: Mol. function=nucleic acid binding; Biological process= DNA integration
MANNKGTMDENPLTLHNSDNPSIILVSQLLEPHNYGQWSWAMRISLSAKNKIGIIDKSIKKLSSTDKAFHSWQRCNDMVLSWILNSMSPVIASSIICMDTTTT

SEQ ID NO: 144634 - protein, 66 aa, Glycine max
  Coding DNA Sequence Number=SeqID_27856
MAGKINWNCIMHQQFLDNYKIWYAHKCWKSNWYTLFHNNARKVGQAALRKNQTHIYAMKQLFLEII

SEQ ID NO: 144635 - protein, 335 aa, Glycine max
  Coding DNA Sequence Number=SeqID_27857
  Gene Ontology: Mol. function=microtubule motor activity; Cellular component=microtubule associated complex; Biological process =microtubule-based movement
  Homolog annotation: Hit_ID=Q8GS71; Match level="QueryCoverage=90%, HitCoverage=29%, E-value=1e-130, Identity=77%"; Hit description =Kinesin-like protein
  Pfam annotation: Domain name=Kinesin; Domain location=4-335; Score =331.6; E_value=1.3e-96; Accession=PF00225.13; Description=Kinesin motor domain
MSVIVDNLHIFLCSWLLRILLWYFNDQVQIGSHAFTFDYVYGNGGSPSVEMFEECVAPLVDGLFQGYNATVLAYGQTGSGKTYTMGTGYNDNCRSGLIPQVMNALFKKIETLKHQTEFQLRVSFIEILKEEVRDLFDRVSMGKPETSNSNGHSGKITVPGKSPIQIRETSNGVITLAGITEVAVSTLHEMSSYLEQGSLSRATGSTNMNNQSSRSHAIFTITLEQMHKLHSSSPTNDSSDEDMGEEYLSAKLHLVDLAGSERAKRTGSDGVRLKEGIHINKGLLALGNVISALGDEKKRKEGVHVPYRDSKLTRLLQDSLGGNSKTVMIGNTAEC

SEQ ID NO: 144636 - protein, 118 aa, Glycine max
  Coding DNA Sequence Number=SeqID_27858
  Subcellular localization annotation: CTP_CleavageSite=78; ConfidenceScore=5.14e-01
MKKLKIGQWVIDKCSNLTHLRQKVVERVTKKDSSTFSSFVNAMTYFNVGGGKNVKVNVYGLGALSKMLTSKSVQPSVVQPEVVDQIQEMHQMIQKLNVELTTKGDKKKTLKEQMTQLM

SEQ ID NO: 144637 - protein, 303 aa, Glycine max
  Coding DNA Sequence Number=SeqID_27859
  Gene Ontology: Mol. function=transporter activity; Cellular component= membrane; Biological process=transport
  Homolog annotation: Hit_ID=Q1H186; Match level="QueryCoverage=98%, HitCoverage=54%, E-value=1e-122, Identity=68%"; Hit description =Extracellular solute-binding protein, family 5
  Pfam annotation: Domain name=SBP_bac_5; Domain location=1-211; Score=- 13.5; E_value=0.00018; Accession=PF00496.12; Description=Bacterial extracellular solute-binding proteins, family 5
MADNIDSMSMDPITYARIIPSRPALQARLNQFKELGNSYTYLGFNLKRKPFDDVRIRKAINYAIDKQEIIDGVYLGLGITIASPYKPGTRWNNPDLVPYTFDPAKAKQLLIEAGYQDTDGDGIVDRAGKKLSFEILTNLGNKQREKTAVIIQRRLKEVGIETHIRTLEWASLLTNFIKPGDFDAVVMGWGLGLDPDQYSIWHSSQQKPGQFNFIGYNNPAVDKLLEQGRLEFDPEKRMQIYHEFAKVLYEDSPLVYLSAGYGLTAIHKRVQGIMNPVPPAGVSYDSQKWYIPQPLRRTQIQAE

SEQ ID NO: 144638 - protein, 206 aa, Glycine max
  Coding DNA Sequence Number=SeqID_27860
  Subcellular localization annotation: CTP_CleavageSite=41; ConfidenceScore=5.45e-01
MAESSKKGKGTSSTTTATGHRRHGPSEAPTTPIHPSLSSPRSSTLFSLDDQRLRYNSQFSSRIILDPKYLDTDFFNDETFDCYQVFQNSGLVDFMSLKLPYYPELIKVFYNNLKIQDGIISSEGTIVDDWKFDYSSHDAHRMVCNDQAEMNDRLLAGSLTFDCHIMHYIIIRILLPRSSNLAQASEEDLISMWAFLTGRQIDWAHL

SEQ ID NO: 144639 - protein, 68 aa, Glycine max
  Coding DNA Sequence Number=SeqID_27861
  Subcellular localization annotation: CTP_CleavageSite=38; ConfidenceScore=5.08e-01
MCRNLPFGGKARRKAKGASSKKKTHGSRHQRLFEENVRKTKKRSMNFENKGSGVIYARGRCDEEFKPT

SEQ ID NO: 144640 - protein, 59 aa, Glycine max
  Coding DNA Sequence Number=SeqID_27862
MPKLMEADVQFESPTCPSNTVVDPELNGEDQVLCSVSIAPLRPTTESQLVLPLSTTELT

SEQ ID NO: 144641 - protein, 137 aa, Glycine max
  Coding DNA Sequence Number=SeqID_27863
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=83%, HitCoverage=12%, E-value=2e-32, Identity=43%"; Hit description=Chromo
ENRHKTAFRTHQGHYEWLAMPFGLTNAPATFQSLMNEIDYLGHTVSGKGVTMDQEKVQAVLNWPYPINLKQLRGFLGLTGYYRKFIKAAITKAPVLALPDFSKAFTLETDASGSYAYRTKHLILTIQFRINYCIGRA

SEQ ID NO: 144642 - protein, 92 aa, Glycine max
  Coding DNA Sequence Number=SeqID_27864
MSLEQTNQWLAPTFQWKQRCNYERMRDKDDSTSDSPQISASPPQLDLAPYASRSYSAQWNALRLFHDKHMLHSNRILRKWRLRKPSRGYGYH

SEQ ID NO: 144643 - protein, 117 aa, Glycine max
  Coding DNA Sequence Number=SeqID_27865
METCPAVEGLLQWLMEWGQLEVSERAPPAVPKPMPFSYQSNKVVPWKYTPLAFGEGAATEVDSLSSKVTNITSLSGATHNGRVFAPPHSEELPSKGEAPMTQESAGAASPSKEVDPP

SEQ ID NO: 144644 - protein, 218 aa, Glycine max
  Coding DNA Sequence Number=SeqID_27866
  Gene Ontology: Mol. function=RNA-directed DNA polymerase activity; Cellular component=intracellular; Biological process=RNA-dependent DNA replication
MAIFVDMVEKGIEVLQRCEETNLVQNWEKCYFMVQDGIVLGYKISVRRIEADKAKIDVIEKLPPPGNVKGVRSFLEHVGFYRRFIKDFSNIAKPLSNLLNKDVVLLFDEECLKAFNALKTNLVSNPIITASDRIQEFELMCDASDYVVGAVLGQRKSIIFHAIYCHTLISSGDNCLSTCGFLPVTLSYLTSIATQSIGFRDITERNEQDAQNRGILST

SEQ ID NO: 144645 - protein, 390 aa, Glycine max
  Coding DNA Sequence Number=SeqID_27867
  Homolog annotation: Hit_ID=Q9LHB1; Match level="QueryCoverage=86%, HitCoverage=55%, E-value=7e-84, Identity=45%"; Hit description =Transcription factor X1-like protein
  Pfam annotation: Domain name=XS; Domain location=116-233; Score =220.6; E_value=3.6e-63; Accession=PF03468.5; Description=XS domain
  Pfam annotation: Domain name=zf-XS; Domain location=44-87; Score =97.6; E_value=3.6e-26; Accession=PF03470.5; Description=XS zinc finger domain
  Pfam module annotation: Pfam domain module=XS::zf-XS; Domain location= 116-233::44-87
MAHSCSDEDTDISESEISEYEDKSYEELKNGSQDVRTSGKTFTCPYCPKKRKQDYLYKELLQHASGVGQSSSQKRKARDKANHLALVKYLKKDLMNVDVPSNDSKPEDESDPSVNSNDQFVWPWIGVVVNIPTRRTEDGRCVGESGSRLRDEYRSRGFNPVRVNPLWNFRGHSGTALVEFNKNWPGLHNALAFERAYELDHHGKKDWFTNSGQKSGLYAWVARADDYKMNSIYGEHLRRMGDVKTISELMEEEARRQDKLVSNLTNIIQVKNKHLKEIEVRCHETTDKMNLVMKDKDKLIQAYNEEIQKIQSSARDHFQRIFTDHEKLKLQLESHKNELELRKVELEKREAHNESERKKLAEEIEEMFQSFQECLEKYLSSDGCFRANES

SEQ ID NO: 144646 - protein, 96 aa, Glycine max
  Coding DNA Sequence Number=SeqID_27868
MELLLLRVGLREEERKSIARFLSGINMEVRNKVDLLLYRDLDDLVQLCIRVEQQLKRKPTSKSYGSHSNPKKDQGQGILGAAPSKPKDDKRDRKKN

SEQ ID NO: 144647 - protein, 197 aa, Glycine max
  Coding DNA Sequence Number=SeqID_27869
  Homolog annotation: Hit_ID=Q1T1F7; Match level="QueryCoverage=51%, HitCoverage=21%, E-value=2e-10, Identity=39%"; Hit description=IMP dehydrogenase/GMP reductase
  Pfam annotation: Domain name=DUF1723; Domain location=164-197; Score =17.6; E_value=0.0042; Accession=PF08330.1; Description=Protein of unknown function (DUF1723)
MARTRGLGRVIGRLVGRDRQDDHDAADVPERRRPTASARRQRVHQTTADARDMTEDIANMTNDVPDVAAEALEMRADIQGADGAEGSDADDAAEGFLGGPCDPLVLASFADHVAHAVWSGQEHPYLKLVSHGRKVTLIERSVPEIEGLVAATRLSPLIDCSVIIGDPGLISAFVERWHGETSTFHLPVGELTITLDD

SEQ ID NO: 144648 - protein, 65 aa, Glycine max
  Coding DNA Sequence Number=SeqID_27870
  Subcellular localization annotation: CTP_CleavageSite=41; ConfidenceScore=5.15e-01
MEPHSVRRIIVFVTVIVFSLALLAVLTGFGSGGTLTVAMVVCVTRGSEKRTMASSHRKLNMEAIH

SEQ ID NO: 144649 - protein, 139 aa, Glycine max
  Coding DNA Sequence Number=SeqID_27871
MTRRLEVGGWNYLTSHGMEEVRVLRGEEKSLFSFEKSLFGARSERVLRGEEIGEGVVGVDGVGAAAGEGSGVGGGGVDKIRMSMSMSVRVSGGQQTRVQCERRRHIIRMSSTSGHDHVEVFLRFEPIDNPKIPHRSCIY

SEQ ID NO: 144650 - protein, 39 aa, Glycine max
  Coding DNA Sequence Number=SeqID_27872
MSLEELLYIFVSHSQAMEWGDPRKKEFYFYMKSYFPVDN

SEQ ID NO: 144651 - protein, 111 aa, Glycine max
  Coding DNA Sequence Number=SeqID_27873
MTILEGIPKGYFGMPVPKWWILLEQPMQVETIEHVDRVQAVQEVKPVEHVQPTDQQEPKTNVVFSGGIEDTSLLTSYADHVAWEVWGCMECGELKLVAHGRKLQSQIVLHD

SEQ ID NO: 144652 - protein, 127 aa, Glycine max
  Coding DNA Sequence Number=SeqID_27874
MVDCDHEEEGPSKQSEAIVSLEREIQNQNQKFMDMEHKHAEKALIMGELMVGLAQNIDSRQRNLLEMEKKDSRPGPAYLVTLRLVSPAFVDTFIVFQHVMEITSLHIAAVKQQNDYENALKLGDDLK

SEQ ID NO: 144653 - protein, 192 aa, Glycine max
  Coding DNA Sequence Number=SeqID_27875
  Homolog annotation: Hit_ID=A0CXK9; Match level="QueryCoverage=87%, HitCoverage=32%, E-value=7e-07, Identity=23%"; Hit description =Chromosome undetermined scaffold_30, whole genome shotgun sequence
MENHSSEESMSRRSIAFVSLKELEKQLESIPKLEFENQQLKEKLDVMKHMEDEFLNMALSKQNEAIVRVEKDIQNHIQNSLDMEHMHSEKATIMSKLIPELVENIESMQRSVPEMENKYKESLNIIKKLTSEGDTKHEECHKEVQQLKVMNSIISHEMECMKKEHEQISMELKENKAISDLQQKNFTEVIQK

SEQ ID NO: 144654 - protein, 356 aa, Glycine max
  Coding DNA Sequence Number=SeqID_27876
  Gene Ontology: Mol. function=ferric iron binding; Biological process =aromatic compound metabolic process
  Homolog annotation: Hit_ID=Q6KAC4; Match level="QueryCoverage=95%, HitCoverage=61%, E-value=8e-49, Identity=31%"; Hit description =Putative X1
  Pfam annotation: Domain name=XH; Domain location=221-355; Score =219.6; E_value=7e-63; Accession=PF03469.5; Description=XH domain
MCKHSYKCKEALSKQRMVIESLQREIEFKNHKLMEMEHKHSETLTSVRRLIVGLVENINCKERSLLQMECKHSESLNMVQKLMNERDKLQERCHQDLQLTKVTNANMNHDMECLKKDDGQIIKELEESKALHDLQQNFIEEIEKLKTELGDQSHVRSGGDLNTQISTFRNKLKDKMEYLDHVETLYSSLVVKENQYRQELHDAREESIKSLRGMFRGRSQLGIKRMGELDPKPFQHLCLQKYSDEQWQEKSAKLCSAWEENLKDPTWHPFNKIEVNGILQETLDENDEKLKGLRSECGEAVYQAVTNALMEIEEYNSSGRYAIAEIWNWKEGRKATLKEIVQHIIRQLNSHKRKRK

SEQ ID NO: 144655 - protein, 147 aa, Glycine max
  Coding DNA Sequence Number=SeqID_27877
MENHSCEENTSKQSMAFVSLKEVVENQKQKIIDVEDNNLLKADCKSELNKSLKIVMKMVKKEAMLDKECQKELKQIKVLNSKMSRDIECIKKENEKITKELEESKALQKKFTQQNGLIMKELGESRALNDMQHKNFTEEIRKVSNNK

SEQ ID NO: 144656 - protein, 195 aa, Glycine max
  Coding DNA Sequence Number=SeqID_27878
  Gene Ontology: Mol. function=ferric iron binding; Biological process =aromatic compound metabolic process
  Homolog annotation: Hit_ID=Q6KAC4; Match level="QueryCoverage=91%, HitCoverage=28%, E-value=5e-22, Identity=36%"; Hit description =Putative X1
  Pfam annotation: Domain name=XH; Domain location=130-194; Score= -44.9; E_value=0.045; Accession=PF03469.5; Description=XH domain
MQIGSLQVALKLKKDNNVSALDKELKVENERLNAKVIQLEKQLESIQELELENQQLKEKLDVMKHMEDEFLNMVGALHMNVVEKERSLRDSEDFNQSLIIKEREINDELQKARKTLIKGIAEISSLDGNIDVKQMGQIDTEPFVKALTGRRRYNKEEAEQIALETCSLWQKDLGDPHWYPFKIVTIGGKSKVQLC

SEQ ID NO: 144657 - protein, 451 aa, Glycine max
  Coding DNA Sequence Number=SeqID_27879
  Gene Ontology: Mol. function=binding
  Homolog annotation: Hit_ID=Q7N2L2; Match level="QueryCoverage=74%, HitCoverage=19%, E-value=4e-80, Identity=49%"; Hit description =Complete genome; segment 11/17
  Pfam annotation: Domain name=Fil_haemagg; Domain location=175-224; Score=3.6; E_value=12; Accession=PF05594.4; Description =Haemagluttinin repeat
  Pfam annotation: Domain name=Fil_haemagg; Domain location=229-286; Score=12.9; E_value=1.2; Accession=PF05594.4; Description =Haemagluttinin repeat
  Pfam annotation: Domain name=Fil_haemagg; Domain location=82-162; Score=1.1; E_value=22; Accession=PF05594.4; Description =Haemagluttinin repeat
  Pfam module annotation: Pfam domain module=Fil_haemagg::Fil _haemagg::Fil_haemagg; Domain location=175-224::229-286::82-162
SLTAVNAIDAWQSELKGQDVTLNAKNGEIKIHSSEKPHYFRPDGSRWLGSLEASRDLSLTAGSTITLLNTLLAPQSRNIAMTANGSIAIVKNSALLEGSLLGGPVSPAKRQEYFNQLLASGQMRATGSVLLNSGGYLALRGAKINADKDVTLLAAHNADLNYRELDGRFNALFPVSRTPELGSRVHAGGNLLINSARDIGTQGGALSANGNITLLAGQNLWLSNLAYSAIDAANDNNKDDRHVVTALSAGKNLTASANNQLLTYGARLTSGANMTLTSGGDMRFEAVQNHTYREGGNEFTETRTQQGTELNAGGLMTVISGGSILFQATKLVVKGLGANWKPSVAVTDWGSRIAAAEQAVRNAEQNVNQKQNVLNNVRNTPEGLLLDNPAQHPISYKHSSSVMIPGTGTYHLDMGNIEIKTRSDLDRLLNEGGKAFDPFPYGVDPAETSGD

SEQ ID NO: 144658 - protein, 125 aa, Glycine max
  Coding DNA Sequence Number=SeqID_27880
  Homolog annotation: Hit_ID=Q9LIA7; Match level="QueryCoverage=92%, HitCoverage=43%, E-value=2e-11, Identity=29%"; Hit description =Similarity to transcription factor
  Pfam annotation: Domain name=XH; Domain location=68-123; Score=-41.2; E_value=0.02; Accession=PF03469.5; Description=XH domain
MKLMEDELLKTVGTLHLKAMEKDGSLKDAEDFSQSLIIIERERNDELQKARKKLIMGIAEISSDLGNIGVKRMGEIDTEPFLMKREIIDDEDETSKGLKEVMGVGAYNAVVTALKEMMKTIITSF

SEQ ID NO: 144659 - protein, 52 aa, Glycine max
  Coding DNA Sequence Number=SeqID_27881
MEGVRKDLALPNVVDDSSGKDDSSKRQWLLMTEKIVIIVNLESCDKLKMDPK

SEQ ID NO: 144660 - protein, 33 aa, Glycine max
  Coding DNA Sequence Number=SeqID_27882
MEIEACKGWWRTMEDGDDSEWRTWSVGYDVEGK

SEQ ID NO: 144661 - protein, 346 aa, Glycine max
  Coding DNA Sequence Number=SeqID_27883
  Gene Ontology: Mol. function=oxidoreductase activity, acting on single donors with incorporation of molecular oxygen, incorporation of two atoms of oxygen; Cellular component=cytoplasm; Biological process=electron transport
  Homolog annotation: Hit_ID=Q1XSG4; Match level="QueryCoverage=97%, HitCoverage=94%, E-value=1e-110, Identity=55%"; Hit description=2 -nitropropane dioxygenase, NPD
  Pfam annotation: Domain name=DHO_dh; Domain location=8-263; Score= -138.7; E_value=0.074; Accession=PF01180.12; Description =Dihydroorotate dehydrogenase
  Pfam annotation: Domain name=DUF561; Domain location=111-272; Score= -141.9; E_value=0.067; Accession=PF04481.3; Description=Protein of unknown function (DUF561)
  Pfam annotation: Domain name=ECH; Domain location=145-290; Score= -72.0; E_value=0.076; Accession=PF00378.10; Description=Enoyl-CoA hydrataseisomerase family
  Pfam annotation: Domain name=His_biosynth; Domain location=75-252; Score=-130.2; E_value=0.096; Accession=PF00977.11; Description =Histidine biosynthesis protein
  Pfam annotation: Domain name=NPD; Domain location=4-345; Score=247.4; E_value=3e-71; Accession=PF03060.6; Description=2-nitropropane dioxygenase
  Pfam module annotation: Pfam domain module=DHO_dh::DUF561::ECH::His _biosynth::NPD; Domain location=8-263::111-272::145-290::75-252::4-345
MWNTNRITDLLGIEYPIWQGPFGGGLSTVELTSRVSNKGGLGGFGAYTLSPQEIYEVDQKIRSQTAQPYNLNLWVSDTDFVSAEDNKKSYKETVEAFRPYFDRLQIDVPALPSSFESRFQNQLQTVLDIKPKVFSFMFGLLNPTVVEECHKRGILLAGNATTLDEAIALENIGVDIIVASGFESGGHRPSFLDKAEYSTTGTFVLVQLIKDRIKIPVIAAGGIATGTGIAAALTLGAEGVQIGTAFLACEESGALPVHREALFSESSKNTRLSRAYTGRLGRGITNEILQDLSEKQIPHLPFPLQTTFMSSLRKAALEQGKNDMVFFWGGQIAPVLKHKKRIGIDG

SEQ ID NO: 144662 - protein, 270 aa, Glycine max
  Coding DNA Sequence Number=SeqID_27884
  Gene Ontology: Cellular component=integral to membrane
  Homolog annotation: Hit_ID=UPI00005F87B0; Match level="QueryCoverage =63%, HitCoverage=36%, E-value=2e-51, Identity=58%"; Hit description =COG3515: Uncharacterized protein conserved in bacteria
  Pfam annotation: Domain name=ImpA-rel_N; Domain location=37-98; Score= 80.6; E_value=4.9e-21; Accession=PF06812.2; Description=ImpA-related N-terminal
MPARRIKTGSDPRKLPDYSALREELSKLTHPARPDIDWFYVEQHCLSLFEQNGVELQTAAWYTLARLQLAGLVGLNEGLALVEALVSHQWSVLWPQPIHARMDILTSLSQRVQQQMRTLSLNYDDLSQLYRAEQLLTRIGTVLQRLELKHLSQLDTLRALMHNSAARLESRDGTTSDILPGTTIDNGAISAHPHETKTPHSARWVYVAQQQHQPKIKCRDVYHAANQHGRGGRLAISAPARSTAGSAGGIAGSCARHTHVTAAGCAAAAD

SEQ ID NO: 144663 - protein, 377 aa, Glycine max
  Coding DNA Sequence Number=SeqID_27885
  Gene Ontology: Mol. function=methyltransferase activity; Biological process=metabolic process
  Homolog annotation: Hit_ID=Q02H18; Match level="QueryCoverage=48%, HitCoverage=65%, E-value=9e-65, Identity=67%"; Hit description =Putative methyltransferases
  Pfam annotation: Domain name=TP_methylase; Domain location=198-377; Score=138.8; E_value=1.5e-38; Accession=PF00590.10; Description =Tetrapyrrole (CorrinPorphyrin) Methylases
GAGALGGGTEGIAGALQRVGAGYVPARAQRGEDVVALFLQQGQGMRRLLVGQCQLGAGQLVALQAGARQLAGGELAKQAARAGTVAGQVPGPGGIGQGVAAGATFQGCGQRFQLQGGVARFALFDQRQRLALGRRFGRAGQAGGGTAGQQHQRQRQGGDPCGGLVHDRVHAMRAAALAGYTLRFYPCPVSTAEMSVPTLYVVATPIGNLADLSPRAQEVLRSVAAICAEDTRRSGQLLSHFGIQQPLVALHEHNEEALSQRLVSRLQAGESLALVSDAGTPLVSDPGFRLVRAARAAGIKVSPIPGACAAIAALSVAGLPSDRFSFEGFLPAKASGRRDRLQALAGEVRTMVFYESSHRIAESLADMAAIFGGERPA

SEQ ID NO: 144664 - protein, 61 aa, Glycine max
  Coding DNA Sequence Number=SeqID_27886
MGAKYLEAVKQRLHAIKQWFPDKIRVPPLVLLIKATLQSMCEVQELTLATSTLTCLSSKFW

SEQ ID NO: 144665 - protein, 80 aa, Glycine max
  Coding DNA Sequence Number=SeqID_27887
MPETKRKHCYAIREGEERRRKAFNPPGILGSLEISEKNRFREENPSRGASVTRLRRFGKQIREDFPSSFVHSSLFFDLQP

SEQ ID NO: 144666 - protein, 310 aa, Glycine max
  Coding DNA Sequence Number=SeqID_27888
  Gene Ontology: Mol. function=binding
  Homolog annotation: Hit_ID=Q6YRM6; Match level="QueryCoverage=87%, HitCoverage=46%, E-value=1e-104, Identity=64%"; Hit description=Zinc finger (C3HC4-type RING finger) protein family-like
  Pfam annotation: Domain name=DUF23; Domain location=22-270; Score =132.7; E_value=1e-36; Accession=PF01697.17; Description=Domain of unknown function
  Pfam annotation: Domain name=Glycos_transf_2; Domain location=27-189; Score=-17.0; E_value=0.045; Accession=PF00535.16; Description =Glycosyl transferase
  Pfam module annotation: Pfam domain module=DUF23::Glycos_transf_2; Domain location=22-270::27-189
MGVFPSIARPGLRLQHTTPKQKAHEMCICTMLRNQAGFMKEWVMYHAKIGVQRWFIYDNNSDDDIENVISFLQSVGYNISQHLWPWVKTQEAGFAHCALQARSSCDWVGFIDVDEFFNVKIKGGMHGVIWHHAKPGSNVGEIRTPCYSFGPSGLREVPKEGVAVGYTCRLAARERHKSIVRPEALNQSLINVVHHFHLGAPFVTVDVEKSEMMINHYKYQVWKVFKEKFYRRVATYVADWQEEQNVGSRDRVPGLGTKPVEPADWANRFCEVRDNGKGPITRTMSKRLQEDWARPAEEGPRVLMNLRVDF

SEQ ID NO: 144667 - protein, 137 aa, Glycine max
  Coding DNA Sequence Number=SeqID_27889
  Gene Ontology: Mol. function=structural constituent of ribosome; Cellular component=intracellular; Biological process=protein modification process
  Homolog annotation: Hit_ID=Q00Y36; Match level="QueryCoverage=85%, HitCoverage=86%, E-value=2e-54, Identity=92%"; Hit description=[J] KOG0003 Ubiquitin/60s ribosomal protein L40 fusion
  Pfam annotation: Domain name=ubiquitin; Domain location=1-52; Score =35.7; E_value=1.7e-07; Accession=PF00240.13; Description=Ubiquitin family
  Pfam annotation: Domain name=ubiquitin; Domain location=60-128; Score= 127.7; E_value=3.3e-35; Accession=PF00240.13; Description=Ubiquitin family
  Pfam module annotation: Pfam domain module=ubiquitin::ubiquitin; Domain location=1-52::60-128
MVEKKLLITIFAGIPLVQQRLIFAGKQLEDGRTLADYNILNEFTLHLVLRLRGGMQIFVKTLTGKTITLEVESSDTIDNVKAKIQDKEGIPPDQQRLIFAGRQLEDGRTLADYNIQKESTMHLPLRLHGGWLLSESS

SEQ ID NO: 144668 - protein, 658 aa, Glycine max
  Coding DNA Sequence Number=SeqID_27890
  Gene Ontology: Mol. function=DNA binding; Cellular component=nucleus; Biological process=protein modification process
  Homolog annotation: Hit_ID=Q9FNS1; Match level="QueryCoverage=97%, HitCoverage=100%, E-value=1e-126, Identity=41%"; Hit description=MYB- like DNA-binding protein
  Pfam annotation: Domain name=Myb_DNA-binding; Domain location=534 -584; Score=18.4; E_value=0.026; Accession=PF00249.21; Description =Myb-like DNA-binding domain
MVLKKRVDYGFNGFRVPVIPKAPRSARRRVAFNKAVEDGQVCAIELLASLAGQLLQESESSASSNASEGNHQPAFSQGVIEQDIQDEVKPLKMEEIHQGNCAESTFKTEVASQKSSQKPLSHTKTGHVSVNNSSDCCEKAEADVKSEIFEWDNKFGNYSNRLVETREKFRVSTHGNIKNGFKWEQEAGSSCIRGSNLADKCSLEDHLELYGNGIKLGFRDDDEKFLRCKRVCTKPKAFRSPRRIAHRRIRNLMSSKYWKTAPKLKDCELSDLGVPRYHKRKTCYGFERSQHNAIVKKRKFVDRVSGVTSDGGFSSESVSNSPQKGMDADKPSSSAKLHVLKAKDSHVKFSIKSIRIPELYIEVPETSTVGSLKRTIMEAVMAILGGGAHVGVLLQGKKVRDDNRTLVQTGISCNENLDTLSFMLEPTSLRASPTICVGDPSSQCETSQPTWPTETPVLDSGVTDTLHDSPLLTYPGNLIESNHEPTSSLADTTVNKITPDSRAIVAVPATTETLAVVPVSQKTKRSEFVQRRTRRPFSVTEVEALVHAVEELGTGRWRDVKLRAFENADHRTYVDLKDKWKTLVHTATISPQQRRGEPVPQELLDRVLAAHAFWSQHQAKQHGKHQAGPGTLKITEASAERPCKCKKNIEHDSPKESP

SEQ ID NO: 144669 - protein, 677 aa, Glycine max
  Coding DNA Sequence Number=SeqID_27891
  Gene Ontology: Mol. function=protein binding; Cellular component =cytosol; Biological process=regulation of transcription, DNA -dependent
  Homolog annotation: Hit_ID=Q9LHH0; Match level="QueryCoverage=91%, HitCoverage=86%, E-value=0.0, Identity=63%"; Hit description=Actin -like protein
  Pfam annotation: Domain name=Actin; Domain location=9-673; Score =28.2; E_value=9.9e-16; Accession=PF00022.9; Description=Actin
MAKNLVFCCLEYRPRHFFKVLQNDHSWDYLIDSAIVVPCTRQCQVRFDSSQAKILDFGFDRLGATGSEIDHPVLITECVCNPVQSRSKMGELLFETYGVPSIAFGVDAAFSYKYNQQQGVCDKDGLAMCPGFNTTHVIPFVDGEPIYKGCCRTNIGGFHVTDYLKQLLSLKYPYHMARFTWEKVEDLKMEHCYIAPDYASEARLFQKGAKEAEEKTRCWQLPWVPPPTEEPPSEEEIARKAAIKERQGQRLREMAEAKRSSRINELENELHGLEFLLKQLEQVEDSNVPSFLAATGYVSRQEIESARTKVTQSLRKAKGEPKNEQAETDKASPNANEKYSLINIPDDMLTTDQLIEKKKQLSLKSMSEGRQRLKQKRYEEELERERKQQLEDEKRLENPELYLEQLHARYKDLSEKVDQRKRLKTNGGHSNGNNLSGGIGRGERLNAAQRERMRLLTTAAFDRGKGEDTFGAKDEDWQLYKLMGKDNDDGDEEPDEDDAELARISSRLLDLDPTFVPNKSETGSSQPAEAPRARPLTKEDFQIVFGVERFRCPEILFNPNWIAVDQAGLDEMAGVSIRRLSCKDESLEERLTSSILVTGGSSLFPGIIERLEAGIRMIRPCGAPIKVVRALDPVMDAWRGAAAFASAPQFHTQTFSRMDYFEKGEDWLRSYQIKYSL

SEQ ID NO: 144670 - protein, 491 aa, Glycine max
  Coding DNA Sequence Number=SeqID_27892
  Gene Ontology: Mol. function=enzyme activator activity; Cellular component=centrosome; Biological process=cell division
  Homolog annotation: Hit_ID=Q6T2Z5; Match level="QueryCoverage=79%, HitCoverage=85%, E-value=1e-156, Identity=71%"; Hit description=WD -repeat cell cycle regulatory protein
  Pfam annotation: Domain name=WD40; Domain location=206-244; Score =8.9; E_value=3.3; Accession=PF00400.22; Description=WD domain, G -beta repeat
  Pfam annotation: Domain name=WD40; Domain location=248-284; Score =19.9; E_value=0.009; Accession=PF00400.22; Description=WD domain, G -beta repeat
  Pfam annotation: Domain name=WD40; Domain location=289-327; Score =37.1; E_value=6e-08; Accession=PF00400.22; Description=WD domain, G -beta repeat
  Pfam annotation: Domain name=WD40; Domain location=331-369; Score =16.9; E_value=0.072; Accession=PF00400.22; Description=WD domain, G -beta repeat
  Pfam module annotation: Pfam domain module=WD40::WD40::WD40::WD40; Domain location=206-244::248-284::289-327::331-369
  Subcellular localization annotation: CTP_CleavageSite=62; ConfidenceScore=5.67e-01
MEAKKSGLNLPAGMSGTSLRLDTAAASSISTLNSPSSLRSISNLTSPSKSNSACSDRFIPCRSSSRLHTFGLLDRPSPVKEGSNEAYSRLLKSELFGSDFASPSLSLSSPAGAAPPSPLSPSKNMLRFKTDHSVAPSSPYSPSILGQQNAFPSDSSTPPPKPPRKVLDAPSLQDDFYLNLVDWSTQNVLAVGLGTCVYLWSASNSKVTKLCDLGPYDGVCSVQWTREGSFISIGTNLGQVQVWDGTQCKKVRTMGGHQTRTGVLAWNSRILASGSRDRNILQHDMRIPGDFVSKLVGHKSEVCGLKWSSDDRELASGGNDNQLLVWNQHSQQPVLRLTEHTAAVKAIAWSPHQSSLLVSGGGTADRVTRGIGLVSTTSDLSFMGLASGIGELSSTPNLRHNSPVVASRVGNSQPAQLASPTGESHGAQIAGGTGETSATCHPQSELANAFCDLHGFYVCNLAWSKNVNELVSTHGYSQNQIMVWKYPSLSK

SEQ ID NO: 144671 - protein, 286 aa, Glycine max
  Coding DNA Sequence Number=SeqID_27893
  Gene Ontology: Mol. function=nucleic acid binding; Cellular component= intracellular
  Homolog annotation: Hit_ID=Q1RZD5; Match level="QueryCoverage=77%, HitCoverage=38%, E-value=1e-17, Identity=33%"; Hit description=Zinc finger, C2H2-type
  Subcellular localization annotation: CTP_CleavageSite=59; ConfidenceScore=5.32e-01
MEFKYRDGQIRRTPSPLRSPLPSNSYVSNRPLHGCDFASGGFPSNVSAPRVFPMVMPINVNEVFQRELEKEQIWRELEKEKIRREIIAREMAFAQRRELEDEVRKEMELERTSRMSMQRSEGIAFREPISESINQSRLNNITMFGGLPFHLSSQASKQIHTDNILFDNKEASNSKDKVIILNKPDDHCGEKRKAITLAIDDNESLRKKAKKEWTCELCQISTTSEKGLNDHIQGKKHKANKESTRTQKIWLHSGPESETLHSCFTPADTCNLESEKRAKLSKTAKG

SEQ ID NO: 144672 - protein, 63 aa, Glycine max
  Coding DNA Sequence Number=SeqID_27894
MNKVLEFGALLASGGQCTLYAYKHKHTDYQLLLIFRDFNIAFTLCPEYHPLNLLTITVPNTVY

SEQ ID NO: 144673 - protein, 202 aa, Glycine max
  Coding DNA Sequence Number=SeqID_27895
  Subcellular localization annotation: CTP_CleavageSite=58; ConfidenceScore=5.16e-01
MEFKYCDCQNQRTSSPTPRPFPTLTYKNSDISKRSSQDMSFPNVGVCQYQPSITPRIRENADTVGVEERRDRREIIANEMIWRRGLKEKVLGISMQGLGMFSFGEPISMSFNPRMNSINHVNNADKDTRQFSTLTNKDKIIILEIKVHRREVPIEKGTSLPMEKGFKILLFPIIDSLGNPLRIFYMWYQSMCYEIYDSPRMI

SEQ ID NO: 144674 - protein, 96 aa, Glycine max
  Coding DNA Sequence Number=SeqID_27896
MPPEELTLLEGAASHTSSACPACATSDTLYDTSVTGSTLALYCQRRFLPRAVQMGLWEAFDISLRDSLISRIPSSETERIIHCPTIIEKSVLAFSY

SEQ ID NO: 144675 - protein, 50 aa, Glycine max
  Coding DNA Sequence Number=SeqID_27897
MGFNVHVERLRRERRSCPKAQQLFLSPPQLYLTMNLRLDTWCATQYVTMF

SEQ ID NO: 144676 - protein, 46 aa, Glycine max
  Coding DNA Sequence Number=SeqID_27898
GERRQIAMVTVGVETRRRRRRKGWEQLCALRHENVLRSQSQSATVK

SEQ ID NO: 144677 - protein, 80 aa, Glycine max
  Coding DNA Sequence Number=SeqID_27899
MNYESSDFHQTVLIIQLGKCVTSPTTRNPGPFESCERINAKRMEQPWEVIYVFMRMGIGHCTSWVASASVLAGWLAATSV

SEQ ID NO: 144678 - protein, 166 aa, Glycine max
  Coding DNA Sequence Number=SeqID_27900
  Gene Ontology: Mol. function=structural constituent of ribosome; Cellular component=ribonucleoprotein complex; Biological process =translation
  Homolog annotation: Hit_ID=Q2QD65; Match level="QueryCoverage=54%, HitCoverage=73%, E-value=5e-37, Identity=86%"; Hit description =Ribosomal protein S12
  Pfam annotation: Domain name=Ribosomal_S12; Domain location=47-165; Score=147.7; E_value=3.1e-41; Accession=PF00164.15; Description =Ribosomal protein S12
MDKLLFLGTHIRYHKKDNGHRKDLEDPPTHESRDLSENGFPIRRVHNRMDKLTLTRQFGIQFGSLGGIGKEFWNSGSKGDLSVNFSTITPKKPNSALRKVARVRLTSGFEITAYIPGIGHNLQEHSVVLVRGGRVTDLPGVRYHIVRGTLDAVGVKDRQQGRSSAL

SEQ ID NO: 144679 - protein, 241 aa, Glycine max
  Coding DNA Sequence Number=SeqID_27901
MTRRLLASSLALESHILHYLIARILLPRSSNLAQVYEEDLIVMWAFHTGRQIDWAHVVRYHMHKALRLNAPLPYPQLVTLFLQHFNIPLDFEPYVLIKKSFLIGVVVVASFGYRKERRDDSWVKKGAQPNDDEGHLPVEGDSFLLQGILDRFDGLKTYAGERIVIIKKGEIVEAMTSKIILTMPKNQEFSKFQRIKIQEQSSFKIQSSFKNQDSRTIKIKIQESREDSIKISTKKVFQNIE

SEQ ID NO: 144680 - protein, 83 aa, Glycine max
  Coding DNA Sequence Number=SeqID_27902
MEEKVKRKINGGLRSTYLKLLCSDTTGWKLALEASMEAGSLSFNKPSTWEASLRSKEGRFLGKLEEESFLEKLEGGYSHSSNS

SEQ ID NO: 144681 - protein, 59 aa, Glycine max
  Coding DNA Sequence Number=SeqID_27903
  Subcellular localization annotation: CTP_CleavageSite=36; ConfidenceScore=5.20e-01
MEKDASHVGPQNGGFNPFSFSLTFGNPNRATGGGVLESTKNATIDNRERLSDYIELMSQ

SEQ ID NO: 144682 - protein, 275 aa, Glycine max
  Coding DNA Sequence Number=SeqID_27904
  Homolog annotation: Hit_ID=Q6B388; Match level="QueryCoverage=24%, HitCoverage=39%, E-value=5e-12, Identity=58%"; Hit description =Hemolysin-coregulated protein
MAIPVYLWLEDDSGRKIKGSVDIQDREGSIEVIEFMHSREQPIDKLTGKTTAKRICRLHHCSFKCQKEYLEKQRYGTDCQMKRLFYLLPLLVAVSTHVFATEMTGFATQYYDEDGSLAEISTTLPLSPAITIGNKTVLMEVTHLSDISSTPVNKGGSARWVCLHDDDGTNYWFISDNEMGAGLLTALAIAQDGIHKECAKTTEHVSVSVANVPLLNATHGNLVELLGKKEIAKNTAMLFYQETPVQNGFIRSNTVSYYFDGEKVRGVIIGQITSN

SEQ ID NO: 144683 - protein, 123 aa, Glycine max
  Coding DNA Sequence Number=SeqID_27905
  Gene Ontology: Mol. function=DNA binding; Biological process =regulation of transcription, DNA-dependent
  Homolog annotation: Hit_ID=UPI0000E451E8; Match level="QueryCoverage =99%, HitCoverage=31%, E-value=9e-54, Identity=82%"; Hit description =conserved hypothetical protein
MGLTSYKGEEVRKSDVTTAKNYLSQDEVSELNRVVNMWLDFAEDQAKRRKQVFLRDWQTKLDQFLQFNDRDVLEGAGKISKKVADEKACSEYVEFEKKQRLLKEAEGEKDIIGLLKWDKQAKR

SEQ ID NO: 144684 - protein, 320 aa, Glycine max
  Coding DNA Sequence Number=SeqID_27906
  Gene Ontology: Mol. function=4-amino-4-deoxychorismate synthase activity; Biological process=folic acid and derivative biosynthetic process
  Homolog annotation: Hit_ID=Q1H0S0; Match level="QueryCoverage=41%, HitCoverage=37%, E-value=3e-24, Identity=49%"; Hit description=S -layer protein, putative
  Pfam annotation: Domain name=Anth_synt_I_N; Domain location=154-298; Score=84.8; E_value=2.7e-22; Accession=PF04715.3; Description =Anthranilate synthase component I, N terminal region
MALGPTIQWQGIDCHIAAEYFATSADVYRVLGELSPAYDLADTADGQGRSISDSMRRLARMVGHDFTNADASVWRSLASAFKTSQLASLMHAIQAGLARAGKQPVCLLGLGAGSFLAESLAQCLHMPYQAASAREVMASMALIVLDLPYAEGMHWLRQVNHLSWPMLLESGRVEGSKENTIEDEETGLGARFDIVVAAPVAKITHRRPYTQVSVNDSVQQSQQDPFAEIQQWLSPHHVERVADIPFAGGALGYFAYDLGRSIERLPELALEDMPVPELLVGIYDWAIVVDHHLASTKLVSHLRFGTHKALEALHQALLQT

SEQ ID NO: 144685 - protein, 285 aa, Glycine max
  Coding DNA Sequence Number=SeqID_27907
  Gene Ontology: Mol. function=phosphoribosylformylglycinamidine cyclo -ligase activity; Cellular component=cytoplasm; Biological process =purine nucleotide biosynthetic process
  Homolog annotation: Hit_ID=Q126R8; Match level="QueryCoverage=38%, HitCoverage=31%, E-value=4e-55, Identity=99%"; Hit description =Phosphoribosylformylglycinamidine cyclo-ligase
  Pfam annotation: Domain name=AIRS; Domain location=72-231; Score =108.3; E_value=2.2e-29; Accession=PF00586.14; Description=AIR synthase related protein, N-terminal domain
YDGVFEVLQWLLFLSAVPPVQLLTGWCVTAKAPPDISAGKCSGRVPFAIQAAQLLGRAIGAGLFAITPAGERGMCCKAIKLGIRCDALVERIKPLAKKTMREGVLAGIGGFGALFEVPKRYKEPVLVSGTDGVGTKLKLAFEWNMHDTVGIDLVAMSVNDVLVQGAEPLFFLDYFACGKLDVDTAAAVVGGIAKDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 144686 - protein, 129 aa, Glycine max
  Coding DNA Sequence Number=SeqID_27908
MAAQVAPPMMERELITMIVDMLPVSYYEKMPGANGEKEKEEGTHVVAAIPTWPNFPPAQQCHYSANVRPSHYPPPNHPQRSPLNQPQRLLVAHPMSNTTRNMNQNTNQGGKFPAKEPVEFTPIPVSYVE

SEQ ID NO: 144687 - protein, 85 aa, Glycine max
  Coding DNA Sequence Number=SeqID_27909
MWKATLQLKKTYLDSYHHSIHPWCPLSIVIDPGIGDKYVVEPWYQFLEESDFSHDDEISFYYRRIEKIWEIVIRRQKDWDDSDTK

SEQ ID NO: 144688 - protein, 122 aa, Glycine max
  Coding DNA Sequence Number=SeqID_27910
  Homolog annotation: Hit_ID=Q1SKD7; Match level="QueryCoverage=93%, HitCoverage=29%, E-value=5e-13, Identity=33%"; Hit description =Ankyrin
MTPKKLSAKRSRRDAAVEGTSAAPEFDSHRFRSAEYQQRFEAIKGWSFHRERRVQLRDNEYTDFQEEIARRHWTSLVTPMAKVDLDIVLEFYANAWPTEEGVRDMRSWVRGQWIPYDADALS

SEQ ID NO: 144689 - protein, 110 aa, Glycine max
  Coding DNA Sequence Number=SeqID_27911
GLGFPALITGLCQSFGVPVTPSKAADAPPPPHQADPAGSLGMEPYLQHLIRQQAANHRGQVQVHECLYQLSLSQQGQGEAPTKAPGDAEEARMDEEMTDLLGFLGGSGAT

SEQ ID NO: 144690 - protein, 93 aa, Glycine max
  Coding DNA Sequence Number=SeqID_27912
MHALLGSFNSGNWSDSKALGSTGLSCCAITRDRVHLPGVNTFAKGLESIIYHMIILSNHHSLCILGSENMEGIHRRKRIEQYHIYLKFPLSSS

SEQ ID NO: 144691 - protein, 295 aa, Glycine max
  Coding DNA Sequence Number=SeqID_27913
  Gene Ontology: Mol. function=nucleic acid binding; Biological process= transport
  Homolog annotation: Hit_ID=Q8H6Q8; Match level="QueryCoverage=79%, HitCoverage=43%, E-value=2e-34, Identity=43%"; Hit description=CTV.20
  Pfam annotation: Domain name=DUF755; Domain location=134-245; Score= -26.1; E_value=0.0046; Accession=PF05501.2; Description=Domain of unknown function (DUF755)
MVTRRFSGQLKGWWDNYLTNEEKSKIYSAVKTDLNGKVITNDDDKEIPDAVNTLIFTIAQHFIGDPSLWKDRSAELLSNLKCRTLADFRWYRDTFLTRVYTREDSQQPFWKEKFLAGFPRSLGDKVRDKIRSQSANGDIPYENLSYGQLISYVQKVALKICQDDKIQRQLAKEKAQTKRDLGSFCEQFGLPACPKQKKKQTSRKEIQDHKPANRRRFSKRRYTQKPSTKTSEEETKTSSSALSDEDLNLIQQDDQLSSTDDEDRQINTLTREQDLLFEAINSIPPPGKEGFSGKT

SEQ ID NO: 144692 - protein, 98 aa, Glycine max
  Coding DNA Sequence Number=SeqID_27914
MDKVDIFVPHPLTNACLLIQLSPECGCKPLVCLLKRPALLGVDFQDCSIRDYSSCTLVGRSELSRIGCWINGLSYLEKGGVELRYEDYFPIKLSLSPD

SEQ ID NO: 144693 - protein, 173 aa, Glycine max
  Coding DNA Sequence Number=SeqID_27915
  Gene Ontology: Mol. function=unspecific monooxygenase activity
  Homolog annotation: Hit_ID=O04892; Match level="QueryCoverage=56%, HitCoverage=20%, E-value=9e-26, Identity=66%"; Hit description =Cytochrome P450 like_TBP
MSRRARRSLQNPGREPGRSGRRCRSWCLPTLETAQPEVGSSGWKSTARRVVSGAPPAALENPEDRVPPTPGRTHNRIRSPREVGKIGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 144694 - protein, 411 aa, Glycine max
  Coding DNA Sequence Number=SeqID_27916
  Subcellular localization annotation: CTP_CleavageSite=52; ConfidenceScore=5.58e-01
NPGQATLPHQRKKSITSAMSSSPYAPSPSPGVLAGPAPAKGKGWGLGSTDARCTGRSSLSAEPNPYDYPSASRLHVAYMHAFGAPSAEVAVVEVVAVHPRLAAADPPLATIVPDPPVNWQRPVIKARNPRALLDFSGSTGCQGGHMNTHLGQDGIDQLALEYGEVGICVRVVMLVGMIRTHLPATLRAKSYPGTLFVCDWARLAQEETTTSLGGLAAHWASTSLTDPLLGFPNPLMLGHPEVWKGPPELALEYPELMWDKCPSAVSLLSGLQRREVGATSGVSSSVSSGVASGSGYGSWGVGASSSPIGEGWTPGQATWAMKSSMLMMGRCAGTKVGGGASVEIEAGAVAGVSEVEASEGPRALVLRVPGKVIVGSFRDSKVNESGTTPLSMHKAVISAGKPSLEELEWVI

SEQ ID NO: 144695 - protein, 68 aa, Glycine max
  Coding DNA Sequence Number=SeqID_27917
MALQELPMVTWHRCRGICETTVYYWKNRCRILICDHIPTVWKFIGLLAIATLLVLIIVQTFYSSHNSS

SEQ ID NO: 144696 - protein, 229 aa, Glycine max
  Coding DNA Sequence Number=SeqID_27918
MSSKLSHLGPFDLIKKIEWTILDDGNRIERLHLPSLFFPPPSPSTCGRRGYEISPRLVGISPEANTTSTATIGGGSAFSIKEHQVKPLIPRFQEQRRRRGFPPRTAKKVESTVLFFDEIEVLARAINLENSVPIEVVVGDWLLSSEEDVEDGQDLVGAFEEHLRIVAKIAAAAWAEVLCGEGQGLQDPVVGCGEGEEEEAGGHDEGSEVTFSTKTTEGEGRYPKQISTV

SEQ ID NO: 144697 - protein, 34 aa, Glycine max
  Coding DNA Sequence Number=SeqID_27919
MEFHATNSIITIIPNFDPRETWVVLSVALPCSNA

SEQ ID NO: 144698 - protein, 101 aa, Glycine max
  Coding DNA Sequence Number=SeqID_27920
  Homolog annotation: Hit_ID=Q9XIE6; Match level="QueryCoverage=47%, HitCoverage=3%, E-value=2e-10, Identity=56%"; Hit description =Putative phospholipid-transporting ATPase 3
  Subcellular localization annotation: CTP_CleavageSite=78; ConfidenceScore=5.27e-01
MGFNLRSLLDRVPRWANINNNLPRKLFDSAEFSLRLRLTAPSSATIARPIFPSDSSTIASRLTAMSCSIEAIAVQLFVAPEAGQIVVRPHLWIFMALDGTT

SEQ ID NO: 144699 - protein, 91 aa, Glycine max
  Coding DNA Sequence Number=SeqID_27921
MFPPLEPCSVAILRLSRQRLKSRRNKEKHNHNICQRGSSVKWGMPMFGGVKKWCALPLSLIQCLVVHCAPIFCHGHGRHNRNTNSVCLGTP

SEQ ID NO: 144700 - protein, 295 aa, Glycine max
  Coding DNA Sequence Number=SeqID_27922
  Gene Ontology: Mol. function=protein serine/threonine kinase activity; Biological process=protein amino acid phosphorylation
  Homolog annotation: Hit_ID=Q84V35; Match level="QueryCoverage=89%, HitCoverage=37%, E-value=2e-17, Identity=27%"; Hit description =Receptor kinase ORK10
MIVLPSSSRYAQSMVAIVVIIFLLFQQPSSAKHHPSCPPSSCGKIRNITYPFRLKGDPRGCGLSGYELDCVNNVTVLTLFSGKYHVQEINYKKYQIRLTDVGIVEDACSVPRYFLYEQNFSSFEIPYYSTPDALTFGDMEIARFGYPSIGFLNCSNAVTNDPRYVEMDTHRCDSGGHIYAILMCDLIGFNLMDIKVGCHLKVATFANLFKSIKKIDDDYYGAEYVDYINASSADIRKWLNGGFWLSWLAPVICRKQCGKDIKCFLNETAQVQCDRHRYCHYVTTTSTNCESVELS

SEQ ID NO: 144701 - protein, 107 aa, Glycine max
  Coding DNA Sequence Number=SeqID_27923
MRTIVETERQSPFPTPSTKTRKNNSQVSQIAKPGEGGIGKQEQGAGSNQRQLKVAQRIKSDSLCSQTTRKTKYTEPLTRVSCSRDLIPCLKEIVGIREKMREEDNKL

SEQ ID NO: 144702 - protein, 123 aa, Glycine max
  Coding DNA Sequence Number=SeqID_27924
MKLLNRPMPPTLLRFSSIYINHDLNSAGRAWENRINVDDMMYTSIEILERDRGGEEHRQRLKQSHNRTWHQHTILDDKGYNDDRTSMPSSSKWFKTSLLQGDNGDSTSTRVGCYERRLIMNFQ

SEQ ID NO: 144703 - protein, 96 aa, Glycine max
  Coding DNA Sequence Number=SeqID_27925
MLSTSGRLRARYSLQREWVWSCIVTQTACYTCHTRVHVVPADRPDIACIEYTQWRLQRTKVTILTCHLGDGRVPGTNQAFGTDVWEESEDSPEDTS

SEQ ID NO: 144704 - protein, 109 aa, Glycine max
  Coding DNA Sequence Number=SeqID_27926
MAIYRKEPRGAEKFAQASCSSPRRICDLVLKALIHPTQASWMLAWASGCLKSWKNDHFSLPFDFIYGSNKQPSKPTKSWDRRLQEDWAKDAREGPRVLMSLRVDFEPMG

SEQ ID NO: 144705 - protein, 169 aa, Glycine max
  Coding DNA Sequence Number=SeqID_27927
MDFLVSPFQASFILGRQSANIVVISQEIFHLMRKLKERLSHLIHMEVYIHNWKHVPLFRVGLRSRILSLQTICCSLMRLLVINELFPQISHPFLGMDIMLEGGHKGAYGGILRDKNGCWIGGFSKNFGACSVLFVRHSVILLTLELAWQKGISKLHMKGECEISFHLIK

SEQ ID NO: 144706 - protein, 241 aa, Glycine max
  Coding DNA Sequence Number=SeqID_27928
  Gene Ontology: Mol. function=nucleic acid binding; Biological process= DNA integration
  Homolog annotation: Hit_ID=Q2HSF6; Match level="QueryCoverage=55%, HitCoverage=9%, E-value=2e-20, Identity=40%"; Hit description =Glycoside hydrolase, family 1; Zinc finger, CCHC-type; Polynucleotidyl transferase, Ribonuclease H fold
  Pfam annotation: Domain name=zf-CCHC; Domain location=29-46; Score =28.5; E_value=2e-05; Accession=PF00098.13; Description=Zinc knuckle
MKKKGKFMHSSRQKDTIFKNKHKGESNEIICLKCKKPGHMKVECPQLKRKIHSGDKKKKSLMVTWDDSYSEKSRSSDDEQTNICLMVDTDDKVEISWVGKGQGLSWYLDNGCSRHMTREISMFLDPKPIEGGIVAFGGMSKGKITGIDQVAKFDSKVDKGIFLGYSDTSKAFKVFNSRTIVMEEFIHVKFNDGLITDEKLSNLEDDFANMQIGPFVAPKIDKVKQSDETPPQSRESSSQQL

SEQ ID NO: 144707 - protein, 665 aa, Glycine max
  Coding DNA Sequence Number=SeqID_27929
  Gene Ontology: Mol. function=galactosyltransferase activity; Cellular component=membrane; Biological process=protein amino acid glycosylation
  Homolog annotation: Hit_ID=Q10BV0; Match level="QueryCoverage=82%, HitCoverage=82%, E-value=0.0, Identity=67%"; Hit description =Galactosyltransferase family protein, putative, expressed
  Pfam annotation: Domain name=Gal-bind_lectin; Domain location=175 -385; Score=155.1; E_value=1.8e-43; Accession=PF00337.12; Description= Galactoside-binding lectin
  Pfam annotation: Domain name=Galactosyl_T; Domain location=431-624; Score=41.6; E_value=8.1e-10; Accession=PF01762.12; Description =Galactosyltransferase
  Pfam module annotation: Pfam domain module=Gal-bind_lectin::Galactosyl _T; Domain location=175-385::431-624
MKRVKKLYPLLSLLPNRPKPLQIFMAVMFLYLLFTTFEIETFLGFRTRFVSVTSLLGNEDQQQQQHTHFSKASNFPSQGVFQGSVHRKALQGLQKVSTLSFMEALNDTTVEENMVSELHNAARHAWLEGKRLWEQVESVKETMDDVARFKAENLSDSCKNSISLSGSELKEKKGVMVMVLPCGLTLGSHVTVVGTPRWAHWEDDPKIAVVKEEEGKVMVSQFMMELQGLKSVDKEEPPRILHFNPRLKGDYSGRPVIEQNTCYRMQWGSALRCEGWKSRADEDTVDGQVKCEKWIRDDDSHTEEAKATWWLSRLIGRTKKVTIDWPYPFVEGRLFVLTVSAGMEGYHVSVDGRHVTSFPYRTGFSLEDATGLSIKGDVYVHSIFAASLPSSHPSFAPQMHLELLPQWKVPPLLHVNVELFIGILSAGNHFAERMAVRKSWMQHKLIKSSNVVARFFVALHGRKDLNVEIKKETDYFGDIIIVPYMDHYDLVVLKTIAITEYGIRSVAAKYIMKCDDDTFVRIDSIISEARKVGSGRSLYLGNMNYHHRPLRSGKWAVTYEEWSEEEYPTYANGPGYIISADIARFIVSNFEKHRLKLFKMEDVSMGMWVEQFNSSRPVEYVHSFKFCQFGCIEDYFTAHYQSPRQMTCMWDKLQQKGQPLCCNMR

SEQ ID NO: 144708 - protein, 534 aa, Glycine max
  Coding DNA Sequence Number=SeqID_27930
  Gene Ontology: Mol. function=protein binding; Cellular component =integral to membrane; Biological process=protein amino acid phosphorylation
  Homolog annotation: Hit_ID=Q9ZTK0; Match level="QueryCoverage=94%, HitCoverage=84%, E-value=4e-68, Identity=34%"; Hit description=Hcr2 -0A
  Pfam annotation: Domain name=FNIP; Domain location=213-257; Score =9.3; E_value=0.064; Accession=PF05725.3; Description=FNIP Repeat
  Pfam annotation: Domain name=LRRNT_2; Domain location=30-69; Score =35.4; E_value=2e-07; Accession=PF08263.3; Description=Leucine rich repeat N-terminal domain
  Pfam annotation: Domain name=LRR_1; Domain location=108-130; Score =2.5; E_value=98; Accession=PF00560.23; Description=Leucine Rich Repeat
  Pfam annotation: Domain name=LRR_1; Domain location=134-156; Score =17.8; E_value=0.04; Accession=PF00560.23; Description=Leucine Rich Repeat
  Pfam annotation: Domain name=LRR_1; Domain location=158-180; Score =13.6; E_value=0.73; Accession=PF00560.23; Description=Leucine Rich Repeat
  Pfam annotation: Domain name=LRR_1; Domain location=182-204; Score =15.7; E_value=0.17; Accession=PF00560.23; Description=Leucine Rich Repeat
  Pfam annotation: Domain name=LRR_1; Domain location=206-228; Score =11.2; E_value=2.3; Accession=PF00560.23; Description=Leucine Rich Repeat
  Pfam annotation: Domain name=LRR_1; Domain location=230-252; Score =19.4; E_value=0.013; Accession=PF00560.23; Description=Leucine Rich Repeat
  Pfam annotation: Domain name=LRR_1; Domain location=280-302; Score =7.6; E_value=11; Accession=PF00560.23; Description=Leucine Rich Repeat
  Pfam annotation: Domain name=LRR_1; Domain location=304-326; Score =16.8; E_value=0.078; Accession=PF00560.23; Description=Leucine Rich Repeat
  Pfam annotation: Domain name=LRR_1; Domain location=347-370; Score =15.5; E_value=0.2; Accession=PF00560.23; Description=Leucine Rich Repeat
  Pfam annotation: Domain name=LRR_1; Domain location=372-394; Score =6.2; E_value=20; Accession=PF00560.23; Description=Leucine Rich Repeat
  Pfam annotation: Domain name=LRR_1; Domain location=397-419; Score =10.4; E_value=3.2; Accession=PF00560.23; Description=Leucine Rich Repeat
  Pfam annotation: Domain name=LRR_1; Domain location=421-443; Score =13.4; E_value=0.83; Accession=PF00560.23; Description=Leucine Rich Repeat
  Pfam annotation: Domain name=LRR_1; Domain location=445-464; Score =3.8; E_value=57; Accession=PF00560.23; Description=Leucine Rich Repeat
  Pfam annotation: Domain name=LRR_1; Domain location=474-497; Score =5.5; E_value=26; Accession=PF00560.23; Description=Leucine Rich Repeat
  Pfam annotation: Domain name=LRR_1; Domain location=498-518; Score =5.1; E_value=32; Accession=PF00560.23; Description=Leucine Rich Repeat
  Pfam module annotation: Pfam domain module=FNIP::LRRNT_2::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1; Domain location=213-257::30-69::108 -130::134-156::...
  Pfam module annotation: Domain location=158-180::182-204::206 -228::230-252::280-302::304-326::347-370::372-394::397-419::421 -443::445-464::474-497::498-518
MDYDYQLLHVVALLTLIAFGGTSWTIEACSPNELEALMSFKNGIQKDTSGRVAKWIGQSCCDWEGIVCENATSRVTQINLPGFISTDTDLFQTQMKGLISPSITLLTFLEIIDLGGLVGLSGTIPQTIGLHLPKLQKLYLYGNNLTGPIPESIGELPNLQELALQENRLSGLIPVSLGSLKSLKRLLLYSNQFSGTIPDSLGNLMNLVELDVHDNALIGNIPNSVGEMQALEKLDLSNNLLSGKIPSSLTNLTVISVLYLNTNYLEGTVPFPSRSGEMSSLGFLRLHNNLLVGNIPSNIGYLVSLQRVSLSNNKLEGALPSSLGNLVALTELYLSGPLPQEMSSLQNLQTLDLSFNHLNLSAIPKWIENMSSLSNIYFAGCGIQGQIPDFFQRTNSPIQELDLSVNFLSGNIPSWIGSLNQLYKLNLSRNSLYSDIPDSFRNLQDLGILDLHSNRLAGTIASAFDIQQGVLGGSLKFVDLSANNFSSGIEEIGGGQCGIQFLNLSHNLLKGAGKFNLIGEIEAAAKSLHWQNSK

SEQ ID NO: 144709 - protein, 61 aa, Glycine max
  Coding DNA Sequence Number=SeqID_27931
MEKCTFIFIHLNYKRDDGWHSSQLLEDLQYSNPYQNTGSGSTNDLYEGREHPLVKYAGGGR

SEQ ID NO: 144710 - protein, 57 aa, Glycine max
  Coding DNA Sequence Number=SeqID_27932
  Homolog annotation: Hit_ID=Q9SLT5; Match level="QueryCoverage=98%, HitCoverage=11%, E-value=4e-19, Identity=78%"; Hit description=CW14 protein
GENYYEIDLDMHRFSYISRKGFDMFLDRLKICILDVGLTIQAREQSRGAARASFMLY

SEQ ID NO: 144711 - protein, 742 aa, Glycine max
  Coding DNA Sequence Number=SeqID_27933
  Gene Ontology: Mol. function=transferase activity, transferring hexosyl groups; Cellular component=mitochondrion; Biological process= metabolic process
  Homolog annotation: Hit_ID=Q84NV9; Match level="QueryCoverage=95%, HitCoverage=92%, E-value=1e-175, Identity=40%"; Hit description =Putative CRP1 protein
  Pfam annotation: Domain name=PPR; Domain location=182-216; Score=9.0; E_value=0.64; Accession=PF01535.11; Description=PPR repeat
  Pfam annotation: Domain name=PPR; Domain location=253-287; Score =40.6; E_value=5.4e-09; Accession=PF01535.11; Description=PPR repeat
  Pfam annotation: Domain name=PPR; Domain location=288-322; Score =38.7; E_value=2e-08; Accession=PF01535.11; Description=PPR repeat
  Pfam annotation: Domain name=PPR; Domain location=323-357; Score =39.3; E_value=1.3e-08; Accession=PF01535.11; Description=PPR repeat
  Pfam annotation: Domain name=PPR; Domain location=358-392; Score =41.9; E_value=2.1e-09; Accession=PF01535.11; Description=PPR repeat
  Pfam annotation: Domain name=PPR; Domain location=393-427; Score =60.8; E_value=4.5e-15; Accession=PF01535.11; Description=PPR repeat
  Pfam annotation: Domain name=PPR; Domain location=428-462; Score =60.4; E_value=5.7e-15; Accession=PF01535.11; Description=PPR repeat
  Pfam annotation: Domain name=PPR; Domain location=463-497; Score =50.0; E_value=8e-12; Accession=PF01535.11; Description=PPR repeat
  Pfam annotation: Domain name=PPR; Domain location=498-532; Score =48.2; E_value=2.8e-11; Accession=PF01535.11; Description=PPR repeat
  Pfam annotation: Domain name=PPR; Domain location=533-567; Score =45.1; E_value=2.4e-10; Accession=PF01535.11; Description=PPR repeat
  Pfam annotation: Domain name=PPR; Domain location=568-602; Score =37.7; E_value=4e-08; Accession=PF01535.11; Description=PPR repeat
  Pfam annotation: Domain name=PPR; Domain location=603-637; Score =27.4; E_value=5.2e-05; Accession=PF01535.11; Description=PPR repeat
  Pfam annotation: Domain name=PPR; Domain location=638-672; Score =42.3; E_value=1.6e-09; Accession=PF01535.11; Description=PPR repeat
  Pfam annotation: Domain name=PPR; Domain location=673-707; Score =39.7; E_value=1e-08; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=182 -216::253-287::288-322::323-357::358-392::393-427::428-462::463 -497::498-532::533-567::...
  Pfam module annotation: Domain location=568-602::603-637::638 -672::673-707
  Subcellular localization annotation: CTP_CleavageSite=38; ConfidenceScore=5.31e-01
MKRVAISSYFHCFHYHYHCHHNPFLGFGPRRCLSVKFSTSLGSSNARPFPDYSPRKPSVTDTDFVHHISTTIKQRRAEPFRRILKPFESKFRPDHLIWVLMSIRDDYKLVLDFFDWARLRRDPSLESLCIVVQIAVASKDLRMAHRLVFEFWEKPHLDVGNSFDRFTERLIYTYKDWGAHPLVFDVFFQVLVEAGLLLEAGKLFDKLLNYGVLVSVDSCNLFLARLSNSFDGIRTAFRVFREYSEVGVCWNTVSYNIILHLLCQLGKVKEAHSLLIQMEFRGNVPDVVSYSVIVDGYCQVEQLGKVLKLMEELQRKGLKPNQYTYNSIISFLCKTGRVVEAEQVLRVMKNQRIFPDNVVYTTLISGFGKSGNVSVEYKLFDEMKRKKIVPDFVTYTSMIHGLCQAGKVVEARKLFSEMLSKGLKPDEVTYTALIDGYCKAGEMKEAFSLHNQMVEKGLTPNVVTYTALVDGLCKCGEVDIANELLHEMSEKGLQPNVCTYNALINGLCKVGNIEQAVKLMEEMDLAGFFPDTITYTTIMDAYCKMGEMAKAHELLRIMLDKGLQPTIVTFNVLMNGFCMSGMLEDGERLIKWMLDKGIMPNATTFNSLMKQYCIRNNMRATIEIYKGMHAQGVVPDTNTYNILIKGHCKARNMKEAWFLHKEMVEKGFSLTAASYNSLIKGFYKRKKFEEARKLFEEMRTHGFIAEKEIYDIFVDVNYEEGNWENTLELCDEAIEKCLVKKT

SEQ ID NO: 144712 - protein, 90 aa, Glycine max
  Coding DNA Sequence Number=SeqID_27934
MIVNMNIFDWVSKVNHGKGFIILFFSLPFLHVALLECVFSSLSLECVFSWLPPRKDNTYFLTTTIIAVVYEVRILAIEDEGSKSPSLERM

SEQ ID NO: 144713 - protein, 205 aa, Glycine max
  Coding DNA Sequence Number=SeqID_27935
  Gene Ontology: Mol. function=nucleic acid binding; Cellular component= nucleus; Biological process=DNA integration
MEFKQLDIKIAFLCGRLEKDILMQQLEDFEQGGGWFHIYLLLYVDDMLIASQNLLAIKKLKSILSSEIEMKDKRVVEKILGMEIKRDRVQKKLFLFQKEYIKKVLNCFEMESAKSIYTPLTTSICPSELNTTQSESEKEYMSRVPYASVVESLMYTMVCTRLDLAQEGTIDIGLAYHGDTSYAHTSYSDSNYVKNLDACKEICNW

SEQ ID NO: 144714 - protein, 125 aa, Glycine max
  Coding DNA Sequence Number=SeqID_27936
MESHPFMSLPQFGEPPRHPPMVHDDTYIIPDPPVLPVHSVAMQQPPAPATIDADMSRHLVVVACQKITESLEYIISIRMVIVGTDAYALTDHYLRLAKGVTQQGNVYVRSRQRRDTQDRNGGGRR

SEQ ID NO: 144715 - protein, 72 aa, Glycine max
  Coding DNA Sequence Number=SeqID_27937
EDVAIELHNLAAEEDATKGPWWWCTNDDLRSDSVFQDVTTASGEGISRCRHCCWWLTSIGKWRREGREEEDM

SEQ ID NO: 144716 - protein, 88 aa, Glycine max
  Coding DNA Sequence Number=SeqID_27938
  Homolog annotation: Hit_ID=Q9FQF3; Match level="QueryCoverage=97%, HitCoverage=68%, E-value=6e-08, Identity=53%"; Hit description =Glutathione S-transferase GST 5
MAKSDELKLMGKWSSPYAMRVKIALNIKSLEHEHFEETMISIIIVEGEEERKPYFEVLEEVLERIEDAFMKCSKGKPFFGGDMIGWIP

SEQ ID NO: 144717 - protein, 769 aa, Glycine max
  Coding DNA Sequence Number=SeqID_27939
  Gene Ontology: Mol. function=extracellular matrix structural constituent; Cellular component=proteinaceous extracellular matrix; Biological process=multicellular organismal development
  Homolog annotation: Hit_ID=Q6RYR9; Match level="QueryCoverage=40%, HitCoverage=98%, E-value=5e-29, Identity=32%"; Hit description=GD3 protein
MACEMPLDLIKHLRILLRREANLSWYDPEKEENLALPKLPSVAETIAKLDPSPNYLRCKNCNGKLIRDLQSSICVFCGTNSQNELPPEPIKFKSTIGYRWLLESLQLDGSVLLVLFSNQNWSFPAGTCIIEDMVAPVVDENEWKRGRSELKDEIPLSELLDLEIRWPSEAERAQTSTSDLAAQGKSSLNLAGVDLDSFFDRRESDSEVYEQNLASGKQVGGASDKSFQANENLSLFQNVQALEAAAGSAENQSGDSFSSWETSFMSASSGPVHEMPKSVYHSKVELDMTSGFLKDSVGVKKNDDFNPSASTEDDYFQGGWRTFNSEVHDQTGKSESTMDPSGIKTAENANGSSRNLDWMQDDLWQGSDNKTTDTVPTAEDKDSFDEWNDFTGSGSTQDPSSTISNSKTTAQTGNVGYSVDFNDTKTSQDANSSSNKDFDWMQDQWQDNNNKTTNAISGNEAADAFDAWNNFTGSANTQHSSFGLSNSEITGQAGKFELSQDHNDTKTAESATGSSSNFDWMQDNQWQGSDDKATGIVTTNEASDVFDTWNDFTGSAISQNPSSGVSDSAITAQTRKSEVTADLDDMKTEEGTNASSCRSFDRMQDDLWQVSNNKTTVTRTTNDIDSFDVWNDFTSLASTQDHSSNVWKQTVNLTSAEMTSETNLLSSSNSSHDKDFSGFSQHDLFSGQFGSSLPVTSSNRVDEVDITRGNSGDVSSAECYYCILASSCGEMNLIMIFCVRFDFRAAFNYVELRVETVLTLLAPLPNNLQ

SEQ ID NO: 144718 - protein, 485 aa, Glycine max
  Coding DNA Sequence Number=SeqID_27940
  Homolog annotation: Hit_ID=Q1SWU2; Match level="QueryCoverage=99%, HitCoverage=95%, E-value=1e-119, Identity=64%"; Hit description =Cytosolic fatty-acid binding; Actin-crosslinking proteins
  Pfam annotation: Domain name=DUF569; Domain location=1-141; Score =260.9; E_value=2.5e-75; Accession=PF04601.4; Description=Protein of unknown function (DUF569)
  Pfam annotation: Domain name=DUF569; Domain location=202-343; Score =379.3; E_value=5.9e-111; Accession=PF04601.4; Description=Protein of unknown function (DUF569)
  Pfam module annotation: Pfam domain module=DUF569::DUF569; Domain location=1-141::202-343
MEHFNKAKAVKLRSHLGKYLIADEDKLRQSKRGSTKKAIWEIELINGKNHHVRLKSSNGRYLTATDAPFLLGMTGNKVVLANFDKGTDWKFEWEPITEGFHVKLRSWCGKYLRGNGGTVPWRNSVTHDDPASSVTHTWILWASEPVQEFPEKMVSFAESDFSSLDSEDELLASEEESSRSHKSMLKTTSSNTSGATSIRSGMELFHRAKAVRLRSHHDKYLLADEDEESVTQDRNGSSRNAKWTVELIPEFDNIIRLKSCYGKYLTASNQPLLLGVTGRKVVQSLPRRLDSSVEWEPVRDGAQVKLKTRYGNFLRANGGVPPWRNSVTHDIPHRTATQDWILWDVDVLEIHVVSPAPPPIPHSDSLDFESNTPSAVNIKSTTFSRQESTDSNVGSPPKKMEGRTIYYHVAEDNGDVDDENVQGYSLNFKGNGVEQLARKFEEETGLEGVIVCTRSPLNGKLYPLRLQLPPNNVTMQVVLVLPSSK

SEQ ID NO: 144719 - protein, 86 aa, Glycine max
  Coding DNA Sequence Number=SeqID_27941
MVVVASRDGGALDLGGDGILGGVWVTVGGVGFCEGGIVAWRLWIYGRLRLVVAMMIGCKVVDGGDGDNDTGKTRGEEEKEEEACIL

SEQ ID NO: 144720 - protein, 640 aa, Glycine max
  Coding DNA Sequence Number=SeqID_27942
  Gene Ontology: Mol. function=metal ion binding; Cellular component =intracellular; Biological process=protein kinase C activation
  Homolog annotation: Hit_ID=Q6Z4H7; Match level="QueryCoverage=75%, HitCoverage=94%, E-value=1e-125, Identity=49%"; Hit description =Putative pentatricopeptide (PPR) repeat-containing protein
  Pfam annotation: Domain name=PPR; Domain location=198-231; Score =31.2; E_value=3.6e-06; Accession=PF01535.11; Description=PPR repeat
  Pfam annotation: Domain name=PPR; Domain location=301-335; Score =14.9; E_value=0.13; Accession=PF01535.11; Description=PPR repeat
  Pfam annotation: Domain name=PPR; Domain location=337-371; Score=6.0; E_value=1.4; Accession=PF01535.11; Description=PPR repeat
  Pfam annotation: Domain name=PPR; Domain location=373-407; Score =12.5; E_value=0.25; Accession=PF01535.11; Description=PPR repeat
  Pfam module annotation: Pfam domain module=PPR::PPR::PPR::PPR; Domain location=198-231::301-335::337-371::373-407
MATSPPSLLLSTTTSTNNQSQHLIHLLNEPTTITMPQLKQIHAQTLRTVNSNHPNAIFLYTNILQHYSSLTQPNLTYATRVFHHFPNPNSFMWNTLIRVYARSTNTNHKHKAMELYKTMMTMEEKTAVPDNHTFPIVLKACAYTFSLCEGKQVHAHVLKHGFESDTYICNSLVHFYATCGCLDLAEKMFYKMSERNEVSWNIMIDSYAKGGIFDTALRMFGEMQRVHDPDGYTMQSVISACAGLGALSLGLWVHAYILKKCDKNMVDDVLVNTCLVDMYCKSGELEIAKQVFESMAFRDLNAWNSMILGLAMHGEAKAALNYYVRMVKVEKIVPNSITFVGVLSACNHRGMVDEGIVHFDMMTKEYNVEPRLEHYGCLVDLFARAGRINEALNLVSEMSIKPDAVIWRSLLDACCKQYASVELSEEMAKQVFESEGSVCSSGVYVLLSKVYASACRWNDVGLLRKLMSEKGVTKEPGCSIIEIDGVVHEFFAGDTTHPKSENIYKVVTEIEEKLESIGYLPDYSGAPMVDEVNDGKLNTLRLHSERLAIAFGILNSKPDVPIRVFKNLRMEHVLVWIIGDRCLCRRTRKIQFIKERKLIAHAHALVGYCVQYQDIPMSKRLSNSANDVHGDNWSCRSTLS

SEQ ID NO: 144721 - protein, 160 aa, Glycine max
  Coding DNA Sequence Number=SeqID_27943
  Gene Ontology: Mol. function=transmembrane receptor activity; Cellular component=membrane; Biological process=defense response
  Homolog annotation: Hit_ID=Q1SWS7; Match level="QueryCoverage=93%, HitCoverage=61%, E-value=3e-60, Identity=70%"; Hit description=TIR
  Pfam annotation: Domain name=TIR; Domain location=16-148; Score =164.9; E_value=2e-46; Accession=PF01582.10; Description=TIR domain
MASSSSSSNLEERHEVFLSFRGEDTRKTFTSHLHAAFKRMEINTYIDYNLERGDEISGTLLRAIEDAKLSVIVFSKNFGTSKWCLDEVKKIMECKKTRRQMVVPVFYDIEPTHVRNQTGSFASAFARHEERFMDRPNKVQKWKDALREATNLSGWDCSVD

SEQ ID NO: 144722 - protein, 152 aa, Glycine max
  Coding DNA Sequence Number=SeqID_27944
  Gene Ontology: Mol. function=transmembrane receptor activity; Cellular component=membrane; Biological process=defense response
  Homolog annotation: Hit_ID=Q1SWT5; Match level="QueryCoverage=99%, HitCoverage=81%, E-value=4e-35, Identity=49%"; Hit description=TIR
  Pfam annotation: Domain name=TIR; Domain location=17-139; Score=55.1; E_value=2.3e-13; Accession=PF01582.10; Description=TIR domain
MASSSSFSFIPQETDDVFISFRGEDTRHSFTAHLLAALGRLKIRTYVDYKLGRGDEISPTLLRPIVESKVSVIVLSRNYICHFEVVLGRARENYGMQKNKGSNHVRNQTGSYADAFVKHEQRLKDNVQKVELWRDSLREVANLSGLDCLVNR

SEQ ID NO: 144723 - protein, 45 aa, Glycine max
  Coding DNA Sequence Number=SeqID_27945
MVKVWGVMRLSCFKKILEIGKIGYSTEVELVLREKKAGKLGGKKN

SEQ ID NO: 144724 - protein, 237 aa, Glycine max
  Coding DNA Sequence Number=SeqID_27946
MESCNVKNKSSGKRKMSSEDTRSYFAWNLEMEHVLADVLRDQRNLGNKGDGNWKAIAYSTAAQSLSKHFGVHLMADNVKNCFKLWRTWYEIDRATGLGAKNALDADDIMSKETNEEETIHSVSFDLEGSSAVTRKNIRPSKSGEKEGMISSMKEVVESLKEFVEVTKKKMENKKKMEIKEAQEVVHEVVSELDNIPNFNGALRHRAIDWLTENLIKFAIIKALPLDEKEDYISSFMP

SEQ ID NO: 144725 - protein, 57 aa, Glycine max
  Coding DNA Sequence Number=SeqID_27947
  Homolog annotation: Hit_ID=Q9SJ22; Match level="QueryCoverage=91%, HitCoverage=4%, E-value=4e-17, Identity=75%"; Hit description =Probable cellulose synthase A catalytic subunit 9 [UDP-forming]
MAWNNVRDHPGMIQVFLGENGLCDIKGNKLPCLVCVSREKRAGYHHHKKGGAMNALA

SEQ ID NO: 144726 - protein, 154 aa, Glycine max
  Coding DNA Sequence Number=SeqID_27948
MGMFKLQSPDPTLSNQAFMDEVFLLVEIYKKERCIKCDQDYIFSCFHSQMWWKRGERETLYNAYGSNGCGVRRQMDLSLRFGFSWGPLLEYLSRLDDKELQISNESDSATVSAMKLKLFKEISMRQYSKHLTSTRYSIFCCLTQDILYALDLGQ

SEQ ID NO: 144727 - protein, 732 aa, Glycine max
  Coding DNA Sequence Number=SeqID_27949
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=70%, HitCoverage=47%, E-value=6e-82, Identity=43%"; Hit description=Chromo
GRGEHVPNNKVLHLLSSYLLGEAGGLCGVPAVREGGNSRKRGLKGMNLDAGGGKVIFQMSRSSLDARWSWVGCVTVVGAAVTGDVAVVIGGANTTVRPQKPPCPQGGENRGNIVVVEGAGYHGPVRTIRRWRWVVDRDGDGGESNETLGVSATQVEEEDDWPLRRLIDVCRPGRNLTYTHWPATNVTSSHLESALSSFVAGGAGNIVKDCGRWFAINDFKWREARAGMEGRVITLFCEGEVDRGRSIGGIAQRCGSSPSSGRQTGGGTQCLTGVAKSCNLQTISRNKLATLKAVNPEAKAPKCTPLENLSTTTRITVKPFEFGRWAMKSMERSSHTPSGVDQTRRSLTQGDGDDTMKEWVILIEPDSTLEQYQPVTESIVRMVIRVITNGLSKALELRVRVEGLLDVTEEVKLGNTKDEQGSFRRWSSGKSISDHCCSGVCMTCVINSRRLLWSVRMVNGRPKRHLLKYASGWPFCRSTAPMAIPEASVSITKGSEKLGRASTGALVMASLSLSKACCESWDQVKASLHSRDVRGAAMEARYAFAGNDMAQIFDGILCEETLGAFQEKLSVMKGLEDDLKVLQIGCVTKPEGHHQIFEVAIVGSKGCLLDVAFIHQNLMEPLPEIQLGEPRSTSITDTKSPSAVLLLHEEHWRRIGTGAWSDQTGGEELGDLVFDLILLEVGLSVGTNGYWGSGWLEGDVVDHLSWGRCSIAGIGCGGAGCSGSVTGKTCSW

SEQ ID NO: 144728 - protein, 57 aa, Glycine max
  Coding DNA Sequence Number=SeqID_27950
MGEAWSMELFGWKKINIGVTTIIKEKHGGDGSGLASQQLWEDGKDKPVGMMQLQLSE

SEQ ID NO: 144729 - protein, 79 aa, Glycine max
  Coding DNA Sequence Number=SeqID_27951
MVALRPLVGILGDPYKIPIQPLITHYSHVQTGGYECGYYVMHWMWCIVTGDLKDEWHKVMLVGWGGNNSSTLTGGVIAN

SEQ ID NO: 144730 - protein, 522 aa, Glycine max
  Coding DNA Sequence Number=SeqID_27952
  Gene Ontology: Mol. function=RNA-directed DNA polymerase activity; Cellular component=chromatin; Biological process=RNA-dependent DNA replication
  Subcellular localization annotation: CTP_CleavageSite=38; ConfidenceScore=5.07e-01
MAGDNIAKTAFHTHQGHYEYRKIPFSFCNAPSTFQVTMNALLQSFLRKFTTVFFDDILIYSDTMYSYLHHLLLIFETLLQGRFYLKCSKCLLAQLQLEYLGLIISGRGIELEQSKITAMFDWHVPSNQKDLHGFLGLTSFYHKFIKGYATIASRLTLLLCKDKFVWTSKSQLAFDNLKRAMTESLVLTLPDFSLLLVLETFASDSAMGVVLMQQNHLIAFFSKQFSPHMQRASTYVHELHVITTAIHKWRNYLLSHQFIILIDHRSLKDLMFRLTHHPIITQLRLHGSTPSSSSRKSCFLGNDKTCQQLKRITRHPTDRLQPLPMPLGIWEDLSLDFIIHLPRSQGFTTIMVMVDFFQKGAFWKELFKLSGTSLRMSTAYHPQMDDQTEHQFLALPKWSYYTSLHSSTRITPYEATFGKPLPSIPQCIMGTSKNKAVDSLLTTREAIHSSLKHRLLKAQETVKKHANAKHQDDKFAVGQWVYVKLRPYCLGSVTGVAHHKFAKCFYGPFEITECIGKVEYHL

SEQ ID NO: 144731 - protein, 300 aa, Glycine max
  Coding DNA Sequence Number=SeqID_27953
MKELHHLFLDFELLEIRVPIETGVHWFNYGSKVDMVDDLARRGAIELACGRYGRICWGGSGLEKSRDLRHRRRVPLGGPSGPWRDTVNMWPWRSKGVVRQSWRQSKTELLPTMTHKDEVFVVGRSVAGFVGFKGVDSGVVLGSSGSSVNKMGFGCVVRSLVRAVTWGREIGCNAWTSRRMSDEKPKIKKLRRNVGGRPMIWFVRRSNSMRVVVERWGNPRFRSLKKTALGCDEPIAEHPLESSELVKAIHYGIDLVGQVGVSIGKGIMVNGEVEPIDTSKGEGSLISRTRQPPLYTNKLS

SEQ ID NO: 144732 - protein, 35 aa, Glycine max
  Coding DNA Sequence Number=SeqID_27954
MGRRETICDGSARPGEALKGLSLAYDESLRPEPGL

SEQ ID NO: 144733 - protein, 95 aa, Glycine max
  Coding DNA Sequence Number=SeqID_27955
MFPKRFRDPKTVLGALWLYNNNSSLGWGKLKPQLKEHEEALKEFIAKGKMIGTTNSPKGKAESDKENFDEEAQKLWLRMKNELKTELMENGFDVE

SEQ ID NO: 144734 - protein, 297 aa, Glycine max
  Coding DNA Sequence Number=SeqID_27956
  Subcellular localization annotation: CTP_CleavageSite=60; ConfidenceScore=5.51e-01
MTSKTDGFTTCHRHPSTPVTGFCASCLRERLAGIDSSSRRLRRNSAAPSPFSGRTADAPSSSAAPEPRRRSCEVGLPPLGGLLSDPFNVADKNKKPPNRTAEICSGPAGVGTGENEGGNAVRVSGDDDGEGKTMKEFIDLELRDKKNTGRDFRDIAASFRDAASVFSKGLMKWRRKENPKRNRNNDGASAGVGSVEKLGLRTLHETQSEVGEYGFALGRRSCDTDLRLSVDDSRFSFEAPRASWDGYLIGKAFPRVSPMVCVGDRVLLEEEGRREFWRMIGIGGEGVSIGRIRVRSR

SEQ ID NO: 144735 - protein, 340 aa, Glycine max
  Coding DNA Sequence Number=SeqID_27957
  Gene Ontology: Mol. function=transporter activity; Cellular component= integral to membrane; Biological process=oligopeptide transport
  Homolog annotation: Hit_ID=Q9LFB8; Match level="QueryCoverage=100%, HitCoverage=60%, E-value=1e-129, Identity=66%"; Hit description =Oligopeptide transporter-like protein
  Pfam annotation: Domain name=PTR2; Domain location=1-340; Score =332.4; E_value=7.8e-97; Accession=PF00854.12; Description=POT family
MTLLTLSASVPGIKPTCHGHGDENCHATTLESAVCFLALYLIALGTGGIKPCVSSYGADQFDDTDPAEKEHKSSFFNWFYFSINIGALIASSLLVWIQDNVGWGWGFGIPAVAMAIAVVSFFSGTRLYRNQKPGGSALTRICQVVVASIRKYKVETAETESAIKGSRKLDHTDELRFFDKATVLARSDKVKESTNPWRLCTVTQVEELKSILRLLPVWATGIIFSTVYGQMSTLFVLQGQTMDTRVGNSTFKIPPASLSIFDTLSVIFWVPVYDRIIVPIARKFTGYKNGLTQLQRMGIGLFISIFSMVAAAILELIRLRMVRRHDYYQLEEIPMTIFWQ

SEQ ID NO: 144736 - protein, 79 aa, Glycine max
  Coding DNA Sequence Number=SeqID_27958
MTSQTFDYGQNLDITVFQETRFGRAVVSNSLQATTMSVDLKYKSSKEFIKNILDCKSRVISKRACKVFVFLELHYLENL

SEQ ID NO: 144737 - protein, 262 aa, Glycine max
  Coding DNA Sequence Number=SeqID_27959
  Gene Ontology: Mol. function=AMP deaminase activity; Cellular component=integral to membrane; Biological process=purine ribonucleoside monophosphate biosynthetic process
  Homolog annotation: Hit_ID=Q1SKM8; Match level="QueryCoverage=99%, HitCoverage=45%, E-value=7e-59, Identity=65%"; Hit description =Adenosine/AMP deaminase active site
  Pfam annotation: Domain name=A_deaminase; Domain location=69-262; Score=47.7; E_value=1e-11; Accession=PF00962.12; Description =AdenosineAMP deaminase
TEELFPVASSTRFFTDMHYILKVMSIGNVRTSCYHRLRFLEEKFRLHLLLNADREFLAQKGAPHRDFYNIRKVDTHIHHSACMNQKHLVRFIKSKLRKESDEVVIFRDGKYMTLKEVFESLDLTGHNSLKPPKFTGRFLAEVTKEVLTDLEASKYQVVGFDLVDDESKPERRPTKHMPTPAEWTNEFNPAYSYYLYYCYANLYTLNKLRESKGMTTIKLRPHCGEAGDSDHLAAAFLLCHNISHGINLRKTPVLQYLYYLAQ

SEQ ID NO: 144738 - protein, 267 aa, Glycine max
  Coding DNA Sequence Number=SeqID_27960
  Homolog annotation: Hit_ID=Q8LBT7; Match level="QueryCoverage=33%, HitCoverage=19%, E-value=3e-21, Identity=64%"; Hit description=Rev interacting protein mis3-like
  Subcellular localization annotation: CTP_CleavageSite=22; ConfidenceScore=5.05e-01
MSSSRFPMLIGEPRRSSTLDLSSSAFSSYSFNLSCIKILQIRAWMLTNTWLQIESILCSVFRRISPLTLTASLNPNRVLFCFGTKSRGHSPSSGGCAIAPAPSFIEHIANTIQYITHGTMPKIATLGWPLANFGHRLVTVANSQTTLTGTKKTAKNTTTPALEIPTGCYILHVQGNTVAAMGSFKGLKQVRRIVEECMLNKLPLWCRFWPKKICHFFSHCQVLMMKKELEKDPALAQENWDRFLPKFKKYAFYLFDKLYILLFQNSH

SEQ ID NO: 144739 - protein, 148 aa, Glycine max
  Coding DNA Sequence Number=SeqID_27961
ISCQYNIRIVYGESVQVLCSYKRIGSVGRIMTPRSPGRTTFESAEDSDEEEIQLADDNRIPFSNTYGLDSNVCNLPAVPFRVEDANNQMYGEASKEVKAGADMNGHGITDSTPVHVAGDDIVFANNVLPTRNTAHGTFTLLSQSLLLF

SEQ ID NO: 144740 - protein, 54 aa, Glycine max
  Coding DNA Sequence Number=SeqID_27962
MAQWTKTEWQQYVSKSDTESKGYIPESKRERENAKFVIVTSIFQKPMLRMPIYL

SEQ ID NO: 144741 - protein, 91 aa, Glycine max
  Coding DNA Sequence Number=SeqID_27963
  Homolog annotation: Hit_ID=Q1SMF0; Match level="QueryCoverage=50%, HitCoverage=8%, E-value=2e-09, Identity=63%"; Hit description =Tetratricopeptide-like helical
MTREAQLVNLLEQPMQVEHVKHVDQVQDENVNPVQVTPTISSKGGLYLLVLYVLSMKNTMLNAFNNFTASGYVQKMSCTTSSIQNVSLAYS

SEQ ID NO: 144742 - protein, 105 aa, Glycine max
  Coding DNA Sequence Number=SeqID_27964
MIILEAKRVSRMRFQKGCSRTVFWLPKKVFQNGLWKTHSKRNKCTLEQAFRNDLLAYGKGGLERPFQKQQLEKERHFCARSFGIESWKNTLVGEEEKNSKVDALQ

SEQ ID NO: 144743 - protein, 129 aa, Glycine max
  Coding DNA Sequence Number=SeqID_27965
MEYLPQGNFPKWQATVARGGHRWSRVVEKKVLGFGWAFGEEKSEKIMFFTLKNVFIICRSRLVSLSRSAGVHFSCLARQFVLSETPFALSATILAQRNSLSGWNCAYRTNSRLAQFPLRLELRLARFSC

SEQ ID NO: 144744 - protein, 590 aa, Glycine max
  Coding DNA Sequence Number=SeqID_27966
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=86%, HitCoverage=35%, E-value=2e-72, Identity=31%"; Hit description=Chromo
  Pfam annotation: Domain name=RVP_2; Domain location=354-478; Score= -42.5; E_value=0.002; Accession=PF08284.2; Description=Retroviral aspartyl protease
  Pfam module annotation: Pfam domain module=RVP_2::Retrotrans_gag; Domain location=354-478::110-200
MLSLPSCLTLRRIRDRLEDALLRLTNQDMYLGESVHALTLQIKELLQRTNPSPHSTPTPIPLSLPPSNPASPHRMKLDMPRFDDTEPQGWIFKINQFFEYHGTPKQDKLIVASFYMEGRTLAWYQWMNANGHFTSWSSFLQVLRARFAPMSYKDPTGALFKLTQKGTVAQYLAEFEDLATHVVGISPPLLLSCFISGLSPETRREVQPHQPLSMVQAAGFGRLQEEKVLNQRPPQHPRPPTPNPFPSHSRTNPQIAAFPLPPLLNPPPRTTPTPTPTLKRLSPEEIALRREKGLCFNCEEKYHRGHKCSSRFFVLISDELDPTPSHIPIPDPPKNPPPDLPDSSDLYPTQISLNSLAGHIASETLCLFGHLTGHPMIILVDGGSTHNFIQHQLVTELSLSYRKMNPLQVLVGNGQYLTCNCVCADIPIEMQDLTFTINLYVLPILGTNVVLGVQWLITLGPVLTDYANLSMQFFYDGRLGPSLYFHIMVIPEDTTLDSIADLPADICTLLIKFGALFCPLHAMPLAKDTNHHIHLLPQATPVNVRPYRYPYFQKKEIEAQVTCMLQKGLIQPSTSPFSSPILLVKKHDWS

SEQ ID NO: 144745 - protein, 136 aa, Glycine max
  Coding DNA Sequence Number=SeqID_27967
  Gene Ontology: Mol. function=RNA-directed DNA polymerase activity; Cellular component=chromatin; Biological process=chromatin assembly or disassembly
MTSKECAQCAPAIGIKHQQLDYGTQNDTGSCSCIPSNEPSVHFDSEWSLEVGQGEDRSCGQSVFEMVKSCLCLRRPLEGVKHCCLDQRICNHGITLYKASVEPNQAQEASQSSSGQRHRPLGYGGNLGSNRFNPTG

SEQ ID NO: 144746 - protein, 126 aa, Glycine max
  Coding DNA Sequence Number=SeqID_27968
MEQAILTLDRTIGKMEYKSDLEQVQNDKNSIIDNDMVRSFHLKNSSFIDLRELEHTRKLAVELELTIFCFLVEDLSEELLSGCNCGHYQKNGCWNDKIYLRGTHNFFHLLTPFKKGILDSTWEHST

SEQ ID NO: 144747 - protein, 108 aa, Glycine max
  Coding DNA Sequence Number=SeqID_27969
  Subcellular localization annotation: CTP_CleavageSite=54; ConfidenceScore=5.21e-01
MGLFCNYLLYRSLFLLQRAYPGGSGGLSGTTTSGGLPGATTSAQIKRRKRGFIRKKEVSGWPPLVVAPGRPPLVVVLGRPPLPPPVPPPLSPSHVMPRVSFSWNTLLG

SEQ ID NO: 144748 - protein, 85 aa, Glycine max
  Coding DNA Sequence Number=SeqID_27970
MEWVLTLKIHFCEDPALERERVRFSSVAQWILYKNPQDPKSSLTDLGENQQEKDAKEEKYLNERMHAIHRRIVERNARERKREGR

SEQ ID NO: 144749 - protein, 176 aa, Glycine max
  Coding DNA Sequence Number=SeqID_27971
  Gene Ontology: Mol. function=sequence-specific DNA binding; Cellular component=nucleus; Biological process=regulation of transcription, DNA-dependent
  Homolog annotation: Hit_ID=Q93XA4; Match level="QueryCoverage=99%, HitCoverage=55%, E-value=5e-64, Identity=70%"; Hit description =Homeodomain leucine zipper protein HDZ2
  Pfam annotation: Domain name=HALZ; Domain location=136-176; Score =50.3; E_value=6.7e-12; Accession=PF02183.8; Description=Homeobox associated leucine zipper
  Pfam annotation: Domain name=Homeobox; Domain location=81-135; Score =66.8; E_value=6.9e-17; Accession=PF00046.19; Description=Homeobox domain
  Pfam module annotation: Pfam domain module=HALZ::Homeobox; Domain location=136-176::81-135
MAGEKLHEGSSMTLLLQKERLTCSPELIRSFWVQNSESSFQGSKSLANVVNVTQRPFFQGLEKEENGEDEDFGVCLNQPGKKRRLTSKQVQFLESNFEVENKLEPERKVQLAKELGMQPRQVAIWFQNRRARFKTKQLEKDYGVLKASYDVLKRDYDNLLQESDKLKEEVTIIRHK

SEQ ID NO: 144750 - protein, 220 aa, Glycine max
  Coding DNA Sequence Number=SeqID_27972
  Gene Ontology: Mol. function=phosphoenolpyruvate carboxykinase (ATP) activity; Biological process=gluconeogenesis
  Homolog annotation: Hit_ID=Q94LX9; Match level="QueryCoverage=96%, HitCoverage=20%, E-value=3e-16, Identity=59%"; Hit description =Phosphoenolpyruvate carboxykinase
MPTSDNAGNGNGLAKIQQLGDNEEGRPTVKAQTIDELHSLQKKKSAPSTPKGSLPTSASVFTEEERNKQQLESIRFPKSRSRTCDSYFTPDDPLLQEISFKFAKRRSRCRHRGTCRTVPTNQGSNSRCPSRGRGARWHEGSESCLASLTKCCGVGVVIASLASLTRESGPKVVKGDPAARKYEASRVEHVPHQILTPTIAVSDSALKFTHVLYNLSPAEN

SEQ ID NO: 144751 - protein, 46 aa, Glycine max
  Coding DNA Sequence Number=SeqID_27973
MELKEGAMEDLGGGREVSRWWVPLWGARWKRRVSSVEDDSLFIFYY

SEQ ID NO: 144752 - protein, 175 aa, Glycine max
  Coding DNA Sequence Number=SeqID_27974
  Gene Ontology: Mol. function=phosphoenolpyruvate carboxykinase (ATP) activity; Cellular component=cytosol; Biological process =gluconeogenesis
  Homolog annotation: Hit_ID=Q9T074; Match level="QueryCoverage=99%, HitCoverage=26%, E-value=4e-92, Identity=91%"; Hit description =Phosphoenolpyruvate carboxykinase [ATP]
  Pfam annotation: Domain name=PEPCK_ATP; Domain location=1-175; Score=- 44.0; E_value=4.7e-18; Accession=PF01293.11; Description =Phosphoenolpyruvate carboxykinase
LYEQAIKYEKGSFITSTGALATLSGAKTGRCPRDKRVVKDEVTENELWWGKGSPNIEMDEHSFMVNRERAVDYLNSLDKVFVNDQFLNWDPENKIKVRIVSARAYHSLFMHNMCIRPTTEELENFGTPDFTIYNAGQFPCNRYTHYMTSSTSIDLSLARKEMVILGTQYAGEMKK

SEQ ID NO: 144753 - protein, 71 aa, Glycine max
  Coding DNA Sequence Number=SeqID_27975
MLERMLQPYEISIDLKEHSNPVTPKAYTPKSPSGPLRPDSDTAHELYNTHDLYTRVLNTFNTMALRFNTGS

SEQ ID NO: 144754 - protein, 101 aa, Glycine max
  Coding DNA Sequence Number=SeqID_27976
  Gene Ontology: Mol. function=integrase activity; Cellular component =chromatin; Biological process=chromatin assembly or disassembly
MGCYNNHRLPSKIKEGDWVYLKIRPHRQASMPTRLNPKLSARYYGPYRVVKKVGAVTFQLQLPGTARIHPVFHVSLLKLAVGEHQIEAELPKELQDEEQGI

SEQ ID NO: 144755 - protein, 155 aa, Glycine max
  Coding DNA Sequence Number=SeqID_27977
  Gene Ontology: Mol. function=RNA-directed DNA polymerase activity; Cellular component=chromatin; Biological process=chromatin assembly or disassembly
  Pfam annotation: Domain name=rve; Domain location=43-155; Score=-5.9; E_value=0.019; Accession=PF00665.16; Description=Integrase core domain
MDSNSHGKYTLENGRLYFKGKLVLPTNSSWIPKLFKEFHSSLAGGHSGEDISLDFIVGLPKSKGHDAILVVVDRLSKYGHFLLLKHPFTARSVADIFTKEVIRLHGIPSSIMNIAYHSQSDGQIEVLNITVETYLRCFCAEQPKSWPEFIPWAEY

SEQ ID NO: 144756 - protein, 199 aa, Glycine max
  Coding DNA Sequence Number=SeqID_27978
  Gene Ontology: Mol. function=phosphoenolpyruvate carboxykinase (ATP) activity; Cellular component=cytosol; Biological process =gluconeogenesis
  Homolog annotation: Hit_ID=Q94LX9; Match level="QueryCoverage=96%, HitCoverage=32%, E-value=3e-90, Identity=75%"; Hit description =Phosphoenolpyruvate carboxykinase
  Pfam annotation: Domain name=PEPCK_ATP; Domain location=1-146; Score=- 92.0; E_value=1.2e-15; Accession=PF01293.11; Description =Phosphoenolpyruvate carboxykinase
NTRAAYPIDYIPNVKLPCVGPHPKNVILLACDAFGVLPPVAGTEEGIKEPQATFSACFGAAFIMLHPTKYAAMLAEKMQNHGATGWLVNTGWSGGSYGCGSRIKLSYTRKIIDAIHSGSLLDVEYKKTEIFGLEIPTEVEGVPSEILEPENTWSDKQAYKETLLKLAGLFKNNFETFTYGENNQVTKEILAAGPIIHDA

SEQ ID NO: 144757 - protein, 564 aa, Glycine max
  Coding DNA Sequence Number=SeqID_27979
  Gene Ontology: Mol. function=protein kinase activity; Cellular component=integral to membrane; Biological process=protein amino acid phosphorylation
  Homolog annotation: Hit_ID=Q93Y06; Match level="QueryCoverage=98%, HitCoverage=87%, E-value=1e-163, Identity=55%"; Hit description =Receptor protein kinase-like protein
  Pfam annotation: Domain name=LRR_1; Domain location=110-131; Score =14.8; E_value=0.32; Accession=PF00560.23; Description=Leucine Rich Repeat
  Pfam annotation: Domain name=LRR_1; Domain location=17-38; Score =15.4; E_value=0.21; Accession=PF00560.23; Description=Leucine Rich Repeat
  Pfam annotation: Domain name=LRR_1; Domain location=40-62; Score =16.7; E_value=0.083; Accession=PF00560.23; Description=Leucine Rich Repeat
  Pfam annotation: Domain name=LRR_1; Domain location=64-86; Score =14.5; E_value=0.39; Accession=PF00560.23; Description=Leucine Rich Repeat
  Pfam annotation: Domain name=LRR_1; Domain location=88-109; Score =8.3; E_value=7.9; Accession=PF00560.23; Description=Leucine Rich Repeat
  Pfam annotation: Domain name=Pkinase; Domain location=289-546; Score =71.1; E_value=3.6e-18; Accession=PF00069.15; Description=Protein kinase domain
  Pfam annotation: Domain name=Pkinase_Tyr; Domain location=288-546; Score=15.9; E_value=1.9e-13; Accession=PF07714.7; Description =Protein tyrosine kinase
  Pfam module annotation: Pfam domain module=LRR_1::LRR_1::LRR_1::LRR _1::LRR_1::Pkinase::Pkinase_Tyr; Domain location=110-131::17-38::40 -62::64-86::88-109::289-546::288-546
  Subcellular localization annotation: CTP_CleavageSite=71; ConfidenceScore=5.19e-01
MGLRVPFPPHSLTSLDQLRVLSLRNNSLFGPIPDLSPLVNLKSLFLDHNNFSGSFPPSLIFLHRLLTLSLSHNRLSGPLPVNLTLLDRLIALRLNSNHFSGTLPFFNQTTLKVLDLSYNNLSGPVPVTPTLAKFNATTSFSGNPGLCGEIVHKECDPRSHFFGPATSSSTTPLSQSEQSQGIVVVPSSTTTTKHDKKTGLVVGFVVAVVLVAAFTLTMVSLVRKKQNGKAFRAKGVVLESPEVEGGGGVVVVEGEREVKMRKMEEAHRSGKLVFCCGEVQSYTLEMLMRASAELLGRGSVGTTYKAVMDSRLIVTVKRLDGKSAAAGSDGEGFERHMEVVGRLRHPNLVPLRAYFQAKGERLVIYDYQPNGSLFNLVHGSRSARAKPLHWTSCLKIAEDVAHGLAYIHQVSSLIHGNLKSSNVLLGMDFEACITDYCLALFADSSFSEDPDSAAYKAPEARNSSRRATAKSDVYAFGVLLIELLTGKHPSQHPFLAPADLQDWVRAMRDDDGSEDNRLEMLTEVASICSATSPEQRPAMWQVLKMIQGIKDSVTMEDTALTGLS

SEQ ID NO: 144758 - protein, 356 aa, Glycine max
  Coding DNA Sequence Number=SeqID_27980
MDRDEARFTALESLVAALKTTTSELKVMTIELFAQDDGDAHGKERQTFNDAKNAFTEHNSGLEDEESATEPEPSSTSEDEESDATCPTECESEIGLYQHGRKCLALVPVLEAKDEAEKLEFDVLVAQVSGTKEVQLKGYFLAGLRKEIREKFHPYKPKDLSSAMELAANFKEAEKEGNPEVELCSRGFHFQPKGGTWIHNVGGSATNTFHNNNRQNQTLTGEACSSANDEWINIEGEITRMEGELEKTFYNIGETKQLGLKVTPTQTYGVRLGDGNKKNAQGCCEQMEVQLGQMTMTEKFFLFDLGGVDAMLGVAWMEKLGDVKVTIPDKFPIPVIKELLDELKGAQYFSKIDLKE

SEQ ID NO: 144759 - protein, 64 aa, Glycine max
  Coding DNA Sequence Number=SeqID_27981
MTIMMTKVVAVDDSGGGGDHNHCGGYIDGHGNGNDNNNHGDGCNDGHDGVVLIVVATIIIMMVS

SEQ ID NO: 144760 - protein, 126 aa, Glycine max
  Coding DNA Sequence Number=SeqID_27982
MVVGHTPQTIGVNSKYNCSIWLKDCRMCSGVLNSRPKCLNQLHYPMSPITQKTNRKNHNHFTSSGISWKEDQQTPRNNSKKLQCGIDGFPVTYRKDNEHIGWSIHSAEFFNPINQNFTKISLHAFH

SEQ ID NO: 144761 - protein, 373 aa, Glycine max
  Coding DNA Sequence Number=SeqID_27983
  Gene Ontology: Mol. function=binding; Cellular component=nucleus; Biological process=protein kinase C activation
  Homolog annotation: Hit_ID=Q9FND7; Match level="QueryCoverage=99%, HitCoverage=60%, E-value=1e-135, Identity=61%"; Hit description =Selenium-binding protein-like
  Pfam annotation: Domain name=PPR; Domain location=113-147; Score=1.3; E_value=5.2; Accession=PF01535.11; Description=PPR repeat
  Pfam annotation: Domain name=PPR; Domain location=210-244; Score =50.0; E_value=7.7e-12; Accession=PF01535.11; Description=PPR repeat
  Pfam annotation: Domain name=PPR; Domain location=311-345; Score =40.8; E_value=4.7e-09; Accession=PF01535.11; Description=PPR repeat
  Pfam module annotation: Pfam domain module=PPR::PPR::PPR; Domain location=113-147::210-244::311-345
MKSVKRIAKHPTISLLNSCTTLKEMKQIHAQLVVKGILNNPHFHGQFVATIALHNTTNLDYANKLLNHNNNPTLFTLNSMIRAYSKSSTPSKSFHFYANILHSNNNNLSPDNYTFTFLVRTCAQLQAHVTGLCVHGAVIKHGFELDPHVQTGLVFMYAELGCLSSCHNVFDGAVEPDLVTQTAMLNACAKCGDIDFARKMFDEMPERDHVTWNAMIAGYAQCGRSREALDVFHLMQMEGVKLNEVSMVLVLSACTHLQVLDHGRWVHAYVERYKVRMTVTLGTALVDMYAKCGNVDRAMQVFWGMKERNVYTWSSAIGGLAMNGFGEESLDLFNDMKREGVQPNGITFISVLKGCSVVGLVEEGRKHFDSMRN

SEQ ID NO: 144762 - protein, 255 aa, Glycine max
  Coding DNA Sequence Number=SeqID_27984
  Homolog annotation: Hit_ID=Q9FND7; Match level="QueryCoverage=31%, HitCoverage=13%, E-value=6e-26, Identity=69%"; Hit description =Selenium-binding protein-like
LPGCSVIEVDGEVHEFIVGDKSHPRYDEIEMKLEEISKCLRLSGYVANTNPVLFDIEEEEKEDALSKHSEKVAIAFGLISLKAIDLSRCMDMVHNVGINEVWTLLYTIKASPDSWLSHAHTVVYDEDANAATMAHYFANSGEGKEIGLSVVAKIQPSNGKLDITVEGPEQDPALALLCMFEEVNRTEVWKPSMCPHCDRDIGTRHHVVTISRKIKSRRFKGNSYRSTFLQPDSEDSNSDEDSDSAPIIPTSLGIQ

SEQ ID NO: 144763 - protein, 105 aa, Glycine max
  Coding DNA Sequence Number=SeqID_27985
MLFMLFCKLVPLTGAEEIFHGTPRKISSAPVNGRRTAEEPSSVESHERRFIRGTPRKNLLPLSPTKEPSFVEMTNKAKGKGKEVTGKGSAGKRKGAFDDDKIGGG

SEQ ID NO: 144764 - protein, 244 aa, Glycine max
  Coding DNA Sequence Number=SeqID_27986
MSSLMLRMLSMWIIQLTRFMSSLRSQLLMPRERHELKLSSDEMKVQKFGRHVLEIEGIVVATRLSSLIAYSLDTGDRELISAFAKRRCHITFDDVASLLHLPITGAFHTFDALDVDQVADLIVELLEVSTQEAKDETLQTKGASTSLAARHLSQSESYSWGAAALVHIYDNLNDESKKSAMLLATYITLLHCWIYEHFLIVALCVADEDYHERKPCTCRWKSGNALSVSTYLKWLDRLMLDAVS

SEQ ID NO: 144765 - protein, 93 aa, Glycine max
  Coding DNA Sequence Number=SeqID_27987
MEAQTAAVRREEVKNKEEGSTIAHYWYNPYGLLILMHYMDWLCNPISIKEWKRETYGDGGGEDGRQCANGGTNSGGAARRSREQRRGKHNSTL

SEQ ID NO: 144766 - protein, 158 aa, Glycine max
  Coding DNA Sequence Number=SeqID_27988
MASLKKSGCTDNDARLNAYAIWKEDEGTDFDQPNWLEQFTENCSKRTMISAFGAYSSSFNPETTFEDAKADTPSLIVRPMGKKEAKRKSKGKGVGTSTNPVDLTGVKEAMRERNVVNTKLAALREKELENEYYDILMKDTSTMSGTQLKDHKAFCKII

SEQ ID NO: 144767 - protein, 63 aa, Glycine max
  Coding DNA Sequence Number=SeqID_27989
MCRNVKWNPSSSSIPMGVHMETQEMRAMVLRAILNGLKLARQFGYSHTVCETDSKIAIDMISD

SEQ ID NO: 144768 - protein, 58 aa, Glycine max
  Coding DNA Sequence Number=SeqID_27990
MKKKKIASYGSRFDEEMSKIGRFGGLGMEERRKGEGVAQGFLENVIFIEQDAWPSVLV

SEQ ID NO: 144769 - protein, 163 aa, Glycine max
  Coding DNA Sequence Number=SeqID_27991
LENEIRKLGGLLVINYQGIVMAAQLIHDRVEMECLEGAWETLEGNTRCRFRGTIRFTATSLVHPDEPAHTLQRTVEWILPTPTPYRLVEPVQVIEVMSSEEDPEEDPEELPPKPAVDALDFLECDEDPLPEVDSLEDVMSASEADSTEDSGPGEMAISGGSSS

SEQ ID NO: 144770 - protein, 488 aa, Glycine max
  Coding DNA Sequence Number=SeqID_27992
  Gene Ontology: Mol. function=protein serine/threonine kinase activity; Cellular component=cytoplasm; Biological process=protein amino acid phosphorylation
  Homolog annotation: Hit_ID=Q1RWL0; Match level="QueryCoverage=89%, HitCoverage=86%, E-value=1e-170, Identity=69%"; Hit description =Protein kinase
  Pfam annotation: Domain name=Pkinase; Domain location=80-438; Score =206.1; E_value=8.1e-59; Accession=PF00069.15; Description=Protein kinase domain
  Pfam annotation: Domain name=Pkinase_Tyr; Domain location=80-438; Score=-45.3; E_value=1.1e-09; Accession=PF07714.7; Description =Protein tyrosine kinase
  Pfam module annotation: Pfam domain module=Pkinase::Pkinase_Tyr; Domain location=80-438::80-438
  Subcellular localization annotation: CTP_CleavageSite=49; ConfidenceScore=5.69e-01
MSMASTTRDESSDNDSTCSSITLADSTRSWLSTFSFRRSSSSNSSSLPLCAAAPDTTKSASWEAMRRLRLDTGGIGLDNFRLLRRLGSGDIGNVYLCQIQNSMVGRPQSLYYAMKVVDREALAVRKKLQRAEMEKQILAMMDHPFLPTLYAAFDASHYSCFVMDFCPGGDLFSARQRQPGKRFTISSTKFYAAETLVALEYLHMKGIVYRDLKPENVLIREDGHIMLSDFDLCLKCDVVPKLLRSKTSSESSVKTRRSSAPSCVAAPMHSCFSASSKRKKVVTTAIIRENMDVYEDQSQHKGHDYCTSGLGEHDTEIVAEPINARSKSFVGTHEYLAPEVISGNGHGSAVDWWTFGVFLYEMLYGRTPFKGENNEKTLMNILKQPLAFPRVSSVSSSSKEFEEMVKVQDLISKLLVKNPKKRIGCCMGSVEIKRHEFFKGVNWALIRSVRPPEVPAELNKIRSRVSLQKLSKKDKDQPYQITHHFDYF

SEQ ID NO: 144771 - protein, 136 aa, Glycine max
  Coding DNA Sequence Number=SeqID_27993
MERNNEDSGSLGLASWPHYCLPTLVLSTLSRLCLMSRPKRQATKFIPNHTTLHHPPGGSADQCGGPLPPLREAQLLRRHLQQHRPLRPPPPRAHHAHTSSIAKAGTEEAIRKSKISESQFEKGLTLCDGDLGSMKI

SEQ ID NO: 144772 - protein, 68 aa, Glycine max
  Coding DNA Sequence Number=SeqID_27994
  Gene Ontology: Mol. function=hydrolase activity, hydrolyzing O -glycosyl compounds; Biological process=carbohydrate metabolic process
  Homolog annotation: Hit_ID=Q1SKR1; Match level="QueryCoverage=79%, HitCoverage=11%, E-value=1e-18, Identity=72%"; Hit description =Proteinase inhibitor I4, serpin
MVVITTTLGEFGWILMEILFKLMEGAFYMMKDKEHTIGMVNIKMGPRTMLTREHLLGLIIKQVYVYKK

SEQ ID NO: 144773 - protein, 77 aa, Glycine max
  Coding DNA Sequence Number=SeqID_27995
MTVSKLRMMQSREPSWKIPLRLKGSSRCGISMENNGGLWWLLVAVGDGESVWDVGNGFGRKEEKEMTFFQGYTKSKG

SEQ ID NO: 144774 - protein, 194 aa, Glycine max
  Coding DNA Sequence Number=SeqID_27996
  Gene Ontology: Mol. function=nucleic acid binding; Cellular component= nucleus; Biological process=DNA integration
MGTSEVSMTHVYHSMVDDGSHIYLVLYEDNKLITSQNLLAIQKLKSLLSSEFEMKDKGAPEKILGIEIKRNQVQKKPFLCQKEYIQKVLNHFGMVSTKPVCTPLIVSIRLFELNTKSGSKKEYMSRVPYASVVGSLMYAMVCARLDLAQEVYVVSRYIGNPRKKHWQACSKKQVHALIGSSYLTSIVGNELNHL

SEQ ID NO: 144775 - protein, 276 aa, Glycine max
  Coding DNA Sequence Number=SeqID_27997
  Homolog annotation: Hit_ID=Q8LF70; Match level="QueryCoverage=37%, HitCoverage=23%, E-value=2e-24, Identity=54%"; Hit description=EDGP
WNISRAEAEASALMEAILWVPELGLNNVTFECDLSSVFNLTVTKVVEPFGVCYPVGDLTETRVGLVVPTINLVMHNEDMFWRVFGGNSMVRVAKGEMDVCCLGFVDGGTRERMPVVIRGHQLKDNLMQFDLDSNKFSFTSTMLLQGTNVRKLSKMTEKLSKFVLNGVGIVSGSMMAHVPALSIGNVRQLVEDLFISSMGSERVGYLDDPNILPCVGNDAYGSFPFPQGDLALPHEAYDSLSNALTIIQQRSPVVKVSPESFAMCGLFLISLVVGTR

SEQ ID NO: 144776 - protein, 163 aa, Glycine max
  Coding DNA Sequence Number=SeqID_27998
EQEPRICRPPHNLCHTDPGVMWHAETNYGHSASFVIQRRWARQRQIVVILRLLSSRGGGPGDIHVRWHAETNIVFCAFCHPEAAGPMTCGAKLWSSKNAQRQIMVILRPLSFRDSESRETNYGHSAPCHPGSIVSEDTQRQIMVILHLVSTKRNELGSIRMML

SEQ ID NO: 144777 - protein, 87 aa, Glycine max
  Coding DNA Sequence Number=SeqID_27999
MLLAGKESLLMKSPITINEISDVSISFLNDHLEETLGSTKIEEIHSKCINLAQCGAKKSLAHGISVGNQKEKTILGRGFLSFFLFIW

SEQ ID NO: 144778 - protein, 97 aa, Glycine max
  Coding DNA Sequence Number=SeqID_28000
  Subcellular localization annotation: CTP_CleavageSite=72; ConfidenceScore=5.16e-01
MGAEDDVSLCVLSGFSSYRQQKRMFIRITTREFPPVSVTQMSTAKKNVYTDNHSGISARQRDSNVSMTDLVSAEDDVNLRVSTGLSAAIDEGRRRQR

SEQ ID NO: 144779 - protein, 240 aa, Glycine max
  Coding DNA Sequence Number=SeqID_28001
  Subcellular localization annotation: CTP_CleavageSite=62; ConfidenceScore=5.09e-01
MGGYVGAKASLLSTAPLSVTMTQELVARGDTLRLSAPRHLVTPSVIDEQRPMWSSAPFPKMSAFSDGDFSSLTSYQDYVEAAGPMIRGDTLRLSAPFCHPEAAGPMTSRDQVWSFCTLVSSRGGGPDDTRRYLTVIRTLLSSRGGGPDDKQRPKTKFGHSAPLYHPEAAGPMIRGDTLRLSAPFCHPEAAGPMTSRDQVWSFCTLVSSRGGGPDDTRRYLTVIRTLLSSRGGGPDDKQRP

SEQ ID NO: 144780 - protein, 114 aa, Glycine max
  Coding DNA Sequence Number=SeqID_28002
GGACHPARPGELGCFLQKQPPSGGTSWKAQNLTDYVIIPFLPSGKLRNFMDCALTLPFNFWHVTEFHGLCYNAFLLASGMSQNFTNFLTMGAKFLEVVKRGSHPNNGWSPDKIR

SEQ ID NO: 144781 - protein, 212 aa, Glycine max
  Coding DNA Sequence Number=SeqID_28003
MLGLQHWPRIAPAAALYNVLMSATLSLPIAAARLSGGTVDGIVANPKKKELLNFLAMGILPAILFLLVSIPARGVFTRVAASMLPEEDDPIVPFDRRFGGKVKSAMVGGSGELSLLDAWTSFDWAARIHYIKIILKALVIEVALGVVGGLLVMGELELKRVIPRLSKNNEFYMWAGDFQRSEFDITMKQCAVDRSAVISGPIGLVDKPTDRV

SEQ ID NO: 144782 - protein, 182 aa, Glycine max
  Coding DNA Sequence Number=SeqID_28004
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=8e-24, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LRALTFRGLHALTFRGLHVLAFRGLHALAIRGLHVLAFTGLHTLAFRGLHVLAFRELHVLPFKGLHVLTFIGLHILPFRGLHLLAFRGLPVLTFRGLHTLHFIGLHIFPFRELHVLAIRGLHVPAFRELYALALVGLHALTFRGLHVLTFRGLHALAFIGLHALAFIGLHICSFRELKVLRP

SEQ ID NO: 144783 - protein, 95 aa, Glycine max
  Coding DNA Sequence Number=SeqID_28005
MAFLHSLSAVELGRCDRIVQHARRPPGGIMDLVCGHQCRGYLAIVSGTLRLVARSDIRSQYLQGYAPGWIERSDGGGLYHAIDLCMFTVVDRYLS

SEQ ID NO: 144784 - protein, 250 aa, Glycine max
  Coding DNA Sequence Number=SeqID_28006
  Gene Ontology: Mol. function=nucleic acid binding; Biological process= transport
  Homolog annotation: Hit_ID=Q8H6Q8; Match level="QueryCoverage=96%, HitCoverage=8%, E-value=1e-35, Identity=33%"; Hit description=CTV.20
MGIDAAVLMCLRDIRHNQFEDSLIGTVETSLGQGPIYFNCYPNKIVSLMDRNILDSLFLNIHFHGLDMKEGSIPAALIYRIQYKVMNTCASRVLLKPQRGETTLFITDMTKANVSLPRKIKWDEVTLPERWVMDKATPSIPRPAPTIEHIKQDNSGKVEITFNRRNSFSSRIEASRSEYESARRSFSVRTRSIPVGLTRSESHNQFPTVNLQGLDTTSSIPRTTYNQEQEDDQKSIQSPTYSSMEPYDVI

SEQ ID NO: 144785 - protein, 323 aa, Glycine max
  Coding DNA Sequence Number=SeqID_28007
  Gene Ontology: Mol. function=1,3-propanediol dehydrogenase activity; Cellular component=mitochondrion; Biological process=metabolic process
  Homolog annotation: Hit_ID=Q222C5; Match level="QueryCoverage=23%, HitCoverage=23%, E-value=4e-21, Identity=67%"; Hit description =Transcriptional regulator, LysR family
MELSLQQHLHRKATGFAQESIATLILSGKYVGFLPDHYAAFFVAQNLMRAIKPALFRYHCEYSSVLRRSPVPQRVSFDAKRLFDHPLPLRRRIVDPGILAVGFLQRHRQFLAGNRQIVPPERRDGVAGDEIGQVALRAALPVRIQARGQLGHQRALLRLFAAFQQGEERQQQTAADLAVVVVAQRANLAGDAVDHPQPGGAQRQPPEVGSLHNRFARRIAAVERRPGRKEVADAAQRHVARHGAGGFRQIGLEQVGEGVDGAVGQHLVRRARQQLRIENGGVRHEVIVAQRGLHFADLSVGDHRVLRHLAAGAGGGGNGDQRQ

SEQ ID NO: 144786 - protein, 279 aa, Glycine max
  Coding DNA Sequence Number=SeqID_28008
  Gene Ontology: Mol. function=oxidoreductase activity; Cellular component=glycerol-3-phosphate dehydrogenase complex; Biological process=electron transport
  Homolog annotation: Hit_ID=Q7MZJ8; Match level="QueryCoverage=77%, HitCoverage=50%, E-value=1e-92, Identity=78%"; Hit description =Similar to probable oxidoreductase
HLVGAHRAHGGAHRDARPILHVEHAAVLEDFHPVAAQRLGLAQQQVERMHVAAAHVFQRAGVGVGAHHLLHLRPGVELNLLLRRYRPELLQPAAQGLLLARIAAEIAVAEAEVGVDVIFLDAFADDAGAEVADFEDGFQPGRANVALDLLQIVADAGHHLATVAPGAAVTQIAAFENGDVGDALLRQLQRSVDAGEAAADDHHVDVQILFQRREAQIAEQFGLRADVQLAVDVLAVIFYRAEADEQPVGNLLRTAAGEDKIDDLALARRQQIARLRAIV

SEQ ID NO: 144787 - protein, 161 aa, Glycine max
  Coding DNA Sequence Number=SeqID_28009
  Pfam annotation: Domain name=zf-CCHC; Domain location=35-52; Score =22.8; E_value=0.00017; Accession=PF00098.13; Description=Zinc knuckle
QGILGAVPSNPKDDKGKTIEKQHPKASMQEKTSSIKCFKCLGRGHITSQCPTKKTMIMWGQDIYSSQDEASTSPSSSESEEAKGEESRVPTHRRRIKVIHDWPTPPTPLIELVRNQVPSWEDAQDRGVEGRSPEYQEPRDLRSNPFQGGGDDAILPSKGIG

SEQ ID NO: 144788 - protein, 82 aa, Glycine max
  Coding DNA Sequence Number=SeqID_28010
  Gene Ontology: Mol. function=protein phosphatase type 2A regulator activity; Cellular component=protein phosphatase type 2A complex; Biological process=signal transduction
  Homolog annotation: Hit_ID=Q6Z8B7; Match level="QueryCoverage=97%, HitCoverage=14%, E-value=2e-11, Identity=53%"; Hit description =Serine/threonine protein phosphatase 2A 55 kDa regulatory subunit B beta isoform
MDSCPVATFEVHEYLRPKIVRSNWFLQVSDTNLICGSVVLGIVYPASYDFVSLVDSNLFRVFGCDPGSADATNLEANKNPMS

SEQ ID NO: 144789 - protein, 58 aa, Glycine max
  Coding DNA Sequence Number=SeqID_28011
DGIHQLTLRQREVGVMIAGQDVAEQQHHPHLGQGGHAGAHDPHPPPGSGPGKILTRYA

SEQ ID NO: 144790 - protein, 281 aa, Glycine max
  Coding DNA Sequence Number=SeqID_28012
  Homolog annotation: Hit_ID=Q8H6Q8; Match level="QueryCoverage=89%, HitCoverage=8%, E-value=3e-35, Identity=34%"; Hit description=CTV.20
MASESHDDSKVDLQKQIQKTKQTKTVCNQKEKRMLAQQDPTPQPTNNYISKNKFFNVLQMEPEYWDKNPFKATAKVFPQGFHYRPTALNKTRKFYEFILVDTNSVSIKHFKDSKDPSLNTHSKIQILKVMQPRHYGTNLNQPKKFSAPFDLAGYTYWDYIDAWTNVFWHQNNKFKHPSLIYFKNSIVYHFPNWFLQWWNYFGPIPQIFPEEVQQGFQQFNKLFNSQELRILADLKYGKTENNKQYPPLQRHAFVKWWSQFDTSNTTPGQVKNWFPSHPNPL

SEQ ID NO: 144791 - protein, 64 aa, Glycine max
  Coding DNA Sequence Number=SeqID_28013
  Homolog annotation: Hit_ID=Q5N890; Match level="QueryCoverage=50%, HitCoverage=4%, E-value=7e-09, Identity=93%"; Hit description=C -terminal domain phosphatase-like protein
MLNLRCLAIVFDLDEKLIVANTMKSFEDRIEDLRGFRQRRGRDGHRNYRHEASDGGLQTPFCFA

SEQ ID NO: 144792 - protein, 207 aa, Glycine max
  Coding DNA Sequence Number=SeqID_28014
  Gene Ontology: Mol. function=protein serine/threonine kinase activity; Cellular component=integral to membrane; Biological process=protein amino acid phosphorylation
  Homolog annotation: Hit_ID=Q10P10; Match level="QueryCoverage=76%, HitCoverage=26%, E-value=1e-36, Identity=47%"; Hit description =Protein kinase domain containing protein, expressed
MMLLHPNHRRKKFGEEGENECDQNGEFSFRRGWKKKSTHSIGSDMWSGDLFSRELSSTTSMRGTLCYVAPEYGGCGFLMEKADIYSFGVLILVIVSGRRPLHVLASPMKLEKANLISWCRHLAQAGNILELVDERLKEDYKKEQASLCINLALICLQKIPELRPDIGDIVKILKGEMELPPLPFEFSPSPPSKLYSRSRRKPKGTAE

SEQ ID NO: 144793 - protein, 66 aa, Glycine max
  Coding DNA Sequence Number=SeqID_28015
MGRVVKALDLETISSWTLEPFTQPPSRLFIANNGIGVMAARPGELLLQPKVTLLVQASSARWLLHP

SEQ ID NO: 144794 - protein, 206 aa, Glycine max
  Coding DNA Sequence Number=SeqID_28016
MSEIEEVQEQMKADMDAMKDQMAAMMEAMLSMKKIMESNTAAVATTSAATEVDPTYPSGLNQVNPLVSNIVGQGGKVLGKQTFLPTIWLASQLYTPNVAHTPDENVDNSAPIPIESQQPQSDHAHVSQAIGETHEAPRNHNLADFKPHLRCSIEGQVVGGVPLPNTSGGPQYHPQPQPLNFVVGRVFPAMVEREKFSHIEERLRAI

SEQ ID NO: 144795 - protein, 121 aa, Glycine max
  Coding DNA Sequence Number=SeqID_28017
MAQDRMQLQNMCKKKHELFKEYAQREMITMIVDKLPVFYYEKMVGYTPSSFADLVFAGDKIEVGMKRCKFDHPALMNRKPGANRENKNEGGTYTVTAIPTWPNSPPAQQCQYYWIKWPQNN

SEQ ID NO: 144796 - protein, 192 aa, Glycine max
  Coding DNA Sequence Number=SeqID_28018
  Homolog annotation: Hit_ID=Q1T344; Match level="QueryCoverage=44%, HitCoverage=30%, E-value=4e-13, Identity=43%"; Hit description=RNA polymerase, RBP11-like
MEDLTERSFVSTFIELQVLRWQVVVVVVVGVAVNGEVSNLQIVNPYVTYGLTICKFVRFHYSFMDEDKWMHDSIMFEEVDMNEKNEDEAGVNEEAKKKDLVRTITRSRKCECPFKLRAKLVVGGEGWIMKLMCGSQNHELAKSLVGHPYVGPLTKDENIIITDMTKSMMKPKNILLALKEHTANSYTTIKQV

SEQ ID NO: 144797 - protein, 47 aa, Glycine max
  Coding DNA Sequence Number=SeqID_28019
MARVRGPKLLMLRQPLRKVLIETPQDRLGIEQSSAFRLSRARLRTTT

SEQ ID NO: 144798 - protein, 102 aa, Glycine max
  Coding DNA Sequence Number=SeqID_28020
MADSGDKNFLLYDIHERYGPFSLTLYREKCRNQCFLHNFGLPDKMKLYMTIPCKKNSSKLCGSEFLLYVHQKLAICSVISVIFGAIPCDDRVGGSNNSTEDI

SEQ ID NO: 144799 - protein, 62 aa, Glycine max
  Coding DNA Sequence Number=SeqID_28021
MTKFGLCLSSGPPPLDDKRVRITVRMTKFGLCLSSGPPPPDDTPGADNRKVSPRIIGPAASG

SEQ ID NO: 144800 - protein, 73 aa, Glycine max
  Coding DNA Sequence Number=SeqID_28022
  Homolog annotation: Hit_ID=Q2N2B2; Match level="QueryCoverage=91%, HitCoverage=27%, E-value=5e-09, Identity=40%"; Hit description=RPGR ORF15 isoform
MKPSEGEDVQSSKGQDVQYSEGDDVPPSEGEGVHPSEGEDVKPSEGEDMQPSEGEGVQPSKGEDVQPSEGENV

SEQ ID NO: 144801 - protein, 162 aa, Glycine max
  Coding DNA Sequence Number=SeqID_28023
  Homolog annotation: Hit_ID=Q3KDR9; Match level="QueryCoverage=48%, HitCoverage=50%, E-value=5e-19, Identity=60%"; Hit description =Lipoprotein, putative precursor
MAHVPGQGSDPALPGWPDRVRCLRPVAVPRRCRAQPPAHQGAGGAARRHSAAPCRYRSDPPGVEAADQASIGAVVAAAGRGNDDETQGVRAGPGAGGIAGTVGAGQWRRRRNAAVPSGRSRAGARRSPAGWQHRRAAVAVGQAPDAGGRGRCRRQFALGSGG

SEQ ID NO: 144802 - protein, 168 aa, Glycine max
  Coding DNA Sequence Number=SeqID_28024
  Homolog annotation: Hit_ID=Q3KDR9; Match level="QueryCoverage=82%, HitCoverage=86%, E-value=5e-28, Identity=49%"; Hit description =Lipoprotein, putative precursor
MLGLLLPRQADRFDIGTALRSVFVQHHQHLGAQAVGRGIAAEQPLAVGIEHGQAIREARGHFLVQERAPLRLADGVGLRAVAGTLLLAHAEVQLTAHPAMAGGRPCGIALQFGGGGRGIGAGRLRRKAGAAAGGQQHGEDEAKVFHRYSSGEGGQGEPAAYSATGPAC

SEQ ID NO: 144803 - protein, 216 aa, Glycine max
  Coding DNA Sequence Number=SeqID_28025
MQQPIPGCPSQPLNIHGITLKGKQDENWEQLFTPMIGQWNKQVDFRVDGYPRQEGLLNFNSNYMRITEPVSHGPASEHQFPAQEFHILQSSVETQGIDRRRVVVEAEEYSQQMAERGHGMYYTPPTFSQYPTQMYQYPFKGHHTDISASKHSFGGVAETHLHFSWPTMTPSQQHDAPIPTPNAPLGTQWNVPRAIPDIGDLLGADLHHQFSVEPDQ

SEQ ID NO: 144804 - protein, 172 aa, Glycine max
  Coding DNA Sequence Number=SeqID_28026
  Pfam annotation: Domain name=Transposase_23; Domain location=88-158; Score=-10.8; E_value=0.017; Accession=PF03017.5; Description =TNP1ENSPM transposase
  Subcellular localization annotation: CTP_CleavageSite=34; ConfidenceScore=5.07e-01
FLEEQATQGSFFAHGRQDVLTTAIGRLEHPSRMRAAGVSVTIKRYFGSAPRTSCTSSSMAPEDLEQLTQKIRDKLEESITEKSNDPDTGDSEKYGLYIEENPPHLVALGRLYEGSTTVHNIPLSYDQVKVGVEEFRDADAHIPLPTKEVQLVGQALNTFIAWLTHLVKHLSE

SEQ ID NO: 144805 - protein, 244 aa, Glycine max
  Coding DNA Sequence Number=SeqID_28027
  Homolog annotation: Hit_ID=Q47522; Match level="QueryCoverage=17%, HitCoverage=53%, E-value=6e-19, Identity=100%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGNARVFPEFDTATMLFATTLPLPNLYPGGNPHTVFLVTNTLGMANLSAKFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 144806 - protein, 77 aa, Glycine max
  Coding DNA Sequence Number=SeqID_28028
MSIGFNDETCAISAHQWSKHASTAKRSFGVLSATEESGRASISRLHAKHEISALSVAIVFSQAQRTTGAKLKSTYSR

SEQ ID NO: 144807 - protein, 107 aa, Glycine max
  Coding DNA Sequence Number=SeqID_28029
  Gene Ontology: Mol. function=DNA binding; Biological process=DNA integration
MEPKHIDDAVQDDNWVKEMEEELDQFPKNNVWKLVELLKGKKVVGAKWVFQNKLNENGKVVRNKARALYGLKQDPRAWYKKLSSFLLKNGFERGKVDTTIFCKTYDS

SEQ ID NO: 144808 - protein, 210 aa, Glycine max
  Coding DNA Sequence Number=SeqID_28030
  Gene Ontology: Mol. function=RNA-directed DNA polymerase activity; Biological process=RNA-dependent DNA replication
MGKMNEAPRDHTLANSKPCLNMLLKGEHLYHPQPQPLPFAVGRVLLAMVEREKFNHIEERLMAIEEGGDYAFVDIEELCLVPNMVIPPKFKVPDFDKYKGTNCPKNHLKMYSRKMGAYSKDEKLLMHFFQESLTGAVDLTVAFIRQYEYNSDMAPDRMQLQNLCKKEHESFKEYAQRWRDLAARVAPPMTEKAMITMVVDTLAVFYYEKM

SEQ ID NO: 144809 - protein, 96 aa, Glycine max
  Coding DNA Sequence Number=SeqID_28031
MKDEEKRKEQDDQKAKSILTFGLSSNEFFRTARCKNAKEIWKMLKPLMKAQRISFLQKAVASGGSNLARLGELGGKLLPYFAINRGRSEEERGSAS

SEQ ID NO: 144810 - protein, 214 aa, Glycine max
  Coding DNA Sequence Number=SeqID_28032
  Subcellular localization annotation: CTP_CleavageSite=45; ConfidenceScore=5.17e-01
MISTEGQLSDPNFVRGLSFADVLILANRKVLFDTSFCTRHLGSPRLASSSPGPPNSLGLKKPARLGLREAKERVQPSTLRGFSEKLGRRRRKGLAVNIATMIDFYIVLRSVFFVHHPKLECCHLLVDKLNIPLEGSDEFKTNTEHNIIVLYYVPSTFVDSSSGPRIMLISNSVYISSSIMLISNSVYISSSIMLISNSVYISLEKIFTKISSVA

SEQ ID NO: 144811 - protein, 44 aa, Glycine max
  Coding DNA Sequence Number=SeqID_28033
MAFVPYALRLVKSSSQGPEDDFVSCLCLSVSLRMFDRGDQVLDA

SEQ ID NO: 144812 - protein, 83 aa, Glycine max
  Coding DNA Sequence Number=SeqID_28034
  Gene Ontology: Mol. function=DNA binding; Cellular component=nucleus; Biological process=regulation of transcription, DNA-dependent
  Homolog annotation: Hit_ID=Q6R074; Match level="QueryCoverage=48%, HitCoverage=15%, E-value=3e-13, Identity=78%"; Hit description=MYB transcription factor
  Pfam annotation: Domain name=Myb_DNA-binding; Domain location=17-58; Score=20.2; E_value=0.0075; Accession=PF00249.21; Description=Myb -like DNA-binding domain
MAGHMGRDVIEEQVWRKGPWTAEEDRLLVEYVRLHGEGRWNSVARLATNKNSEYFDILTLTVARSRHHSKEHDFGYGGGGNNR

SEQ ID NO: 144813 - protein, 68 aa, Glycine max
  Coding DNA Sequence Number=SeqID_28035
MEDKDTGSKRDEDESIQSKNGPLKNERRTAKNGKETSTESITETSRKRYESVSAWIFSFLLLLLTNFK

SEQ ID NO: 144814 - protein, 40 aa, Glycine max
  Coding DNA Sequence Number=SeqID_28036
MTTKSMENQLAMLLGVKVLDRALTIGPKVITDSQGTTLST

SEQ ID NO: 144815 - protein, 143 aa, Glycine max
  Coding DNA Sequence Number=SeqID_28037
MQWRFQSQKRCKDKLKLTRNKRRTMVTSKENERSNLGFVLYRNREPSWTIPLRLKGSSQCGVATENNGGLWWLMVAVGDGESAWDVRNDFGRKKGEEMVFFLIYTKAKAENAQVRNGLRHENVAHTPYIFSKIPTVRSWKCVL

SEQ ID NO: 144816 - protein, 266 aa, Glycine max
  Coding DNA Sequence Number=SeqID_28038
MEREMITMIVDTLLVFYYEKMVGYMPSSFAYLVFAGERIEVGLRRGKFDYATSTSTSNRRTRTCGAKKNTNTNPRRNFPERKLVEFTPKPMPYADLLPSLLSNHLVVCVAFKHKVKSLINAVWLAFQEDSPNAGMIHLNGDKGASCLIHLGTSHNVETCPMAEELLQGMMSRGHIEVCSAKKGEEDILVSCPSSTLYVEAAEESLETSFQALGIMSNAYVESPLADKYEPGMGLGQNDDDTASLVEFPENRGVRYRTIHQRQGIPA

SEQ ID NO: 144817 - protein, 165 aa, Glycine max
  Coding DNA Sequence Number=SeqID_28039
MYDLHLYIFKNMHSRSCSLILEPFDTFSRGAVSVNPYPWPTPEQFRATIAWPGGRPNFQAGAGPTEAPGGEDEAEENGDMNPDLGWKFPTLPWDKKERVSSKGEFHHLLGCEKAKIDGSKTFVFKGENEWSCHQHLFEENVRKTKKESADFENKGSGVVYARGMY

SEQ ID NO: 144818 - protein, 33 aa, Glycine max
  Coding DNA Sequence Number=SeqID_28040
MGVGFVADLGVAFVDDRAFLVDRWWVMRRVDIG

SEQ ID NO: 144819 - protein, 284 aa, Glycine max
  Coding DNA Sequence Number=SeqID_28041
  Subcellular localization annotation: CTP_CleavageSite=65; ConfidenceScore=5.27e-01
MQFLQQHDPKIPKLQNSISPSILDQITSHKAQNSSFFSFSFISTDQNFQKLPQMAEPLKKRKGVSTSSAVTGTRSHGAFKAQTTQIPPSISSPALFSSEEQHIRYSSHFSSRSIIDPKFVDLAFFDDEVFDCFQAFQNSGIIQFISMKLPFYPELVRAFYSNLEIQENSLIFELSSDGVPFEGTLDDDWKFDFSISDARRLVCTNLADIIGRFLVRSLAFEYCIMHYLIVHILLPRSSNLAQVSKEDLIIMWVLSTGRQIDWAHLVRYRMHKCSASSKCTGSHK

SEQ ID NO: 144820 - protein, 169 aa, Glycine max
  Coding DNA Sequence Number=SeqID_28042
  Homolog annotation: Hit_ID=Q8VXQ4; Match level="QueryCoverage=31%, HitCoverage=6%, E-value=1e-17, Identity=79%"; Hit description =Putative potassium transporter
MVYMDGDLTCELNSDLKAVVVAPNGSMTAEQPANGRLQQIPAAIIILVLEPSSVDPHTLILIRSLAPSPAPALPPPTPLPPPTVAPAPNTFAEDIGHSETNKEIYGVLSLVFWTLSLVPLVKYVFIVLKANDNGEGSTNAMEQPPTEAVESLSVSDPEIPQSSNPNPTH

SEQ ID NO: 144821 - protein, 174 aa, Glycine max
  Coding DNA Sequence Number=SeqID_28043
  Gene Ontology: Mol. function=DNA binding
  Homolog annotation: Hit_ID=Q1S0F5; Match level="QueryCoverage=88%, HitCoverage=32%, E-value=7e-13, Identity=32%"; Hit description=IMP dehydrogenase/GMP reductase
MGTNQNGKRFYQVKVKSLDVTSLKELGRLMGPLQRQAFRKVYGKILDLTTAEVFTGAVVSLAQYYDHPLRCFTFGDFQMVPTIEEFEEILGCPLGGRKPYLFSGFLPSLSKIVAVVEDSAKELDRMKQTRNGVVGLPRKYLEGKARDMASQEKWGPKESPVVAILADLFDTFDQ

SEQ ID NO: 144822 - protein, 103 aa, Glycine max
  Coding DNA Sequence Number=SeqID_28044
MEGYQYTWARHSGKYDDVKGKQELEAICHSHYANDVVRFSKIQKQLKMLIAQEESYWRQKAKMLMGTSILNFSTQQQGKPLTTSHLSLVKMVPWSMLKKICLM

SEQ ID NO: 144823 - protein, 79 aa, Glycine max
  Coding DNA Sequence Number=SeqID_28045
  Subcellular localization annotation: CTP_CleavageSite=41; ConfidenceScore=5.10e-01
MKKKFGTKNESFARKWRGNKKRMNIKNLSYQSFKGRNLKTTCMKLGRRRKWIPLLPLKNSCITMENEGSKFDIFGEVKR

SEQ ID NO: 144824 - protein, 56 aa, Glycine max
  Coding DNA Sequence Number=SeqID_28046
MGSSLAMGFSFRFDVWVYGCCEGGVKGDEGWFYWSNEAVVVVVDMRVVETMVVVEK

SEQ ID NO: 144825 - protein, 119 aa, Glycine max
  Coding DNA Sequence Number=SeqID_28047
  Gene Ontology: Mol. function=protein serine/threonine kinase activity; Biological process=protein amino acid phosphorylation
  Homolog annotation: Hit_ID=Q39011; Match level="QueryCoverage=81%, HitCoverage=49%, E-value=1e-17, Identity=77%"; Hit description =Shaggy-related protein kinase eta
MDVEINEMPTLVADGNDALTGHIISTTISGKNGEPKQTISYMAERVVGSGSFGIVFQIFRGLAYIHTAPGIYHRHVKPQNLLIDRLIHQVKLCDFGSAKVLMKGHWLGSHANLLLVICS

SEQ ID NO: 144826 - protein, 61 aa, Glycine max
  Coding DNA Sequence Number=SeqID_28048
MTSKLYSEWLHDRSIHNNSSPHQPHVQRTTWEPPPTGEDGIFIKTRNCIFNGSPTPAQAEE

SEQ ID NO: 144827 - protein, 105 aa, Glycine max
  Coding DNA Sequence Number=SeqID_28049
MIGLSGKTIGEPPTCKHATRNHFFCSPHSLTPEKREERKTKLAPRLVVGRRKLALMEIRRRRGWVKVVSWYVVEEVRKMETKGTYKVYVCCMREDENGVAEWFHK

SEQ ID NO: 144828 - protein, 48 aa, Glycine max
  Coding DNA Sequence Number=SeqID_28050
MGDWVLRWESGAEDEPLWTTKLSFRDLRLSRKNPTLVDPCAHERQYNR

SEQ ID NO: 144829 - protein, 659 aa, Glycine max
  Coding DNA Sequence Number=SeqID_28051
  Homolog annotation: Hit_ID=Q1SXQ3; Match level="QueryCoverage=15%, HitCoverage=13%, E-value=8e-20, Identity=45%"; Hit description =Integrase, catalytic region
MKTLMHPTTHLGLNEESTKVDGTQYRAMIGSLQYLTTFRPDITESFRLISYCDADYASDKVERKSTSGSCLLIEGNLVTWICKKQGSTVLSTTEAKYMTFWQHDEFINKKTIASKVLGVKVILSSDTIAKATRCLCEGNTYIEGWEKNYDSHVTRALYCDNVDMANDPKMIYNLMCEKEKILLHKAGSKMTLFDLHKFMMSFLMENLPFDLPHIIYINIVRNLKDLGGLDDVYYSTLANKLLLDQEVYHVFNKMDKDSKHTLIVHGSVVTKQQKFSKAKLKAMKVALEQTLKEAPKVDMEAISKEEENQEIVPRDEEEKEMLAKEHQSKRRHEFAVFAPARPPVVNLVAQSLKNLIETNDDGEGLVRVALQKQKVIAPNVLASKKAKKAQPATEPRASILPWAIPRRVKSRATKTNPKISDKEWAVSFTGNKEDPTSSSSNSEFTDDTPLMPLPPREPLEDAQHFPLAYIHDNPTPLSPYSKVIFTEPVVMETISTEAPIWTCLLIDYHLALNNGFNPPLRATDIKMVADKVCPHLPVWDAAKKQGFELYYKAQMPYRHMKIVWMDSKKSSTPTYDGSDVVVPHNNVQLLRPLPSIPYRGNYNLKKMTEAQMIAHVTPIHEAQKKRRAEATAAKIDEQEAVTTVQVEASAKVMDDTIVR

SEQ ID NO: 144830 - protein, 88 aa, Glycine max
  Coding DNA Sequence Number=SeqID_28052
MGSKIEKLKNIIVSLKKAVLAEVGKVVERMEVVVVSEPRVVVGVQETKVWRVVEKRVQVQVLQQLQALIAKLVGCFVKGQHQDWRTAL

SEQ ID NO: 144831 - protein, 125 aa, Glycine max
  Coding DNA Sequence Number=SeqID_28053
MALKKLHAKRARKAIAGRDPAGPTKRMRVHKIPSRGCQEAMDPADRAHGKGQWIPYDEDAINQFQGHPLILEEGQHCEYTERRSQVLGFDEEAIGQLLCSLKQDFAWSVIGRQVRIMRTSMTTLT

SEQ ID NO: 144832 - protein, 72 aa, Glycine max
  Coding DNA Sequence Number=SeqID_28054
MQHLADQQRQDLNPYPWPTPEKFRATIAWPGDGPNFQLLTKLICQLSEPSAERTTLVAERTTPAAEREKESG

SEQ ID NO: 144833 - protein, 147 aa, Glycine max
  Coding DNA Sequence Number=SeqID_28055
MEFTPIPMPYPDLLPSLLSNQMVVVSPGKVYQPRFLQWYNPNATYAYHGGVPGHSIELCVALKHKDSSNMRTNPLANHGGLAVNTVEGWGSRGLKRIGDVSTSRQFILEALHEADIVDLDGDRGDLCLMHPGASHDVETYPIVEELL

SEQ ID NO: 144834 - protein, 138 aa, Glycine max
  Coding DNA Sequence Number=SeqID_28056
KDKIDASHDESQDSYRDSEIDSQESTKSETDEEVEQRETLQPESSKDQQCINKDQEESHEKHEIEEEKAYEQVDEADHEDSQMLEEKKECEEEATEGKKNDQKRSKKLFVSIIIAGSALLASGIFLFIRHRRARKGGK

SEQ ID NO: 144835 - protein, 95 aa, Glycine max
  Coding DNA Sequence Number=SeqID_28057
MGACARDKEFTDTFLPRKSYWVAVTCKKIDVDLKRGKFDHPTRMTEKTGANEEGEKEGETHVVTAIPIRPSFPPTQQCHYSANNKPPPYPPTSYP

SEQ ID NO: 144836 - protein, 127 aa, Glycine max
  Coding DNA Sequence Number=SeqID_28058
MQSQVLALPLEPEDGRSATRVSTKENVVIWFCSLHNRLDNYLKGIIIRLIIFFNTFTLALVGNINILIVQYTSMFVLNNALKGFDDTPQSKSKATVRWIVVKTKRKYCMRVLCHAPDVNYNLRKFQE

SEQ ID NO: 144837 - protein, 97 aa, Glycine max
  Coding DNA Sequence Number=SeqID_28059
  Subcellular localization annotation: CTP_CleavageSite=79; ConfidenceScore=5.19e-01
MKAKCNQRGCSPRRANLPFFFRGTLTMSPPSSWTIVKETVNAKDTGLSCSDVLCLFSAGKGQRSVGRDPSPTCIRPYVPASKKQQGVANLDRVVVLP

SEQ ID NO: 144838 - protein, 91 aa, Glycine max
  Coding DNA Sequence Number=SeqID_28060
MELNSYLTYMSPEEIEVMEEAMLQYVIEAYLRDQEDDIVETDPSAECSYPKLVFKVDEQMIDVAQPNVMHEFKLRRMEEAYGVLKCLSMRL

SEQ ID NO: 144839 - protein, 108 aa, Glycine max
  Coding DNA Sequence Number=SeqID_28061
  Homolog annotation: Hit_ID=Q1SRJ5; Match level="QueryCoverage=66%, HitCoverage=7%, E-value=2e-12, Identity=50%"; Hit description =Probable helicase [imported]-Arabidopsis thaliana-related
MVHGPCGILQPKSPCYDRVTAVVIHDANGTLENAINQNDEIKEYVDCRYISPCEATWRIFGFPIHARKPVVERLHFHLPGQHSVLYEDDDDIDDILSKPSISDSKFLA

SEQ ID NO: 144840 - protein, 725 aa, Glycine max
  Coding DNA Sequence Number=SeqID_28062
  Gene Ontology: Mol. function=binding
  Homolog annotation: Hit_ID=Q1SBZ0; Match level="QueryCoverage=91%, HitCoverage=62%, E-value=0.0, Identity=80%"; Hit description =Tetratricopeptide-like helical
  Pfam annotation: Domain name=TPR_1; Domain location=104-137; Score =19.3; E_value=0.014; Accession=PF00515.18; Description =Tetratricopeptide repeat
  Pfam annotation: Domain name=TPR_1; Domain location=138-171; Score =5.1; E_value=1.3; Accession=PF00515.18; Description=Tetratricopeptide repeat
  Pfam annotation: Domain name=TPR_1; Domain location=172-205; Score =31.3; E_value=3.4e-06; Accession=PF00515.18; Description =Tetratricopeptide repeat
  Pfam annotation: Domain name=TPR_1; Domain location=206-239; Score =30.8; E_value=4.8e-06; Accession=PF00515.18; Description =Tetratricopeptide repeat
  Pfam annotation: Domain name=TPR_2; Domain location=104-137; Score =16.1; E_value=0.13; Accession=PF07719.7; Description=Tetratricopeptid e repeat
  Pfam annotation: Domain name=TPR_2; Domain location=138-171; Score =2.8; E_value=16; Accession=PF07719.7; Description=Tetratricopeptide repeat
  Pfam annotation: Domain name=TPR_2; Domain location=172-205; Score =19.6; E_value=0.012; Accession=PF07719.7; Description=Tetratricopepti de repeat
  Pfam annotation: Domain name=TPR_2; Domain location=206-239; Score =28.0; E_value=3.3e-05; Accession=PF07719.7; Description =Tetratricopeptide repeat
  Pfam module annotation: Pfam domain module=TPR_1::TPR_1::TPR_1::TPR _1::TPR_2::TPR_2::TPR_2::TPR_2; Domain location=104-137::138-171::172- 205::206-239::104-137::138-171::172-205::206-239
MISFSTSCLLWQNTAAPGVLAQSLGPVPLPDSVCDLCCRWTAAATDLPVIHLQFLPLGGIVNFKFKEFDAAVEDLSACVKLDKDNTSAYTYLISYMEGLFSLSLNKLTLQGLALSSIGEYKEAEEAHLKSLQLDKNFLEAWAHLTQFYQDLAKPTKAQECINRMLHIDGRFARAYHLRGLLFHAMGEHRKAIKDLTMGLSIDGSNIECLYLRASCYHAVGQYKEAVKDYDAALDLELDSMDKFVLQCLVFYQKEIALYTASKFNGDFCWFDIDGDIDALFKEYWCKKLHPKNVCEKVFRQPPLRESLRKGKLKKQEFTITKQKAALLQASDSIGMKIQYDCPGFLPNRRQHRMAGLAAIEIAQKVSKAWRSLHAEWKYSNKGNSKNGRRARRRERINMPSQNRGGAGCSTSSTSVTSSNGTVDDRLSSRTFSWHNVYSLAVRWRQISEPCDPVVWVNKLSDEFNAGFGSHTPMILGQARVVRYFPNYERTLEIAKTVMKERSFVRSKTDKIIHLSEDGKLEEIMHAKSCSDLYKVIGEDFWLATWCNSTAFEGKQLEGTRINLVKMGEHGFDFAIKTPCTPARWEDFDEEMTVAWETLCNAYCGENYGSTDFDTLENVRDAILRMTYYWYNFMPLSRGSAGVGFIVMLGLLLAANMEFTGSIPQGLQVDWEAILNLDPNSFVDSVKTWLYPSLKVTTSWKDYPDIASTFATTGSAIAALNFSFDD

SEQ ID NO: 144841 - protein, 80 aa, Glycine max
  Coding DNA Sequence Number=SeqID_28063
MVVAQLAQASQVASSRSNSLLEESSGGPKWAWLLFAPLFLLITETYEFRNDTFFLSVMFTEPCGLHNHPLFDLRNVTEPH

SEQ ID NO: 144842 - protein, 66 aa, Glycine max
  Coding DNA Sequence Number=SeqID_28064
MFKELLNYVVTKVLDQVEELGGVDVSTFVPPWLDEGPGQGVAHRGLVILLEDFLGHDGGEGHGYSH

SEQ ID NO: 144843 - protein, 199 aa, Glycine max
  Coding DNA Sequence Number=SeqID_28065
  Homolog annotation: Hit_ID=Q1S6N9; Match level="QueryCoverage=34%, HitCoverage=5%, E-value=2e-18, Identity=57%"; Hit description =Integrase, catalytic region; Zinc finger, CCHC-type; Peptidase aspartic, catalytic
MGLEIYPRVHENPRAFFSSSSPILLEPLARGSGDWSLPREDCISLRAGGSATCPVLMERERVKEICKKSCKSIEEPKKRRNRGRIKKKAQQVDQDIHYANIVERKATLHLDIGEDLMLSVVSLIKWGMKFLFAETRINHMMKRQRLLIKRRKITYFLPLVMQSYPARALDRKLQVDWARDAREGPRVLMSLRIDFGPMG

SEQ ID NO: 144844 - protein, 413 aa, Glycine max
  Coding DNA Sequence Number=SeqID_28066
  Gene Ontology: Mol. function=transcription regulator activity; Cellular component=nucleus; Biological process=regulation of transcription
  Homolog annotation: Hit_ID=Q1SBF4; Match level="QueryCoverage=94%, HitCoverage=96%, E-value=3e-60, Identity=45%"; Hit description =Probable DNA-binding protein T6L1.1 [imported]-Arabidopsis thaliana
  Pfam annotation: Domain name=HLH; Domain location=179-265; Score =48.7; E_value=1.9e-11; Accession=PF00010.16; Description=Helix-loop -helix DNA-binding domain
MKKELEDQGQCSSLPIDTKNNIQSYQEHLLQQQMQQNSDIFGGGASRGLMFPPEVSPTLQQQSWSMPPVHSFNSNPVHYINNNNTNPVHHHHEQAPFLVPPPTTPSPYASFFSSRRVVPSLQFAYEGPSSHLDHHHHLRIISDTLGPMVQPGSAAPFGLQAELGKMTAQEIMEAKALAASKSHSEAERRRRERINNHLAKLRSLLPNTTKKITKFDKTSYKITPNMHMSGEIPRRLLVEKVIKDERKTDKASLLAEVIQHVKELKRQTSLIAETSPVPTESDELTVDAVDEDGKFVIKASLCCEDRSDLLPDLIKTLKALRLRTLKAEITSLGGRVKNVLVITGDEDNSNSNTHNGEQSMQQQQQQFCISSIQEALKAVMEKSGGGDESASGNVKRQRTTTNNNINILEQRSL

SEQ ID NO: 144845 - protein, 71 aa, Glycine max
  Coding DNA Sequence Number=SeqID_28067
  Gene Ontology: Mol. function=nucleic acid binding
MKKILGLQAPMELASTCFSSIESIGNGKYTIVNGKATITISTYLGTKFIYDVLYVPEIDQNLLSVRKQVEK

SEQ ID NO: 144846 - protein, 290 aa, Glycine max
  Coding DNA Sequence Number=SeqID_28068
  Gene Ontology: Mol. function=binding
  Homolog annotation: Hit_ID=Q6L4Y6; Match level="QueryCoverage=80%, HitCoverage=38%, E-value=1e-45, Identity=44%"; Hit description =Putative tetratricopeptide repeat (TPR)-containing protein
MGRESIANLQEVVESLCNVSRSSDERQRMVIESLVQLLIDPVTRYKVMDKVAPVLADLVELRDIKGKHKVIGKAIMKVLLHYFHRIKICKVSLYSERTRRLEELWNLKVERVKKEKLLSVQELREKEALSCVLKKEGRKSFFAGEIENAVVKYSEALNLCPLKLRKERIVLHSNRAQSYLLLRDSECAISDATRALCLSGAARPHGKSLWRRSQAFDMKGLTKESLMDCLAFIDTEGFKIPCYAAGHELHCRRTFHWEKSMGEKKVWKDESSDCKCWKKTGSVKNKKGKA

SEQ ID NO: 144847 - protein, 107 aa, Glycine max
  Coding DNA Sequence Number=SeqID_28069
MVIYRKSHLVQGKLAQASQLFRLEGISSPRRVGCLRMKAFHGLGEPDADLGELKHRNIQKMAILPPFLVVGLAKRPPNVNNGTCLGPNVTWRGVFMTSSTGLNMKYL

SEQ ID NO: 144848 - protein, 132 aa, Glycine max
  Coding DNA Sequence Number=SeqID_28070
MDEHGSESVLELKRCLCWGFEVMTLYSMGKRPLSSIHMAVLVNSGDLRVSLVIPDYSGVVFMVGESIMSCTDMRHVHPIVIHMLGWISAFGFASLTVGGSLREFFIGFLLVGLLSSSIYLLDGVVIPQGMDR

SEQ ID NO: 144849 - protein, 61 aa, Glycine max
  Coding DNA Sequence Number=SeqID_28071
MVVEMNSMSKMILVFSCVGGSRRGRVALSGGSEWWLVVALSGGSRPMVVVRGGGEWRLSGG

SEQ ID NO: 144850 - protein, 70 aa, Glycine max
  Coding DNA Sequence Number=SeqID_28072
MSFSCTVSSFTTASISLVLLYGEQIVSWKNHRKEELLFMSTKLMSSMEIFLLDRLTRNNIKQSEEEYQLA

SEQ ID NO: 144851 - protein, 159 aa, Glycine max
  Coding DNA Sequence Number=SeqID_28073
MFYDYSTTLVLGSPLLNIARWRFCKYHEMNDNVFSQKRSGISDDPAGDGSNRNGAVKRVAGLLLYAALAAHDLFILSGEPPSPWEDSQSHRKTLVGEGAGTRVIEATEAMTGTSFVVQVEGISTWVVVLRTREGTSLVDQFKWRVERNLKNRWLLGDWM

SEQ ID NO: 144852 - protein, 97 aa, Glycine max
  Coding DNA Sequence Number=SeqID_28074
MQTASPIGEFVVVVTRGMSSLPLATQPVVVATSIGESSVERTRWFDWRLEGSSGAVAFDGEVTIVAGDLGYEDIAIPAGDLSLVDYKIPFNESESEL

SEQ ID NO: 144853 - protein, 215 aa, Glycine max
  Coding DNA Sequence Number=SeqID_28075
MAPSKGSKLLLAKEFPSFTVPCEIASPIGEFGLASTCGNGLASHIGDLTMRGVAAHIDATFQRHSFFRAYSQWYWRDDKEIASATGEITDIASGTGEIIRDVSNLHGDEDDNDDDDYLVSNSYVEESLDEDNSVDDISDTDDEATDMIQPRYAMDIEWLRRTLGNRLLHFKLSQISIGLLRCHSTTWKQMSGTTAHHATLPTKQIGGNADITVAL

SEQ ID NO: 144854 - protein, 382 aa, Glycine max
  Coding DNA Sequence Number=SeqID_28076
  Subcellular localization annotation: CTP_CleavageSite=36; ConfidenceScore=5.21e-01
MVTMPNCFNHSIPKTTSASLMGNTWTITVKVWCWICSVVVGQSSTEPLPTMTRRGETCLIDEAIYAKGFRCVVSKLGNSWKALGFSGSAMKRRTRPLQQWGGLGLGGTKMGIVVFGGKSLGLGQQLMSLSFCNLARAVAWGKEMGYRANPSQLVLRQLEECTLGIVVERRGKTQFQGLEKTSPGGDKPIAVHPLVPTKGGSVHVEGRDYDVLLIMRSLGEGRGGMVVIWLRRLSNESTLLTKTEWRSARESWWRVKQVRPVVKGWEPFLVFEDKVIDESQSTFLGGQNMMDGVVITNEVIQEAKEKKKPCFILKVSKKLMIILYVGSDKRESYLRIHNAKRFEARGFSRPFFIPFGGGRTRRYDESDTGEIINCGMQNWEQR

SEQ ID NO: 144855 - protein, 84 aa, Glycine max
  Coding DNA Sequence Number=SeqID_28077
MGSIYCHTSTREGCAIVWCPADYMEWFYMISHSFMSPAQPGDPPRHPPVLHDDIFIEPDILQHLVATTIMEEAPTDALIHAEQP

SEQ ID NO: 144856 - protein, 311 aa, Glycine max
  Coding DNA Sequence Number=SeqID_28078
  Homolog annotation: Hit_ID=Q1SMF0; Match level="QueryCoverage=61%, HitCoverage=36%, E-value=3e-24, Identity=36%"; Hit description =Tetratricopeptide-like helical
MDKDQWMHDSIMSEEVDMNEQNEDEAGVKSEHVFPIHDDVLNWAQAVTYEIDSVAVIIRPDTNIGMRGRTSFVLIGCERSGQYKTKKKDLVRTDTDSRKCGCPFKLCGKLVVGGEGWMIKLMCGSHNHELVKSLVGNSYVGRLKMDEKIIIDDMTKSMVKSRNILLTLKEHNTNNYITIKQVYNARNAQRSSIRGSNIETQQLMKFLERDRYIHWHRLKDGDVVRQAPVITNGVILILDVIPGVIVTNRDLALMNAMKTIFPKCINLLYRFHIDKNVKAKCKSLVFMCLPYTAFVVTAHIHCIPQSHLGDP

SEQ ID NO: 144857 - protein, 198 aa, Glycine max
  Coding DNA Sequence Number=SeqID_28079
PEVKDWGKRREKKKKEEKKKLNHRRTVTAIDFYIVLQSFFILHPMHFLVLPRPPAEGKVATDANGDFGGICQHVWYLTVVNSAPQVARRQLLWDDLFELCSDVVDDWEIISDFNSTLSPNEKVGGNDNHGHKDMSAFRNILHEGNLIDMGVTNIGALLNKWSKGPGHTSWSVALKSKLDRIDARKGAQFDLGVDVEYR

SEQ ID NO: 144858 - protein, 429 aa, Glycine max
  Coding DNA Sequence Number=SeqID_28080
  Homolog annotation: Hit_ID=Q1SLB1; Match level="QueryCoverage=14%, HitCoverage=14%, E-value=5e-08, Identity=53%"; Hit description=RNA -directed DNA polymerase
MPFVARYRQKKFHLPEHFHYVAPSFWAWKEGEARLRGLAKFVDYLLSITGYEIGIFDIALTSFTIELVEDKLEGFGNSSLHVAQTIGSEFGGVISNKGTKKKPGKYDVKNRPMLISPFKYNFFRARRRMKSHKEVNVLREDSQRRDKEGARRLFMVTSKTTPRVTAKEEEAVNSMAFLEERDIKENKKFAGGSQRGNIGVDQQRKLRKIMVPEGNSEVEYECCTAINRARGGVNGLASGGDMEIEEFNDLLANMEVVDVPMVGRKFTWYRSGALPKLGWIKSLYQKEIDWGPKPFRVLNARLLELPFSNFVRSDGRWLDDPKVLKKEVKSFFMRDLMKEEQCRSVEVLCDFHAHGKIPRGTNASFISLIPKNENLGGLRLREVGVSLLHDEKDEFSEFVVEKGLRQGDPHAPFLFLIVAEGLGGFMREA

SEQ ID NO: 144859 - protein, 340 aa, Glycine max
  Coding DNA Sequence Number=SeqID_28081
  Homolog annotation: Hit_ID=Q9LTA2; Match level="QueryCoverage=29%, HitCoverage=38%, E-value=5e-08, Identity=43%"; Hit description =Similarity to AT-hook DNA-binding protein
MEAPIWASILRNKYRCGADSFPTVDSKRAVNFWRDCWIPRSFPLIDSYAEAIPESKMEKKVSDYVGINGNWVVIFYGAGVIGSFFMMIIELLRRLFTKLAIGVTDIKWDFPSEGEIALNCDGAVTDGGNKSACGGAIYLGLKLAGQEAFARSEWIHARTEEVVDEVDSKGPRSKRGYHRGGVGDVDEDEVGVLAPIEMAARDGELRVFLVASEVSGDSTASCLMASLKILSPFAIHFAAKTGGDYASPLSSKLFCTSSSNESQSYNGLLNDAEITNIVPRTRSLSVTIYPCCLERDTAKVFGITAREPWWRKVADMERISKQPWKVTMATVALMGVKEGW

SEQ ID NO: 144860 - protein, 192 aa, Glycine max
  Coding DNA Sequence Number=SeqID_28082
  Gene Ontology: Mol. function=transferase activity
  Homolog annotation: Hit_ID=Q1SFG3; Match level="QueryCoverage=100%, HitCoverage=39%, E-value=2e-77, Identity=75%"; Hit description =Transferase
MALEVTHICKRTVVSTKAVEPGKYFPLSVLDRYMENNHIRMVYYYQTSREVELGKVTKKLRETLSEMLTHFPIVSGRLVRDDETGHWKIKCNDAGVRVVEAKAKGSVGGWLANLDREKELQLVHWEDMFHKPYYWSTFYVQVVDIIIVREDLRMKLTEFEEGGLAIGLSCFHLLVDSTCATLFMKAWADISM

SEQ ID NO: 144861 - protein, 131 aa, Glycine max
  Coding DNA Sequence Number=SeqID_28083
MCLMTLETSWSISQLSVDMYPDHNPYSLQILYPKPNLISLSLFNADGLWVANLWERKHRWVGWQRLKCRWVGVLTQEFFAPRGYGSRMGEGAKVEESGGDGEAIDDDGVVQVCLRVCVRVVFSVRVGVSAS

SEQ ID NO: 144862 - protein, 138 aa, Glycine max
  Coding DNA Sequence Number=SeqID_28084
MGEIKEVQEQMKTDMEAMKEQMATMMEAMMSMKKIIEVNAATVASTGVVAKEDPIPPSGLNQINHPTSDMVGQGGKELGSTDGPHFVQVQNKHVFPPYGLPPNYTPPNVAHTPNENVDNSAPIPIESQQPQSNHAHVS

SEQ ID NO: 144863 - protein, 75 aa, Glycine max
  Coding DNA Sequence Number=SeqID_28085
MRLHCDQASQRPSMTTDRPPLLVARIDPDKGSGVVYARGRVDKGVALVSMHPQVDYKQNSFKALDLETISRFLMK

SEQ ID NO: 144864 - protein, 113 aa, Glycine max
  Coding DNA Sequence Number=SeqID_28086
MTLRSTNMHSSSFFQILPYAQPRCVALSGWLAKPEDWLSNGSGSRGSGGKNQNMISPVATYPFAGERGEAHGCIFQRRKMRGVATNIYLWKTSEKPKETDHKEYSKFGSCIYV

SEQ ID NO: 144865 - protein, 71 aa, Glycine max
  Coding DNA Sequence Number=SeqID_28087
MTISMTDTSTPYHRGGMMNASGHVYAMHDKCVYLWTQELKRPYLLTHNALGIMFHLQSLPWCPMHAIKKAM

SEQ ID NO: 144866 - protein, 202 aa, Glycine max
  Coding DNA Sequence Number=SeqID_28088
MGAMKDQMDAMMEAMLSMKRIMESNTAAVATTNAAAEVDPTHPSDINQTSHPVPDVVGQGGEGLGSTGGPHVVQSKNSFPPYNLPPNYAPPNVHRPLQPLHFSVGRLPPGAEEREKFDLIEERLRDIEGIGDYPFADMAKLCLVPDFVILPKFKVPDFDKYKGITCPNKHLKLYCRKMGTYVKDEKLLMHFIQERLSGAEIT

SEQ ID NO: 144867 - protein, 49 aa, Glycine max
  Coding DNA Sequence Number=SeqID_28089
MATIALLSRYGRWCLASNVQQMGFMVDLGTTFVDDWVFLIGRMVGNEKD

SEQ ID NO: 144868 - protein, 111 aa, Glycine max
  Coding DNA Sequence Number=SeqID_28090
MVICPHSKTSMSFNRDYYSLPLPSRDNYLQNISIGFNDEISAFSNEKEAKSGSAKNLCTLFQSAYFGKTTLEDARGTTCALKPRFCKLRGINELEIECEMMRRGGGIPLLV

SEQ ID NO: 144869 - protein, 213 aa, Glycine max
  Coding DNA Sequence Number=SeqID_28091
  Subcellular localization annotation: CTP_CleavageSite=66; ConfidenceScore=5.18e-01
MDRNGVLSLAFICIVVAGVGGQSPAAAPSNTPATPAAATPAQAPSTVPKSPAPVASPKSSPPAATPASTPAASPTTTPAAPAPVTKPPAASPPPATPPPATPPPAPVPVSSPPAPVPVSSPPAPVPVAAPTTPVAPSPAPKHKKKGKKHGAPAPSPLLGPPAPPTGAPGPSEDASSPGPGTAANDESGAETTMCLEKVLGGLALGWATLVLVF

SEQ ID NO: 144870 - protein, 126 aa, Glycine max
  Coding DNA Sequence Number=SeqID_28092
  Gene Ontology: Mol. function=two-component sensor activity; Cellular component=membrane; Biological process=two-component signal transduction system (phosphorelay)
  Homolog annotation: Hit_ID=Q4IXN6; Match level="QueryCoverage=61%, HitCoverage=19%, E-value=4e-12, Identity=53%"; Hit description=GGDEF
  Pfam annotation: Domain name=GGDEF; Domain location=1-84; Score= -40.8; E_value=0.00059; Accession=PF00990.12; Description=GGDEF domain
MPVEGQFARLGGEEFAALLPGDSEQAQRICERIRLATQLSLPNDIGYTVSIGFATASQRHQAFPALLALADEALYRAKAAGRNRVEGYQTPQAAMAEAAFVTVVTQPVIAVFHPLPSADACADQPQ

SEQ ID NO: 144871 - protein, 113 aa, Glycine max
  Coding DNA Sequence Number=SeqID_28093
MVLGCFGSSVWVNLVGRGRGISVRSSLLGVVRSKIGMQKIECGLSGRVPYWPNSENRMTLVTSKNNTEPSKTPLRCEDVLTLFLFVPRVWQLNKLIVSYCNWGGSSRGLIFVL

SEQ ID NO: 144872 - protein, 643 aa, Glycine max
  Coding DNA Sequence Number=SeqID_28094
  Gene Ontology: Mol. function=pepsin A activity; Cellular component =cellulose and pectin-containing cell wall; Biological process =proteolysis
  Homolog annotation: Hit_ID=Q1SED9; Match level="QueryCoverage=93%, HitCoverage=95%, E-value=0.0, Identity=81%"; Hit description =Peptidase aspartic, active site
  Pfam annotation: Domain name=Asp; Domain location=83-424; Score= -10.7; E_value=5.6e-13; Accession=PF00026.14; Description=Eukaryotic aspartyl protease
MARALTHHLSLILILIVAVAGDANLLRNRHHGSRPAMLLPLYLSAPNSSTSALDPRRQLTGSESKRHPNARMRLHDDLLLNGYYTTRLWIGTPPQMFALIVDTGSTVTYVPCSTCEQCGRHQDPKFQPESSSTYQPVKCTIDCNCDSDRMQCVYERQYAEMSTSSGVLGEDLISFGNQSELAPQRAVFGCENVETGDLYSQHADGIMGLGRGDLSIMDQLVDKNVISDSFSLCYGGMDVGGGAMVLGGISPPSDMAFAYSDPVRSPYYNIDLKEIHVAGKRLPLNANVFDGKHGTVLDSGTTYAYLPEAAFLAFKDAIVKELQSLKKISGPDPNYNDICFSGAGIDVSQLSKSFPVVDMVFENGQKYTLSPENYMFRHSKVRGAYCLGVFQNGNDQTTLLGGIIVRNTLVVYDREQTKIGFWKTNCAELWERLQISVAPPPLPPNSGVRNSSEALEPSVAPSVSQHNARPGELKIVQITMVISFNISYVDMKPHIKELAGLFAHGLNVNTSQVHLLNFTSTGNDSLSKWAITPKPDSHYISNTTAMNIIARLAEHRIQLPGTFGNYKLIDWSVEPPSKARLYLKVELVAATLLGREFSYFDHIASRIVDIRNVLNLEKKTAKLAFIQASGCGCSRARTSAIMS

SEQ ID NO: 144873 - protein, 83 aa, Glycine max
  Coding DNA Sequence Number=SeqID_28095
  Homolog annotation: Hit_ID=O64438; Match level="QueryCoverage=50%, HitCoverage=17%, E-value=2e-08, Identity=66%"; Hit description=ARG10
MRIFTLVLSMFCFFLFPMIVSIPSLLTLLFSVGGLRCYESPKNKITAVPTEEEEIWGAFFKVVVELKKLELKIYYVTRIARRN

SEQ ID NO: 144874 - protein, 585 aa, Glycine max
  Coding DNA Sequence Number=SeqID_28096
  Gene Ontology: Cellular component=microtubule; Biological process =microtubule cytoskeleton organization and biogenesis
  Homolog annotation: Hit_ID=Q7XIP0; Match level="QueryCoverage=88%, HitCoverage=86%, E-value=6e-96, Identity=41%"; Hit description =Putative ABI3-interacting protein 2; CnAIP2
  Pfam annotation: Domain name=Frigida; Domain location=185-491; Score =363.2; E_value=4e-106; Accession=PF07899.2; Description=Frigida-like protein
MVEDGLKREVFLTIKWSRKVLRGRWYLVGCVNMGVEDQDEKINVQSVIEQLSQAFLELKAQKGETENKIQWVEIKQHFHDLETELNKKLEELEAKERQYEAKQLEVDTLLAERKAVVASKEQDLLDRLQELKDAAVASIVEAHANHWNATLESVYDGKNKDHKVSSSLGDTNSSEDDFPHKSGEKSKGVAVEGRPHPELTQFCEQMDAKGLLNYIMENKKKLSVNCEEISVALQSATNPARLVLDLLEGFYPTSETSQLKDKSGAALQGMRKSCIIILEAMATLLARADPGADHLLNPQTKQQAKAIADEWRPKLARADTDAANGNSLEAKAFFQLISTFRIASEFDEEELCKLVLAVAQLRQAPELCRSIGLIHKMPVVVESLINNGKQIAAVHFIHAFQLQESFPPVPLLKAYLKNRRRNSQVKTGNVRDIASAKNDANAQELSALRAVIKCIEEYKLESEYPPDTLRKRVLQLEKSKGDRKRSGGEFIKRPQSKRPRPNERHFSLHSSGSAASAVILGRQVPPVRAPYAANPDRYPHAGAIPYNYQVPGQSVYTAPSNAPPSNYGRYMGTSTSLQSSHQPYM

SEQ ID NO: 144875 - protein, 193 aa, Glycine max
  Coding DNA Sequence Number=SeqID_28097
MSAGSSARIKSSLRKKLQQVLSRQQNVACGRRFCRIFCGSAEDKVLPLDDAKDLAEPSSVGSRGRSFRSFFRRNPQKNLPHFFHGSSRSPFPTRRRRFFSWKNLRLQPPAINVVYPKVPTAIYTIHAIETVTRSFFSKFQIQNEMRARRKKLNEGEEEEQAQMEIVGCTGKKQARKQGIFGTSLNCWMHQQFY

SEQ ID NO: 144876 - protein, 175 aa, Glycine max
  Coding DNA Sequence Number=SeqID_28098
MYPDKNRGERQRGQRQRRKVRRRQTPMLPSVGGPLRACNATAIVVRARDLHTAPYGNIKYNDDVCLEPPLISVRDGKVVIWTKLAAAPVTLSHRALREPQATPSVSCVDIPKICFYRLTVGILKTITFGLPQSEDSALSTIPTEGNCAKWPKAALSPIPTERKCGERPEGALSEP

SEQ ID NO: 144877 - protein, 473 aa, Glycine max
  Coding DNA Sequence Number=SeqID_28099
  Gene Ontology: Mol. function=transporter activity; Cellular component= membrane; Biological process=transport
  Homolog annotation: Hit_ID=Q7X9B8; Match level="QueryCoverage=99%, HitCoverage=89%, E-value=0.0, Identity=92%"; Hit description=Ferrous ion membrane transport protein DMT1
  Pfam annotation: Domain name=Nramp; Domain location=77-440; Score =752.7; E_value=2.3e-223; Accession=PF01566.9; Description=Natural resistance-associated macrophage protein
MSGSHQEQPLLENSFIEEDEPQETAYDSSEKIVVVGVDESDDEENWGRVPRFSWKKLWLFTGPGFLMSIAFLDPGNLEGDLQAGAIAGYSLLWLLMWATAMGLLIQLLSARLGVATGKHLAELCREEYPPWARIVLWIMAELALIGSDIQEVIGSAIAIRILSHGVVPLWAGVVITALDCFIFLFLENYGVRTLEAFFAILIGVMAISFAWMFGEAKPSGKELLLGVLIPKLSSKTIQQAVGVVGCLIMPHNVFLHSALVQSRQVDRSKKGRVQEALNYYSIESTLALVVSFIINIFVTTVFAKGFYGSELANSIGLVNAGQYLEETYGGGLFPILYIWGIGLLAAGQSSTITGTYAGQFIMGGFLNLRLKKWMRALITRSCAIIPTMIVALLFDTSEESLDVLNEWLNVLQSVQIPFALIPLLCLVSKEQIMGTFRIGAVLKVFCHSILHFDLTGHLLGAIMYLIKDFVMTT

SEQ ID NO: 144878 - protein, 83 aa, Glycine max
  Coding DNA Sequence Number=SeqID_28100
MVNMHQSTTEEQGYLYSMLNDNSYGSFAPETLAEEVLWDGLWNIDDVHGNFSENYSCKSLYFIENGGGITGQSTNLTETSSDL

SEQ ID NO: 144879 - protein, 117 aa, Glycine max
  Coding DNA Sequence Number=SeqID_28101
MVFHDEDNIEKGLTSHFEATSKCCDPKTINEVAELVEGTLDDEMREIMNKDFTKEEQKKKGTKGIMALKLHDLKHYDRVEWDFISTMLQNMVFDKHEDPNDRPKRRTKPHQNLKDYF

SEQ ID NO: 144880 - protein, 177 aa, Glycine max
  Coding DNA Sequence Number=SeqID_28102
  Gene Ontology: Mol. function=hydrolase activity; Cellular component =endoplasmic reticulum; Biological process=traversing start control point of mitotic cell cycle
  Homolog annotation: Hit_ID=Q9M3Z3; Match level="QueryCoverage=87%, HitCoverage=37%, E-value=3e-73, Identity=85%"; Hit description =Putative PTS protein
KAYISKPVPQKDTAPGLAYFHIPLPEYATFDSSNMSGVKQEPDGNGISSPSVNSGFFTTLLAAGDVKAVFTGHDHINDFCGNLMNIQLCYGGGFGYHAYGKAGWPRRARVVVASLEKTGKGSWGDVKSIKTWKRLDDQHLTGIDDEVLWSKSTGGKISFDTCSPILVLNKAMLKMNM

SEQ ID NO: 144881 - protein, 66 aa, Glycine max
  Coding DNA Sequence Number=SeqID_28103
MDNHSWCYPACAQCHRKTDIQTGPFTCGCGKDNDQSVLRYRVEVMVTQNNESNKFLLWDRECAELI

SEQ ID NO: 144882 - protein, 117 aa, Glycine max
  Coding DNA Sequence Number=SeqID_28104
MVVPKVSGAFFDEVVSKGFDVVIGGKRTVGGNDSKAVVREGQSGCGSECELSRATSPLVHATGKGSRTATHASKQNPFPVARFDAVDGGGVAWSTVVAVFVGEGEEREKGEKEMTWQ

SEQ ID NO: 144883 - protein, 95 aa, Glycine max
  Coding DNA Sequence Number=SeqID_28105
MEFASNSLAIVMKGKKEKRKALFSIDGAVVAVDGGGAGLDDSGDMVVMVFVGEREEGDDVAMMSSAKRNTHGLSTRKTLEEDELYRFAKRITSSH

SEQ ID NO: 144884 - protein, 97 aa, Glycine max
  Coding DNA Sequence Number=SeqID_28106
MSSKLDHVRADMLELVAEQKELAAQLHAVESELAKVSTEAQFVPTIKANIEAMRHEIQRGRMRVQQCLAFHLELLNEAEVAAVAEEKETHSFEIDPS

SEQ ID NO: 144885 - protein, 197 aa, Glycine max
  Coding DNA Sequence Number=SeqID_28107
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O24078; Match level="QueryCoverage=99%, HitCoverage=51%, E-value=7e-93, Identity=83%"; Hit description =Protein phosphatase 2C
  Pfam annotation: Domain name=PP2C; Domain location=1-186; Score =167.8; E_value=2.8e-47; Accession=PF00481.12; Description=Protein phosphatase 2C
VVRRDECDIKEAVKHGYLNTDSEFLKEDLNGGSCCVTALIRNGNLVVSNAGDCRAVISRGDMAEALTSDHKPSREDERDRIETQGGYVDVCRGVWRIQGSLAVSRGIGDRNLKQWVIAEPETKVIKIEPQHDLLILASDGLWEKVSNQEAVDIARPLCVGNNRQQPLLACKKLVELSVSRGSLDDISVMIIKLQNYI

SEQ ID NO: 144886 - protein, 479 aa, Glycine max
  Coding DNA Sequence Number=SeqID_28108
  Gene Ontology: Mol. function=DNA binding; Cellular component=nuclear pore; Biological process=DNA integration
  Homolog annotation: Hit_ID=Q1T1K8; Match level="QueryCoverage=98%, HitCoverage=24%, E-value=1e-153, Identity=57%"; Hit description =Integrase, catalytic region; Zinc finger, CCHC-type
  Pfam annotation: Domain name=zf-CCHC; Domain location=230-247; Score =9.5; E_value=0.026; Accession=PF00098.13; Description=Zinc knuckle
MTYLQLSLSSWIEITISYGSHYYILGTKECPKQFVNTNDTTVKINSDYEEWIAHDQALLGWLMAIDIATQLLHCETSKELWDEAQSLAGAHTKSRTIYLKSEFHNTRKGEMKMDQYLLKMKNLVDKLKLAGSPISNSNLMIQTLNGLDADYNPVVVKLSDQINLGWVDLQAQLLAFESRIEQLNNFSNLSMNASANLVSKTYSRGNKPGTRGNWRGSNFRGGRGRGRSKPTCQVCNKFGHTVVQCFYRYDKSYTSSNAENNTQENHSAFIASPYHGQDYEWYFDSGASNHVTHQNEKLQDLSESNGKNSLLVGNGKRLSILASGSTQLNNLNFHNVLYVPEITKNLFSVSKLTANNNALVEFDANCYYVKDKLIGKALLKGKLRDGLYQLSSVNSQVNKDPCTYMSVKENRHRKLGHPNNKVLEKVLKNCNVKASSNDQFSFCEACQFGKLHLLPFKPSSSHAKEPLDLIHSDPNLVSI

SEQ ID NO: 144887 - protein, 496 aa, Glycine max
  Coding DNA Sequence Number=SeqID_28109
  Gene Ontology: Mol. function=nucleic acid binding; Cellular component= mitochondrion; Biological process=DNA integration
  Homolog annotation: Hit_ID=Q1T1K8; Match level="QueryCoverage=99%, HitCoverage=27%, E-value=0.0, Identity=76%"; Hit description =Integrase, catalytic region; Zinc finger, CCHC-type
MRTRSKAGIYKPKLPYIGLTVTHKEDKEPENVNEAQGQNNIIDSKWVLKTKYKADGSIERRKARLVAKGFLQTAGLDYDETFSLVIKSSTEVRQLDINNAFLNGNLKETVFMHQLEGYIDSTRPHHICKLTKAIYGLKQALRAWFDRLKDTLLEWGFQNTKSDSSLFVLRGTDHITLLLIYVDDIIVTGSNKKFLETFITQLNIAFSLKDLGHLHYFLGVEVHKDTSGMYLKQTKYIKDLLKKFNMEKASSCPTPMVTGKQFTVEGEPMANPTLYRQAIGALQYLTNTRPDIAFSVNKLSQYMSCPTTDHWQGIKRILRYLHGTTNLCLHIKPSTDLDIAEFSDADWATSIDDRKSMAGQCVFLGETLISWASRKQRVVSRSSTESEYRALADLAAEVAWIRSLLAELKLPMPRKPILWCDNLSAKALASNPVMHARSKHIEIDVHYIRDQVLQNQVTIAYVPTAYQIADCLTKPLTHTRFNILRDKLGVIMSPSV

SEQ ID NO: 144888 - protein, 115 aa, Glycine max
  Coding DNA Sequence Number=SeqID_28110
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q84QD6; Match level="QueryCoverage=63%, HitCoverage=18%, E-value=4e-11, Identity=51%"; Hit description =Avr9/Cf-9 rapidly elicited protein 284
  Subcellular localization annotation: CTP_CleavageSite=53; ConfidenceScore=5.82e-01
MSCSVAVPTSPVFSFYNNNVNSNSIPSTTPSCSSPPSSPLLKRRRPAKLDIPVASLAFGLSPAAAPSPARDAVVEVDGRGFSVFCKRGRRHHMEDRFSAAVDLHGQPKQAFFGDI

SEQ ID NO: 144889 - protein, 126 aa, Glycine max
  Coding DNA Sequence Number=SeqID_28111
  Gene Ontology: Mol. function=binding; Biological process=protein transport
  Homolog annotation: Hit_ID=Q10LA0; Match level="QueryCoverage=55%, HitCoverage=7%, E-value=2e-25, Identity=81%"; Hit description =Adapter-related protein complex 1 beta 1 subunit, putative, expressed
MLFLLRTASDLLRCSVWLGEVKLYLITSSSLAFAFRFLLVVGTVKVFHLVIKTLYVAKLYDINAELVEDKGFLESLKDLISDNNPMMVANVVATLVDDQENSCSPIFEIPSHTLSKLLTALNECTE

SEQ ID NO: 144890 - protein, 99 aa, Glycine max
  Coding DNA Sequence Number=SeqID_28112
  Gene Ontology: Mol. function=transcriptional repressor activity; Biological process=regulation of nitrogen utilization
  Homolog annotation: Hit_ID=Q2KBP3; Match level="QueryCoverage=95%, HitCoverage=30%, E-value=8e-27, Identity=65%"; Hit description =Hypothetical conserved protein
MAEEKRIITVFGATGHQGKGVVQALKRASQFRVRALTRNPQTYTGEADEVQYADLEKPETLHDALKGVQGVFLVTDYWQQGTDERKQAAFAIEAAKSAG

SEQ ID NO: 144891 - protein, 281 aa, Glycine max
  Coding DNA Sequence Number=SeqID_28113
  Gene Ontology: Mol. function=transcription factor activity; Biological process=regulation of transcription, DNA-dependent
  Homolog annotation: Hit_ID=Q2KBP2; Match level="QueryCoverage=100%, HitCoverage=84%, E-value=7e-92, Identity=61%"; Hit description =Putative transcriptional regulator protein, LysR family
  Pfam annotation: Domain name=HTH_1; Domain location=7-66; Score=57.6; E_value=4.1e-14; Accession=PF00126.17; Description=Bacterial regulatory helix-turn-helix protein, lysR family
  Pfam annotation: Domain name=HTH_8; Domain location=5-43; Score=12.6; E_value=0.02; Accession=PF02954.9; Description=Bacterial regulatory protein, Fis family
  Pfam annotation: Domain name=LysR_substrate; Domain location=90-280; Score=110.1; E_value=6.5e-30; Accession=PF03466.10; Description=LysR substrate binding domain
  Pfam module annotation: Pfam domain module=HTH_1::HTH_8::LysR _substrate; Domain location=7-66::5-43::90-280
MALATETSELIAFTKTAEAKSLSRAAAELGLPRATLSRRIAQLEKKLDARLLLRTTRSLVLTEPGNIFYREAIIALEAIRQAEQSVSRAGGHLRGDLRVSLPPGMKKSFRAMLCEFIAQHPMLHVHIHTSSQHIDFRQGGYDVALRASSQMQPGLIARTLFRDPVIAVASPAYLSKMGVPVTADDLKNHQCLVGFARGEMPDMYWPLISGERMKVEGAFFSDDITLLCEAAINSLGIALLPEDLMREHLRQGALVPVLRDVLGTEMQIAVVYPDRHFLMPQ

SEQ ID NO: 144892 - protein, 96 aa, Glycine max
  Coding DNA Sequence Number=SeqID_28114
  Homolog annotation: Hit_ID=Q1SW04; Match level="QueryCoverage=95%, HitCoverage=15%, E-value=2e-07, Identity=36%"; Hit description =Cyclin-like F-box; F-box protein interaction domain
MPGYHLVGSCNGLHCGVSEVPEGYCVCLWNKATRVISRESPTLSFSPGIGRRIMIGFGYDPSSDKYKVVAIALTMLSLDVSEKTKMKVYGAETSSW

SEQ ID NO: 144893 - protein, 64 aa, Glycine max
  Coding DNA Sequence Number=SeqID_28115
  Subcellular localization annotation: CTP_CleavageSite=26; ConfidenceScore=5.03e-01
NPCGVYSDLSSFTGSGVIQNSVAYIKRSAPSQKIVDQIPLSRFSSEFGRCSHWMTIKEKIFSTP

SEQ ID NO: 144894 - protein, 121 aa, Glycine max
  Coding DNA Sequence Number=SeqID_28116
  Gene Ontology: Mol. function=indole-3-acetic acid amido synthetase; Cellular component=cytoplasm; Biological process=auxin homeostasis
  Homolog annotation: Hit_ID=Q05680; Match level="QueryCoverage=99%, HitCoverage=20%, E-value=2e-45, Identity=78%"; Hit description=Auxin- responsive GH3 product
MRRKNVLLSIDIDKTDKVELHNTMENASVLLKKEFETSGVDYTSFVDMKVILGHYVIYCELLVKDASNTPTSEALEQCCLRMEESLNAVYRQCRVADHTIGPLEIIVVKNGTFEELMDYVI

SEQ ID NO: 144895 - protein, 61 aa, Glycine max
  Coding DNA Sequence Number=SeqID_28117
MKEVDESLKKFVEVTKKKMENKKKMEIKEAQEVKICEGIPVLKQMQLENSELFWKLDLFCD

SEQ ID NO: 144896 - protein, 65 aa, Glycine max
  Coding DNA Sequence Number=SeqID_28118
MVIVAVVGSVVNRHWSEINEDQWMYDSIMSEEVDMNDENEDKAGVNEEEHVDCSKAFNTSQVFAT

SEQ ID NO: 144897 - protein, 125 aa, Glycine max
  Coding DNA Sequence Number=SeqID_28119
MDRDHMVAIAALDTIPGFSSSATSTPCSCSRGHDHPTRDNDCSNIDDYPFNVFLQPDHYWEAGFEWDSRLIYMIDFGVDIGPIIATNDDIVMDVNEEPIHVESLALMLCCTSLSSHFPEDGLHHT

SEQ ID NO: 144898 - protein, 559 aa, Glycine max
  Coding DNA Sequence Number=SeqID_28120
  Gene Ontology: Mol. function=indole-3-acetic acid amido synthetase; Cellular component=cytoplasm; Biological process=auxin homeostasis
  Homolog annotation: Hit_ID=Q05680; Match level="QueryCoverage=99%, HitCoverage=100%, E-value=0.0, Identity=85%"; Hit description=Auxin -responsive GH3 product
  Pfam annotation: Domain name=GH3; Domain location=12-536; Score =1161.1; E_value=0; Accession=PF03321.4; Description=GH3 auxin -responsive promoter
MAIANCDDKNAKTLQFIEDMTRNTDSVQERVLAEILSQNAQTEYLKRFELNGATDRDTFKSKVPVVSYDDLKHDIQRIANGDRSPILCAHPITEFLTRYVADLDKGKALLFLFTKAETKTPSGLVARPVSASMYKSEQFKNRPYDPYNVYTSPNEAILCLDSFQSMYTQVLCGLIMRHQVLRIGANFASGLLRAIRFLQLNWAELAHDISTGTLNPKISDLPIKQRMTQILKPDPELADFIVKECSGENWESIIPRIWPNTKFVEVIVTGAMAQYIPTLDYYSGGLPIASNIYGSSECFFGINLNPFCNPSDVSYTIMPNMGYFEFLPHDHDDDDGALYSGSDSSSRLTDLADVELGKSYEIVVTTYSGICRYRVGDILRVTGFHNSTPQFSFVRRKNVLLSIDSDKTDEAELQNAVENASVLLKEFKTSVVEYTSFADTKSIPGHYVIYWELLMKDSSNAPTSEALEQCCLRMEESLNAVYRQCRVAEHSIGPLEIRVVKNGTFEELMDYAISRGASISQYKVPRCVSFTPITELLDSRVESVHFSPAEPHWTPERRR

SEQ ID NO: 144899 - protein, 86 aa, Glycine max
  Coding DNA Sequence Number=SeqID_28121
MVGYVPSSFADLVFTGKMIEAGLKRGKFDSPTLMSEKAGANEEDENEGETLAMTAIPTWSNFPSAQQCHYPANSSPSHPIIHKGHP

SEQ ID NO: 144900 - protein, 184 aa, Glycine max
  Coding DNA Sequence Number=SeqID_28122
MVCDDQAEMTGRLLTGSLTFDCPVMHYIIVRILLPCSSNLAQASDEDLILMWAFLTGRQIDWAHLANAPLPYPQLVTLFLCHFQIPLDDEPFVQVKRSFTIGAGAVTSFGYRKDRDDQWLKKDALPQQDERTPSPLPQRDDSSALMNEVLSELRGLRTYVGERFDSLDGRFEGMDTRITQLEEM

SEQ ID NO: 144901 - protein, 113 aa, Glycine max
  Coding DNA Sequence Number=SeqID_28123
  Homolog annotation: Hit_ID=Q1SYR3; Match level="QueryCoverage=78%, HitCoverage=4%, E-value=3e-08, Identity=36%"; Hit description=RNase H, putative
MPQHHLADFEPCLEYATKGQAVGGIPMPNTLEGPQYHLQTHLLHSTTGKNPHAMAEMGKLDHLEERLKAIEGGEDYAFANLEGLFLVPDIITPPKFKVPNFDKHKGTTCPKNH

SEQ ID NO: 144902 - protein, 307 aa, Glycine max
  Coding DNA Sequence Number=SeqID_28124
  Homolog annotation: Hit_ID=Q1SFC5; Match level="QueryCoverage=60%, HitCoverage=24%, E-value=2e-22, Identity=35%"; Hit description =Asp/Glu racemase
MGLIIPQDYAEEVANRSIEGQRALRLTPKTLDQNPQKLFLKYMRIFLSFDKFLPQHAPFISREVGPAWFTDYFPAVDPDNEEEVNEIWSFYLNPQILSCRTGVQSNYLGLVGYQPNLVSRQFGLSQIRPKSLFEDPRDVIRGANLSEKTFKKFLKISLDENYNLHPFEFNHSHFCTMGFVTWWEKYYSTRSVGDTTIMISRLESGFIQPTVENIRSNLQARGKTIMTKKSAETSRADVRPKKPTGVKIQEWKQEEKSQKKDDSIDTTTTSKRSKHAVVELDEEKDARRRGKTSYKKKKVTFDFDQVC

SEQ ID NO: 144903 - protein, 378 aa, Glycine max
  Coding DNA Sequence Number=SeqID_28125
  Gene Ontology: Mol. function=aminoacyl-tRNA ligase activity
  Homolog annotation: Hit_ID=Q2K445; Match level="QueryCoverage=38%, HitCoverage=80%, E-value=8e-48, Identity=65%"; Hit description =Hypothetical conserved protein
  Pfam annotation: Domain name=CHAD; Domain location=155-378; Score =170.0; E_value=6.1e-48; Accession=PF05235.4; Description=CHAD domain
  Pfam annotation: Domain name=CYTH; Domain location=2-149; Score =107.2; E_value=4.7e-29; Accession=PF01928.11; Description=CYTH domain
  Pfam module annotation: Pfam domain module=CHAD::CYTH; Domain location=155-378::2-149
MAKEIERKFLVAGGEWRDEVTHSMAFRQAYVASMENRSVRVRIVDGRDATLTIKIGASALVRDEYEYPIPLEDAEELMASAPGVVIEKTRHTVDHGGFTWEIDVFEGRYKGLIVAEVEMDDENADPDLPAWLGREVTGDRRFSNQIDPKKPFDDEIRRAGLELIEDTVTILRNRPSGPHEAVHDARKRFKRLRALYRLIRKAAPDFSREENARFRDIARSLAFARDATALVETAEYLEAFALSDTQGEALRSITAMLRARRDHAVKYEAALDEAISAAITGCEAGRERLKTLSLPDELKDSARLLRTSWARQRKRARQALADCHEQADVEHFHELRKAGQTYWMHLGLMRRIWPSAMRAKRADTKRLVDILGHEHDLS

SEQ ID NO: 144904 - protein, 211 aa, Glycine max
  Coding DNA Sequence Number=SeqID_28126
  Gene Ontology: Mol. function=catalytic activity; Cellular component =membrane fraction; Biological process=metabolic process
  Homolog annotation: Hit_ID=Q2K446; Match level="QueryCoverage=87%, HitCoverage=87%, E-value=4e-71, Identity=76%"; Hit description=4 -hydroxy-2-oxoglutarate aldolase/2-dehydro-3-deoxyphosphogluconate aldolase protein
  Pfam annotation: Domain name=Aldolase; Domain location=34-211; Score =229.9; E_value=5.6e-66; Accession=PF01081.9; Description=KDPG and KHG aldolase
MPRHQSRGRLIDKRDFNRFNRARRLILAQDSEKLLSILKLQPVVPVLIVDDAASAVPLARALVAGGLKAIEITMRTPAALDAIRAVAAEVEGANVGAGTILNAKDFEAAAEAGSTFIVSPGINKSVLEAARSSRVPLLPGAATASEVMALRDEGYKVLKFFPAEQAGGAPYLKALSSPLAGTVFCPTGSVSLKNANDYLSLPNVVCVGGSW

SEQ ID NO: 144905 - protein, 75 aa, Glycine max
  Coding DNA Sequence Number=SeqID_28127
LNFKVKTSLEALNFCRSKASRRCFDDAKGMRLNGSYWKLKVENGSWKLEVGSGSYWKLEVGSRSYWKLKVEVTGS

SEQ ID NO: 144906 - protein, 145 aa, Glycine max
  Coding DNA Sequence Number=SeqID_28128
MVLSANCLQKLTLTNNPSLISFPTDDCKKLSSLSEQIDLPLLKVLSLSGLPQLALFSPSFLPSGLEALVAEAAMLSSMYKHELGLLFQCLTPLTHLALCGLGEEDLLNTLLKELILPTSLWVLTLWCFNGLKLLEGKGLQHLTSL

SEQ ID NO: 144907 - protein, 110 aa, Glycine max
  Coding DNA Sequence Number=SeqID_28129
MAQSNSSWLGFPALITALCIARGVIPDSLTFESLSPTINLAYIKKNCWNLDDLTITFPGSRKARARGASNASTSTLAPTPALAPAPVPPPAPTTPSGPSTLSTNAIMLML

SEQ ID NO: 144908 - protein, 43 aa, Glycine max
  Coding DNA Sequence Number=SeqID_28130
MVGDKALVNISASCREDEIGRSLMRPMGSWLDKCDAEILEEIR

SEQ ID NO: 144909 - protein, 162 aa, Glycine max
  Coding DNA Sequence Number=SeqID_28131
  Homolog annotation: Hit_ID=Q1SFD6; Match level="QueryCoverage=49%, HitCoverage=6%, E-value=2e-09, Identity=33%"; Hit description =Integrase, catalytic region
MKEQNLEGNEQSSKHWYCVKRHHDDSPANMLGRVSFAWNVWVVRKKVPLGVRCLRVPVLWVVMMWVLQMSRIGHWKKKLGMVIEAMSRFNYTNLHTIVRILQHTRSGRKYQCTVSGRHKFGNGNDTEEVHDSGMGGMDMVAVRKLYYDWANVFIGMKIIEGG

SEQ ID NO: 144910 - protein, 106 aa, Glycine max
  Coding DNA Sequence Number=SeqID_28132
  Homolog annotation: Hit_ID=Q1SXX9; Match level="QueryCoverage=71%, HitCoverage=7%, E-value=7e-14, Identity=50%"; Hit description=Zinc finger, RING-type
MEQEGGLCDGKEVDQFHQPSGSNEVAIANEDGISYGSELIEVDKVKINQGDLLFGGDASDGALWDIFWRQDVPKLQEYLKKNFREFRYVHCCRLKQDWVKDQAANK

SEQ ID NO: 144911 - protein, 294 aa, Glycine max
  Coding DNA Sequence Number=SeqID_28133
  Gene Ontology: Mol. function=zinc ion binding
  Homolog annotation: Hit_ID=Q1RX12; Match level="QueryCoverage=51%, HitCoverage=16%, E-value=1e-42, Identity=55%"; Hit description=Zinc finger, RING-type; Transcription factor jumonji, jmjC; Cupin region; Zinc finger, FYVE/PHD-type
MNKRKPKKISFIPILVYGSNCFLIPQQKVVFEQCVTRTLSPALTLEEGLEKLKEALQILNYPSPSSPTVLRPSLCFAPNPTPPRSFLSFMYPRTTPTLNHSMSIWMIIFYTFVNEKRESFIMKIDLFQGYKLISFLRISYWVNILSELVCKAKELVQAYKLQNVVKTADNFCSCLKLDRNTDVSYSNMRKAASWEDLTDNYLFCSKAVDPQYKDLRHFQWHWEKGEPVIVSNVLECTSGLSWEPLVMWRALHHVTNTKHGQHLAEKTIDCLDWTELLNSIESSEQNVLEYFVKY

SEQ ID NO: 144912 - protein, 94 aa, Glycine max
  Coding DNA Sequence Number=SeqID_28134
  Subcellular localization annotation: CTP_CleavageSite=43; ConfidenceScore=5.41e-01
MTGVSLGVRTGSYGTLLQQQNGTVSPKPLLVRRPSKTLLYNPREKERGFFFVCRLLGRGKVAMLLMLALGLCVFVFGCFTVYRVIKVFMIDTPR

SEQ ID NO: 144913 - protein, 168 aa, Glycine max
  Coding DNA Sequence Number=SeqID_28135
QKVYTDNHLGISARQRDSNVSMTDLVSAKDDVNLRIQQKVYTDNHSGISARQRDSKVSMTDLVSVEDDGAEDDISLCVLSGFSSYRQQKVYTDNHSGISARQRDSKVSMTDLVSAEDDGAEDDVSLCVLSGFSSYRQQKVYTDNHSGISARQRDSKVSMTDLVSAEDD

SEQ ID NO: 144914 - protein, 408 aa, Glycine max
  Coding DNA Sequence Number=SeqID_28136
  Gene Ontology: Mol. function=nucleic acid binding; Cellular component= chromatin; Biological process=DNA integration
  Homolog annotation: Hit_ID=Q1SRN1; Match level="QueryCoverage=99%, HitCoverage=31%, E-value=1e-121, Identity=50%"; Hit description =Integrase, catalytic region
MITRYKDGIVQPRIHPSLLLAHAEPKSVKQALQDSKWHTAMTGEFNALQRNNTWTLVPLPPNRNAIGCKCVFRVKENSDSSVKKYKARLVAMGSDQKFGFDFHETFYPVIKPVTIRLILTLAINHKWPLQQLGVNNAFLNGFQEEEVYMTQPPGFESSDKSLVCKLQKAIYGLKQAPRAWFERLKSTLLQFGFTDSKCDPSLYKTSSTIIYILVYVDDIIITGNSSSLVEKLIQKLNATFSLEQLGSLDYFLGIEISVEALQYLTITHPELSFAVNKVCQFMSSSLESHYTTVKRILRYLKGALHSGLVLYPVLSHQPLSIGAFCDSGWALDPDDRRSNSGAAVYKAVVSRSSTEAEYTSLAAATADILWIQTLLQELAVPHSTPLVLCDNPVLHARAKHMELDVFFC

SEQ ID NO: 144915 - protein, 52 aa, Glycine max
  Coding DNA Sequence Number=SeqID_28137
MVLGSYCFGLCRFGFRGLCDDWVLVVGGVGSRRRRGALSGGSRRRRGALSGG

SEQ ID NO: 144916 - protein, 76 aa, Glycine max
  Coding DNA Sequence Number=SeqID_28138
  Homolog annotation: Hit_ID=Q1SS72; Match level="QueryCoverage=99%, HitCoverage=5%, E-value=5e-10, Identity=47%"; Hit description =Integrase, catalytic region
MARPEIKILVGRSSEDFRSPTRSLNTETRSTLGNGILHSTAYSIQSALATLDVLAPPSPSLHKESLKIEPCSSCVA

SEQ ID NO: 144917 - protein, 71 aa, Glycine max
  Coding DNA Sequence Number=SeqID_28139
MQRHPKGPLKNWFIRGWPTQLYKHLSSLLNIRCGTILNTPPRARARHHKTRAGDTHRTEYSSDTMLKEILG

SEQ ID NO: 144918 - protein, 471 aa, Glycine max
  Coding DNA Sequence Number=SeqID_28140
  Gene Ontology: Mol. function=RNA-directed DNA polymerase activity; Cellular component=chromatin; Biological process=chromatin assembly or disassembly
  Pfam annotation: Domain name=Chromo; Domain location=412-459; Score =21.4; E_value=0.003; Accession=PF00385.14; Description='chromo' (CHRromatin Organisation MOdifier
DVGLEFFSTPTINELLDELHGSHYFSKIDLKFGYCQICTKEQDVPKTAFGTHEAPLGMITYLILLKLSFLYHHQLVANHKKCLFGLTSIEYLGHIISARGVNMDPSKVQAVLDWPIPRTAKEEIMALALSVQHWRHYLFSRSFKVIYRLGPENKAADALSCQFKLAELNVVSISPYWVDFPKLREEEYTPDLPRLTNGWQQPSVGKISLRILLLDFPFYSQNSCREFHQRLQGTVLRMSTTHHPQTDGQTEAVNHGLETILRCFTSEQPTNGIPSYLGQNSGTKLLPIQLPPNLPLRETQVESVASVLIDCNEALCQLKYHLNRVLQTMKKHLDAHHQQVTYIVVDWVYVKLRPHRQHSVARRINPKFYPQYLGPFLVISQIGEVAYKHSLNRGYVPVALPPGMEVEDPEIPQPEAVIATQLSSTLEWSILWKLQPVEEATWETAASIKDKFPSFWLEDKADFVADDIDEN

SEQ ID NO: 144919 - protein, 165 aa, Glycine max
  Coding DNA Sequence Number=SeqID_28141
  Gene Ontology: Mol. function=catalytic activity; Cellular component =nucleus; Biological process=regulation of transcription
  Homolog annotation: Hit_ID=Q70I19; Match level="QueryCoverage=60%, HitCoverage=27%, E-value=1e-21, Identity=51%"; Hit description=TCP -domain protein
  Pfam annotation: Domain name=TCP; Domain location=22-164; Score=74.9; E_value=2.6e-19; Accession=PF03634.4; Description=TCP family transcription factor
MDNMGVERGYDYCPAKKGPSVMKTKKPCSKGNKKDCHIKVNGRDRRVRVSTICAARIFQLTCELGNKTNGETIEWLLRQAEPSIIAATGTGIMPSNTTVANNTSSIISATCANFLPSNNTTLVPPNTIVTQDSNLVTNVASARIEQQIPPFDFDFDWLQHSDLGF

SEQ ID NO: 144920 - protein, 145 aa, Glycine max
  Coding DNA Sequence Number=SeqID_28142
  Gene Ontology: Mol. function=transferase activity, transferring glycosyl groups; Cellular component=glycosylphosphatidylinositol-N -acetylglucosaminyltransferase (GPI-GnT) complex; Biological process =biosynthetic process
  Homolog annotation: Hit_ID=Q9M1U9; Match level="QueryCoverage=78%, HitCoverage=36%, E-value=3e-40, Identity=53%"; Hit description=N -acetylglucosaminyl-phosphatidylinositol-like protein
MSSYRKPVPREIYFQRHNSYIHLKVRFIIGVDGPKHVRLEEMREKHSLQDRVEMLGAVQHVLPDEMIVLAEPDPGDMVHAIQKAISMLPKIDPQAMHNRMRELYNWHDVAKRTEIVYDRAFKCSNQNLLERLSRYSLNIIGTIYL

SEQ ID NO: 144921 - protein, 223 aa, Glycine max
  Coding DNA Sequence Number=SeqID_28143
  Gene Ontology: Mol. function=nucleoside-triphosphatase activity; Cellular component=integral to membrane; Biological process=transport
  Homolog annotation: Hit_ID=Q9ZUU9; Match level="QueryCoverage=99%, HitCoverage=37%, E-value=8e-36, Identity=41%"; Hit description=White- brown complex homolog protein 3
MSLGDHANKLIGGHCYMKGLPSGERRLVSIARELVMRPQPFLLNVCYLSIFLKCLSTFNDGYIEETCKHWLHSHIDHLSEQHRSLWPFLPHMSTFKWKHPLLWRNISLLADFDRIIAMCKNWQDDNGDFSSVNMDTAVAIRTLEATYKSSADAAAVETMILKLAEKTRVAAIFVFASFSSLLSIARVPALKKEIKFVHLASIFIWLSHDLLNAVLNYNSRSSS

SEQ ID NO: 144922 - protein, 206 aa, Glycine max
  Coding DNA Sequence Number=SeqID_28144
  Gene Ontology: Mol. function=transferase activity, transferring glycosyl groups; Cellular component=glycosylphosphatidylinositol-N -acetylglucosaminyltransferase (GPI-GnT) complex; Biological process =biosynthetic process
  Homolog annotation: Hit_ID=Q9M1U9; Match level="QueryCoverage=92%, HitCoverage=42%, E-value=2e-84, Identity=80%"; Hit description=N -acetylglucosaminyl-phosphatidylinositol-like protein
  Pfam annotation: Domain name=PIGA; Domain location=10-99; Score =238.8; E_value=1.2e-68; Accession=PF08288.2; Description=PIGA (GPI anchor biosynthesis)
MSIQVVVATHAYGNRSGVRYMTGGLKVYYIPWSPFVMQNTLPTFYGLLPIIRTILIRERITVVHGHQAFSTFCHEALMHARTMGYKVVFTDHSLYGFADVGSIHMNKVLQFTLADVSQAICVSHTSKENTVLRSGLPPEKVFVVPNAVDTAIFKPAVDRPSGSEIVIVVISRLVYRKGVDLLVEVIPEVCRLHPNEIWALTSWKKC

SEQ ID NO: 144923 - protein, 229 aa, Glycine max
  Coding DNA Sequence Number=SeqID_28145
  Gene Ontology: Mol. function=transferase activity, transferring glycosyl groups; Cellular component=glycosylphosphatidylinositol-N -acetylglucosaminyltransferase (GPI-GnT) complex; Biological process =biosynthetic process
  Homolog annotation: Hit_ID=Q8LIL5; Match level="QueryCoverage=70%, HitCoverage=36%, E-value=2e-67, Identity=80%"; Hit description =Putative Phosphatidylinositol N-acetylglucosaminyltransferase
  Pfam annotation: Domain name=Glycos_transf_1; Domain location=2-165; Score=42.5; E_value=1.5e-09; Accession=PF00534.10; Description =Glycosyl transferases group 1
MPSYRKPVPREICNDIGMIWISFFLVIIDFQRHNSYIHLKVRFIIGGDGPKRVRLEEMREKHSLQDRVEMLGAVQHVQVRSVLISGHIFLNSSLTEAFCIAILEAASCGLLTVSTRVGGVPEVLPDEMIVLAEPDPGDMVHAIQKAISMLPKIDPQAMHNRMRELYNWHDVAKRTEIVYDRAFKCSNQNLLERLSRYSLNIIAIGIMAEYQKNTSAVNTNPSSQILKWR

SEQ ID NO: 144924 - protein, 342 aa, Glycine max
  Coding DNA Sequence Number=SeqID_28146
  Gene Ontology: Mol. function=RNA-directed DNA polymerase activity; Cellular component=chromatin; Biological process=chromatin assembly or disassembly
  Pfam annotation: Domain name=Chromo; Domain location=283-332; Score =16.0; E_value=0.013; Accession=PF00385.14; Description='chromo' (CHRromatin Organisation MOdifier
MALALSVQHWRHYLFSRSFEVIYRLGPENKAADALSCQFKSAELNVVSISPYWVDFPKLREEEDTPDLPRLTNGWQQPSIGKWHKYQAMSPTDLLQSIPILEVVWTDISMDFITGLPLLQPKQLQKVSSEMWPNCTSPPITPKPMGRRNNQPMVFLVIRAKFWYNTSSHSASTKSPFEVVYVESVASVLIDCDEALYQLKYHLNRVLQTMKKHVDAHCRHVTYVVGPFLVISKIGEVAYKVKLLDSARIYPVFHVSQLKRSLNRGSVAAALPPGMEVGDPEIPQPEAVIAMQWSSTLEWSILWKSQPVEEVTWEIAASIKDEFPSFCLEDKADFVADDIDEN

SEQ ID NO: 144925 - protein, 168 aa, Glycine max
  Coding DNA Sequence Number=SeqID_28147
  Subcellular localization annotation: CTP_CleavageSite=7; ConfidenceScore=5.02e-01
MPISPCRCIGIAPTRRPVGPKKSNRALGFPALVRGLCQSYRVPVPPARSCHRDIGIAPTKTPSGSGEVQQGPGGSRLQDTQWTRRSPTRSWSCQALITGLCQFYGVLVTSGKGIRPPTNRAFIKKYCVPRQAQGETPQQPGRNTITSRVHLSSSTKRLERCLRPMADQ

SEQ ID NO: 144926 - protein, 213 aa, Glycine max
  Coding DNA Sequence Number=SeqID_28148
MKNTLENGGFHWENNKYHISQSRGSALGGEEHIGEWRNPIGKITNITFPSQEGPLLTVKNTLENGGFNRENNKDHISQSRGSALDGEEHIGEWRNPIGKITKITFPSQEGPLLTMKNTLEMEDSIGKITKITFPSQEGPLLTVKNTLENGGFNRENNKDHISQSRGSALDGEEHIGEWKNPIGKITKITFPSQEGPLLTVKNTLENGGIQSGK

SEQ ID NO: 144927 - protein, 107 aa, Glycine max
  Coding DNA Sequence Number=SeqID_28149
  Gene Ontology: Mol. function=nucleic acid binding
  Homolog annotation: Hit_ID=Q1S9T9; Match level="QueryCoverage=63%, HitCoverage=5%, E-value=3e-17, Identity=56%"; Hit description =Peptidase S8 and S53, subtilisin, kexin, sedolisin; Integrase, catalytic region; Zinc finger, CCHC-type
MAQGGETLHDEINLQQVASEMTMRWPLNEKRKNAIIFCDSSSAIYLAKYQIHHEKTKHIDIKYHFICTEKRVKVQKVYKRDNPVDMFTKPIPRSKFMHYLDLFNIDC

SEQ ID NO: 144928 - protein, 380 aa, Glycine max
  Coding DNA Sequence Number=SeqID_28150
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=1e-47, Identity=30%"; Hit description= UPI00006A17C9 related cluster
GQHVLALRGLHPLAFRGLHVLTLRGPHVLTFRGQHAFAFRGLHILASRGQHVLSLRGLYILAFRGLHVLAFRGLHVLALRGLHVLSIRGLYVFAIRGLHVLAFRGLHLLDFRGLHDRAFRELHFLSIRGLHVLAIRGLHVLAFRGLHLLDFRGLHVLTFTGLYLLAFRGLHVLAIRGLQVLAFRRLHVLAFRGLHFLAFRGLHPLDFRGLHVLTFTGLYLLAFRGLHVLTFRGLQVLAFRGLHVLAFRGLHVLDFRGLHVLAFIGGLHILAFRGLHFLSFKGLHVLAFRRLHVLAFRGMHVLTFRRLHVLAFRVLHVLTFRRLHVLAFRVLHALAFRGLHFLTFRRLHILAFRGLHVLAFRRLDVLAFTELYVLAIRGLH

SEQ ID NO: 144929 - protein, 1406 aa, Glycine max
  Coding DNA Sequence Number=SeqID_28151
  Gene Ontology: Mol. function=RNA-directed DNA polymerase activity; Cellular component=chromatin; Biological process=chromatin assembly or disassembly
  Pfam annotation: Domain name=Chromo; Domain location=1301-1349; Score= 25.1; E_value=0.00025; Accession=PF00385.14; Description='chromo' (CHRromatin Organisation MOdifier
  Pfam annotation: Domain name=rve; Domain location=996-1152; Score =94.5; E_value=3.3e-25; Accession=PF00665.16; Description=Integrase core domain
  Pfam annotation: Domain name=zf-H2C2; Domain location=937-978; Score =21.3; E_value=0.00053; Accession=PF09337.1; Description=His(2) -Cys(2) zinc finger
  Pfam module annotation: Pfam domain module=Chromo::RVT_1::Retrotrans _gag::rve::zf-H2C2; Domain location=1301-1349::559-728::105-195::996 -1152::937-978
MADQPHSTSSSPLETAILKLTTLQVSLGETVHSMAQKFDELLLRLPSTSPSPSPQPPPSISPVPAHHHRMKLDIPRFDGTDPFGWVFQINQYFQYHATPEHDRLTIVSFYMDARALAWFQWMATNGQLTSWPAFIQALQTRFAPSHYDDPTGSLFKLTQRGSVTQYLSEFEELANRIVGLPPQFLLSCFISGLTPEIRREVQSLQPLTLVQAAGLARLQEEKLLDTRSSFRNRAPLVLSVPPPRQSSTPALLQAPSSPATSSRPPPVKRLSPAEIASRRERGLCFTCEEKYHRGHICASRVFLLVAAEDDNSDPLIEDLDPGPNPPDSPNPTAAQISFNSLSGNLAPKTLRLLGLASGHHTTTPLRVLVGNGQHLACSSWCPRVILTIQDLTCDVDLYVLPIAGANIVLGVQWLKTLGPVLTDYSLMTMKFFYDQRLIELRGDTDLIINMLTPPQLRRFLKLNEHASCFHIAVLTEAVPDEPSQSLDPQIQALIDHFGPLFQTPTSLPPARITDHHIHLLPQATPVNVRPYRYPHYQKQEIELQVESMLQKGLIRPSTSPFSSPVLLVRKHDHSWRFCVDYRALNAITIRDRFPIPTIDELLDELGHACWFSKLDLLQGYHQIRMHSLDIAKTAFRTHHGHYEFKVMPFGLCNAPSTFQATMNMLFRPFLRRFLIVFFDDILIYSITFTDHVLHLQQDFQVLLDNQFVLKLSKCTFAQPEVEYLGHVVSQRGVEPVSSKVDAVRQWPLPQSAKALRSFLGLAGFYGRFIKGYATIAAPLVAATIIEPFQWTPSAQVAFDQLKQALSEAPVLTLPNFQLPFTVETDASDIGMGAVLSQKGHPIAYFSKQFPPKLRHSSTYVRELFAVTSTTPEQHTYLARLMGYDFQIQFRSGATNQAADALSRISEEDISNNLILRKGRIWLPPHLPLLPTLLTEYHATPTGGHLGVTKTIARLTDNFYWDGLRDDVARFISTCLDCQHSKYETKRAADLLCPLPVPHRPWEDLSLDFITGLPVFQGNTTILVVVDRFSKGIHLGMLPTSHTTYTVAALFMNIVGKIHGLPRSMIFDRDPLFLSRFWQDLFRLSGTHLRMSSSYHPQSDGQTEALNRVIEQYLRAFIHRRPSSWGKLLLWVEWSHNTSWNAATGSTPYEITFGKKPFNYPDYLAGDSKLDVVDDMLTNREDTFRLIRKKLLKAQELMKKYADAKRRDVEYQVGEWVMVKLRPHRQTSAKPSSSSGKLQKRFYGPFEITERIGPVAYRLKLPEGARIHPVFHCSILKPFKGSPASADSVFLPDQFAHDQLTVSPLAILDYRYNSDNPESPWEVLVQWEGLDLDETSWESWTQLSRDYHLEGKVNFQGPWDDRERGVQQVTEVQQANPRQGTNSNTETQTEGRAKRVINKPSYLKDFV

SEQ ID NO: 144930 - protein, 221 aa, Glycine max
  Coding DNA Sequence Number=SeqID_28152
  Homolog annotation: Hit_ID=Q5H2N1; Match level="QueryCoverage=24%, HitCoverage=11%, E-value=1e-21, Identity=89%"; Hit description =Chloride channel
MTCGMPLPRVGFSTPEVSHANNAKMPGVSSRAHHGECEVMRWNRWKAASLALANRMATSATATAPPQSAARRRQASLRTSAVIRPRRRWRSVMRGSLDAAEEGGQRLLWLKALQDAVKCPAMDPADSLPRACTARRAGAPATGAFPRCARWAAAAATPDRAADVPTHHRSHHRSGLLPDAHFAMAHARQVALRFQYAAHDQFAHALGVEDIGNAGAALRVQ

SEQ ID NO: 144931 - protein, 71 aa, Glycine max
  Coding DNA Sequence Number=SeqID_28153
MEGKGNLSKLDGFLCEDLDDPLEIFQYTPEECPNTRNCNRKNLALNCSITTNLTEQLRSSMLVCFLKLSMC

SEQ ID NO: 144932 - protein, 224 aa, Glycine max
  Coding DNA Sequence Number=SeqID_28154
  Gene Ontology: Mol. function=N-acetylmuramoyl-L-alanine amidase activity; Biological process=peptidoglycan catabolic process
  Homolog annotation: Hit_ID=UPI00005F75F1; Match level="QueryCoverage =72%, HitCoverage=86%, E-value=2e-70, Identity=71%"; Hit description =COG3023: Negative regulator of beta-lactamase expression
  Pfam annotation: Domain name=Amidase_2; Domain location=17-175; Score= 194.1; E_value=3.3e-55; Accession=PF01510.15; Description=N -acetylmuramoyl-L-alanine amidase
MKLEHGWITSARKVPSPHFNARPDNEAPSLLIIHNISLPPGEFGGPWIDRLFTGTLPADAHPYFADIAQLRVAAHCLIRRDGELVQYVSFDQRAWHAGISQFAGRENCNDFSMGIELEGTDTLPYTDAQYATLQQVTRLLMQHYPLTPQRITGHSDVAPERKTDPALLVAAYAADDRDRHAAGLAGGVEPEGHSVWRGAAAVLDCGRFAVHWCRLGAAALPPVS

SEQ ID NO: 144933 - protein, 65 aa, Glycine max
  Coding DNA Sequence Number=SeqID_28155
  Gene Ontology: Mol. function=nicotinate-nucleotide diphosphorylase (carboxylating) activity; Biological process=pyridine nucleotide biosynthetic process
  Homolog annotation: Hit_ID=P30011; Match level="QueryCoverage=93%, HitCoverage=20%, E-value=6e-11, Identity=59%"; Hit description =Nicotinate-nucleotide pyrophosphorylase [carboxylating]
MVSRRYNPEHRRQELLKRIQLDIPETVARALQEDLGGDVDADRDITAQLLPQAAQAEARVITREA

SEQ ID NO: 144934 - protein, 329 aa, Glycine max
  Coding DNA Sequence Number=SeqID_28156
  Gene Ontology: Mol. function=transporter activity; Cellular component= membrane; Biological process=sodium ion transport
  Homolog annotation: Hit_ID=UPI00005F8C69; Match level="QueryCoverage =93%, HitCoverage=66%, E-value=1e-154, Identity=83%"; Hit description= COG2211: Na+/melibiose symporter and related transporters
  Pfam annotation: Domain name=MFS_1; Domain location=19-320; Score= -32.1; E_value=0.0093; Accession=PF07690.6; Description=Major Facilitator Superfamily
MGAIADRTQSRWGRFRPWLLWISLPYVLFSVLMFTTPDWSYDNKVIWAFVTYFLMSLTYTAINIPYCSLGGVITNDPGERVSCQSYRFVMVGIATLILSLSLLPMAEWFGGDNKARGYQLAMSVLALIGLVMFLFCFATVRERIRPAVPSNDDLKKDLRDVWKNDQWVRILLLTFCNVCPGFIRMAATMYYVTWVMGQSTHFATLFISLGVIGMMLGSTLAKVLTDRWCKLKVFFWTNIALALFSSGFYWIDPHATVTVVIAYFLLNILHQIPSPLHWSLMADVDDYGEWKTGKRITGISFSGNLFFLKVGLAVAGAMVGGEAAVCQRA

SEQ ID NO: 144935 - protein, 180 aa, Glycine max
  Coding DNA Sequence Number=SeqID_28157
  Gene Ontology: Mol. function=transcription factor activity; Cellular component=intracellular; Biological process=regulation of transcription, DNA-dependent
  Homolog annotation: Hit_ID=Q8D1B5; Match level="QueryCoverage=100%, HitCoverage=64%, E-value=8e-87, Identity=89%"; Hit description =Transcriptional regulator for pyruvate dehydrogenase complex
  Pfam annotation: Domain name=FCD; Domain location=99-180; Score=24.6; E_value=5.8e-05; Accession=PF07729.2; Description=FCD domain
  Pfam annotation: Domain name=GntR; Domain location=11-74; Score =101.4; E_value=2.6e-27; Accession=PF00392.11; Description=Bacterial regulatory proteins, gntR f
  Pfam annotation: Domain name=HTH_11; Domain location=18-73; Score =2.0; E_value=0.055; Accession=PF08279.2; Description=HTH domain
  Pfam module annotation: Pfam domain module=FCD::GntR::HTH_11; Domain location=99-180::11-74::18-73
MAYSKIRQPKLSDAIEQQLESLIMEGTLQPGEKLLPERELAKQFDVSRPSLREAIQSLEAKGLLLRRQGGGTFVQQNLWQSLSDPLVGLLAEHPESQFDLLETRHALEGVAAYYAALRGTDEDLQRIRDCHVNIQQAQDSGDLDAEADAVMKYQIAVTEAAHNVVLLHLLRSMGPMLEQN

SEQ ID NO: 144936 - protein, 69 aa, Glycine max
  Coding DNA Sequence Number=SeqID_28158
MAYKSKVFLNKETEAAAELHRIGKEGEGRWMKNRNLLKLERSAYKSCSFRAPRLRNLKMAKWKGASLDG

SEQ ID NO: 144937 - protein, 175 aa, Glycine max
  Coding DNA Sequence Number=SeqID_28159
  Homolog annotation: Hit_ID=Q1T493; Match level="QueryCoverage=59%, HitCoverage=19%, E-value=5e-08, Identity=26%"; Hit description =Nucleic acid-binding, OB-fold, subgroup
  Pfam annotation: Domain name=Rep_fac-A_C; Domain location=1-122; Score=-52.0; E_value=0.0043; Accession=PF08646.1; Description =Replication factor-A C terminal domain
MDNHSWCYPACAQCHRKTDIQTGPFTCGCGKDNDQPVLRYRVEIMVTQNNESGKFLLWDCEYAEFIGQTADDVNRVKIEDGDLDLNASPQALDKLLGHVLAFKARIQSRFKNAVVLRYSKDLDLINAVLEMLPDSEVFFSDIYFSRYCHDDMIHEFDYHQLIYGASMFQNRSFQC

SEQ ID NO: 144938 - protein, 86 aa, Glycine max
  Coding DNA Sequence Number=SeqID_28160
MGLLANRHWQWRVCCTEEPTIPIGDFAMHGGTASQTGEFVAGEAQPTCRLRVQATCCSRDRLGAEGKNSPLVQASCSFGAGKNSPV

SEQ ID NO: 144939 - protein, 143 aa, Glycine max
  Coding DNA Sequence Number=SeqID_28161
MATSLVHPEEPARTLQRTVEWILPTPTPYLLVEPVQVIEVTSSEEDPEEDPEELPPEPVVDALDFLEGDEDPLPEVDSPEDVMSASEADSTEESGPGGIATSGDLLYRNLMNVYMWLKPPHWTPLLWMTLCILQNSHILDNFR

SEQ ID NO: 144940 - protein, 73 aa, Glycine max
  Coding DNA Sequence Number=SeqID_28162
MTSRKRARTDDIPSSSILAPQLSAIGPDVQHSQTLVSMLQSLFKGQLLIMYSLQELAHNRPIIPMEHFLEQVA

SEQ ID NO: 144941 - protein, 128 aa, Glycine max
  Coding DNA Sequence Number=SeqID_28163
  Gene Ontology: Mol. function=serine carboxypeptidase activity; Cellular component=mitochondrion; Biological process=proteolysis
  Homolog annotation: Hit_ID=Q5Z5A3; Match level="QueryCoverage=73%, HitCoverage=18%, E-value=7e-22, Identity=52%"; Hit description =Putative serine carboxylase II-3
MKKVCSNFQGKDNAPPPPPQWIEAKFFFNGTPLDTDTITTLRKKWAAYFLEDGKWIYIQVYIGNHKVGVHSDGHAVTSLSMKTTEGPFSTGFLKLNLNHRRSLSFSGSVEDPDAPLLGMVQLLRLDLL

SEQ ID NO: 144942 - protein, 66 aa, Glycine max
  Coding DNA Sequence Number=SeqID_28164
MQAPVAVNKARKARRIFPAGTGREGWPSPLRKDAFPDCGRDTGALLLGCAKLAAHHLPHAEYGERK

SEQ ID NO: 144943 - protein, 102 aa, Glycine max
  Coding DNA Sequence Number=SeqID_28165
EVQEQMKADMEAMKEQMATMMEVMMSMKMIMEANAVAVVATSTVAKVNPTPPSGLNQMNHPTSDMHAFPPYGLPPNYTPPNVVYTPGEDVKSDNPALINAKN

SEQ ID NO: 144944 - protein, 162 aa, Glycine max
  Coding DNA Sequence Number=SeqID_28166
  Gene Ontology: Mol. function=DNA binding; Biological process=DNA integration
  Homolog annotation: Hit_ID=Q1S3H4; Match level="QueryCoverage=71%, HitCoverage=24%, E-value=5e-31, Identity=49%"; Hit description =Integrase, catalytic region
MSPYQVVFGKACHLPVEIEHKAYWAVKTCNFSIDQAGKKKKLQLSELDEIRLEAYENAKFYKEKTNKFHDCMIIKKDFMVGQKVLLYNSRLGLMSVEIISDSTNKSFKVNGHRLKSFLTNPSLVDVVVEKTSLHFLHHDLGSSSFPIFFFAFITFVRFYLMV

SEQ ID NO: 144945 - protein, 181 aa, Glycine max
  Coding DNA Sequence Number=SeqID_28167
  Gene Ontology: Mol. function=nucleic acid binding; Biological process= DNA integration
MALIVKGDRFNLNQCPENELEREQMRNIPYAFVVGSLMYTEVCTRPDIAFVVGMLGRYQSNLGIEHSTTTKKMLRYLQGTKDYKFIYQRSDNLEIVGYSDSDFAGCIDSRSLHFDGKTIEIEVSGGRRAVLEPCHLRNQISVDDAKVEVGVEECVHHDVIAKLEDLQGEDGAQEEDQRERE

SEQ ID NO: 144946 - protein, 159 aa, Glycine max
  Coding DNA Sequence Number=SeqID_28168
  Subcellular localization annotation: CTP_CleavageSite=52; ConfidenceScore=5.12e-01
MSSSICHLSFKQLMQGQKYFPSSSVNFFQKQIARTDQRLPHMQGSFQSLIISDDKNEVPILTGETYKQWKERVLLHLGVADLDYALHRDDIRGSIPECQKVKDFVEAIDEQFESSEKALEEEGRLAQEIGEGALSETQDKRKKERKEKNHILPIAKIKK

SEQ ID NO: 144947 - protein, 378 aa, Glycine max
  Coding DNA Sequence Number=SeqID_28169
  Gene Ontology: Mol. function=DNA binding; Cellular component=nucleus; Biological process=regulation of transcription
  Homolog annotation: Hit_ID=Q6ZI65; Match level="QueryCoverage=97%, HitCoverage=86%, E-value=3e-68, Identity=41%"; Hit description=No apical meristem (NAM)-like protein
  Pfam annotation: Domain name=NAM; Domain location=10-150; Score =119.2; E_value=1.2e-32; Accession=PF02365.6; Description=No apical meristem (NAM) protein
MKVAQEWPGLPKGVKFDPSDQEIIWHLLAKVGVGDSKPHPFIDEFITTLEVDDGICYTHPQNLPGVKQDGSASHFFHRAINAYNTGTRKRRKILGQDFGDVRWHKTGRTKPVVFNGIQKGCKKIMVLYVSNVRGGRAEKTNWVMHQYHLGTEEDEKDGEYIISKVFYQQQQVKLGDKDDKDVPEATEINESTIVKVDPVTPKFVTPETPCNERWCADLDLGQETHNSPQLPQMDCLDEIQADYQDLANESSMVETQHNEGMDDKEKNTEEGQKWWDSESQNLLDSQQLVEALSLCDDLLQSQSPSRDGKHEDHKNQPGLSVYAQLGPENLKKDIEECQNLALDKANIENDTPSEFRLSQLEFGSQDSFISWGYGKAVN

SEQ ID NO: 144948 - protein, 144 aa, Glycine max
  Coding DNA Sequence Number=SeqID_28170
MDKSLEVGEEEWREKERGSMKFVPQKSLLSNALGGRIASKTTSTLLAGQQVFHQVKDIITIFGKTQKKDASNKNIWKKSRAKRTLWAQHASTAKRSISTLSVTRESERAQESRLRAKCEIISLSETFVSCQAQRTTGAKPKSTY

SEQ ID NO: 144949 - protein, 72 aa, Glycine max
  Coding DNA Sequence Number=SeqID_28171
  Homolog annotation: Hit_ID=Q6IM95; Match level="QueryCoverage=46%, HitCoverage=85%, E-value=2e-10, Identity=85%"; Hit description=DVL6
MDSKVVRVGSNWCLSGGFGGTALPFMPHHWPFTRPRLKEEDIIQQRNWRSPQRAKGKAIHYKKMCCHAPLLA

SEQ ID NO: 144950 - protein, 70 aa, Glycine max
  Coding DNA Sequence Number=SeqID_28172
MGCYSNGSGDSSGEMVVVAATTVVRSNGGGCGGNDNVVVVEARNVMCNGGGMVEAIMVVTTRLIAMISLL

SEQ ID NO: 144951 - protein, 130 aa, Glycine max
  Coding DNA Sequence Number=SeqID_28173
MQQPIPGCPSQPLNIHGITLKGKHDENCEQLFTPMIGQWNNQVDFRVDETLQYMVSPQGRNTWTVDDLVPYVEKITILMKEQERITEPVSHGPASEHQFPAQEFHILQSSVETQGIGRRRVAVEVEEYSQ

SEQ ID NO: 144952 - protein, 299 aa, Glycine max
  Coding DNA Sequence Number=SeqID_28174
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=95%, HitCoverage=31%, E-value=8e-23, Identity=36%"; Hit description=Chromo
  Subcellular localization annotation: CTP_CleavageSite=75; ConfidenceScore=5.24e-01
MALLDMSVSTMNGSMKLGRARTGALVIAVLSRSKAALEATVHSNASLHNSVVQLPCLKPRALNTPIGSVRINTWHASSRTGLVAMFERLFPDAGYGMIGVHGNLKVGGCVAQPERSSLENHDACPNSSSNSSIVGIGNRSRMVTEFNAREKIKNLLLYFGFLEVQIAGKDLFDELLPAAAEGWSEFGKGVGNGGAMLRWLELGEEDVVLPNCYVYMKLNCMAQMTEFHDKRGVVNSYWPKLLQPFYAEDCISATYRKQMKGDLAGRVEYLDKGNVGLEKIVGAPTTNKDSEASMIKHGD

SEQ ID NO: 144953 - protein, 98 aa, Glycine max
  Coding DNA Sequence Number=SeqID_28175
MVDHATKKTTTDRLEDAIAHLSNSQASLTNKYTKLSGKIRREVLAIQPISLPQATALEKLQEDKLRDRRPSSQCPNNFPSPSSHHTNSNLRPKPPFVQ

SEQ ID NO: 144954 - protein, 373 aa, Glycine max
  Coding DNA Sequence Number=SeqID_28176
MTTLPVSPPPPPVDVTYDTWKEVPVAQKDLIWEDIQTEFEIPEAFDSRTKKKVLQIVGERWRKFKSDLTRKWALAADKDEHMLVAKKTKKRLEEAAQSGSTEGVIDPPSPIKRYDLLTAAIGQPKHPGRVPAAGANVTIKQYFGLAPRNSHSSSFMPPEELEQLTQQIRDQLEELITEKGFAMPPEPEVGPSATHVSTKGSCVDPSPTDPEMGDSVKYGLYIEDNPSLLVKDAEAPVPVPTDEVIFVGQALNTFHAWPTHLVKRPSEQAAVSQQNLQICGILPCSGPDNYLKGIINSVLKGLDDTPQPKSKDGARWIIVKCYRQKGTTECGYYIMHWMSTIILGTFKNNWETYFNDVRPLEAERLKVLRIQRA

SEQ ID NO: 144955 - protein, 475 aa, Glycine max
  Coding DNA Sequence Number=SeqID_28177
  Gene Ontology: Mol. function=RNA-directed DNA polymerase activity; Cellular component=chromatin; Biological process=one-carbon compound metabolic process
  Pfam annotation: Domain name=zf-H2C2; Domain location=366-403; Score =13.5; E_value=0.0058; Accession=PF09337.1; Description=His(2)-Cys(2) zinc finger
  Pfam module annotation: Pfam domain module=RVT_1::zf-H2C2; Domain location=1-152::366-403
MCVDYRALNSVTIRDRFPIPTIDELLDELGHASWFSKLDLRQGFHQILMHKLDIEKTTFRMHNRHYEYRVIPFRLCNAPSNFQVAMNTLLSPFLRCFATAFFDDILLYSDSLSSHIQHLETIFQTLLQGQFYLKHAKCLFAQNQLEYLGHVVLGKGVEPEPSKVHAMVKWPSPTSVMELRAFLGLIGFYRKFVKNYASIAIPLTTLLCKDAFEWTVASKAAFDLLKTAMTSAPVLALPNFIEPFIVETDMSKKHCYLSKLLGFNYTIQYKVDTSNTIADALSRVSFDSDQMLLLSVPHLDFIDELRRTLQASPEFQALLSKVPTNLSAHPKYHIHNELLLFQGRIWLDKANPYIPILLLEYHATPLGAHLGVAKTTHRLESSFFWSGLWQDIRRFVRECKVCQQTKTSTHRPAGLLQPLPIPKRVWEDLSMDFITHLPPSHGSLLSSSLLIDTRRVSTSVHYPQASPPSRSHLYS

SEQ ID NO: 144956 - protein, 193 aa, Glycine max
  Coding DNA Sequence Number=SeqID_28178
  Gene Ontology: Mol. function=identical protein binding; Biological process=negative regulation of enzyme activity
  Homolog annotation: Hit_ID=Q1SX73; Match level="QueryCoverage=67%, HitCoverage=16%, E-value=8e-45, Identity=72%"; Hit description =Protease-associated PA; Proteinase inhibitor I9, subtilisin propeptide
  Pfam annotation: Domain name=Subtilisin_N; Domain location=29-115; Score=56.7; E_value=7.7e-14; Accession=PF05922.7; Description =Subtilisin N-terminal Region
MDHSIFYLYLLVSSFFFPLFLNVVYASKKCYIVYLGAHSHGPTPSFIDLETATHFHYDFLGSILGSHEKAKEAIIYSYNKHINGVVAALEEEEAADIAENPNAVSVFLSKEHKLHTTRSWEFLGLQRNGRNTTYGKREDLVKIQSSVTLIQAFQHLRGVIFILHYPFSLFVIVDRREGFPAPLWFSCVVDYRL

SEQ ID NO: 144957 - protein, 74 aa, Glycine max
  Coding DNA Sequence Number=SeqID_28179
GGHGIGGSMLVELLMLKFNTWKQGLMTPVGLVVLVEILLFLEDCRAKVGEGKVPSSCSLKQCNFNEVYITSLVP

SEQ ID NO: 144958 - protein, 81 aa, Glycine max
  Coding DNA Sequence Number=SeqID_28180
MVGAFSQNIVTLTGLPMILLSESDLTNPLCVRKGCKIDFKPAKYAAYMILTVLEETARNGATMKFLHEFRFEALNHKILYT

SEQ ID NO: 144959 - protein, 144 aa, Glycine max
  Coding DNA Sequence Number=SeqID_28181
MIRERTSAGSSARIKSSLRKKLQQALPRQQIVACGRRMTRKILQNLLPLDHAEDPSEASFAGIRGRTFHTSSAGVPEAPFLRAEEGSSHGRTFIFNLQPLMLSILRTRTTTSMEDVNFNGGHEQQLLLQISNSERNEGEEEEQA

SEQ ID NO: 144960 - protein, 154 aa, Glycine max
  Coding DNA Sequence Number=SeqID_28182
  Gene Ontology: Mol. function=RNA-directed DNA polymerase activity; Biological process=RNA-dependent DNA replication
  Homolog annotation: Hit_ID=Q1RV13; Match level="QueryCoverage=80%, HitCoverage=36%, E-value=1e-09, Identity=29%"; Hit description=IMP dehydrogenase/GMP reductase
MRAPTAVINRLSAIQRQFVWGGSFEGKKIAWGVGRGPRNPKLNLQYGRTPPNEVLSKELCRNYNIACPSLAFSFSIKTKDNLSRRQVEIDNDLCPFCQSQPESASHLFFTCGKVLPLWWEFNSWVREDRVLHYSPMDNFLQHSTTARRKEINRR

SEQ ID NO: 144961 - protein, 541 aa, Glycine max
  Coding DNA Sequence Number=SeqID_28183
  Gene Ontology: Mol. function=protein serine/threonine kinase activity; Cellular component=chloroplast; Biological process =regulation of photosynthesis, light reaction
  Homolog annotation: Hit_ID=Q9S713; Match level="QueryCoverage=93%, HitCoverage=97%, E-value=0.0, Identity=64%"; Hit description =Serine/threonine-protein kinase SNT7, chloroplast precursor
  Pfam annotation: Domain name=Pkinase; Domain location=169-431; Score=- 44.7; E_value=6.7e-06; Accession=PF00069.15; Description=Protein kinase domain
  Subcellular localization annotation: CTP_CleavageSite=56; ConfidenceScore=5.34e-01
MATIGIGVGVTKLQPHKPKSKSLFLGQRLRIRPFWGEPQCSERRLFSVSNPPRVVQVFALAGGEWLDTVHSLFVGVGVGLPCSVMQCGDVIYRSTLPKSNGLTLTVPGVILALGTLSYLWATPGVAPGFFDMFVLAFVERLFRPTYKKESNTGARGLQQLWHPAQLFLYNIVSSVVDLMILVVVAKEGDLVLKKATEYGAVEIWMNERSSSKKAAEYWLIWRFEGDATLADLMQSRDFPYNVVFVERFIQIDSISPFLVDIKPQNIIFSEESRTFKIIDLGAATDLRVGINYIPKEFLLDPRYAAPEQYIMSTQTPSAPSVPVATALSPVLWQLNLPDRFDIYSAGLIFLQMAFPSLRSDNSLIQFNRQLKRCDYDLVAWRKSAEPRSELRKGFELLDLDGGIGWELLKSMVRYKARQRLSAKAALAHPYFVREGLLALSFMQTLRLQLFRATQQDYSEAARWIIQLMAKSGTQKDGGFTEAQLQELREIEPKKKASAPRNALASALRLQRKIIRTLNESMDELTRRRKSFWWSRWIPREE

SEQ ID NO: 144962 - protein, 98 aa, Glycine max
  Coding DNA Sequence Number=SeqID_28184
  Homolog annotation: Hit_ID=Q2QMW0; Match level="QueryCoverage=41%, HitCoverage=8%, E-value=6e-11, Identity=70%"; Hit description =Expressed protein
MRLPGKESLLMKPPITINEILDVSISFLNDHLEETLGSTKIEENHSECINLAQGQGYSLHADIQYFDARWEVLVVLPLRDCFAQEINMLCRLDGFVVL

SEQ ID NO: 144963 - protein, 76 aa, Glycine max
  Coding DNA Sequence Number=SeqID_28185
  Subcellular localization annotation: CTP_CleavageSite=44; ConfidenceScore=5.07e-01
MVDSLLAQFLAVPQNVLKKATLSTTRPGEAPLPRSLLTLGLHVSDAEVEVTTLILGPPGSEKEAIEKEKLDLHLKI

SEQ ID NO: 144964 - protein, 104 aa, Glycine max
  Coding DNA Sequence Number=SeqID_28186
  Homolog annotation: Hit_ID=Q1SAV4; Match level="QueryCoverage=48%, HitCoverage=12%, E-value=2e-11, Identity=64%"; Hit description =Integrase, catalytic region
  Pfam annotation: Domain name=Chromo; Domain location=16-67; Score =19.5; E_value=0.0049; Accession=PF00385.14; Description='chromo' (CHRromatin Organisation MOdifier
MPDLTIVKSLFSSSANIVFRLLAPTDSKIDDSTSPPTRLVLTQWMGQPPEDTTWEPWLELRDAYHLEDKVVFWDGSIDRDPQDPNIARPRRVVTKPKYLSDYVT

SEQ ID NO: 144965 - protein, 71 aa, Glycine max
  Coding DNA Sequence Number=SeqID_28187
  Gene Ontology: Mol. function=dihydroneopterin triphosphate pyrophosphohydrolase activity; Cellular component=cytosol
  Homolog annotation: Hit_ID=Q9CA40; Match level="QueryCoverage=65%, HitCoverage=31%, E-value=2e-09, Identity=63%"; Hit description=Nudix hydrolase 1
MENKNNNSGESELRVLVVIFLLKGRSILLGRCRSAVGNATFTLLGGHLEFGHSLTLSHIMFFFSSNILKTK

SEQ ID NO: 144966 - protein, 99 aa, Glycine max
  Coding DNA Sequence Number=SeqID_28188
MWNLKLFFLLFFPFFFQTFILCSNNDGDDNTEVTLWSSKSINFMVSLNVVELSSVILVVMDSQTTSATNLMCWECKLGQRAVDVFGVLVTQNNLLLSYI

SEQ ID NO: 144967 - protein, 72 aa, Glycine max
  Coding DNA Sequence Number=SeqID_28189
MIGDRTKYNSNDIPVLGVTCNSLSGARSPYETVVATTESPREAMTKKDAKKMADRVPGNGRFDDGDGGHQCR

SEQ ID NO: 144968 - protein, 203 aa, Glycine max
  Coding DNA Sequence Number=SeqID_28190
  Homolog annotation: Hit_ID=Q1STQ3; Match level="QueryCoverage=55%, HitCoverage=62%, E-value=4e-15, Identity=42%"; Hit description =Bromodomain
  Pfam annotation: Domain name=Bromodomain; Domain location=53-130; Score=17.8; E_value=4.7e-05; Accession=PF00439.15; Description =Bromodomain
MSLCCVRVRASRLSLYAYVKGRKVESKGLHSVPVSGAPVILQSGIPLPDKRTLELILDKLHKKDTYGVFADPVDPEELPDYHDVIKHPMDFATVRKKLGNESSYTTLEQFETISLFLSTPQSPCHWSLHSSTTSVGLGLNLEVSNFEPIMVVTMMSWPPWPPLSSKKFEVVFIVRRLEGSTSMEKAEEVKSKVVEIKWKEPLC

SEQ ID NO: 144969 - protein, 449 aa, Glycine max
  Coding DNA Sequence Number=SeqID_28191
  Gene Ontology: Mol. function=DNA binding; Cellular component =chromatin; Biological process=DNA integration
MASNNVPLVAPPVFTGKNDEIWVVKMRRQLKAFDLWKAMEKTEPPALEENPTVAQIRFHSKQVAKRAKALTILHSVVDDDVFMRISNLDTAREIWEKLQEEFFGNERTKKILMKVVNQIKLLAEKFLYSGIVEKEMTTIEDNNTWQLVDKLEDKNSIGVKWVYKVKLNLNGSINKYNTKLVVKGYAQQPGIDYVETFSPVTKMNTIRILVALAAEMKWKIWHLDVKSAFLNRNMTGEIYVAQSEGFVYNNIDAYFSSQGFRSENDATLYVKRLLDVHQSEVGIFLNQEKYAYEILKKFRMKSCKFVPTPSVQNMKLSKDDGAEKMGDSLYRNVIGSLLYLTSSRPRSHMFSWNSKKQDIVTQSTAEAEYVAAAAATNQAIWLKKIMFDLGVEKMDATEIYCDTWKDKAYSSDFHVVREAVKNCEIKLIQWVTEEGIFGAAGEVLKVQYN

SEQ ID NO: 144970 - protein, 171 aa, Glycine max
  Coding DNA Sequence Number=SeqID_28192
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=90%, HitCoverage=48%, E-value=7e-29, Identity=40%"; Hit description =Similarity to MADS-box DNA-binding protein
  Pfam annotation: Domain name=SRF-TF; Domain location=9-60; Score =42.4; E_value=1.5e-09; Accession=PF00319.9; Description=SRF-type transcription factor (DNA-binding and dimerisation domain)
MARKKVDLAYISNPKKRKEVLKKRKNGLLKKVDEITTLCGIEACAIIYSPDEPEPQVWSSDQGVESVIFKFRGVSELTRNKRMFCQESLLRKNIIQVQGQLKKLRNENRMKEINLFMCQYFVGGNHLDKSNIIDLNDITFLADKKLEEITKKIEMLHVQEVTPTTENEEKP

SEQ ID NO: 144971 - protein, 73 aa, Glycine max
  Coding DNA Sequence Number=SeqID_28193
  Homolog annotation: Hit_ID=Q1SAV4; Match level="QueryCoverage=55%, HitCoverage=10%, E-value=2e-07, Identity=53%"; Hit description =Integrase, catalytic region
MDNTTTPPTPMVLIQWQGISPKEASWEPWEIVYDKFHLEDKNPSLPDIDTAKEAKASMPKRSANRATYLEDYV

SEQ ID NO: 144972 - protein, 387 aa, Glycine max
  Coding DNA Sequence Number=SeqID_28194
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=50%, HitCoverage=13%, E-value=8e-45, Identity=47%"; Hit description=Chromo
MAFRTHHGHYEYRVMPFGLCNTPSTFQAIMNVVLFVAVFFNNILVYCVSLSTHLEHLDMVLQTLLQGKFYLKHSKCLFAQRQLEYLGHIVSSKGIELDPSKVATMLQWSPPTSQKDLCAFLGLTGFYMRFIKGYTIATPLTTLLYRDKFLWSPEAQHAFDNLKQAMTQAPVLIAHDFSIPFILVTDAGHPQVASIFTRPFVHHPYGPPELKGSHESNPSSPKLASASLGPPNSFMVKKPARLGELTVAGKWREIRENKKKEEEMKLRHCRIATVINLYIVPCSVFFVRSSELFKLSSTSLRMSTAYHLLSDGQTEVMNHVLEQYLKSLVHARPTEWNKPLPSIPSYILGSSSIEVVDSILITRKTMHEDLKRHLLKAQETMKQFTDA

SEQ ID NO: 144973 - protein, 370 aa, Glycine max
  Coding DNA Sequence Number=SeqID_28195
  Gene Ontology: Mol. function=transferase activity, transferring hexosyl groups; Cellular component=integral to membrane; Biological process=carbohydrate biosynthetic process
  Homolog annotation: Hit_ID=Q9M8J2; Match level="QueryCoverage=83%, HitCoverage=87%, E-value=1e-121, Identity=64%"; Hit description =Putative glycosyl transferase
  Pfam annotation: Domain name=Glyco_transf_8; Domain location=53-311; Score=296.1; E_value=6.4e-86; Accession=PF01501.10; Description =Glycosyl transferase family 8
MPPKLTLVLVVLFFAPVDAHFPATGELPTFREAPAFRNGRECRNRARSDSVIHIAMTLDATYLRGSVAGVFSVLRHASCPENIVFHFIGTTRRSTELRRIITATFPYLAFYLYQFDANLVRGKISYSIRRALDQPLNYARMYLADLLPATVRRIIYFDSDLIVVDDVAKLWSIDLHARVLGAPEYCHANFTNYFTHRFWSNPSYAASFKGRDACYFNTGVMVIDLWKWREGRYTEKLERWMRIQKRNRIYELGSLPPFLLVFAGDVERVEHRWNQHGLGGDNLEGLCRDLHPGPVSLLHWSGKGKPWLRIDSKKPCPLDSLWAPASLDCCHLLLLVVVVQLKGSVIGNDGKGHASVREILDDDDDDWVAM

SEQ ID NO: 144974 - protein, 72 aa, Glycine max
  Coding DNA Sequence Number=SeqID_28196
  Homolog annotation: Hit_ID=Q38IW9; Match level="QueryCoverage=47%, HitCoverage=7%, E-value=4e-11, Identity=94%"; Hit description =Ornithine aminotransferase
MHNCFNCLFTQILGKASGGGVIPVSAVLADKDVMLCIQPGQHGSIFLSVVVKLLDYDGHLFSSLKPFICQIM

SEQ ID NO: 144975 - protein, 57 aa, Glycine max
  Coding DNA Sequence Number=SeqID_28197
  Gene Ontology: Mol. function=transporter activity; Cellular component= integral to membrane; Biological process=transport
  Homolog annotation: Hit_ID=P49173; Match level="QueryCoverage=60%, HitCoverage=12%, E-value=7e-11, Identity=80%"; Hit description =Probable aquaporin NIP-type
MEENGAGGGLREKGMGRKIQCGGPVSGASMNPARSIGPALIKHVYQWLWIYVVGPIV

SEQ ID NO: 144976 - protein, 128 aa, Glycine max
  Coding DNA Sequence Number=SeqID_28198
  Gene Ontology: Mol. function=protein binding; Biological process =protein amino acid phosphorylation
  Homolog annotation: Hit_ID=Q5ZDH7; Match level="QueryCoverage=91%, HitCoverage=18%, E-value=4e-31, Identity=55%"; Hit description =Senescence-induced receptor-like serine/threonine kinase-like
DGGEEVGVGTVAGEGLGPRRAPGEDDGGGDGDVEGGRVGPSVVVVVDDECAEEVAGGRKIGDGVAVLLAGGDWEEAEGLLVPVPEAQRLRHDPSSAAAEVAVGEPRRVELVGGIRRTSAVDVKRTGWE

SEQ ID NO: 144977 - protein, 150 aa, Glycine max
  Coding DNA Sequence Number=SeqID_28199
  Gene Ontology: Mol. function=RNA-directed DNA polymerase activity; Biological process=RNA-dependent DNA replication
MATRVLNAKYYWPTLIIDNVEYVKRCIQCQKHGNLIHQPVDELLILASSWQLPCGGMLGPFPLARGQWINYRVRLVEHPQTNRQAKVANKVILAELKKKLGLAKGKWVEELLEVLWGIQCTLQSTTKEMPFRLTYGTDAFIPVEVGEPLF

SEQ ID NO: 144978 - protein, 191 aa, Glycine max
  Coding DNA Sequence Number=SeqID_28200
  Gene Ontology: Mol. function=protein binding
  Homolog annotation: Hit_ID=Q5ZDH7; Match level="QueryCoverage=82%, HitCoverage=24%, E-value=4e-40, Identity=49%"; Hit description =Senescence-induced receptor-like serine/threonine kinase-like
  Pfam annotation: Domain name=LRRNT_2; Domain location=104-145; Score =16.9; E_value=0.015; Accession=PF08263.3; Description=Leucine rich repeat N-terminal domain
MVFWSSKLSVDAKLDYLVWLHFAEIEGRVRRVGERVFDVYINNDNLTRIDIYKQVGGFAAFTWHHTVKNLSSSVLSVKLVGVVGAPLICGIENYALVPSDPSTVPEQVVAMKALKDSFRVPERMGWNGDPCAPTNWDAWEGVTCRTSKNSTTLVISQMVLRERGAKAPACPPLDPSLVSGAVVVSEVVIMC

SEQ ID NO: 144979 - protein, 70 aa, Glycine max
  Coding DNA Sequence Number=SeqID_28201
MKDAHEKLTKKTKPFDILEDAHECVIMSINDIPEKTPIQANHPFHLPIPITNVTFDEEEERQLDDDKVNN

SEQ ID NO: 144980 - protein, 177 aa, Glycine max
  Coding DNA Sequence Number=SeqID_28202
  Gene Ontology: Mol. function=RNA-directed DNA polymerase activity; Biological process=RNA-dependent DNA replication
MDDAIICKVFPISLKGKALSWFTWLLPNSIDCFETLMAGFGIQFTTRRPIHLTSVVLVSLRLIKKETLWSFMKSLCKKPATDLGDLHCRATKYMQLEEFIEYDRQLRNKVPGPKKKVERDIQKGKEYVCGTPKPRYNYYNPLNASKSRILEQALATEVLAVSKCANTPPRDHPSKHC

SEQ ID NO: 144981 - protein, 173 aa, Glycine max
  Coding DNA Sequence Number=SeqID_28203
MDWPRRILNNITDGFGGGEYTSLPKKKHLHNVQFVNMVATRNMVEMLDIMFTSADFKGIDPEEDDPWSLPSRRPIACTSYNILLGQPSINAIGAIVSILHLATKFPSYEGLIITIHANKKETWECYMVSLKLTGQYHKRREKWGRKGEEPFRKKLGSFSQPSLSEKRDTRLGS

SEQ ID NO: 144982 - protein, 87 aa, Glycine max
  Coding DNA Sequence Number=SeqID_28204
MIFHFSYLQTPTQTLNPSSPPPMATGGHHKLPLLADRQPHREEHFNWSGILRIHLKDSVVKQVLKPFFRSFFEESAFGPANLNARDL

SEQ ID NO: 144983 - protein, 201 aa, Glycine max
  Coding DNA Sequence Number=SeqID_28205
  Gene Ontology: Mol. function=transcription factor activity; Cellular component=nucleus; Biological process=regulation of transcription, DNA-dependent
  Homolog annotation: Hit_ID=Q2A9W8; Match level="QueryCoverage=56%, HitCoverage=38%, E-value=3e-26, Identity=56%"; Hit description =Ethylene responsive element binding factor, putative
  Pfam annotation: Domain name=AP2; Domain location=32-97; Score=73.1; E_value=9.2e-19; Accession=PF00847.10; Description=AP2 domain
MKLSLQIVVPKKTKWIQFQNLEVVTPENQPEKKHYRGVRQWPWGKFVVEIHDPNKCGSRVWLRTLDTTIKANKAYNQVIFRLHGSKANLNFPLEVNVVVETVFVITADSERKHHREEEEVVVEEEKVVVKKEKIMEHDLLISKSLLLLDLTNISSKYILNTNTNNKARQCSLNHKTILIELFSWKITIPSSFPMYSVNMYS

SEQ ID NO: 144984 - protein, 53 aa, Glycine max
  Coding DNA Sequence Number=SeqID_28206
MLKVLRGCCICRVQEEKKEERDWGRYRTPRKRKEVDQDNEIYPREYLNRDRVK

SEQ ID NO: 144985 - protein, 130 aa, Glycine max
  Coding DNA Sequence Number=SeqID_28207
MYKEVDYLFPRDSILSKAVAQANVKAEPMSLQAEAVVGAHYVMKMSVILLHHRKTNRFASQSLKIWRGSSVLVDLLGRVFERKAKLATTLTWRFAASNGSTLAANDMEDATAFVVVETPKTAILVATIAL

SEQ ID NO: 144986 - protein, 149 aa, Glycine max
  Coding DNA Sequence Number=SeqID_28208
MSSSEPLSSRDGESDDMRRYLMVIRTFCQPEASELVDMQRLTSSSAPLSSKDGKSDDMRKCLMVIHTFCQLEAPEPINAQRQTSSSAPFSSRDGEFDDMRRYLMASEPVDTQKLTSSSSPLSSRDDKSNDMRRCLTVICTFCQLEASEP

SEQ ID NO: 144987 - protein, 114 aa, Glycine max
  Coding DNA Sequence Number=SeqID_28209
MTGRLLADSLALESHILHYLIVCILLPRSSNLAQALRLNAPLPYPHLVTLFLQHFNIPLDSEPYVPIKRSFLIGAIVVASFGYRKDRDGTWVKKGAQPNDDEGHLPVEEDSSLL

SEQ ID NO: 144988 - protein, 55 aa, Glycine max
  Coding DNA Sequence Number=SeqID_28210
MPDGRLIEKNAAEKDDRKTTIGDIGRQIQPTDIHRETSSKIIYQERLFFGRHCAK

SEQ ID NO: 144989 - protein, 88 aa, Glycine max
  Coding DNA Sequence Number=SeqID_28211
MALYSVSALLVATMFCVLALVTKLPHTRGKSGYPSQKILREPKSEPQIRQNIPLGVIGAIVDPALIAGKSIVPKPPTQVFISLIQKIL

SEQ ID NO: 144990 - protein, 62 aa, Glycine max
  Coding DNA Sequence Number=SeqID_28212
  Homolog annotation: Hit_ID=Q8S8I2; Match level="QueryCoverage=84%, HitCoverage=23%, E-value=5e-08, Identity=45%"; Hit description =Protein ULTRAPETALA2
MRKQNFHRDEFLRCTRCGKERRFHLKSRPDIKNYHDALNNKCWTLSLWPYQKLSSMDSEMER

SEQ ID NO: 144991 - protein, 45 aa, Glycine max
  Coding DNA Sequence Number=SeqID_28213
TVEIPQRKYSRNLNGHNFSHGCPNLALAAGATCPLDVAKTRRQIE

SEQ ID NO: 144992 - protein, 126 aa, Glycine max
  Coding DNA Sequence Number=SeqID_28214
GKLAKEVAELPFLVTREENFEEFKAYEESLVEEHDSRERDEEKKKKEERHVECDKSLSVILSLNTNASLAMVWKAFLGYMSFMESLAKKRKCKEDVFYKSEEKLEESQENARDAAIVVGRHVSPLR

SEQ ID NO: 144993 - protein, 101 aa, Glycine max
  Coding DNA Sequence Number=SeqID_28215
GNVMSVEDNQCEHIITRIEVDNKKVKGETLDLESGVHKNQTMSKDHLYRLMVIQADITVVVLGSVLASASSTSLPNPANPKDVYVDVFLTSGCSSTSSASS

SEQ ID NO: 144994 - protein, 354 aa, Glycine max
  Coding DNA Sequence Number=SeqID_28216
  Gene Ontology: Mol. function=aspartic-type endopeptidase activity; Cellular component=membrane; Biological process=proteolysis
  Homolog annotation: Hit_ID=Q9LX20; Match level="QueryCoverage=77%, HitCoverage=52%, E-value=2e-67, Identity=57%"; Hit description =Aspartic proteinase-like protein 1 precursor
PHRDETKRNETIHNDDDAHCAVRTLTSLINTNRYLNQLQRVIGTSASAPDLDLDLDAVAVAAFVAFGANGSRNAVSDHFFRAPRSPLRRRNETGSASDRLLAGPAEHALLPDASHRRHSPAQDQSRRHTLPATVSFSRQQNDVARQRLRLEHRVLRFSWRWTQGVIFFGFRVIAYSALHCHRATIPIWCSFTYGASIMQDRDLNEYSPSRSLSSKHLSCSHRLCDKGSNCKSSQQQCPYMVSYLSENTSSSGLLVEDILHLQSGGTLSNSSVQAPVVLGCGMKQSGGYLDGVAPDGLLGLGPGESSVPSFLAKSGLIHYSFSLCFNEDDSGRMFFGDQGPTSQQSTSFLPLDGL

SEQ ID NO: 144995 - protein, 70 aa, Glycine max
  Coding DNA Sequence Number=SeqID_28217
  Homolog annotation: Hit_ID=Q1T192; Match level="QueryCoverage=67%, HitCoverage=7%, E-value=3e-08, Identity=56%"; Hit description =Polynucleotidyl transferase, Ribonuclease H fold
MCTNYINLNKACSKDSDPLPSTESNRVVVRTNHPIQQILRKSELAERMIAWLLELSEFDIKFELRWPVKA

SEQ ID NO: 144996 - protein, 109 aa, Glycine max
  Coding DNA Sequence Number=SeqID_28218
  Subcellular localization annotation: CTP_CleavageSite=45; ConfidenceScore=5.34e-01
MSPPPLEPYNHSQTHLKLSGRLSLQASFSAGGLVGACALSITLARLASISEFRLIACLFALRMDSSDALSGISPRSSNMHSSSFFQILPRAQQKECCTQRMAHKARKLA

SEQ ID NO: 144997 - protein, 89 aa, Glycine max
  Coding DNA Sequence Number=SeqID_28219
MINIRLELMPCPRQEPGEEKLRSGDKGGINKTPQSIAMPGEKRRKGWSSEVCNCKLKLPNKQEGIMPSQKQMQTPPTPLPFNSPIPILT

SEQ ID NO: 144998 - protein, 99 aa, Glycine max
  Coding DNA Sequence Number=SeqID_28220
MDLLLEWRKVSPLDPKFILFSSIFTKLSFSSIEKAFNLVLEVVVVANTEWAYRMDVMQAPLELVGLGSSSSMDSFASWKMNGSGMEKGRERGDATSRRR

SEQ ID NO: 144999 - protein, 837 aa, Glycine max
  Coding DNA Sequence Number=SeqID_28221
  Gene Ontology: Mol. function=protein serine/threonine kinase activity; Cellular component=integral to membrane; Biological process=protein amino acid phosphorylation
  Homolog annotation: Hit_ID=Q9C6K9; Match level="QueryCoverage=73%, HitCoverage=95%, E-value=1e-127, Identity=42%"; Hit description=Wall- associated kinase, putative
  Pfam annotation: Domain name=APH; Domain location=352-534; Score= -13.1; E_value=0.049; Accession=PF01636.13; Description =Phosphotransferase enzyme family
  Pfam annotation: Domain name=Pkinase; Domain location=350-622; Score =140.6; E_value=4.1e-39; Accession=PF00069.15; Description=Protein kinase domain
  Pfam annotation: Domain name=Pkinase_Tyr; Domain location=350-622; Score=137.6; E_value=3.4e-38; Accession=PF07714.7; Description =Protein tyrosine kinase
  Pfam module annotation: Pfam domain module=APH::Pkinase::Pkinase_Tyr; Domain location=352-534::350-622::350-622
ETTFSYGSLTLRRLTLGHGELKPWPDSHDRKIEAIVEYCMGSNSEDVMTGSDKYHDITCMMTQGVVLLSAGNVNAGNANGHHDECPDSFDCGSLGRIYFPFTTVQYLNCGALAIHGCDDHNQTAVKRVQLNNGGKLFQVTQVNSHQRQGWRTSISITDHDFRMLLVNGSCMAFTYNIIFPPFSAFGCPSSDFYFAPPYSDYESLRSLISSCSMVKLPVRQDSQFFKDPFGFLTAEITFEFKFSNECLQCYHGRRDGNCRLDSKGNFYCANRKARVWTRIRKLALMLGTGVGPWIIFGLFLTLRHCKRKYGQSSSNTSDDPYPSRDTESDRIFFGVPIFSYMELLEATNNFDSTRKLGEGGFGTVYYGTLRDGREVAIKHLFEHNYKRVEQFMNEIEILTRLRHRNLVSLYGCTSRHGQELLLVYEYVPNGTVASHLHGDLARVGLLTWPIRMQIAIDTASALAYLHASNIIHRDVKTNNILLDISFSVKVADFGLSRLLPNDVSHVSTAPQGSPGYLDPEYFQFYRLTDKSDVYSFGVVLMELISSMPAVDAARERDQVNLASFCIKKIQKGKLSELVDPSFGFESDQQVKRMLTSVAGLAFRCVLGDNGLRPSMDEVLEALRKIQSGNYESENLEKGDDVGGGGVTSSTSSTEQVHVLQPPPASPDWGQAGISKNKLPASPMSLTEKRESESTTPNVSDHSAKSATVEQVFYREKRSDIGKRFGPTCDSMVIIQSMKRKVMNVYGRKDATIPKIDPMLENNRERQIERERETDNLGDGSVAEIQAVRDAVWSGAKPKDEPIDSIPAARTRGGEESDAETLTEGPLCVLGATREARG

SEQ ID NO: 145000 - protein, 1077 aa, Glycine max
  Coding DNA Sequence Number=SeqID_28222
  Gene Ontology: Mol. function=protein serine/threonine kinase activity; Cellular component=cell surface; Biological process =protein amino acid phosphorylation
  Homolog annotation: Hit_ID=Q53VE0; Match level="QueryCoverage=60%, HitCoverage=40%, E-value=6e-95, Identity=65%"; Hit description =Ser/Thr protein kinase
  Pfam annotation: Domain name=Pkinase; Domain location=445-704; Score =113.6; E_value=5.7e-31; Accession=PF00069.15; Description=Protein kinase domain
  Pfam annotation: Domain name=Pkinase; Domain location=867-1077; Score= 83.5; E_value=6.6e-22; Accession=PF00069.15; Description=Protein kinase domain
  Pfam annotation: Domain name=Pkinase_Tyr; Domain location=446-683; Score=69.4; E_value=1.2e-17; Accession=PF07714.7; Description =Protein tyrosine kinase
  Pfam annotation: Domain name=Pkinase_Tyr; Domain location=868-1074; Score=40.3; E_value=6.1e-15; Accession=PF07714.7; Description =Protein tyrosine kinase
  Pfam module annotation: Pfam domain module=Pkinase::Pkinase::Pkinase _Tyr::Pkinase_Tyr::Retrotrans_gag; Domain location=445-704::867 -1077::446-683::868-1074::196-286
MSTDSNIQVAEHIENAAVPNNTQIAADNNTNREEFTVMNSRSSNGPKRNTLRPKYLADFVYQTGPTCLASMPEHHTRQVTLDKLDNVVQRLSQGQVSLTEGQASLSQSNHALNKKIDNIHASLTTQIESLFDRLAAIAVPHSSPISASQPPPSPISRHHHLKLDVPRFDGHDPLGWIFKISQFFNYQGIPELERLTIASFYMDGPTLSWYQWMHRNGYFPSWPAMLQALESRFAPSFCDDPQGNLFKLHQTGSVIDYLTAFERLANRTIGIAPSSLLSCFISGLIPELRREVQALRPISLPQAIELARLQEDKMLDHRRGSPEELAIHRDQGLCYHCDDKWSHGHRCRCRLHLLIADKDVENPDIPLDPNPDLTVVSQISLNTMEASAVVAAGIVVLQMVLACCFRRNIFWRENPTHWIIEGFLKEHGPLPTARYSYSEVKRMTNSFRNKLGQGGFGSVYKGQLQDGRVVAVKILNKSDSNGEEFVNEVASISRTSHVNIVRLLGLCLDSSKRALIYEFMPNGSLDNFIYEEKNPLKVARHLDCKVLYDITIGIARGLEYLHRGCNTRILHFDIKPHNILLDEDFCPKISDFGLAKICPRKESVVSMLCARGTAGYIAPEVFSRNFGAVSHKSDVYSFGMMVLEMVGRRKNIKAEVDNSSEIYFPHWIYNRLESNQELGLQNIKNEGDDQMVGKMTIVGLCLHVSPPTGMLNYTKCPDYDLYYKHIITADDVSRSSLAACTEVQLPIKDVPDAINPFTFVTADIIIRVDLTDECADCNYRHGGQCKLDSTETFCCVNVVKKGLSLKTKLGIGAAGVVVLLMVLACCFRKNLFRRENPTHRIIEGFLKEHGPLPTARYSYSEVKKLTNSFRKQLGQGGFGSVYKGQLHDGRAVAVKILNKSEGNGEEFINEVASISRTSHVNIVRLLGFCLDSSKRALIYEFMPNGSLDRFIYEEKNPLQVAHQLDCKQLYDIAIGIARGLEYLHRGCNTRILHFDIKPHNILLDEDFCPKISDFGLAKLCPRKESAVSIFGVRGTAGYIAPEIFSRNFGAVSHKSDVYSYGMMVLEMVGMKTNIKAE

SEQ ID NO: 145001 - protein, 105 aa, Glycine max
  Coding DNA Sequence Number=SeqID_28223
MPKPGFPQKGCGWTCKKFWVHITGGVFGKEIEEDDVGENQGRRKGSEDKEDVHFGGLWIENIEEERIGLYPKEDAECEVRGEGMAAYGIDIDNLSLPLIFEWNPV

SEQ ID NO: 145002 - protein, 93 aa, Glycine max
  Coding DNA Sequence Number=SeqID_28224
MLKLKDTKELKSHLRGRVDRDGTTQREMEYWSPNMTLEMAALCSALAMASIIKAILLGSKSDIECTIPTEIQTYFGTLCGTSTLCYMSISNSR

SEQ ID NO: 145003 - protein, 301 aa, Glycine max
  Coding DNA Sequence Number=SeqID_28225
  Homolog annotation: Hit_ID=Q2QU89; Match level="QueryCoverage=36%, HitCoverage=14%, E-value=7e-22, Identity=48%"; Hit description =Pentatricopeptide, putative, expressed
  Pfam annotation: Domain name=PPR; Domain location=152-186; Score=6.4; E_value=1.3; Accession=PF01535.11; Description=PPR repeat
  Pfam annotation: Domain name=PPR; Domain location=218-252; Score =35.4; E_value=2e-07; Accession=PF01535.11; Description=PPR repeat
  Pfam module annotation: Pfam domain module=PPR::PPR; Domain location =152-186::218-252
MPQHLAPLPAPLTSKGDIARKLIEPLYPTLPFESDNNIHRDTRLSLNVLSVGNRVPQTILGKILKDSASQTVNPEFHNVQHVVTQHHLVSFGSSLASLPRPPYSSPSPPPPPPEPPPPPRPWSARVCASWTMRFGRKGLDRVTHCSQKVDALTCSFALKGCTRTLAFFEATQIHSQLLRFGFEADILLLTTLLDVYAKIGDLDAAQKVFDNMCRRDITSWNAMIFGLAQGSRPNEAIALFNRMKDEGRSPKEVIVLSALLYSWNVMNKSRKQQDTEQEPEPKKEERPMREIYKPQYLRDFV

SEQ ID NO: 145004 - protein, 165 aa, Glycine max
  Coding DNA Sequence Number=SeqID_28226
  Subcellular localization annotation: CTP_CleavageSite=50; ConfidenceScore=5.37e-01
MTLRVSNAAFSVSRSNTTNSKGCLPLPLTQNLTLPSTREFDIAPNQTNIRLFYGCGSLPWLEEHKVGCFNKTSSVLALYKEDKNISFVSKNCKGEVVDTIVEDGIIGGNEEALTKGFLLTWKAGNCSVCHNTGGRCGFDFVMYTFRCFCTDRVHSVKCGPDDDPG

SEQ ID NO: 145005 - protein, 112 aa, Glycine max
  Coding DNA Sequence Number=SeqID_28227
MRLLQRAQLAAKTIRAVRHSNERVGYGYCLPNPLSRLLNIFLYRYLISDGFEFIDGFEFIVPSSYPSGTRQTDLVISYPYLYPTFGYREKPEPVPIPDQLGYYPSKSGRIRA

SEQ ID NO: 145006 - protein, 82 aa, Glycine max
  Coding DNA Sequence Number=SeqID_28228
MELAWACVRGVPSQRKKMEVWVNGVNGLPTHWLEASLVMASSMCSILVLGRVVVAMVAVLNESTKLLCSQNLRTRRSPEKGD

SEQ ID NO: 145007 - protein, 258 aa, Glycine max
  Coding DNA Sequence Number=SeqID_28229
MAPVDLFCFLFCFLVLILSAGYGNGHQDCPHSFTCGNLGTLHYPFTKAELPDCGLLAIRDCDDPLQPTKTIQLEKNGNSSSIVVNGITQQGEISILDEDFHKRLQQNTCGALKNNYSLPSPSSLYSIHIEYNVTLFKCKHSLNMNMKPPAHYFKYQCHDYDYDIYYDSLPSPNNKEAHSLFSSYSVIQISSKDLTDTSNILSFLSAEMTLEVVLSNDCYECYNLRGGQCLLDSNQKFYCEKVSFLDQTIEIVTYEVSS

SEQ ID NO: 145008 - protein, 49 aa, Glycine max
  Coding DNA Sequence Number=SeqID_28230
MEYWSPKVIVEMVAVNERKQCNAMQCNVQTTRRDKGIDGVGGRELVGAC

SEQ ID NO: 145009 - protein, 672 aa, Glycine max
  Coding DNA Sequence Number=SeqID_28231
  Gene Ontology: Mol. function=protein kinase activity; Cellular component=integral to membrane; Biological process=protein amino acid phosphorylation
  Homolog annotation: Hit_ID=Q2LJM2; Match level="QueryCoverage=92%, HitCoverage=93%, E-value=0.0, Identity=70%"; Hit description =Putative receptor kinase
  Pfam annotation: Domain name=LRRNT_2; Domain location=28-67; Score =48.0; E_value=3.1e-11; Accession=PF08263.3; Description=Leucine rich repeat N-terminal domain
  Pfam annotation: Domain name=LRR_1; Domain location=116-138; Score =8.1; E_value=8.7; Accession=PF00560.23; Description=Leucine Rich Repeat
  Pfam annotation: Domain name=LRR_1; Domain location=140-162; Score =15.8; E_value=0.16; Accession=PF00560.23; Description=Leucine Rich Repeat
  Pfam annotation: Domain name=LRR_1; Domain location=164-184; Score =10.4; E_value=3.3; Accession=PF00560.23; Description=Leucine Rich Repeat
  Pfam annotation: Domain name=LRR_1; Domain location=186-208; Score =16.6; E_value=0.093; Accession=PF00560.23; Description=Leucine Rich Repeat
  Pfam annotation: Domain name=LRR_1; Domain location=70-91; Score=4.8; E_value=36; Accession=PF00560.23; Description=Leucine Rich Repeat
  Pfam annotation: Domain name=LRR_1; Domain location=93-114; Score =15.4; E_value=0.2; Accession=PF00560.23; Description=Leucine Rich Repeat
  Pfam annotation: Domain name=Pkinase; Domain location=365-638; Score =62.6; E_value=1.3e-15; Accession=PF00069.15; Description=Protein kinase domain
  Pfam annotation: Domain name=Pkinase_Tyr; Domain location=364-638; Score=65.6; E_value=1.6e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=28 -67::116-138::140-162::164-184::186-208::70-91::93-114::365-638::364 -638
MAATLSHLVAVFHFLILLLLLLMVHGFSNPDFDALLSFKTASDTSQKLTTWNINSTNPCSWKGVSCIRDRVSRLVLENLDLEGSIHPLTSLTQLRVLSLKGNRFSGPVPNLSNLTALKLLFLSRNAFSGEFPATVKSLFRLYRLDLSNNNFSGEIPATVSHLTHLLTLRLDGNKFSGHIPDVNLPGLQEFNVSGNRLSGEIPKSLSNFPESSFGQNPFLCGAPIKNCAPDPTKPGSEGAIASPLVPPNNNPTTTVSSSPSSMPKTPASASTKSNKSHGKGGSKISPVALIAIIVCDVLVLAIVSLLLYCYFWRNYKLKEGKGSKLFESEKIVYSSSPYPAQGGFERGRMVFFEGEKRFELEDLLRASAEMLGKGGFGTAYKAVLDDGNVVAVKRLKDAQITGKREFEQHMELLGRLRHPNVVSLRAYYFAREEKLLVYDYMPNATLFWLLHGNRGPGRTPLDWTTRLKIAAGAARGVAFIHNSCKSLKLTHGNIKSTNVLLDKQGNARVSDFGLSVFAGPGPVGGRSNGYRAPEASEGRKQTQKSDVYSFGVLLLELLTGKCPSVVESGGSAYGGVVDLPRWVQSVVREEWTAEVFDLELMRYKDIEEEMVGLLQIAMTCTAPAPDQRPRMTHVLKMIEELRGVEVSPCHDSLDSVSESPSLSEDACGTTSQ

SEQ ID NO: 145010 - protein, 405 aa, Glycine max
  Coding DNA Sequence Number=SeqID_28232
  Gene Ontology: Mol. function=transferase activity, transferring nitrogenous groups; Cellular component=membrane; Biological process =biosynthetic process
  Homolog annotation: Hit_ID=Q5N9Z8; Match level="QueryCoverage=96%, HitCoverage=78%, E-value=1e-149, Identity=69%"; Hit description =Putative aspartate aminotransferase
  Pfam annotation: Domain name=Aminotran_1_2; Domain location=43-400; Score=206.0; E_value=9e-59; Accession=PF00155.11; Description =Aminotransferase class I and II
MTTKSDFDDTDVDISLSHRVNAVKPSKTVAISDHATALLQSGVPVIRLAAGEPDFDTPAVIAEAGMNAIREGYTRYTPNAGTLELRQAICHKLKEENEITYTPDEIVVSNGAKQSVVQAVLAVCSPGDEVNIYLKSYRNINDIVEVNVNPNKTLMLLSHLEVIIPAPFYTSYPEMARLADATPVILPSHISNNFLLDPKLLEANLTERSRLLILCSPCNPTGSVYSKKLLEEIAQIVAKHPRLLVLSDEIYEHIIYAPATHTSFASLPGMWDRTLTVNGFSKTFAMTGWRLGYIAGTKHFVAACGKIQSQFTSGASSISQKAGVAALGLGYAGGEAVSTMVKAFRERRDFLVESFREMDGVKISEPQGAFYLFIDFSSYYGREVEGFGIIENSDSLCRYLLDKGL

SEQ ID NO: 145011 - protein, 456 aa, Glycine max
  Coding DNA Sequence Number=SeqID_28233
  Gene Ontology: Mol. function=sulfate porter activity; Cellular component=integral to membrane; Biological process=sulfate transport
  Homolog annotation: Hit_ID=Q02920; Match level="QueryCoverage=61%, HitCoverage=62%, E-value=1e-137, Identity=86%"; Hit description =Early nodulin 70
  Pfam annotation: Domain name=STAS; Domain location=327-443; Score =108.7; E_value=1.7e-29; Accession=PF01740.11; Description=STAS domain
  Pfam annotation: Domain name=Sulfate_transp; Domain location=9-304; Score=404.3; E_value=1.8e-118; Accession=PF00916.10; Description =Sulfate transporter family
  Pfam module annotation: Pfam domain module=STAS::Sulfate_transp; Domain location=327-443::9-304
MAWLSLLIVTFYRFGFLVEYLSDPTIVGFLAAAAVSIGLQQLKGLFGIVNFTNKTGLFSVVKSLWTSFKNQGKRNKKLMWLSHVAPLLSVIVSSVVAYKINFNELQVKDYKVEVLGPIKGGSSNPSSLHQLTFDSQVVGHLIRIGLTIAIISLTGSIAVGRSFASLKGHSIDPNREVVSLGIMNIVGSLTSCYIASGSLSRTAVNYNAGSETMVSNIVMALTVLMSLKFLTGLLYFTPKAILAAIILSAVPGLIDLNKAREIWNVDKMDFLACTGAFLGVLFASAEIGLAIGITISFAKIIITSIQPATAVIGRLPGTDAFGDVEQYPMAVNIPGVLIVSLKSSWLCFANANLVEERIERWVNNAKAKEGRESTFTYVIIDASSLTNIDTAGIASLVELNKNLISRGVKLAIANPRWHVIHKLRLANFVSKIGGRIFLSVGEAVDACVGTKIMVVV

SEQ ID NO: 145012 - protein, 312 aa, Glycine max
  Coding DNA Sequence Number=SeqID_28234
  Gene Ontology: Mol. function=heat shock protein binding; Cellular component=endoplasmic reticulum; Biological process=protein folding
  Homolog annotation: Hit_ID=Q9ZSY2; Match level="QueryCoverage=93%, HitCoverage=71%, E-value=1e-150, Identity=90%"; Hit description =Chaperone protein dnaJ 15
  Pfam annotation: Domain name=DnaJ; Domain location=4-56; Score=34.6; E_value=3.4e-07; Accession=PF00226.21; Description=DnaJ domain
MTKKTWIQKMMIGDSYLRNLYHPDKNASNPEASELFKEVAYSYSILSDPEKRRQYDSAGFEALDADSMDMEIDLSNLGTVNTMFAALFSKLGVPIKTTISANVLEEALNGTVTVRPLPIGSSVSGKVEKQCAHFFGVTINEHQAESGIVVRVTSTAQSKFKLLYFEQDANGGYGLALQEDSEKTGKVTSAGMYFLHFQVYRMDSTVNALAMAKDPEGAFFKRLEGLQPCEVSELKPGTHIFAVYGDNFFKTASYTIEAVCAKSYEDTTQKLKDIEAQILRKRNELRQFEAEYRKALARYQEVTDRYTKEKQS

SEQ ID NO: 145013 - protein, 60 aa, Glycine max
  Coding DNA Sequence Number=SeqID_28235
MHENDRKIRRKLESSDEEIKSALQHWRFLFIKSAYEENNSALVQISEVLVHQKFLFAVLL

SEQ ID NO: 145014 - protein, 108 aa, Glycine max
  Coding DNA Sequence Number=SeqID_28236
MKNSNNNNNKRKRKEKLKRESKEENVLKSKLSKQCDMLLIGPTAPKIEFKSNKDVPTEGGRHAIQSGIGSVVDWLLSLEWENKADNLQGGNLGSGWEQKKTRFSFSRI

SEQ ID NO: 145015 - protein, 208 aa, Glycine max
  Coding DNA Sequence Number=SeqID_28237
ISAYHGCRMTKLGLCVPSDTTVSEWQRGADNHKVSPRIMGIFAYHGCRMTKLGLCVPTDTTVSEWQRGADNRKVSPRIMGIFAYHGCRMTKLGLCVPSDTTVSEWQRGADNRKVSPRIMGISAYHGCRMTKLGLCLSSGPPPLDDKRGANNHKVSSRIMGISAYHGCRMTKLGLCVPSDTTVSEWQRGADNRKGADNRKVSPRIMGAE

SEQ ID NO: 145016 - protein, 136 aa, Glycine max
  Coding DNA Sequence Number=SeqID_28238
MVTSVLQLDSMNLFVKARAWFNPITQGMAILIANTSSTFHRDERLGNTHGKTQGSRMSKHENNWYAICRSKSLENHLSLPAHLGAQCPMCAVKKTIWIFRLPTTKDETYIQRMCDDMMQMRKSATGGFTQHGNILK

SEQ ID NO: 145017 - protein, 374 aa, Glycine max
  Coding DNA Sequence Number=SeqID_28239
  Gene Ontology: Mol. function=binding; Cellular component =intracellular; Biological process=metabolic process
  Homolog annotation: Hit_ID=Q5ZDP1; Match level="QueryCoverage=98%, HitCoverage=74%, E-value=4e-70, Identity=35%"; Hit description =Pentatricopeptide (PPR) repeat-containing protein-like
  Pfam annotation: Domain name=PPR; Domain location=11-45; Score=1.2; E_ value=5.4; Accession=PF01535.11; Description=PPR repeat
  Pfam annotation: Domain name=PPR; Domain location=127-161; Score=9.0; E_value=0.64; Accession=PF01535.11; Description=PPR repeat
  Pfam annotation: Domain name=PPR; Domain location=241-275; Score =39.8; E_value=9.1e-09; Accession=PF01535.11; Description=PPR repeat
  Pfam annotation: Domain name=PPR; Domain location=331-365; Score=1.8; E_value=4.5; Accession=PF01535.11; Description=PPR repeat
  Pfam annotation: Domain name=PPR; Domain location=77-111; Score=19.2; E_value=0.015; Accession=PF01535.11; Description=PPR repeat
  Pfam module annotation: Pfam domain module=PPR::PPR::PPR::PPR::PPR; Domain location=11-45::127-161::241-275::331-365::77-111
MCLLGVKSNEFTFPSVLKACSMKRDLNMGRKVHGMAVVIGFESDGFVVNILVVMYAKCCLLADSRRLFGGIVEQNVVSWNAMFSCYVQSESCGEAVGSFKEMSRKDGSWIMLKMGLNLDQFSENVFVDIYWLIAGCVLHNRNDLALMLLDEMKGSGTHPNMFTLSSALKACATMGFKELGRQLHSSLIKMDADSDLFAAVGVQDADIKPDPFICSFLLNVCGNLFAYADRAFSEIPNRGIVSWSAMIGGYAQHGHGKEALQLFNQMLRDGVTQPYYFGKLNEAVELVNSIPFEADGSVWGALLGAARIHKNIELGQKAAEMLFDLEPEKSGTHVLLANIYASAGIWENVAKVRKLMKDNKVKKEPGMSWNEIKD

SEQ ID NO: 145018 - protein, 68 aa, Glycine max
  Coding DNA Sequence Number=SeqID_28240
MEDHNNDGKGERARDFEGGVKNDAIKGHKRLERFKNQITTTYTSKILAREVLEGKREGKHEKVTVRKF

SEQ ID NO: 145019 - protein, 166 aa, Glycine max
  Coding DNA Sequence Number=SeqID_28241
MAQAQGWLANLTFKPPAHLNPYCLKFPCEEDELVVDQQVLMSFIIGKYKDVVLCYVASIESYSLFKGFQEELPCVEFKISCSTLLFDDEVSHVKMENEDEVSMEESKTLILSSNLNDEINSYCNFVCASNHAKSFVIMPKEELYIKNEWARQFGEEVDAHEDQGNH

SEQ ID NO: 145020 - protein, 73 aa, Glycine max
  Coding DNA Sequence Number=SeqID_28242
MEDIKSYETKKEDLESYQKDVESYETKNEDLESYESKKEDVESYETKKEELESYETKKEVESYETENGGCSAL

SEQ ID NO: 145021 - protein, 202 aa, Glycine max
  Coding DNA Sequence Number=SeqID_28243
  Gene Ontology: Mol. function=RNA-directed DNA polymerase activity; Cellular component=signal recognition particle, endoplasmic reticulum targeting; Biological process=RNA-dependent DNA replication
MEVVGKMKGLMTKHPHGGNLKKMQERRIRKLEIETWKEMKELMRKTFLPPSYERDAYDRLQNLTQDSKSLEEYHKEMIMTIRRANVQEPKTSMTTFLCGLNRDIQCIVKLQHYESLDMVHQAKKIERQLERKHSYKKTYQYNSFSGKDKSKKEGSSPSKQQGSKSPSGKHVSNPSISSTSRNISIKCFKCLHNIVQTRKPKF

SEQ ID NO: 145022 - protein, 98 aa, Glycine max
  Coding DNA Sequence Number=SeqID_28244
MRKNRKNENIPLLRNGIVASNKIPEACRLSDGPTGSVVVHFVVMFSMFLIVQVAIRNDQLHILIRRRQYDVMEVMKNKQEQQQQKQQRAMSHTQIAAK

SEQ ID NO: 145023 - protein, 179 aa, Glycine max
  Coding DNA Sequence Number=SeqID_28245
  Gene Ontology: Mol. function=galactosyltransferase activity; Cellular component=membrane; Biological process=protein amino acid glycosylation
  Homolog annotation: Hit_ID=Q9ZS49; Match level="QueryCoverage=98%, HitCoverage=43%, E-value=5e-59, Identity=65%"; Hit description=Avr9 elicitor response protein
MKIRSSKKISAKWVPVFSVFSFLIGMLITTRIWEPPESNGVFLSNHRHEQELQVVSGDCAPKKPVQDNDVMNKVYKTHGAIQGVRSLDKQVSMLQMELAAARSTREHKISDGSANTLASGVSTEGPPRKKVFVVIGINTAFSSRKRRDSVRETWMPQGEQLLQLEREKGIVIRFMIGHR

SEQ ID NO: 145024 - protein, 41 aa, Glycine max
  Coding DNA Sequence Number=SeqID_28246
VEFAPVISDLRSLHMSEQVTIPELLIFYQWHVCVYCSDCIL

SEQ ID NO: 145025 - protein, 50 aa, Glycine max
  Coding DNA Sequence Number=SeqID_28247
MVDTSTTDVICCEVHPNATSLLSQPYKVNLCYSVGRKIIDWKLVQNTING

SEQ ID NO: 145026 - protein, 132 aa, Glycine max [sequence omitted]

SEQ ID NO: 145027 - protein, 81 aa, Glycine max
  Coding DNA Sequence Number=SeqID_28249
MLADSKLNIEVQHAWIPPPFRTLKCNCDAAFFVEEGITDFGACLRNGGGDFLQARTSLLKQICQSRRVKNKWCLTGSNLAQ

SEQ ID NO: 145028 - protein, 542 aa, Glycine max
  Coding DNA Sequence Number=SeqID_28250
  Gene Ontology: Mol. function=metal ion binding; Cellular component =intracellular
  Homolog annotation: Hit_ID=Q500Y9; Match level="QueryCoverage=44%, HitCoverage=76%, E-value=8e-87, Identity=65%"; Hit description=NADH kinase
  Pfam annotation: Domain name=NAD_kinase; Domain location=7-252; Score= -1.2; E_value=1.8e-05; Accession=PF01513.11; Description=ATP-NAD kinase
  Pfam annotation: Domain name=zf-B_box; Domain location=260-307; Score= 53.0; E_value=1e-12; Accession=PF00643.14; Description=B-box zinc finger
  Pfam annotation: Domain name=zf-B_box; Domain location=312-359; Score= 58.5; E_value=2.2e-14; Accession=PF00643.14; Description=B-box zinc finger
  Pfam module annotation: Pfam domain module=NAD_kinase::zf-B_box::zf-B_ box; Domain location=7-252::260-307::312-359
MLENLQILQFLENRRKVHHDAINFCQAILQKKSIEWKAVHRNNLSQPINDVDLVITLGGDGTLLQASHLMDDKIPVLGVNSDPTQIDEVEEFGSEFDARRSTGHLCAAIVENFEQVLDGILEGQIVPSELTRIVMSVNALHLPTFALNDILISHPCPASLSRFSFRIKEGDQPCSPLVNCRSSGLRVSTATGSTAAMQSAGGFPMPILSQDLQYMVREPISPGATSDHMHGLIKPDQTIVATWTCRKGWNPEFGLVGVERMKIQCNVCEAAEAKVLCCADEAGLCWECDEKVHAANKLASKHQRVPLSTSSSHMPKCDICQEALGYFFCLEDRALLCRKCDVAIHTANAYVSGHQRFLLTGVRVGLEATDPGASSTSLKSDSGEKVSDSSVSRKVSTAPQPSNYNEVLPAEVGGVGEFPSAKVSFGGGSTAGNISQWTIDEFIGLNEFSQNYDYMEGSSRADGGKLGDSDSPVLRSGEEEMEEEDDYLERVPDSSWTVPQIPSPPTSSGLCWPKDHTNLYGSSDSVLFVPDISFSHLQQSQI

SEQ ID NO: 145029 - protein, 160 aa, Glycine max
  Coding DNA Sequence Number=SeqID_28251
  Gene Ontology: Mol. function=intramolecular transferase activity, phosphotransferases; Biological process=metabolic process
  Homolog annotation: Hit_ID=Q1T1X7; Match level="QueryCoverage=75%, HitCoverage=75%, E-value=4e-53, Identity=77%"; Hit description =Pollen Ole e 1 allergen and extensin
  Pfam annotation: Domain name=Pollen_Ole_e_I; Domain location=47-159; Score=106.4; E_value=8.1e-29; Accession=PF01190.8; Description =Pollen proteins Ole e I family
MANIPNSSRRNYKSCKSSPDNYVPSASPDHLAITLYIFPIATEIFHVKGSVYCDTCRAGFETNATFYIQGAKVGIQCKERKTMKVVYYTEGVTDSTGTYHIEVENDHRDNICECVLVKSPIKWCNTPDSGRDKSSIVLTHHQNGVVNHLHYANAMGYLRD

SEQ ID NO: 145030 - protein, 121 aa, Glycine max
  Coding DNA Sequence Number=SeqID_28252
MEKKEAIWLAALISVKFFLKANSPIFQSLEEYMFLLSFLIDDGLHSPSDYHASTTAFCFESLPISSPLLLLFKTLCCSHPEYSSYGIVYPILPSIPCPQRRDAFMRDDACNYVIPNIPKRV

SEQ ID NO: 145031 - protein, 39 aa, Glycine max
  Coding DNA Sequence Number=SeqID_28253
MALKREFIRLKCDAELGLTKSPLSCWDWIVVGLPSIYSL

SEQ ID NO: 145032 - protein, 203 aa, Glycine max
  Coding DNA Sequence Number=SeqID_28254
MTVMLQSMWKALLSTTLLAWCSEGDTHPMESATWSNPLPLSTLTSPSHLRHPSPYKFSTLHAFPLSSLSSSFSFHPFPLHLTPSLSPFSPKPISFNPLRPLPRTMHATRIQDAVGGALALVQSSPATWQSALLSNALIFLLGSPILVSGLSLSGIGAAFLLGTLTWRAFGPSGFFLVATYFVICEVGLFGEWCGIWEWVCGFG

SEQ ID NO: 145033 - protein, 202 aa, Glycine max
  Coding DNA Sequence Number=SeqID_28255
  Gene Ontology: Mol. function=DNA topoisomerase (ATP-hydrolyzing) activity; Cellular component=chromosome; Biological process=DNA topological change
  Homolog annotation: Hit_ID=Q0GPE3; Match level="QueryCoverage=88%, HitCoverage=69%, E-value=2e-65, Identity=68%"; Hit description=BZIP transcription factor bZIP133
MAQLLEESECFGLSFSNWINHHISYIEALNVWLQNCILQPRERFKSRKPFCPLRALAPPIFVLCRDWCAGIKALPSEELSHTIKNFVSDLRCMVEQQDKELHEKQNSAVASIGGETESKTNEDSEDDSLHLCCIHASLTKLVHQLTKFSEASLKSYEDIRQKSETAQTAYHNCMSIRTGKIRSSNINFLFLPKINRKSKMIS

SEQ ID NO: 145034 - protein, 190 aa, Glycine max
  Coding DNA Sequence Number=SeqID_28256
  Homolog annotation: Hit_ID=Q1S9S5; Match level="QueryCoverage=48%, HitCoverage=24%, E-value=3e-08, Identity=34%"; Hit description =Leucine-rich repeat; Leucine-rich repeat, cysteine-containing type
  Pfam annotation: Domain name=LRRNT_2; Domain location=31-73; Score =43.0; E_value=1e-09; Accession=PF08263.3; Description=Leucine rich repeat N-terminal domain
MELCRKKQWLVSVLLGAIVLSDVLGNSSGCFQQEKAALLDFKATYHGNDSLKLRSWVNEAKSNCCDWERVTCDSSSGHVIHLDLGNTIAESEMVPFVYPPGEMGPYTSNIKMPPWPYPYCSKHTSRFLNWSLFLPFRKLTSLSLSNSCLLGFIRTEVIITGMRKYCLGVTIILNLYDKIINVNQCKMKVV

SEQ ID NO: 145035 - protein, 161 aa, Glycine max
  Coding DNA Sequence Number=SeqID_28257
  Homolog annotation: Hit_ID=Q10M67; Match level="QueryCoverage=70%, HitCoverage=14%, E-value=2e-13, Identity=40%"; Hit description =Expressed protein
MFQGDVAIAVQGCKQNNVGVVGQSNSKYNKKDLTVNAEREDPSEFITHRAKDFLPSIKVIENRFVRASESGREVSRLLEANKIKVGYYEAKGKSSPTILLAAFMFACCDQKGTPVCQEPAEKIINWKRALSSQSSSVRNPLVTTSKEYILIMEATLLKNPA

SEQ ID NO: 145036 - protein, 104 aa, Glycine max
  Coding DNA Sequence Number=SeqID_28258
MTWMILGRITQTIWRQQVIYVLCQPNHIPHEATPASTHADLDADEPRHVVEACHAIAEALEQHLNAPGTSTHEEVIQKCLRIAKGVTEDRNVYVKSRRRRRTDQ

SEQ ID NO: 145037 - protein, 91 aa, Glycine max
  Coding DNA Sequence Number=SeqID_28259
MTWMILGRITQTIWRQQVIYVLCQPNHIPHEATPASTHADLDADEPRHVVEACHAIAEALEQHLNAPGTSTHEEVIQKCLRIAKGVTEDRN

SEQ ID NO: 145038 - protein, 298 aa, Glycine max
  Coding DNA Sequence Number=SeqID_28260
  Gene Ontology: Mol. function=DNA binding; Cellular component=nucleus; Biological process=regulation of transcription, DNA-dependent
  Homolog annotation: Hit_ID=Q84WU6; Match level="QueryCoverage=96%, HitCoverage=51%, E-value=4e-64, Identity=45%"; Hit description=Auxin response factor 17
  Pfam annotation: Domain name=Auxin_resp; Domain location=214-292; Score=92.7; E_value=1.1e-24; Accession=PF06507.4; Description=Auxin response factor
  Pfam annotation: Domain name=B3; Domain location=78-183; Score=100.8; E_value=4.1e-27; Accession=PF02362.12; Description=B3 DNA binding domain
  Pfam module annotation: Pfam domain module=Auxin_resp::B3; Domain location=214-292::78-183
MEHASPSHYLSPLIRSLPFVPCHVSSLDFLADPFSDEVFAKFLLTPLSQSQQQPFQNDTKEARNDDDDEDRENNGVVSFAKILTPSDANNGGGFSVPRFCADSCFPPLDFRADPPVQLLSVADIHGVEWRFRHIYRGTPRRHLFTTGWSKFVNHKKLVAGDTVVFVKDSDGIVSVGIRRAARFAAAIETPPPAEREGFSRSTTGRVTAEAVAAAAESAARNAPFEVVYYPRTGFADFVVSAEVVEESMKCAWVGGMRVKISMETEDSSRMTWYQGTVSSACASENGPWRMLQTFIHVN

SEQ ID NO: 145039 - protein, 44 aa, Glycine max
  Coding DNA Sequence Number=SeqID_28261
MELGDLHGGAGTCPPDFGVDAAGLRRRHEGELKYREETEMKREQ

SEQ ID NO: 145040 - protein, 141 aa, Glycine max
  Coding DNA Sequence Number=SeqID_28262
  Subcellular localization annotation: CTP_CleavageSite=63; ConfidenceScore=5.28e-01
LLSGPTGFKAQTKPTKAETALRGKVDVVVNVVVVVFLGIHGAPPSAAPLRRSVRSLLNIPRLVCGVETGAGARAIGARGFRPQEESCSSEAPNWVSPSAVVKLHLDDQLVMGSNLETASLHMQGFIANLTSWDKAVVGVLK

SEQ ID NO: 145041 - protein, 221 aa, Glycine max
  Coding DNA Sequence Number=SeqID_28263
  Gene Ontology: Mol. function=DNA binding; Cellular component=nucleus; Biological process=regulation of transcription, DNA-dependent
  Homolog annotation: Hit_ID=Q1S6Y4; Match level="QueryCoverage=96%, HitCoverage=40%, E-value=5e-29, Identity=36%"; Hit description =Transcriptional factor B3; Auxin response factor
VNWDEPEVLQNAKQVSPWQVELVSPPFALHTVFSPNKRLRADQGSGLLSNREQDPFFPMPGFSNSAMGHMTGFPNSTVGQMDKPLLSYESFPAGMQGARHDLYSPLSFSNFLNDNSYLYMGSGSFGNNPVQSLGTVTTELNMSSSQSDDLSPHSQSSFHSFGTEFTGTRNCDTKVGPGSILLFGKIIQPAESDLHDADCMERDGSRGSNKLKTVEACYFSK

SEQ ID NO: 145042 - protein, 127 aa, Glycine max
  Coding DNA Sequence Number=SeqID_28264
MYIYAYYRQQFVYCIMNVDCIVPHHALNPHKLLRTTLMLLSMHVSEQYAAAYITDESLSVTSWLLTALFSITYQAQRITENHIKAVLDALCSCKHYRRRYIGTIVSVITLLPTDYVQKTVSSLHHDY

SEQ ID NO: 145043 - protein, 272 aa, Glycine max
  Coding DNA Sequence Number=SeqID_28265
  Gene Ontology: Mol. function=helicase activity; Biological process =viral genome replication
  Homolog annotation: Hit_ID=Q1SRJ5; Match level="QueryCoverage=88%, HitCoverage=31%, E-value=1e-69, Identity=50%"; Hit description =Probable helicase [imported]-Arabidopsis thaliana-related
MYTVEFQKRGLPHVHLLLFLHANNKYSSPNNIDNIISAEIPSQKDDPELYKLVQNHMIHGLCGILRHASPCMKEGKCSRFYPKKFQPTTLIDGDGYPIYRRRNTGWTITKNGIIIDNRCIVPYNPKLLKNYQAHINIEWCNQSTSIKYLFKYINKGYDRVTAVMVHDDNETVPLANTPNDEIKEYLDCRKPSVERLQFHLPGQHSVLYQDHDDIDDLLSNPSISKSKFIAWMNTNQAFVEGTMNKPEEVWEKTWHWLSDDIVYSHRRSSNTP

SEQ ID NO: 145044 - protein, 89 aa, Glycine max
  Coding DNA Sequence Number=SeqID_28266
MFSHWCCFVCLFLLAGLRAVVANAQVYRKVGNKHLPSRSILVDASGHENFSTIQTPIDSVPSNNRYWVSIKVKAESPTFAAMADNLVVK

SEQ ID NO: 145045 - protein, 80 aa, Glycine max
  Coding DNA Sequence Number=SeqID_28267
MQHKPKVQRASPKERNSQRSEDKRGGGTGWEWQNNAGMSLWMLSCHWVGFRSSRWMAGVAVCRSVNMNRESGISVSSNET

SEQ ID NO: 145046 - protein, 319 aa, Glycine max
  Coding DNA Sequence Number=SeqID_28268
  Gene Ontology: Mol. function=protein serine/threonine kinase activity; Biological process=protein amino acid phosphorylation
  Homolog annotation: Hit_ID=Q7XTK4; Match level="QueryCoverage=99%, HitCoverage=53%, E-value=2e-54, Identity=41%"; Hit description =Putative mitogen-activated protein kinase 1
MMNHLPRIFGHRKKQASDNMDPTTKNKKKSKKKQQPKLERRNASNHFEYDAGSSCSWRGGDEKDASVSTSSSSSSSLHCTRSMDLYDRTSFRIEGVEGEFDRICRSLGLSGPEDFSIPAAAWEAMKLRCSSDLLPRRPKHGGDEFDEEAKEKEEIEVVESEDRARVLDECVVSAESSGCCGGIKGFRPPMLKPPPGVRVSVVDDATCSTWDLMRDFAPNGEGEGKDSYVELNSFDDEDDHERVEKEEEEDEEDEEEEEGEVGGVREKSVEEENAARIAEIVDDFSGFSTPNEDDSSSTTTGPRSNSISPNGRIKRVITA

SEQ ID NO: 145047 - protein, 101 aa, Glycine max
  Coding DNA Sequence Number=SeqID_28269
  Gene Ontology: Mol. function=DNA polymerase processivity factor activity; Cellular component=PCNA complex; Biological process =regulation of DNA replication
  Homolog annotation: Hit_ID=P22177; Match level="QueryCoverage=62%, HitCoverage=41%, E-value=1e-19, Identity=55%"; Hit description =Proliferating cell nuclear antigen
  Pfam annotation: Domain name=PCNA_C; Domain location=39-101; Score= -29.6; E_value=0.014; Accession=PF02747.6; Description=Proliferating cell nuclear antigen, C-terminal domain
MTIIFYNDINFGEGFLQSLCKNDDLGFRNDEVYAAAQDKISDFEMKLMDIDNEYLGILEEGVKFSTKGDIGTTNIVCKQNTSMDKPEEASIIEMNEPLSNI

SEQ ID NO: 145048 - protein, 66 aa, Glycine max
  Coding DNA Sequence Number=SeqID_28270
MKAEEQQLQPSKLYLLGSRSNPRHQWGVGKAETSQELFYSSLDYDYLVRMFSLDCGLDVLSCNIVD

SEQ ID NO: 145049 - protein, 68 aa, Glycine max
  Coding DNA Sequence Number=SeqID_28271
  Gene Ontology: Mol. function=monooxygenase activity; Cellular component=integral to membrane; Biological process=electron transport
  Homolog annotation: Hit_ID=Q1WCN9; Match level="QueryCoverage=59%, HitCoverage=11%, E-value=5e-10, Identity=63%"; Hit description =Cytochrome P450 monooxygenase CYP76X3
MDVEINGYTIPQGAQIVINEWANGRNPSKWENPNSFSPESYICADKTAHVHLFLDSNTEQISYEIGLS

SEQ ID NO: 145050 - protein, 294 aa, Glycine max
  Coding DNA Sequence Number=SeqID_28272
  Gene Ontology: Mol. function=protein binding
  Homolog annotation: Hit_ID=Q9C6A6; Match level="QueryCoverage=95%, HitCoverage=24%, E-value=1e-17, Identity=30%"; Hit description =Disease resistance protein, putative; 11609-15699
  Pfam annotation: Domain name=LRRNT_2; Domain location=31-73; Score =43.0; E_value=1e-09; Accession=PF08263.3; Description=Leucine rich repeat N-terminal domain
  Pfam annotation: Domain name=LRR_1; Domain location=141-164; Score =2.9; E_value=83; Accession=PF00560.23; Description=Leucine Rich Repeat
  Pfam annotation: Domain name=LRR_1; Domain location=168-190; Score =9.0; E_value=6; Accession=PF00560.23; Description=Leucine Rich Repeat
  Pfam annotation: Domain name=LRR_1; Domain location=192-214; Score =0.4; E_value=2.4e+02; Accession=PF00560.23; Description=Leucine Rich Repeat
  Pfam annotation: Domain name=LRR_1; Domain location=216-236; Score =3.2; E_value=71; Accession=PF00560.23; Description=Leucine Rich Repeat
  Pfam annotation: Domain name=LRR_1; Domain location=246-268; Score =8.3; E_value=8.1; Accession=PF00560.23; Description=Leucine Rich Repeat
  Pfam annotation: Domain name=LRR_1; Domain location=270-290; Score =0.5; E_value=2.2e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=31-73::141-164::168-190::192 -214::216-236::246-268::270-290
MEMCRKKQWLVSVLLGAIVLSDVLGNSSGCFQQEKAALLDFKATYHGNDSLKLRSWVNEAKSNCCDWERVTCDSSSGHVIHLDLGNLYTIAESEMVPLVYPPAGEMGPYPLSIKMPLWPSPYCSKHTSRFLNWSLFLPFRKLTSLSLSNSCLLGFIRTEDDSKSTLKKLETLDLSFNYLNESIMELVGVLPSVKNLILAANFIRGPFLKELSLLPNLEVLDLAINLLGNGSHFATQDYKNKSTLKKLKTLDLSFNYLNESIMELVGALRSIKNLALADNFIARPFPIKGMIVHN

SEQ ID NO: 145051 - protein, 651 aa, Glycine max
  Coding DNA Sequence Number=SeqID_28273
  Gene Ontology: Mol. function=protein binding; Cellular component =integral to membrane; Biological process=protein amino acid phosphorylation
  Homolog annotation: Hit_ID=Q9C6A7; Match level="QueryCoverage=97%, HitCoverage=87%, E-value=3e-92, Identity=29%"; Hit description =Disease resistance protein, putative; 6346-10057
  Pfam annotation: Domain name=LRR_1; Domain location=126-149; Score =14.7; E_value=0.33; Accession=PF00560.23; Description=Leucine Rich Repeat
  Pfam annotation: Domain name=LRR_1; Domain location=151-175; Score =10.9; E_value=2.7; Accession=PF00560.23; Description=Leucine Rich Repeat
  Pfam annotation: Domain name=LRR_1; Domain location=178-200; Score =12.6; E_value=1.3; Accession=PF00560.23; Description=Leucine Rich Repeat
  Pfam annotation: Domain name=LRR_1; Domain location=203-225; Score =7.9; E_value=9.3; Accession=PF00560.23; Description=Leucine Rich Repeat
  Pfam annotation: Domain name=LRR_1; Domain location=227-250; Score =12.0; E_value=1.6; Accession=PF00560.23; Description=Leucine Rich Repeat
  Pfam annotation: Domain name=LRR_1; Domain location=252-274; Score =6.4; E_value=18; Accession=PF00560.23; Description=Leucine Rich Repeat
  Pfam annotation: Domain name=LRR_1; Domain location=27-49; Score=9.7; E_value=4.4; Accession=PF00560.23; Description=Leucine Rich Repeat
  Pfam annotation: Domain name=LRR_1; Domain location=275-297; Score =3.8; E_value=56; Accession=PF00560.23; Description=Leucine Rich Repeat
  Pfam annotation: Domain name=LRR_1; Domain location=298-317; Score =14.9; E_value=0.29; Accession=PF00560.23; Description=Leucine Rich Repeat
  Pfam annotation: Domain name=LRR_1; Domain location=3-25; Score=6.4; E_value=18; Accession=PF00560.23; Description=Leucine Rich Repeat
  Pfam annotation: Domain name=LRR_1; Domain location=319-342; Score =5.1; E_value=31; Accession=PF00560.23; Description=Leucine Rich Repeat
  Pfam annotation: Domain name=LRR_1; Domain location=344-366; Score =6.2; E_value=20; Accession=PF00560.23; Description=Leucine Rich Repeat
  Pfam annotation: Domain name=LRR_1; Domain location=368-390; Score =9.8; E_value=4.2; Accession=PF00560.23; Description=Leucine Rich Repeat
  Pfam annotation: Domain name=LRR_1; Domain location=392-414; Score =14.4; E_value=0.41; Accession=PF00560.23; Description=Leucine Rich Repeat
  Pfam annotation: Domain name=LRR_1; Domain location=459-481; Score =9.5; E_value=4.8; Accession=PF00560.23; Description=Leucine Rich Repeat
  Pfam annotation: Domain name=LRR_1; Domain location=483-505; Score =16.1; E_value=0.12; Accession=PF00560.23; Description=Leucine Rich Repeat
  Pfam annotation: Domain name=LRR_1; Domain location=507-529; Score =20.3; E_value=0.0069; Accession=PF00560.23; Description=Leucine Rich Repeat
  Pfam annotation: Domain name=LRR_1; Domain location=51-74; Score=6.0; E_value=21; Accession=PF00560.23; Description=Leucine Rich Repeat
  Pfam annotation: Domain name=LRR_1; Domain location=531-555; Score =7.5; E_value=12; Accession=PF00560.23; Description=Leucine Rich Repeat
  Pfam annotation: Domain name=LRR_1; Domain location=76-103; Score =2.0; E_value=1.2e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1; Domain location =126-149::151-175::...
  Pfam module annotation: Domain location=178-200::203-225::227 -250::252-274::27-49::275-297::298-317::3-25::319-342::344-366::368 -390::392-414::459-481::483-505::507-529::51-74::531-555::76-103
MKQLREAGLSYNNLIGTLDPCLGNLTSLHSLDLCFNFLSGNPAPFIGHLVSIENLCISFNEFEGIFSLSIFSNHSRLKSLLIGNMKVDTENPPWIAPFQLEQLAITSCKLNLPTKVIPTFLSNQSSLRDIDLSGNNLVGKFPSWLLVNNSNLEEVDLFHNSFSGPFELPFDLNHHMDKIKTLSLSNNQMQGKLPDNIGSFFPHLVNFDVSNNNFDGHIPASIGEMSSLQGLYMGNNNFSGNVPNHILDGCFSLKTLMMDSNQLNGTLLSVIRKLRLVTLTASRNNFEGAITDEWCQHNLVMLDLSHNKFSGTIPSCFEMPAYLFLQGNSLTGTIPEALISNYSRPTAIDFSDNKFIGTIPDSIYKLWSLRFLLLAGNQLQGQLSSQVCQLEQINILDLSRNNFTGSIPPCFSSMSFGNFTIPLYSLDRLKPFSPRPDVAEMQLTTKNLYLSFKSDKFQMMSGLDLSSNQLTGEIPHQIGDLHYLHSLNLSHNHLHGLIPESFQKLKNIESLDLSNNNLSGQIPIQLQDLNFLSTFDVSYNNLSGKAPDKGQFANFDEDNYKGNPYLTWNNSNRGSLTTLPPPSTALHDGEENDTAIDFTAFCWSFASCYVMVQIVLVIILWINPHWRRQWFYFVEVCLHKCFGQFLEDVFY

SEQ ID NO: 145052 - protein, 66 aa, Glycine max
  Coding DNA Sequence Number=SeqID_28274
  Gene Ontology: Mol. function=kinase activity
  Homolog annotation: Hit_ID=Q84PE0; Match level="QueryCoverage=84%, HitCoverage=11%, E-value=4e-17, Identity=71%"; Hit description=AKIN betagamma
KLIRGCLPQSGKVVALDITLPVKQAFHALYREGISMASLWDSNKCQFVGMLSAMDFILVLKEVCGE

SEQ ID NO: 145053 - protein, 98 aa, Glycine max
  Coding DNA Sequence Number=SeqID_28275
MIMMPQWRKLITFVLREVVTDVDVEGFPGGPHDTLVLRDFENYIGLRVWNGVEHPELKLSSHGRKMAKFGRHAPEIEGLVASSRLSPLIACSLDMGNL

SEQ ID NO: 145054 - protein, 719 aa, Glycine max
  Coding DNA Sequence Number=SeqID_28276
  Gene Ontology: Mol. function=DNA binding; Cellular component=nucleus
  Homolog annotation: Hit_ID=Q1SBB2; Match level="QueryCoverage=95%, HitCoverage=99%, E-value=1e-160, Identity=46%"; Hit description =Homeodomain-like
MESTGKDYDNTMELASYRQLIPPSSPDISKIVGTTKSNLRIGHEYQVEVPSIIKESEQLKLPMNPADSELVDKEVEDNVAAAANLNNSWSDADVKSFLLGLFIFRKNFVQIKRFLENKGMGEILSFYYGKFYKSDEYQRWSDCKKLKGRKCITGHKLFSGRKQRELLSHLTLHVSEEFKDALQQVSKSYSEGRISLEEYISSLKSTVGLGVLVEAVDIGKGKADLTRPAVEHVKKTQVLSIPTSKAWSSLGPSDIIKHLTGGYRLSKAKSNDIFWDAVWPRLLARGWHSEKLKNQGSLSSKNLVVFLFPGVKKFSRRKLVKGDHYFDSVSDVLSKVIAEPNLLKLEVVETKVGGSNEEDAETGSNKDSQPDNHHHRYLKHRASTNNADHMKCAVFDTGLVHRGKTSDLRELKSLPANLVGKVEVDADDMVYNKGNKHVSKTKQGKGKLDDISPSGTETAKIYSKKNSSDADCQKGKHNRDASGQKQVNVNPDDANKMAENCENQKTYVPDGNQPKRNVENQFSQRARSGHSDVAVPPIKRQRLTSWAKAETSHILKNSSGGLGSEKLGLSQSSCFPDANKKAGNPLDHQQDVTLISYSAEVSMELKKEERNFNRVCLDKGTSCDKVEKCESQHSINFNAPQVSLKFEDGEMMEMAEEDEQGPKPNDTIPRRKSTRNRPLTVRALESFANEFLHAQRKQKRKHTLTLKHPFSACSRKART

SEQ ID NO: 145055 - protein, 88 aa, Glycine max
  Coding DNA Sequence Number=SeqID_28277
MPLLPFNVAKRRRLSKSKRQERRKNNRESIGECTPLLMAAKIGIVELVEKFIDVNPSATFHVTKNGQNILIILCLKNTNDWNRHDPSI

SEQ ID NO: 145056 - protein, 398 aa, Glycine max
  Coding DNA Sequence Number=SeqID_28278
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q9FJQ1; Match level="QueryCoverage=88%, HitCoverage=95%, E-value=1e-147, Identity=71%"; Hit description =Trehalose-6-phosphate phosphatase
  Pfam annotation: Domain name=Trehalose_PPase; Domain location=142 -377; Score=349.4; E_value=6e-102; Accession=PF02358.7; Description =Trehalose-phosphatase
  Subcellular localization annotation: CTP_CleavageSite=96; ConfidenceScore=5.37e-01
MVTVGTSGISGVGKVVGPSYFPMALVGPIKFDCVKMTQQNVVVSDTKSGVSLTVFSTTQKPPAAPGGYISIPRRRVLKNLEINGGQRINAWVESMRASSPTHHKSTPSLSQEHNSWILHHPSALDMFDQIIDASKGKQIVMFLDYDGTLSPIVDDPDRAFMSDSMRKTVRKLARCFPTAIVTGRCKDKVYNFVRLAELYYAGSHGMDIKGPTRSSKYNKDSKAEAILCQPASDFLPMIDEVYQQLVEKTKSTPGALVENNKFCLSVHFRCVDEKKWSELARQVKSVLKEYPKLRLTQGRKVLEIRPTIKWDKGKALEFLLESLGLANCSDVFPVYIGDDRSDEDAFKKLRDRGQGFGILVSKFPKDTSASYSLQEPNEVMNFLQRLVEWKHVSLRARS

SEQ ID NO: 145057 - protein, 143 aa, Glycine max
  Coding DNA Sequence Number=SeqID_28279
  Homolog annotation: Hit_ID=Q1SJP8; Match level="QueryCoverage=76%, HitCoverage=6%, E-value=5e-31, Identity=55%"; Hit description=D -galactoside/L-rhamnose binding SUEL lectin; Integrase, catalytic region; ...
  Homolog annotation: Hit description=Galactose-binding like; Peptidase aspartic, catalytic
  Pfam annotation: Domain name=zf-CCHC; Domain location=39-56; Score =7.6; E_value=0.056; Accession=PF00098.13; Description=Zinc knuckle
MYANVCIDATRQEAMLSGTQNEGVAMAMKKSANSKKANRKCTHCNGTNHTVNTCFKLHGYPEWHPKGKKVEPPKDYSTAATVFVAKSGTFQPICGFSVVTKGSDWAPNTGGLAFHIHERLYTSGAHVDGRRDWMTKGKKGRNG

SEQ ID NO: 145058 - protein, 93 aa, Glycine max
  Coding DNA Sequence Number=SeqID_28280
MAGSLSKIIPDMSKIEPLDSSNYRRWSQKLLILFEALEVDYVLFEDPPADVNASESSTPKTPATPVVTPLPAETKKADEEAKKKYEKDNKTAR

SEQ ID NO: 145059 - protein, 123 aa, Glycine max
  Coding DNA Sequence Number=SeqID_28281
MDKDTLGYSGLRGLNNLGELVSGDYPTFGALIWHGSGGLTPTTNNFQEEPHHDLEFLLTPVEYDGWDNVRRYSLEQVHPLEVREDHRDHTDMSSEEIEEYQELLWQLKHASKEESDDPSEDIS

SEQ ID NO: 145060 - protein, 98 aa, Glycine max
  Coding DNA Sequence Number=SeqID_28282
  Gene Ontology: Mol. function=phosphatidylinositol phosphate kinase activity; Biological process=phosphatidylinositol metabolic process
  Homolog annotation: Hit_ID=Q9LLS0; Match level="QueryCoverage=84%, HitCoverage=11%, E-value=2e-33, Identity=79%"; Hit description =Putative phosphatidylinositol 4-phosphate 5-kinase
  Pfam annotation: Domain name=PIP5K; Domain location=2-81; Score= -138.4; E_value=0.013; Accession=PF01504.9; Description =Phosphatidylinositol-4-phosphate 5-Kinase
MPARAERMARRSDFDQYTPCCSGETYDVVIYCGIIDILQDYDISKKLEHAYKSLQVDPSSISAVDPKLYSKRFRDFVGRIFIEDCHDNEGREIFVHGG

SEQ ID NO: 145061 - protein, 66 aa, Glycine max
  Coding DNA Sequence Number=SeqID_28283
MTEIVIVTGCTCIDHGTIPDNDDGDNMKEISLKYSKSDNMKEISLKYSKSDNMKEISLKYSKSVFY

SEQ ID NO: 145062 - protein, 141 aa, Glycine max
  Coding DNA Sequence Number=SeqID_28284
MVKCDYATNIVDVAWMVGFYVLLSVFSIQSDPKRSEILSTYPSPRNLALCHRSTHQPLFFFLSLWRRGVMLPPPSMSPLVISFFPLARSLALDLHSLTFYVAAHQRPTFPSFLSLWHCVAVILLDSLSSSATLSTTTSQFN

SEQ ID NO: 145063 - protein, 632 aa, Glycine max
  Coding DNA Sequence Number=SeqID_28285
  Gene Ontology: Mol. function=ATPase activity, coupled to transmembrane movement of substances; Cellular component=integral to membrane; Biological process=transport
  Homolog annotation: Hit_ID=Q1T1V6; Match level="QueryCoverage=71%, HitCoverage=85%, E-value=0.0, Identity=57%"; Hit description=AAA ATPase
  Pfam annotation: Domain name=ABC_membrane_2; Domain location=3-200; Score=6.1; E_value=2.1e-07; Accession=PF06472.5; Description=ABC transporter transmembrane region
  Pfam annotation: Domain name=ABC_tran; Domain location=312-522; Score= 81.4; E_value=2.8e-21; Accession=PF00005.17; Description=ABC transporter
  Pfam module annotation: Pfam domain module=ABC_membrane_2::ABC_tran; Domain location=3-200::312-522
MDDFKGNAIIIYILLEKYRVQLLWGSFRGKSMHGTLMPLAVGVFHMANKNIDADQRITHDLEKLTADLSGLVTGMHLDMFDACSFLLLILLTVVYVKVHMENETINRTVTPDFGNLISQEQQLEGTFRFMHERLCTHAESVAFFGGGAREKAMVESRFRELLSHSKYLLKKKWLFGILDDFITKQLPHNVTWLLSLLYAMEHKGDRASISTQGELAHALRFLASVVSQSFLAFGDILELHRKFVELSGGINRIFELEELLDASQSGDSINSSITSPIWDYHGKDAISFCMVDIVTPTQKMLARELTCDIEFGKSLLVTGPNGSGKSSIFRVLRGLWPIASGRLSRPSEDVDLEAGSGCGIFYVPQRPYTCLGTLRDQIIYPLSREEAQFQALKMHGKGEKHPDLRIMLDTHLQVILENVRLNYLLERDNNGWDANLNWEDILSLGEQQRLGMARLFFHKPKFGILDECTNATSVDVEEHLYGLANKMGITVVTSSQSFNLDCSCPQEFLESLKKESLVLELRQNKIFRSHLVGKGEIPWKAILESPKMEFKEWVKMDLVSGISDCEDIMFKAPQVQVEIKIQVEKENNNNNRRKRLNNKWDECGCKHGHGQHAWCSADDYDIYALGAVLEAF

SEQ ID NO: 145064 - protein, 135 aa, Glycine max
  Coding DNA Sequence Number=SeqID_28286
  Gene Ontology: Mol. function=DNA binding; Biological process=DNA integration
MAISSLKDKFPWFTAMANFKAIGEPPIDLNSYDRNKFYREAKMYVTREKLASILWHCQSSPYGDAIAHAQRCNKCQRTSNIFRRHEMPLQSVLEIEVFDYWGIDFVSPLPLSYDNEYILVAVDYVVVMKVTVIQY

SEQ ID NO: 145065 - protein, 73 aa, Glycine max
  Coding DNA Sequence Number=SeqID_28287
MQHKPKVQKASPKERNSERSEDKRGGGTGWEWQNNDNIGKRRNGKKNPDRTAVGTGKKMESGEGKKQKRTGRT

SEQ ID NO: 145066 - protein, 74 aa, Glycine max
  Coding DNA Sequence Number=SeqID_28288
  Gene Ontology: Cellular component=photosystem II; Biological process =photosynthesis
  Homolog annotation: Hit_ID=Q5Z5A8; Match level="QueryCoverage=60%, HitCoverage=15%, E-value=1e-11, Identity=81%"; Hit description =Photosystem II stability/assembly factor HCF136, chloroplast precursor
MCSMRYWDGKFLYAKVKAFIYLCCFLRTVSTGISGASYYTGTFNIVNRSPGGSHSGCHVIEQLLEESRTCDGGL

SEQ ID NO: 145067 - protein, 32 aa, Glycine max
  Coding DNA Sequence Number=SeqID_28289
MHVAARAYDRAAIKFRGVDADIKRKSTFLKCQ

SEQ ID NO: 145068 - protein, 313 aa, Glycine max
  Coding DNA Sequence Number=SeqID_28290
  Gene Ontology: Cellular component=integral to membrane
MDPCPSSNTNTVNGFYTFVSRGMEELERAFLANNNFISVQFLQKVVSLLRSLHTQLTLLVHKLQLPLGDKWLDEYMDETSKLWETSHLLKSAISNFEPFYSQGFNLLSSLDSSHPHLSPQIVRAISGCRREALGLEEQNRALMETRIHTLCLRLDERVSVESKLNGFNGFRGVLYAMRNVSSMLLMILLHGLVYCWPETSELVAGGYEGGRMFLGSAVMVSAARLRQRVAVEMRGAAGPGILLYEFRRARVAVEELRGELEEAEGGVRERVESVRVCFGVLRSGAENIVCQLDDFFDEIVEGRKKLLDFCSHR

SEQ ID NO: 145069 - protein, 293 aa, Glycine max
  Coding DNA Sequence Number=SeqID_28291
  Homolog annotation: Hit_ID=P00722; Match level="QueryCoverage=19%, HitCoverage=5%, E-value=5e-19, Identity=77%"; Hit description=Beta -galactosidase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLIDGAGAGKHTRHARPKVQRAEAAKHIGGAARLLALQQLVLARHGQLGQCLAAGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145070 - protein, 111 aa, Glycine max
  Coding DNA Sequence Number=SeqID_28292
MMYRLVRVLMMVMIRRLMMVVIRGLMIVVIKSDNEYRSLDDKQATIGDFEDEDGETDELETPLEDERIFKIKKNDKKKVVVRCDPGCPFRLKANTKTRALIAYALDTWGNN

SEQ ID NO: 145071 - protein, 78 aa, Glycine max
  Coding DNA Sequence Number=SeqID_28293
MAWTQDNPRRRFFCCGLYKVSSKRGCKFFYWYDPEMNPYENRVILGLLKKKDELKRKKIELMTKMLARDIDVVSVKAI

SEQ ID NO: 145072 - protein, 88 aa, Glycine max
  Coding DNA Sequence Number=SeqID_28294
MAPRKLASKRSRKDKAAEGTSSAPEYDSHHFRSAEHQQRFEAIKGWSFLRERRVQLRDDEYTDFQEEIAICEIPGHAGKQKKILMHNP

SEQ ID NO: 145073 - protein, 216 aa, Glycine max
  Coding DNA Sequence Number=SeqID_28295
  Gene Ontology: Mol. function=RNA-directed DNA polymerase activity; Biological process=RNA-dependent DNA replication
  Homolog annotation: Hit_ID=Q1SBV5; Match level="QueryCoverage=67%, HitCoverage=24%, E-value=1e-13, Identity=31%"; Hit description=RNA -directed DNA polymerase homolog F21E10.5-Arabidopsis thaliana
MLMGIKAVKKHYRYLGLPRLIGISKSQIFQFVRNRVWKKVKGWKEKPNKESSKSLSVITHPRTANVAEACALRTSSHQINDVQIGAITHVIWHIWFACNKHLFDNHFVGLQAVCVSITTDVKLSGDSSTGSKFSTTDDLATLQAFSVTCHARKNHKIIQVNRYPPLYGWVTCNTDNSAKGCPGRAGCGGFYRDRRAKFLGCLAFHLGTNWPMLWVA

SEQ ID NO: 145074 - protein, 685 aa, Glycine max
  Coding DNA Sequence Number=SeqID_28296
  Homolog annotation: Hit_ID=Q59SG9; Match level="QueryCoverage=72%, HitCoverage=53%, E-value=2e-08, Identity=20%"; Hit description =Flocculin-like protein
MENLLNSRLFGWEGWIFFNNRWRIVSCGVIEFRRKSDKWSKVEKGDLYTILTMLVMERSEPALVPEWLRSAGSVAGAGSSAQQFASSSGHTDSLSVAHHSRNRSSKNGSDFDSARSVFLERTSSSNSRRSSINGSAKHAYSSFNRSHRDKDRDREKDRSSFGDHWDCDGSDPLANLFPGRMERDTLRRSHSMVSRKQSEVIPRRVAVDTKSGGSHQNNSNGILSGSNVSSSIQKAVFDKDFPSLSTEEKQGIAEVVRVSSPGLGAAVSQSLPVGSSALIGGEGWTSALAEVPAIIGSSSTGSLSVQQTVNTTSGSVAPSTTAGLNMAEALAQTPSRARSAPQVLVKTQRLEELAIKQSRQLIPVTPSMPKASRIIDSVNCQVHNSEKSKPKTAIRNADMNVVTKTVPQQPSALHIASQSVRSVNAKVDTPKTSGKFTDLKSVVWENGASPTSKDVSNPTNYSNSKPGNQHAVASGAASAPLRNPNNLKSPTERKPSSMDLKLGSNLEKKHSISQVQSRNDFFNLIKKKTLMNCSAVLPDSGPMVSSPAMEKSGEVNREIVNPSASPQSLGNGTELTSNGTHAHEVIHRISDNEEKESNPSVTIYPEEEEAAFLRSLGWEENSDEDEGLTEEEINAFYQECKKLDPTAFKLSQGMQPKLSKLFESYASNLRESSAELSSSDPGSEA

SEQ ID NO: 145075 - protein, 209 aa, Glycine max
  Coding DNA Sequence Number=SeqID_28297
MSSENHHHPHHYFYHQNLHIHHRSTFLPMLCSRPSIKDVSLPQWRDPPGSFSNDPLSPRIGCMGQVKRHNKIVGLLTTKSNTANNISISPSVKYSKLKKLFSGKNLGTNTINAATAPTASSCGSRPRGTVNSTNVPRNHKHRSSRNENVVPISIENMDPPLPVIKRVQKPEEERQVDNLWKRRSGGAALKSLQLQQIHHSRHHPQLTSV

SEQ ID NO: 145076 - protein, 138 aa, Glycine max
  Coding DNA Sequence Number=SeqID_28298
  Gene Ontology: Mol. function=sequence-specific DNA binding; Cellular component=intracellular; Biological process=regulation of transcription, DNA-dependent
  Homolog annotation: Hit_ID=Q1RSJ9; Match level="QueryCoverage=74%, HitCoverage=81%, E-value=9e-44, Identity=81%"; Hit description =Transcription factor CBF/NF-Y/archaeal histone
  Pfam annotation: Domain name=CBFD_NFYB_HMF; Domain location=5-70; Score=113.6; E_value=5.6e-31; Accession=PF00808.13; Description =Histone-like transcription factor (CBFNF-Y) and archaeal histone
  Pfam annotation: Domain name=Histone; Domain location=2-73; Score =7.4; E_value=0.024; Accession=PF00125.14; Description=Core histone H2AH2BH3H4
  Pfam module annotation: Pfam domain module=CBFD_NFYB_HMF::Histone; Domain location=5-70::2-73
DEQDRALPIANVSRIMKQILPPSAKISKEGKQVMQECVTEFISFVTGEASDKCHKENRKTVNGDDICWALSSLGFDNYAEAIGRYLHKYRQAEREKINHDKKYENPHINRAPPPPLLLSRVTRDKVENPPPSPPNQSG

SEQ ID NO: 145077 - protein, 46 aa, Glycine max
  Coding DNA Sequence Number=SeqID_28299
MTGRYCKFPVYIWRETIREEEAQKILGSCRSSKHTYFPRKEAVIVV

SEQ ID NO: 145078 - protein, 45 aa, Glycine max
  Coding DNA Sequence Number=SeqID_28300
MAYSMRTNICILVVAFLDSPCKITLDVYRWSHSGKTDALPHIVHN

SEQ ID NO: 145079 - protein, 155 aa, Glycine max
  Coding DNA Sequence Number=SeqID_28301
  Gene Ontology: Mol. function=nucleic acid binding; Biological process= RNA-dependent DNA replication
MYDRTVKLVNRNHRLEKVIAKLIDLSIASMENQKNTNASIKNLEMQKTLPAKLRDPGRFTIPITIRNLSIGITFLDLGATINLMPLSVMEKIGNMEVKETYMTIQLANRSIRISHGVVENMLVDVGNFTLPVDFVIMDIEEDSNIPLILGRPFMN

SEQ ID NO: 145080 - protein, 587 aa, Glycine max
  Coding DNA Sequence Number=SeqID_28302
  Gene Ontology: Mol. function=asparagine synthase (glutamine -hydrolyzing) activity; Cellular component=cytosol; Biological process=asparagine biosynthetic process
  Homolog annotation: Hit_ID=Q14SM9; Match level="QueryCoverage=96%, HitCoverage=100%, E-value=0.0, Identity=92%"; Hit description =Asparagine synthetase, type III
  Pfam annotation: Domain name=Asn_synthase; Domain location=230-471; Score=337.3; E_value=2.6e-98; Accession=PF00733.11; Description =Asparagine synthase
  Pfam annotation: Domain name=GATase_2; Domain location=24-182; Score =85.1; E_value=2.1e-22; Accession=PF00310.11; Description=Glutamine amidotransferases class-II
  Pfam module annotation: Pfam domain module=Asn_synthase::GATase_2; Domain location=230-471::24-182
  Subcellular localization annotation: CTP_CleavageSite=17; ConfidenceScore=5.12e-01
MALTTPSPTVIFYFQPPCAESSQCWVASTTLRPSALASSNCLAVEKCRLRHRGPDWSGIDCYEDCYLAHQRLAIVDPTSGDQPLYNEDKTIVVTVNGEIYNHKQLRQKLSSHQFRTGSDCEVIAHLYEEYGEEFVNMLDGMFAFILLDTRDKSFIAARDAIGITPLYLGWGHDGSTWFASEMKALSDDCERFIAFPPGHIYSSKQGGLRRWYNPPWFSEDIPSTPYDPILLRETFERAVVKRLMTDVPFGVLLSGGLDSSLVASVVNRYLAESETARQWGSQLHTFCIGLKGSPDLKAAKEVADYLGTRHHELYFTVQEGIDALEEVIYHIETYDVTTIRASTPMFLMSRKIKALGVKMVLSGEGSDEIFGGYLYFHKAPNKKELHEETCQKIKALHLYDCLRANKSTAAWGVEARVPFLDKEFINVAMSIDPEWKMIRPDLGRIEKWVLRNAFDDDKNPYLPKHILYRQKEQFSDGVGYSWIDGLKDHANKQVTDATMMAANFIYPENTPTTKEGYLYRTIFEKFFPKNSAKATVPGGPSVACSTAKAVEWDASWSKNLDPSGRAALGVHAAAYDGAVDTTKNGPL

SEQ ID NO: 145081 - protein, 157 aa, Glycine max
  Coding DNA Sequence Number=SeqID_28303
  Gene Ontology: Mol. function=nucleotide binding; Cellular component =membrane; Biological process=small GTPase mediated signal transduction
  Homolog annotation: Hit_ID=Q9LFT9; Match level="QueryCoverage=99%, HitCoverage=75%, E-value=8e-75, Identity=89%"; Hit description=GTP -binding protein
  Pfam annotation: Domain name=Ras; Domain location=1-122; Score=131.3; E_value=2.7e-36; Accession=PF00071.12; Description=Ras family
MYLEDRTVRLQLWDTAGQERFRSLIPSYIRDSSVAVIVYDVANRQSFLNTNKWIEEVRTERGSDVIIVLVGNKTDLVEKRQVSIEEGDAKSRESGIMFIETSAKAGFNIKPLFRKIAAALPGMETLSSTKQEDMVDVNLKPTVNSSQTEQQGGGCSC

SEQ ID NO: 145082 - protein, 135 aa, Glycine max
  Coding DNA Sequence Number=SeqID_28304
  Gene Ontology: Mol. function=nucleotide binding
  Homolog annotation: Hit_ID=Q38HS8; Match level="QueryCoverage=54%, HitCoverage=42%, E-value=1e-20, Identity=78%"; Hit description =Ribosomal protein L23 family protein
MVASSNGIVRERSSGLRQIEISLALQCWKMKRGHCGFVRKQVNVVAHNLAKDGKQIGKKDGAVGEPPHKAFDAQHLHQHPRNRPSVTKIEIKRVLESLYSFDVEKVRTLNMEGKKKKRGGLLIENPITRRLTSPS

SEQ ID NO: 145083 - protein, 121 aa, Glycine max
  Coding DNA Sequence Number=SeqID_28305
  Subcellular localization annotation: CTP_CleavageSite=48; ConfidenceScore=5.33e-01
MAKLRDSRDTCPTLPRKVELMMGSGRSRRRLPLNVPSCRRFRKAVCIRCRLEFRSILQSKSLVRTCSNRKERRIFKKEFPGSKKYLRSTKLRQERGLRAIGQFELVYGRVEVEAARVLDLA

SEQ ID NO: 145084 - protein, 259 aa, Glycine max
  Coding DNA Sequence Number=SeqID_28306
  Homolog annotation: Hit_ID=Q1SBB0; Match level="QueryCoverage=31%, HitCoverage=13%, E-value=2e-09, Identity=43%"; Hit description =Homeodomain-like
MAATSLPAYAAREMKSIGKDYDKIMEHASNRKLIPPSSPDKSNIAGAPKSNPRIGFEYEVEVPSMIKESKRLTLLMNPADSELVHKEVEDNVATLNNSWSDTDGKSFLLAVGIGKGKEDLKLAVEETKVGGCNEEEAEKGSYKVHDKLEEIYPDDEQVNDAVIEILEKRSGRPSQLAMNLEANLNQPTTNEELKQALSKFRSLAYEESFKTCFDRPNYKKELAEAIDELIKFKDTMIEEDKHDLDAFIEIFDQAYPLSK

SEQ ID NO: 145085 - protein, 256 aa, Glycine max
  Coding DNA Sequence Number=SeqID_28307
  Gene Ontology: Mol. function=hydrolase activity, acting on ester bonds; Biological process=metabolic process
  Homolog annotation: Hit_ID=Q9S816; Match level="QueryCoverage=79%, HitCoverage=39%, E-value=8e-70, Identity=62%"; Hit description =Putative phospholipase
  Pfam annotation: Domain name=Phosphoesterase; Domain location=14-255; Score=87.5; E_value=4e-23; Accession=PF04185.5; Description =Phosphoesterase family
MSSSSGTSATPYPIKTIVVLVQENRSFDHMLGWMKSLNREIDGVTGLESNQVSTFDPNSNRVYFGDQSGFEEPDPGHTVEDVYEQVFGEPWSESSAANKLSPRMKGFAQNSAKQKKGSTAETVMNGYKPDLLPVYKELVKEFAVCDRWFASVPGPTQPNRLYVHSATSHGLTTQDTKKLIGGLPQKTIFDSLDENGFSFGIYYQYPPSTLFFRFFRYNNGYIENIGEAIKQKLDVNLDPNPNNKPTQLCRKNDTAR

SEQ ID NO: 145086 - protein, 290 aa, Glycine max
  Coding DNA Sequence Number=SeqID_28308
  Gene Ontology: Mol. function=DNA binding; Cellular component=nucleus
  Homolog annotation: Hit_ID=Q1SBB0; Match level="QueryCoverage=68%, HitCoverage=31%, E-value=2e-62, Identity=62%"; Hit description =Homeodomain-like
MEHASNRKLIPPSSPEISNMIGTPKSNPRIGHEYQEEVHSMIQETERLQLLMNPADSELVHNKVEDNVAAANLNNSWSDADAKSFLLGLFIFGKDFVQIKRFLENKEMGEILSFYYGKFYKSDEYRRWSDCMRIKGRKCITGGHQLFSGQKQRELLSRLTPHVSEEYIDALQMVSKSYSEGRISLEEYVSCLKSTVGLGVLVEAVGIGKGKEDLKLEVEETKVCGCNEKVVEKGSNNDGEEPGYKQHYHCYLKPKRAIGAKDPLEALSEKEALLFQANEEKENAKKRPPS

SEQ ID NO: 145087 - protein, 97 aa, Glycine max
  Coding DNA Sequence Number=SeqID_28309
MTMLVSLEALAMAGASDVECAMDIEEWERKDLEQYPPPHLLAQEEEEERNNGVYGLPNHNTWECHKEEEHGVTFTNHQEKLDSTIYGNNMVKMHEVN

SEQ ID NO: 145088 - protein, 576 aa, Glycine max
  Coding DNA Sequence Number=SeqID_28310
  Gene Ontology: Mol. function=RNA-directed DNA polymerase activity; Biological process=RNA-dependent DNA replication
MSFWLVTGKEVDGAIVKEVDGMTVEDGDDWSNFGSPNPTRVIEEENAKFLEIPMEKGANGEGSRETNGIANHYLLVQRWRLGFQASVDVERRVAAWVRILNLSIELYNDAFLTRVGNMIGVMLKADVEVNNIPSMVGILQQSTHDIDGALYGPWMLSLGRRTQKRGAQARKSTPRLKKKVIVPSIIFRASKDKDKTIEMCLDDKAMDVQMGTQNKGFSNLIRDIKKEYKASLMCLLETHSSGLVAKKIFNGCNYDKVFIQDAVGEAGGIWILWDSMIWDIEILAYETHYVHLKVRNGTSPSWFMTVVYGSPHYQARSRLMDSLINLVDSISHPWVVAFKDALSPGDAKASLRDWITCSLISEWKKNIFGHIQVRKKALLKKLQCLAKCFGSNNDTGRRNKVDTIQDDDGVWLTDKWQIERYATDFFRKLFLVENNFTPFRLANSFPDLDVDEVDSLGKHVTRDEIKLSVIWVASKLLIFNYPSMVADLNDTLITLIPKLPVVTKLKDFRPISLCNVTYKLVAKVLAQRLRVLMEKLGKKGWMTIKVDLDKAYDCLKWEFVKETLQDIGYPNNFVQL

SEQ ID NO: 145089 - protein, 78 aa, Glycine max
  Coding DNA Sequence Number=SeqID_28311
MNPGTYIVSLSPEAAEKRHCNSTNSSSLDNGMAIEWVKIKMREWATAVASNNDTKANLTVSEILLIMDNHFMRPTPDT

SEQ ID NO: 145090 - protein, 75 aa, Glycine max
  Coding DNA Sequence Number=SeqID_28312
MPLLWRKTPGSPTYLTSFFMLEGTNLIGTLAVELFLSTLISGKLTPTITVLQLFLSSTKLVLRFVVVRTFNKNVK

SEQ ID NO: 145091 - protein, 356 aa, Glycine max
  Coding DNA Sequence Number=SeqID_28313
  Gene Ontology: Mol. function=ribonuclease H activity; Cellular component=membrane; Biological process=RNA-dependent DNA replication
  Homolog annotation: Hit_ID=Q1RYI2; Match level="QueryCoverage=64%, HitCoverage=43%, E-value=1e-44, Identity=33%"; Hit description =Ribonuclease H
  Pfam annotation: Domain name=RnaseH; Domain location=213-320; Score= -29.6; E_value=0.033; Accession=PF00075.14; Description=RNase H
MIDRKCRSFIWGDFERVRKVHTIPWRKVCTPKNDEGLGMRLTRDFLRKFGWKLMPKKPSLWATLIRGKYKCGAGVLPKVQKRISESNFWRGLCKSWNDLQNQVSWRVGNGLETDFWSHDWIPFIGPVVDKATIYLSNADKEAKFGKPVTDGRFTLESTYASISSQSGQANPLFKVVWRWSGPERTRILLWKTAQQALVTNDFRAKKGMSLSNACHVCDVASENAVHCFRDCPHAIQMSSRLLNVNIGLKLASKKGFSDLIVESDSLVAIKLLTGSCSTNHSSNQLVCNIGQLADQRSLVWHHVFWGVNQVADSLAKSVTFMVMMSTGLTCMPLQALSYDVGVMSYDVVADPSELIH

SEQ ID NO: 145092 - protein, 112 aa, Glycine max
  Coding DNA Sequence Number=SeqID_28314
  Gene Ontology: Mol. function=nucleic acid binding; Cellular component= mitochondrion
  Homolog annotation: Hit_ID=Q8H656; Match level="QueryCoverage=89%, HitCoverage=44%, E-value=9e-52, Identity=94%"; Hit description =Putative plastid protein
MAPLFPGCDYNHWLIVMDHPGGEGATKQQMIDCYIQTLAKVLGSEEEAKKKIYNVSCERYFGFGCEIDEETSNKLEGLPGVLFVLPDSYVDPENKDYGVHVDKARLYAVQWR

SEQ ID NO: 145093 - protein, 131 aa, Glycine max
  Coding DNA Sequence Number=SeqID_28315
MSIEAMAMAGMDYKECAITLEKWDPLYPQQPPLYLLAAERNEIVNLAAEGMKAKIREWAKVVASSSKQQQRVTTDKCKEQNNCCLSFTQKLNTTMFYSPALISNSYHIAFVVQCIRWDKHQEDLHRMLYSM

SEQ ID NO: 145094 - protein, 667 aa, Glycine max
  Coding DNA Sequence Number=SeqID_28316
  Gene Ontology: Mol. function=binding; Cellular component=thylakoid; Biological process=photosynthesis
  Homolog annotation: Hit_ID=Q337L2; Match level="QueryCoverage=96%, HitCoverage=88%, E-value=0.0, Identity=55%"; Hit description=TPR Domain containing protein, expressed
  Pfam annotation: Domain name=TPR_1; Domain location=273-306; Score =9.9; E_value=0.36; Accession=PF00515.18; Description=Tetratricopeptid e repeat
  Pfam annotation: Domain name=TPR_1; Domain location=395-428; Score =0.1; E_value=5.2; Accession=PF00515.18; Description=Tetratricopeptide repeat
  Pfam annotation: Domain name=TPR_1; Domain location=522-555; Score =14.2; E_value=0.11; Accession=PF00515.18; Description=Tetratricopepti de repeat
  Pfam annotation: Domain name=TPR_1; Domain location=556-589; Score =21.9; E_value=0.0022; Accession=PF00515.18; Description =Tetratricopeptide repeat
  Pfam annotation: Domain name=TPR_1; Domain location=626-661; Score =2.9; E_value=2.4; Accession=PF00515.18; Description=Tetratricopeptide repeat
  Pfam annotation: Domain name=TPR_1; Domain location=88-121; Score =2.2; E_value=2.9; Accession=PF00515.18; Description=Tetratricopeptide repeat
  Pfam annotation: Domain name=TPR_2; Domain location=273-306; Score =10.0; E_value=2.3; Accession=PF07719.7; Description=Tetratricopeptide repeat
  Pfam annotation: Domain name=TPR_2; Domain location=395-428; Score =4.8; E_value=9.1; Accession=PF07719.7; Description=Tetratricopeptide repeat
  Pfam annotation: Domain name=TPR_2; Domain location=430-463; Score =10.1; E_value=2.2; Accession=PF07719.7; Description=Tetratricopeptide repeat
  Pfam annotation: Domain name=TPR_2; Domain location=522-555; Score =15.2; E_value=0.24; Accession=PF07719.7; Description=Tetratricopeptid e repeat
  Pfam annotation: Domain name=TPR_2; Domain location=556-589; Score =26.3; E_value=0.00011; Accession=PF07719.7; Description =Tetratricopeptide repeat
  Pfam annotation: Domain name=TPR_2; Domain location=88-121; Score =8.1; E_value=3.8; Accession=PF07719.7; Description=Tetratricopeptide repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2; Domain location=273-306::395-428::522-555::556-589::626-661::88-121::273 -306::395-428::...
  Pfam module annotation: Domain location=430-463::522-555::556-589::88- 121
MVSRNSNMMCDKHEEIETLAKEARALLGRLEYQKGNIEAALHVFEGIDIAAVIPKLKVSISRRCEPNKRRSQSDAMPPMSMHAVSLLLEAVFLKAKSFQALGRFQDAAQSCKTILDTVESALPEGWPENFVSDCKLQETVGNAVELLPELWKLAGSPQDIMSSYRRALLYHWNLDIEATARIQKEFSFFLLYSGCEASPPALRSQLDGSFVPRNNIEEAVLLLLILLRKSILGYIAWDPSLLDHLSFALSVSGEFKTLAQQIEELLPESMERKERYYTLALCYCGEGEHITALDLLRNSLNHRENSNCIKELLLASKICADNKVCVEEGIKYSCKAISQFNGKCMQMVAIANCLLGVLLSSKSRSAASESEKVFMQSEALSALKAAEGMMRESDPYIVLHLCLEYADQRKLSIALDHAKKLIKLEDGSSVSGYILLARILSAQQKFVDAELVIDAALDQSGKWDQGELLRTKAKLRIAQGKLKNAVETYTFLLAVLQVQNKSLGTASKVVKNKGNRDRRLEMEIWLDLANVYTALSQWQDAEVCLAKSEAINPYSASRWHTKGLLSEARGFHQEALKSFRKALDIEPNHVPSLISTACVLRQLGGQSSSIVRSLLTDALRLDRTNPSAWYNLGLLYKADLGTSAMEAVECFEAAALLEESSPIEPFR

SEQ ID NO: 145095 - protein, 151 aa, Glycine max
  Coding DNA Sequence Number=SeqID_28317
MGETHEVPHHNLADFEPRLKYVVEGQVVGGVPLPNTLEGSQFRPQPEPLHFAVRRVSPAMAEKGKLNHIEERLMAIEGGGDHAFADIAELYLVSDVIIPLKFKVPDFDKYKGTTCPKNHLKMYCQKMGAYAKDEKLLMHFFQESLTRETVT

SEQ ID NO: 145096 - protein, 67 aa, Glycine max
  Coding DNA Sequence Number=SeqID_28318
MRMDQSASCFSLAWQMKRKEEKIEPCESSSASAEEEHKLVNSKRTDAKSIFPLTSTADITTTCIMLK

SEQ ID NO: 145097 - protein, 87 aa, Glycine max
  Coding DNA Sequence Number=SeqID_28319
MEKILLQPDATDHHGGYQDFFNKKNVIPINRWRGGRGRKTLYRTKQDQQKVTLICIIRCAKMKIIHTTVQIISSETAMRNIVKLGGT

SEQ ID NO: 145098 - protein, 144 aa, Glycine max
  Coding DNA Sequence Number=SeqID_28320
STGVGGEGMKVSFTCRHTFDETTGKDVICNWYNILCVPAHLILSHYHFLKMANNKDQQDFSQQNVPFSDSDSDSNYSYNEAEDEAFCRAFGQCNDGDNLSSSENLKHDDLEANFLAFSKALESPTMKKLHDDIFAQSISIPIWI

SEQ ID NO: 145099 - protein, 53 aa, Glycine max
  Coding DNA Sequence Number=SeqID_28321
MEWEDNLSGNENEWVWELEDEDDTENLVDEFSFTLLFSFTANVGLSTSLFLEP

SEQ ID NO: 145100 - protein, 379 aa, Glycine max
  Coding DNA Sequence Number=SeqID_28322
  Gene Ontology: Mol. function=heat shock protein binding; Cellular component=chloroplast thylakoid membrane; Biological process =response to heat
  Homolog annotation: Hit_ID=Q9SJZ7; Match level="QueryCoverage=89%, HitCoverage=77%, E-value=1e-158, Identity=79%"; Hit description =Putative DnaJ protein
  Pfam annotation: Domain name=DnaJ; Domain location=26-84; Score=80.4; E_value=5.7e-21; Accession=PF00226.21; Description=DnaJ domain
  Pfam annotation: Domain name=DnaJ_C; Domain location=244-366; Score =202.2; E_value=1.2e-57; Accession=PF01556.9; Description=DnaJ C terminal region
  Pfam annotation: Domain name=DnaJ_CXXCXGXG; Domain location=148-231; Score=104.1; E_value=4.1e-28; Accession=PF00684.9; Description=DnaJ central domain (4 repeats)
  Pfam module annotation: Pfam domain module=DnaJ::DnaJ_C::DnaJ _CXXCXGXG; Domain location=26-84::244-366::148-231
MIWLGIFTASSSAFFNVSCVWVDSDLLHATLEGNSVVTLKRAYRKLARSCHPDVNKEPGAEQKFKELSNAYEVLSDDEKRSIYDTYGEAGLKGSGMGMGDFSNPFDLFETLFEGMGGMGGSRGSWNGAVEGEDEYYSLVLNFKEAVFGVEKEIEIRRLESCGTCNGSGAKPGTKSSKCSTCGGQGRVVTSTRTPLGIFQQSMTCSSCNGTGETSTPCSTCSGEGRVRKTKRISLKVPAGVDSGSRLRVRNEGNAGRRGGSPGDLFVILEVIPDPVLKRDDTNILYTCKVSYIDAILGTTIKVPTVDGMVDLKIPAGTQPSSTLVMAKKGVPLLNKKNMRGDQLVRVQVEIPKKLSKEERKLVEELADLSKGKTAATSRR

SEQ ID NO: 145101 - protein, 66 aa, Glycine max
  Coding DNA Sequence Number=SeqID_28323
MGEALVLTLVLNFVGRILLGHNQKSRQVDGGNQPRYIGTDASGDRVMTDRSLSLPGARQAEDVAAR

SEQ ID NO: 145102 - protein, 54 aa, Glycine max
  Coding DNA Sequence Number=SeqID_28324
MDNHKVSSHATGPSSRDSRSETFSRSQLEDVNISGKGTDDHIDLCVKTSSLASS

SEQ ID NO: 145103 - protein, 55 aa, Glycine max
  Coding DNA Sequence Number=SeqID_28325
MAMGEKDHFLVRKRTFYNHYSHQVARVVAGALVGDGVGALVGCGAGARLTDKVLG

SEQ ID NO: 145104 - protein, 75 aa, Glycine max
  Coding DNA Sequence Number=SeqID_28326
MLVATMVVMELAKARCNGGGGGGIVEVLAVVEWWWRWRWRWCGGKVEMMRCSGDNGRVRVMISGLRQRNSNKSRS

SEQ ID NO: 145105 - protein, 148 aa, Glycine max
  Coding DNA Sequence Number=SeqID_28327
  Homolog annotation: Hit_ID=Q1SZM6; Match level="QueryCoverage=41%, HitCoverage=21%, E-value=1e-09, Identity=52%"; Hit description =Ribonuclease H
MSGVDTNVYSRKMLEKTKKRSTNFENKGSGVVCAWGSRQGCCLCSYVSLEKAIWGRGNSSRRAGYFILKDTQVSDTSSSSPRLVPPDQWFKLNIDGSSLGNLGASGFGGIIRDSLGSFIIGFSGYCGHTTSVHAELFASGLRSWYPVP

SEQ ID NO: 145106 - protein, 160 aa, Glycine max
  Coding DNA Sequence Number=SeqID_28328
  Homolog annotation: Hit_ID=Q9LZ20; Match level="QueryCoverage=25%, HitCoverage=7%, E-value=3e-08, Identity=65%"; Hit description=Amino acid transport-like protein
MTRVMSKMTATTTKSISLKPLGRHGTVRRHLVEEIPIVVPRYAVKPLATVTLESTDQRFHKPDALENLALPLLFVTVKSLFSFSSRLKTAGNRSLDTHMVLAQTHRTPYIAEKPTFSSLEPTEPPTLFLEVWLKENPTYIVVTRVLKQSWVLKAQSFLCE

SEQ ID NO: 145107 - protein, 128 aa, Glycine max
  Coding DNA Sequence Number=SeqID_28329
MASLNSIQNSTTTILLLIILITFLLHHLLCPVSCFNQPQHAIPPPDPLCEEQNRLGSMPPTCHNKCNQCHPCMAVQVPTSPNHERVHPGLLPPTASMEVFFLQGNTNRYSNYKPLSWKCHCGDHFFNP

SEQ ID NO: 145108 - protein, 46 aa, Glycine max
  Coding DNA Sequence Number=SeqID_28330
VVVLALIVVEFHALVVVKELLSFVVMDFQYDMERVLMGGMELKMNH

SEQ ID NO: 145109 - protein, 76 aa, Glycine max
  Coding DNA Sequence Number=SeqID_28331
MSNSEFQAKCIGEAEDKYASLQKSLDPHLSLSYQKRCAEATKEGGKVSDHPLGTWSIPTVIQDEELYRLKLKSDIS

SEQ ID NO: 145110 - protein, 180 aa, Glycine max
  Coding DNA Sequence Number=SeqID_28332
  Gene Ontology: Mol. function=nucleotide binding; Cellular component =membrane; Biological process=small GTPase mediated signal transduction
  Homolog annotation: Hit_ID=Q40191; Match level="QueryCoverage=80%, HitCoverage=65%, E-value=4e-60, Identity=80%"; Hit description=Ras -related protein Rab11A
  Pfam annotation: Domain name=Miro; Domain location=8-90; Score=2.4; E_ value=0.0032; Accession=PF08477.3; Description=Miro-like protein
  Pfam annotation: Domain name=Ras; Domain location=18-137; Score =132.4; E_value=1.3e-36; Accession=PF00071.12; Description=Ras family
  Pfam module annotation: Pfam domain module=Miro::Ras; Domain location= 8-90::18-137
MEIRKDHRLLILLDHIALLQFAQLFIGHIKNFTAKYRAVTSAYYRGAVGAMLVYDITKRQSFDHIPRWLEELRNHADKNIVIILIGNKSDLENQRQVPTEDAKEFAEKEGLFFLETSALEATNVETAFMTVLTEIFNIVNKKNLAAGDNQGNGNAASLSGKQIIVPGTAQEIPKRSMCCQ

SEQ ID NO: 145111 - protein, 723 aa, Glycine max
  Coding DNA Sequence Number=SeqID_28333
  Gene Ontology: Mol. function=methyltransferase activity; Cellular component=nucleus; Biological process=ribosome biogenesis and assembly
  Homolog annotation: Hit_ID=Q6K4D4; Match level="QueryCoverage=94%, HitCoverage=78%, E-value=0.0, Identity=52%"; Hit description =Proliferating-cell nucleolar protein-like
  Pfam annotation: Domain name=Nol1_Nop2_Fmu; Domain location=1-250; Score=-25.2; E_value=2.9e-06; Accession=PF01189.8; Description =NOL1NOP2sun family
MVSRESCLAFEFLPFHEFLKLENEIGNITRQEVVSMAPPLFLDVHSNHFVLDMCAAPGSKTFQLLEILHKLTKAGSLPDGMVIANDLDIQRCNLLIHQTKRMCTANLIVTNHEAQHFPGCLLNRNYDKMEPDQQDQLLFDRVLCDVPCSGDGTLRKAPDLWRKWNTGTGNGLHNLQVLIAMRGVSLLKVGGKMIYSTCSMNPIENEAVVAEPLHCLNTKFSCIRDQLVLRRGGGSIELVDVSSELPQLIRRPGLKRWKMSIKLYPCSHSCSLEGFKVVMQQYAFASEGGKWFFCCKDVPKLRRNVVFPSMFPNGGNYKDDSDCNISIGDDIIIDDVYGNSEDDVQAVENPVMHEFTEEVSDFPLERCMRLVPHDQNTGAFFIAVLQKVSPLPVAATQVKPRKEVDKHDDTANQGNEDAQELQVNPLESTPEEISEANINDNRPKTDLKVSSVTCEEVNLKEAQDPCNVENMTKNTPGKRKLQIQGKWRGIDPVVFFKDEVVINSIKVFYGIDEQFPFNGHLVTRNSDTSHVKRIYYISKSVKDALELNFSVGQQLKITSVGLKIFERQTSCEGRSAPCAFRITSEGLPLILPHISKQILSASAIDFKHLLQYRTVKFADFVDAEFGEKAANLMPGCCVVVLGEGSRAATGPLQVDDSTIAIGCWKGRASLTIMVGALECQELLERLLMCLDTVTEKDSSMHDNKVDEAHESNGKNEDVEITGC

SEQ ID NO: 145112 - protein, 80 aa, Glycine max
  Coding DNA Sequence Number=SeqID_28334
MAYCDVYNQLVCFVREETSTSMENNIIMPIKFGDRVLGRQCRRLKEFENDWVQWTLKVKDGGQKLLSLHSQTKDKVHEVP

SEQ ID NO: 145113 - protein, 51 aa, Glycine max
  Coding DNA Sequence Number=SeqID_28335
MASSNVMGVNKAEGCPVSAPEMNPKNPSKCSQGLLDTAEDSSHNECSCQSA

SEQ ID NO: 145114 - protein, 125 aa, Glycine max
  Coding DNA Sequence Number=SeqID_28336
  Homolog annotation: Hit_ID=Q6K4D4; Match level="QueryCoverage=97%, HitCoverage=10%, E-value=1e-10, Identity=44%"; Hit description =Proliferating-cell nucleolar protein-like
MGRGKRGKSRTQRKHFQQNRENVWTSSKRSKSDPSSENPIPICNPYATQNLAFDHYYKANQTLPTYYFHTFLFYYYSPYLLLLFHLLISFLFEFSGAGNRFLRRMGCIRASSQNSFARSIQNQFH

SEQ ID NO: 145115 - protein, 85 aa, Glycine max
  Coding DNA Sequence Number=SeqID_28337
MNIERGGTSTMMLFIMDLVAYNLQVTTIPQLNEGANVSISGSMWWRCMERPYFYWSTNLMMIIITEWCSLLEHAEGRDVLFERCG

SEQ ID NO: 145116 - protein, 71 aa, Glycine max
  Coding DNA Sequence Number=SeqID_28338
MEATPLSFQVKSAQLPIASPWLLHNHSIAAVVALGWTVMAMVFIGGGEEGDDMTMNRPADVVLCMSHHYLT

SEQ ID NO: 145117 - protein, 170 aa, Glycine max
  Coding DNA Sequence Number=SeqID_28339
  Gene Ontology: Mol. function=DNA binding; Cellular component =chromosome; Biological process=chromosome organization and biogenesis (sensu Eukaryota)
  Homolog annotation: Hit_ID=UPI00006C029D; Match level="QueryCoverage =77%, HitCoverage=73%, E-value=2e-65, Identity=96%"; Hit description =PREDICTED: similar to H3 histone, family 2 isoform 2
  Pfam annotation: Domain name=CBFD_NFYB_HMF; Domain location=64-129; Score=2.0; E_value=0.1; Accession=PF00808.13; Description=Histone -like transcription factor (CBFNF-Y) and archaeal histone
  Pfam annotation: Domain name=Histone; Domain location=58-132; Score =144.1; E_value=3.6e-40; Accession=PF00125.14; Description=Core histone H2AH2BH3H4
  Pfam module annotation: Pfam domain module=CBFD_NFYB_HMF::Histone; Domain location=64-129::58-132
  Subcellular localization annotation: CTP_CleavageSite=24; ConfidenceScore=5.41e-01
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRDGVVREGRFSAGSSINWDIGKYCRVSVTVFSSFKKIGL

SEQ ID NO: 145118 - protein, 861 aa, Glycine max
  Coding DNA Sequence Number=SeqID_28340
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q2TSD5; Match level="QueryCoverage=99%, HitCoverage=99%, E-value=0.0, Identity=80%"; Hit description =Trehalose 6-phosphate synthase
  Pfam annotation: Domain name=Glyco_transf_20; Domain location=59-546; Score=928.0; E_value=4.1e-276; Accession=PF00982.11; Description =Glycosyltransferase family 20
  Pfam annotation: Domain name=Hydrolase_3; Domain location=594-836; Score=-79.1; E_value=0.015; Accession=PF08282.2; Description =haloacid dehalogenase-like hydrolase
  Pfam annotation: Domain name=Trehalose_PPase; Domain location=595 -830; Score=381.5; E_value=1.3e-111; Accession=PF02358.7; Description= Trehalose-phosphatase
  Pfam module annotation: Pfam domain module=Glyco_transf_20::Hydrolase_ 3::Trehalose_PPase; Domain location=59-546::594-836::595-830
MASRSYANLFDLASGDFLDFPCTPRALPRVMTVPGIISDLDGYGCNDGDSDVSSSGCRERKIIVANMLPVQAKRDIETAKWVFSWDEDSILLQLKDGFSADSEVIYVGSLKVEIDACEQDAVAQRLLDEFNCVPTFLPHDLQKRFYLGFCKQQLWPLFHYMLPICPDHGDRFDRILWQAYVSANKIFADKVMEVINPDDDFVWVHDYHLMVLPTFLRKRYNRVKLGFFLHSPFPSSEIYRTLPVRDEILRGLLNSDLIGFHTFDYARHFLSCCSRMLGLDYESKRGHIGLDYFGRTIFIKILPVGIHMGRLESVLNLSSTSAKLKEVQEEFKDKKVILGIDDMDIFKGISLKLLAVEHLLQQNPDLQGKVVLVQIVNPARGSGKDVQEAKNETYLIAQRINDTYSSNNYQPVILIDRPVPRFEKSAYYAVAECCIVNAVRDGMNLVPYKYIVCRQGTAQLDEALDRKSDSPRTSMLVVSEFIGCSPSLSGAIRVNPWDIDAVADAMYAALTMSVSEKQLRHEKHYRYVSSHDVAYWAHSFMLDLERACKDHYTKRCWGFGLGLGFRVVSLSHGFRKLSIDHIVSAYKRTNRRAIFLDYDGTVVPQSSISKTPSPEVISVLNALCNNPKNIVFIVSGRGRDSLSEWFTSCQMLGLAAEHGYFLRWNKDSEWEASHLSADLDWKKMVEPVMQLYTEATDGSNIEVKESALVWHHQDADPDFGSCQAKELLDHLESVLANEPAAVTRGQHIVEVKPQGISKGLVAEQVLMTMVNGGNPPDFVLCIGDDRSDEDMFESILRTVSCPSLPSAPEIFACTVGRKPSKAKYFLDDASDVVKLLQGLAASSNPKPRHLAHSQVSFESTV

SEQ ID NO: 145119 - protein, 49 aa, Glycine max
  Coding DNA Sequence Number=SeqID_28341
MGEFGELVLIARIFVCLCCKDLVCGTRAPCKDLSIWGAHSCSQGLILSE

SEQ ID NO: 145120 - protein, 137 aa, Glycine max
  Coding DNA Sequence Number=SeqID_28342
  Homolog annotation: Hit_ID=O82768; Match level="QueryCoverage=47%, HitCoverage=23%, E-value=2e-15, Identity=63%"; Hit description =Histidine biosynthesis bifunctional protein hisIE, chloroplast precursor [Includes: ...
  Homolog annotation: Hit description=Phosphoribosyl-AMP cyclohydrolase (EC 3.5.4.19) (PRA-CH); Phosphoribosyl-ATP pyrophosphatase (EC 3.6.1.31) (PRA-PH)]
  Pfam annotation: Domain name=PRA-PH; Domain location=66-120; Score= -10.5; E_value=0.00052; Accession=PF01503.8; Description =Phosphoribosyl-ATP pyrophosphohydrolase
MGMNCRLEHILYYQYFGSVQAYFKSMAVSYVHMLQRNRAFHKAFVANLDLKIVFLRSQTVTVSFYLQRRGKRVVSNLENNEGESRTASEMADVLYHSMALLAKKGVKIEDVLQVLRLRFSQSGIEEKKSRVFQKSMD

SEQ ID NO: 145121 - protein, 65 aa, Glycine max
  Coding DNA Sequence Number=SeqID_28343
MVDEVQPCKHSVDRDFDVHILAIATCILPRAWLGTNDVKGLHALHINLAFDLAFEEVMTLRKWNV

SEQ ID NO: 145122 - protein, 128 aa, Glycine max
  Coding DNA Sequence Number=SeqID_28344
  Gene Ontology: Mol. function=phospholipid binding; Cellular component= coated pit; Biological process=endocytosis
  Homolog annotation: Hit_ID=Q69SJ3; Match level="QueryCoverage=89%, HitCoverage=23%, E-value=4e-20, Identity=42%"; Hit description =Clathrin assembly protein AP180 short form-like
MSIGDLLGNQAGGLDKLTLDSLYDDALRRNNQNVSYNPWEPAPGGNMMQPTMHDPFFASNTVAAPPSVQMASMSNQQQAFMYQQQQQMMMAPQQQSVNPFGNPYGATAVHPYGSGMPVQSYNPYTGLI

SEQ ID NO: 145123 - protein, 247 aa, Glycine max
  Coding DNA Sequence Number=SeqID_28345
  Pfam annotation: Domain name=zf-CCHC; Domain location=72-89; Score =21.2; E_value=0.00031; Accession=PF00098.13; Description=Zinc knuckle
DNVEANLDWEIRVKQQLKRKSTSKSYGSHSYPKKDQGQGILGVTPFKLKDDKGKTIERQPLKASMQEKTRFIKCFKCLGRGHITFQCPTKKTMIMRGQYIYGSQDEATTFPSSSESKEAKGEESSEEIYPQEERQPLMVKEECKEASVSSKRLAKKERYFEIKTNIKVISPLRQPPHFLLCEKTLVSIATPLRLEFIPQVKEFLDEGLVRKSLNPCALLVPKIGIIRHQIPKIGGMMNVLSGATLFL

SEQ ID NO: 145124 - protein, 58 aa, Glycine max
  Coding DNA Sequence Number=SeqID_28346
MSMKNLVGRLGVHNKTNHTQSGSCCFAKMLQPCGIDIGLKEHLNQMYLPPRPRLRRVR

SEQ ID NO: 145125 - protein, 178 aa, Glycine max
  Coding DNA Sequence Number=SeqID_28347
AFRLTDSKKVYTDNHSGISARQRDSKVNMTDLVSAEDDSKSPRVNGLIAKNVYTDNHLGISARQRDSKVSMTDLVSAEDDAFRLTDSKKVYTDNHSGISARQRDSKVSMTDLVSAEDYAFHFTDSKKVYTDNHSGISARQRDSKVSMPYLVSAEDDAFRLTDSKKVYTDNHSGISARQ

SEQ ID NO: 145126 - protein, 211 aa, Glycine max
  Coding DNA Sequence Number=SeqID_28348
  Gene Ontology: Mol. function=oxidoreductase activity, acting on single donors with incorporation of molecular oxygen, incorporation of two atoms of oxygen; Biological process=electron transport
  Homolog annotation: Hit_ID=Q4US80; Match level="QueryCoverage=95%, HitCoverage=55%, E-value=2e-54, Identity=54%"; Hit description=2 -nitropropane dioxygenase
  Pfam annotation: Domain name=NPD; Domain location=20-211; Score= -116.1; E_value=0.0027; Accession=PF03060.6; Description=2 -nitropropane dioxygenase
  Subcellular localization annotation: CTP_CleavageSite=47; ConfidenceScore=5.42e-01
MGACPKRWAVMQSSAVTSRAEAFCRRFGVSVPILLAPMAGACPVPLSAALANAGSMGAMGAVLSSSADIGRWMDEFRTASTGPAQVNLWVPDPAPTRDVAAEAASRAFLAQWGPDVPASAADATPADFEEQFAALLAARPAVASTIMGVLLPHHVQQLKDAGIAWIACATTLSEARAAQDAGADAVVAQGAEAGGHRGAFDPAMAERQPVG

SEQ ID NO: 145127 - protein, 82 aa, Glycine max
  Coding DNA Sequence Number=SeqID_28349
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q5H396; Match level="QueryCoverage=56%, HitCoverage=9%, E-value=2e-15, Identity=87%"; Hit description=Signal recognition particle protein
  Pfam annotation: Domain name=SRP_SPB; Domain location=1-52; Score =31.8; E_value=5.6e-09; Accession=PF02978.9; Description=Signal peptide binding domain
MIAIIGSMTKKERRNPNLLNGSRRARIAKGSGVTPADVNKLMKQYMQMEKMMSKMAGGGMKGMLRSMKGMMGAMGGRGMPFR

SEQ ID NO: 145128 - protein, 254 aa, Glycine max
  Coding DNA Sequence Number=SeqID_28350
GVSSLSSFSIPLPFIFQEAKESIDEEDLRPTSSNGAYIIKSSLTTKFMYADTEGARSSTNGTDAKTTINPSRKEHVAHMMPNMGLYVKDDVISVSVEKVFDDDPLRDFIKSLYDIYKKPIELMWDETKFGIPNVDGSFFLTYPDDRYAEYEYYIETWVKESQQEEYLGAYLNYAINTSKTTVDGKNDQGPPKWIEANSHVQSRGYECDYYVMHWMWNIVSWGLKNDCSMVIVRLRIWIFRGKNGELSVTGRLAS

SEQ ID NO: 145129 - protein, 56 aa, Glycine max
  Coding DNA Sequence Number=SeqID_28351
MVRVTSTQGSTLMRKQEIDSSRGPEGTYWVRTSNLPLGSLEAHARCPSLPQCRAMR

SEQ ID NO: 145130 - protein, 168 aa, Glycine max
  Coding DNA Sequence Number=SeqID_28352
  Gene Ontology: Mol. function=transcription factor activity; Biological process=regulation of transcription, DNA-dependent
  Homolog annotation: Hit_ID=Q7WC91; Match level="QueryCoverage=95%, HitCoverage=51%, E-value=8e-69, Identity=75%"; Hit description=LysR family regulatory protein
MARDVGRRGAGHGLQGADAARHQAGIFQVAGADDAVDRLLHHIDGTVAHAQHQLDIGDQPADTGRHIDAQPALQAQRRFLETGLGFLDVGQDAHAVLVVAGAVGRQADAARGAVEQAHAQQAFEILDDGGDGGARKREAVGRPGETIGVHDAHKHLHSLKTVHGDGVL

SEQ ID NO: 145131 - protein, 81 aa, Glycine max
  Coding DNA Sequence Number=SeqID_28353
  Gene Ontology: Mol. function=transcription factor activity; Biological process=regulation of transcription, DNA-dependent
  Homolog annotation: Hit_ID=Q1H0D0; Match level="QueryCoverage=100%, HitCoverage=23%, E-value=1e-25, Identity=65%"; Hit description =Transcriptional regulator, LysR family
MPQTIEELRNHHAVHYFSSRTGRNCAWDFKIDGKHQEVDMRGTVAVNEAGAYLDCGLKGFGLIQTPRYMALPYLQSGELIE

SEQ ID NO: 145132 - protein, 150 aa, Glycine max
  Coding DNA Sequence Number=SeqID_28354
SSDVDHHGKFGSEFNHTFNLLCELWFVKFVMSFEISLDNCSISDYLLHVQTLVNELTSIAETVSNSEHLDLILDGLPDEYESSRKRALSSINLTQGLGSVSLNSGSSSLDNSVNPNFAQSINPNLKFNGNRFFNDRCGWNFGRNNCGGGR

SEQ ID NO: 145133 - protein, 92 aa, Glycine max
  Coding DNA Sequence Number=SeqID_28355
  Gene Ontology: Mol. function=chromatin binding; Cellular component =chromatin; Biological process=chromatin assembly or disassembly
MQQDIRDFVRKCIICQQAKVEQALMAYYNDFQFLKEFGRTLLWTLLRICHLHMCLLATVIQSPWHHIGYEFCLSSSVRWPNGGVEQDTKDVL

SEQ ID NO: 145134 - protein, 486 aa, Glycine max
  Coding DNA Sequence Number=SeqID_28356
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=81%, HitCoverage=29%, E-value=6e-80, Identity=36%"; Hit description=Chromo
MRFLLPKAKLLHRPNVACGKQEGKLARESVTKEGHVADDPHVGNQTTANGGSNSKGRNSSTSVLSPSPISINSSVKEISLGFPHFDGQTPRMETVNTWSELRHVLESQFGPSLFDCPMAELFKLQQQGTIADYYLKFMSLTHRSDGLTPEALLNCFISGLNKDIRRDVVAQAPNDLLRVVALAKLYEEKYVTVPITRPTPFSPRYSNLSSSNTHNNVLKNPVKNSLTPNVPPIRNASCPTRQFLLLQSKNDDAKLEFHDSEDRFDSVVDNAEVILEDHHLSLNALKGGMGVGTIQFMAYIDKLLVKVLVDGGSSDNFLQPRVAKFLKLPMEPAPFFKVMVGNGNYMKVEEMISKLTIKAQNARFQLPVFLLPVSSADLILGASWLKTVGPHIADYDKLNYIISGGCNIDAIAKIFTMQLIEPNYVQFPLLELPTDMEPELALLLHSYSVVFGTPTSLPPPRAHDHSIPLVDGYQPVKVKPYRYPHN

SEQ ID NO: 145135 - protein, 95 aa, Glycine max
  Coding DNA Sequence Number=SeqID_28357
  Gene Ontology: Mol. function=RNA-directed DNA polymerase activity; Biological process=RNA-dependent DNA replication
MTTSSILALLYFTQEFIIESDASENGLGALLTQKGQLVAYFSKALTEHNLAKSAYEKELMAVENYRVEENLPINLEDDNSYQPEVVLAAHTITKA

SEQ ID NO: 145136 - protein, 409 aa, Glycine max
  Coding DNA Sequence Number=SeqID_28358
MEAKVTTLKTEVMSLHNVLITIQSQVKENHEKLLTMFEQRLTMSGDGGLGVKWFHSDPIIEFRQSVKKVELPMFTGEDPARWTTRANIYFQIKETTLEIHVDLDQLCMKGSTIHFFKPLLDDERKRELLHYTVMPGLEMGPNWGSICNNKEVCDESTIGPSPPKTSDKNELISNLVMEGPFHSHHQCPDRQLSILVFDEENIDDGEVQVLTMEETKELKLDVLILILVDSGTTHNFISKRLVLALENRIEVMRLMRIKNGRWLQGDCSSMRFQLANEWFELTGGGHGLLGPMAFQSLFELQINNNTTILFATNVQEVTSLVDQNHEIFREAQGLPPQHTIEHSITLLEGHSSMNVRLYHYPHHHKNEIKKQRDNTWHICVHYRALNKVTIPDKFPIPVIDELLDELHGA

SEQ ID NO: 145137 - protein, 60 aa, Glycine max
  Coding DNA Sequence Number=SeqID_28359
MASRKRKAPTSTSQARYDRSRFTSQEAWDQEPYQSNQRKNLRNLRKLLEMSLLLPECEPA

SEQ ID NO: 145138 - protein, 87 aa, Glycine max
  Coding DNA Sequence Number=SeqID_28360
MEAIGSNGRRNLTSMKIERMELTEEEETLAGRRRKKKRLVGEHQQHHREGEEEPAAARTEEGRRTMLAEEGNEEGSRMTGCTSFLKI

SEQ ID NO: 145139 - protein, 73 aa, Glycine max
  Coding DNA Sequence Number=SeqID_28361
  Homolog annotation: Hit_ID=Q1T2D5; Match level="QueryCoverage=82%, HitCoverage=3%, E-value=3e-09, Identity=44%"; Hit description=Chromo
  Pfam annotation: Domain name=Chromo; Domain location=2-56; Score =20.1; E_value=0.0041; Accession=PF00385.14; Description='chromo' (CHRromatin Organisation MOdifier
MVQPIVVLDSRVLLRDSSQVEQVLIQWEIVGLEEATWEDVTWVKASYPHFNLEDKVIFKGEAIFDFVVNIIPC

SEQ ID NO: 145140 - protein, 126 aa, Glycine max
  Coding DNA Sequence Number=SeqID_28362
  Gene Ontology: Mol. function=protein binding; Cellular component =membrane; Biological process=defense response
  Homolog annotation: Hit_ID=Q19PN9; Match level="QueryCoverage=86%, HitCoverage=18%, E-value=4e-25, Identity=47%"; Hit description=NBS type disease resistance protein
MGKDLGGWKDALNRYEKCPHPGVQKVHRISYDSLPFNEKNIFLDIACFFKGRKLEYVKRVLVASNFSSGNGLTTLVNKSLLTVDNHRLRMHDLIQDMGKEIVKEEAGNKLGEHSRLWHHMKMFVKH

SEQ ID NO: 145141 - protein, 256 aa, Glycine max
  Coding DNA Sequence Number=SeqID_28363
  Homolog annotation: Hit_ID=Q1SP02; Match level="QueryCoverage=78%, HitCoverage=43%, E-value=6e-12, Identity=28%"; Hit description=IMP dehydrogenase/GMP reductase
MGSCWPHPYCSIYEHFLSVVECNADLDYDEVSPRACRWIATKKTVKKVSTTTYKQCLDRLRILYVCWMPYAEHRPAQDFHLISCFSGQLRWGPVVVRYRPEKVMRQFSYVQCIPTHPIHSWVSYDDMDDTWTHYSDHLAAAGDLCVVLGQCAPDYIDWFFIISHPFMTTPQTDPPRDAYATQPSHIPHEAAPASTHADPDADEPRHAVACHAIAEALEQHLNASGTSTHEEVIQKCLRISRGVTEDRNVYVRSRRR

SEQ ID NO: 145142 - protein, 168 aa, Glycine max
  Coding DNA Sequence Number=SeqID_28364
  Gene Ontology: Mol. function=protein binding; Cellular component =membrane; Biological process=defense response
  Homolog annotation: Hit_ID=Q1T2T9; Match level="QueryCoverage=86%, HitCoverage=14%, E-value=2e-18, Identity=37%"; Hit description =Disease resistance protein; AAA ATPase; Tumor Necrosis Factor
MDTLHSLSHQVHKEIKTLEVKMPRLRDIPKCFVYVNEGGLVKFPTVALAFVFGKPKPKTLEWASYVVCMHLFIEGEHKGYRDFLVKKNLALLCDLRFFFGLEWEDAGVGMGNDWKTIQVYCETELTVCSWGVCVYKHETNIEDIQITSEVPSSTLVRSLHALKVKYKN

SEQ ID NO: 145143 - protein, 44 aa, Glycine max
  Coding DNA Sequence Number=SeqID_28365
NALAVVDDSISVQLTNRQHRYRQGRVSYKRRNDLGTQSVKSSME

SEQ ID NO: 145144 - protein, 152 aa, Glycine max
  Coding DNA Sequence Number=SeqID_28366
  Gene Ontology: Mol. function=DNA binding; Biological process =regulation of transcription, DNA-dependent
  Pfam annotation: Domain name=B3; Domain location=53-150; Score=16.9; E_value=0.00087; Accession=PF02362.12; Description=B3 DNA binding domain
  Pfam annotation: Domain name=DUF313; Domain location=37-131; Score= -17.3; E_value=0.0051; Accession=PF03754.4; Description=Domain of unknown function (DUF313)
  Pfam module annotation: Pfam domain module=B3::DUF313; Domain location=53-150::37-131
PQGSSSSSIPTMEEDIDKAAEALVSLVTSYQEGKHNLPPHENLRDYILEYGEPLKKVLTNTDVNVNQNRIFLKKEHVEKSFLPLLRNDENIEEGIRVCAYDMHDNSYTLMFKKWTKKFYVLNGEWKKFFQIHELQKNDVVTVWIFRHSKSNK

SEQ ID NO: 145145 - protein, 316 aa, Glycine max
  Coding DNA Sequence Number=SeqID_28367
  Gene Ontology: Mol. function=DNA binding
  Homolog annotation: Hit_ID=Q1SDS1; Match level="QueryCoverage=69%, HitCoverage=40%, E-value=7e-25, Identity=35%"; Hit description=IMP dehydrogenase/GMP reductase
MGQLQRQAFCKAYGKIWDLAMVEVSTEAIASLAQYYDQPMRCFTFGDFQLSPMAKARILAGKGEWAPFIDILALLIFGGVHFLNVDGLVDLAAIDAFLAYHNHKESPVVAMLTDLYDTFDRRCEKSNTRIVCCTPALYVWLVLHLFRQEVRHACPLEGHRSCTEKGGANWDQLLLSKEGASINWFPRWKEGRTGVLVSCGGFLNVPLMGTRGCISYNLVLTIRQLGYPMRGAPLEEELAPIIALGFNKANVEALQKVRKVWETVQKKDKEFKGSNNRPIGGYRKWLKAHMQGLDWLSSLRTAKGEEVEAPEEDEEV

SEQ ID NO: 145146 - protein, 281 aa, Glycine max
  Coding DNA Sequence Number=SeqID_28368
  Homolog annotation: Hit_ID=Q1SKD7; Match level="QueryCoverage=72%, HitCoverage=52%, E-value=5e-11, Identity=25%"; Hit description =Ankyrin
MASKKRKSSASSSTQARYDRSRFHSQEAWERYTDIIVPRKLLPERNVVVYYTEFDDFKEELERRKWDEELTNFDEGSIDVAIVKEFYANLYDPEDNSLKQVRVRGHLIKFDEDTLNTFLKTQVILEEGENLCAYSRFSLLRPDPQELAAKLCIPGKGFELNADGLPLKILRKNMTTLAQTWSILSFSNLVPTSHTSNVTLDRAKLIYGIIMKMDMNVGYLISHQISITAQHDPSRLGFPALITTLCKARGVTSDSRSLESLSPVINFAYIKKNYWNLDDPT

SEQ ID NO: 145147 - protein, 115 aa, Glycine max
  Coding DNA Sequence Number=SeqID_28369
  Gene Ontology: Mol. function=oxidoreductase activity, acting on single donors with incorporation of molecular oxygen, incorporation of two atoms of oxygen; Cellular component=plasma membrane; Biological process=...
  Gene Ontology: Biological process=methionine biosynthetic process
  Homolog annotation: Hit_ID=Q08G57; Match level="QueryCoverage=81%, HitCoverage=69%, E-value=1e-30, Identity=51%"; Hit description =Acireductone dioxygenase
  Pfam annotation: Domain name=ARD; Domain location=6-114; Score=47.8; E_value=3.6e-11; Accession=PF03079.5; Description=ARDARD' family
MNRHLPLITLDDSDEDQTLPHHKAPKEFVSLDQLVELGVLSWKLDADNHGNDPELKKIHEEHGYCDVKDHNDAWIREWVKKGGMIILPVRIYHHFTLDESNYIKRFWSGSLCVAI

SEQ ID NO: 145148 - protein, 44 aa, Glycine max
  Coding DNA Sequence Number=SeqID_28370
MDPVTTSLALSMHFILIFGYLTPSQRKGNSSSIYEYLFERLLHW

SEQ ID NO: 145149 - protein, 247 aa, Glycine max
  Coding DNA Sequence Number=SeqID_28371
  Gene Ontology: Mol. function=protein kinase activity; Biological process=protein amino acid phosphorylation
  Homolog annotation: Hit_ID=Q2QZ78; Match level="QueryCoverage=96%, HitCoverage=42%, E-value=3e-63, Identity=51%"; Hit description=AT hook motif-containing protein, putative
  Pfam annotation: Domain name=DUF889; Domain location=107-247; Score =54.1; E_value=3.6e-15; Accession=PF05970.5; Description=Eukaryotic protein of unknown function (DUF889)
MENISKFTEGKNQIVIMVASSGIASLLLPGGRTAHSKFKIPVPIFEDSTCNILQGSQLAELLNQTNLIIWDEAPMAHKFCFQALDQCLRDIIKEKKSNQIFGGKVIVFGGDFRQILSVIPRGSRSDIINATINSSYLWPSCEVLTISKNMRLQGNAQSIDDQETTKFAKWILDIGDEVIGNQNDGYATVEIPEYLLITEYNDPIDAIVKSTFPDLYEHHSNPEFFKCRAILASTNETVEEVNDYILS

SEQ ID NO: 145150 - protein, 218 aa, Glycine max
  Coding DNA Sequence Number=SeqID_28372
  Gene Ontology: Mol. function=kinase activity
  Homolog annotation: Hit_ID=UPI00006BD4C0; Match level="QueryCoverage =94%, HitCoverage=70%, E-value=8e-28, Identity=31%"; Hit description =ROK family member transcriptional repressor
MPGPFDYKNGISLMQQGKFIDIYQINIKEELASRLSILNEQIHFVNDAAAFLEGEVFGGCVTEYNRVFGITLGTGLGTTFYNGETSTDEDLWNSPFKDSLAEDYLATRWFVKRYAELTGGEISGTKELLDKPKDIQSRIFQEYADSFSEFIVRYVWDYKPEVLVIGGNIAKAYPYFEERFNENLVKNNINLPVKISAIFEDAAILGAASYALKKTLIN

SEQ ID NO: 145151 - protein, 308 aa, Glycine max
  Coding DNA Sequence Number=SeqID_28373
  Gene Ontology: Mol. function=DNA binding; Cellular component =cytoplasm; Biological process=DNA replication termination
  Homolog annotation: Hit_ID=P16525; Match level="QueryCoverage=98%, HitCoverage=99%, E-value=7e-94, Identity=56%"; Hit description=DNA replication terminus site-binding protein
  Pfam annotation: Domain name=Ter; Domain location=8-307; Score=476.3; E_value=3.6e-140; Accession=PF05472.2; Description=DNA replication terminus site-binding protein (Ter protein)
MARYDLVADLHECVNTLERELTALRASVEQQPLLLARVFSLPEIEKGKEHDEINRIAVTQHLGKRAREMALAHYCRLFMQHQSEKLSTKAAVRLPGALCIEADEAASQRLEQQVTTINTLKQRLEQLITVDSGLPSEARFEFVHQHLRGLITLNAYRSVTLLQAPDTLRFGWANKNIIKKVTREAIVGQLERSLKANRAQAPWTREQWAEKVQQELERLRSLPDGAQLKIKRPVKVQPIARLWRASEKKQLQLACPSPLLVLCRDRTQVPTLGELLDYDAENITHRYKPLAQPLHLIIPRLHLWSDRL

SEQ ID NO: 145152 - protein, 87 aa, Glycine max
  Coding DNA Sequence Number=SeqID_28374
MVEKEMITMMVDTLPVFYYEKLVGYMPSSFADLVFVGERIEIGLKRGKFDYVSSTSTNAMRIRATGEKRKEGDTHAITSAPTWIKPP

SEQ ID NO: 145153 - protein, 143 aa, Glycine max
  Coding DNA Sequence Number=SeqID_28375
  Gene Ontology: Mol. function=transcription regulator activity; Cellular component=nucleus; Biological process=regulation of transcription
  Homolog annotation: Hit_ID=Q8L9U3; Match level="QueryCoverage=61%, HitCoverage=31%, E-value=7e-12, Identity=47%"; Hit description =Putative lipoamide dehydrogenase
MEPLEQKKEAFCNQDKATRTPSASLTTQQYFCVPNSFSRLYPDSPESTLKPALMANNPSDAPADDFLEQILGLPNFASADSGLSAADVGLAGAATQAPMMLQLNSADANAHLAGAAFHAPVYQLGLSLDQGKGGFMKARGSLR

SEQ ID NO: 145154 - protein, 65 aa, Glycine max
  Coding DNA Sequence Number=SeqID_28376
MAIWRRAGAEEERNKKGSERLMEDFWSIFPNSTPLKNSIILQAHRISNSFLGLYQNIQKGYINQQ

SEQ ID NO: 145155 - protein, 163 aa, Glycine max
  Coding DNA Sequence Number=SeqID_28377
MTDVTVCHMKDRRKLVVQVGGDIRATNTANDGDKRGPATDGSDRVGFWEWIRERWICMGTNPCDRGCGAQMGVLDWMGMTMWMLASGDTNLNHPFLILIFVILVAVKGLCLHNHLQALILIPIFIWDPGSVFYTQHLEDKVFLMVVIIAVIVMVLVAVIVVGM

SEQ ID NO: 145156 - protein, 235 aa, Glycine max
  Coding DNA Sequence Number=SeqID_28378
  Homolog annotation: Hit_ID=Q1SN44; Match level="QueryCoverage=60%, HitCoverage=25%, E-value=6e-10, Identity=25%"; Hit description =Nucleic acid-binding, OB-fold
  Subcellular localization annotation: CTP_CleavageSite=69; ConfidenceScore=5.03e-01
MKKEPGLEDEVGPSDAQPHYPPLPTMLCKNVNPTPNSRQRTGPGLTVFSSSNILGMGLTVNKITYYDMANMMLQCCLQPKFTNPRIISGWRALRHFYQLTGDHQVTLTHHGQSVFLITIYKTSSPLKSFPKWHSLYHQVSNSVTFAVLLNEYKISCSSLDVPNNMYYFMKDKGFEHLNLEDVAECRIVYNHWRKTTKIGAGWKSFCETQAFEPSMLLVFEFPNPVVNYVLFWPCL

SEQ ID NO: 145157 - protein, 35 aa, Glycine max
  Coding DNA Sequence Number=SeqID_28379
MPTSSRRLGGSSPESYSLHPATVILLPRTMFVIIT

SEQ ID NO: 145158 - protein, 92 aa, Glycine max
  Coding DNA Sequence Number=SeqID_28380
  Subcellular localization annotation: CTP_CleavageSite=28; ConfidenceScore=5.05e-01
MGPKSTLRLMRTLGPSLASLAQSSWSLLSNALGGILIQAQKSIAWNFIAHTSFSFLKRVEILSNDHREKAINNTDRTKKLKSKSVLLRLKLR

SEQ ID NO: 145159 - protein, 600 aa, Glycine max
  Coding DNA Sequence Number=SeqID_28381
  Gene Ontology: Mol. function=protein binding
  Homolog annotation: Hit_ID=Q10GD4; Match level="QueryCoverage=89%, HitCoverage=95%, E-value=1e-141, Identity=49%"; Hit description =Leucine Rich Repeat family protein, expressed
  Pfam annotation: Domain name=F-box; Domain location=133-180; Score =27.0; E_value=6.7e-05; Accession=PF00646.23; Description=F-box domain
  Pfam annotation: Domain name=LRR_1; Domain location=257-282; Score =6.3; E_value=19; Accession=PF00560.23; Description=Leucine Rich Repeat
  Pfam annotation: Domain name=LRR_1; Domain location=330-357; Score =2.3; E_value=1.1e+02; Accession=PF00560.23; Description=Leucine Rich Repeat
  Pfam annotation: Domain name=LRR_1; Domain location=382-405; Score =9.8; E_value=4.2; Accession=PF00560.23; Description=Leucine Rich Repeat
  Pfam annotation: Domain name=LRR_1; Domain location=408-435; Score =2.5; E_value=98; Accession=PF00560.23; Description=Leucine Rich Repeat
  Pfam annotation: Domain name=LRR_1; Domain location=482-504; Score =2.7; E_value=88; Accession=PF00560.23; Description=Leucine Rich Repeat
  Pfam annotation: Domain name=LRR_1; Domain location=526-551; Score =0.4; E_value=2.4e+02; Accession=PF00560.23; Description=Leucine Rich Repeat
  Pfam module annotation: Pfam domain module=F-box::LRR_1::LRR_1::LRR _1::LRR_1::LRR_1::LRR_1; Domain location=133-180::257-282::330 -357::382-405::408-435::482-504::526-551
  Subcellular localization annotation: CTP_CleavageSite=37; ConfidenceScore=5.04e-01
MLPLPSSFTKPNSHTSQFTNHTMQHFHPEPHIAPTVSSDAKRSGKKRGSYNCGRCGLPKKGHDCTGKTAPTPTSASSATPSHSSFSAVSAPSSGSASRRPLSHLRRALSFDEDEAGRLDPSEPADVWSVEDDLDSSGLPGNLLWEVLRRLPPAGLLTAAMVSRGWREMTRSLWRAAEELRIRVPAWAQVGFVSSILQKCPGIVTLSLKMESDVDSTILACIAFSCPNLAFLEISVSDPAVNRISGGEFARFVADKKSLKSLKMEGCSNLGGFVLCSSSLSTLWLSDLYSLSKMVFNCPQLREVSLEFAHQESDSTDLTTMVEGLGRSCPRLKNIHISSMHLSHAAVLALTAAQLRGLRMLSLVLGSEVTDASVAAIASSYLNLELLDLSGSSISDSGISMICNVFSETLTRLLLALCPNVTSSGIQFATAQLPHLELMDCGMTICEPNSHHPTADESNRKLQKTFATNLHLTNQKLIIKHSCLKKLSLWGCSGLDALYLNCPQLNDLNLNSCRNLHPERLLLQCPSLENVYASGCQDMLIGAIQSQVCNAFTDMENPSPCKRLPDGSKRVRVPHLVNTESPEDEKKGRRKKRRLCNVVVD

SEQ ID NO: 145160 - protein, 119 aa, Glycine max
  Coding DNA Sequence Number=SeqID_28382
MKTCRYHQNFGHTTKECVTLKDKIEELIQEGAFVNYIYTPNNNRGSYRARSRGRGGGFTSEDSTKLAQQRYLHAIKSMNHISITSSRRSIPPITFTDANFARVDLEQDDPMVITVGIAN

SEQ ID NO: 145161 - protein, 300 aa, Glycine max
  Coding DNA Sequence Number=SeqID_28383
  Gene Ontology: Mol. function=uridine kinase activity; Cellular component=cytosol; Biological process=biosynthetic process
  Homolog annotation: Hit_ID=Q2QMK2; Match level="QueryCoverage=87%, HitCoverage=86%, E-value=1e-58, Identity=44%"; Hit description =Phosphoribulokinase/uridine kinase family protein, putative, expressed
  Pfam annotation: Domain name=PRK; Domain location=105-299; Score= -59.7; E_value=0.0065; Accession=PF00485.8; Description =Phosphoribulokinase  Uridine kinase family
MEATFSSTTARGYWNQTRGSTEPLLLRVDEARDRKPSSLSIARPSKFVQLSLARTRKSSFFKVLSAEKEQIHVVEGSRVDELYDALVTRILPLVSVSSNPNHKLLVGLAGPPGAGKSTLAHEVARRINKLWPEKASSFDSQVQLPDVAIVVPMDGFHLYRSELDEMENPEEAHARRGAPWTFNPLRLLQCLKNLRMHGSVYVPSFDHGVGDPVEDDIFVNLHYIHVTALAFKPQAQGCYCRRFIDIDIDKAMQRVLKRHISTGKPPDIAKQRIENNDRLNAELIMKSKKNADIIIKSIDF

SEQ ID NO: 145162 - protein, 91 aa, Glycine max
  Coding DNA Sequence Number=SeqID_28384
  Gene Ontology: Mol. function=glutathione transferase activity; Cellular component=cytoplasm; Biological process=metabolic process
  Homolog annotation: Hit_ID=Q9FQE6; Match level="QueryCoverage=80%, HitCoverage=31%, E-value=2e-25, Identity=74%"; Hit description =Glutathione S-transferase GST 12
  Pfam annotation: Domain name=GST_N; Domain location=5-81; Score=47.6; E_value=4.2e-11; Accession=PF02798.10; Description=Glutathione S -transferase, N-terminal domain
MAEQHKVILHGMWASPFVKRVELALKLKGIPYDYVEEDLANKSELLRKYNPVYEKVPVFVHNGNVISESVNLEEMFSYLALCSIYEENFQN

SEQ ID NO: 145163 - protein, 104 aa, Glycine max
  Coding DNA Sequence Number=SeqID_28385
  Gene Ontology: Mol. function=methyltransferase activity; Cellular component=cellulose and pectin-containing cell wall
  Homolog annotation: Hit_ID=Q1SBL8; Match level="QueryCoverage=96%, HitCoverage=16%, E-value=5e-41, Identity=77%"; Hit description =Putative methyltransferase
  Pfam annotation: Domain name=DUF248; Domain location=1-91; Score= -377.1; E_value=0.0049; Accession=PF03141.7; Description=Putative methyltransferase
MGCEAFSTYPRTYDLIHANGVFSLYKNVCNVEDILLEMDRILRPEGAVIFRDQADVLMQVKGIVKGMRWNTKMVDHEDGPLVSEKVLFAVKQYWVAGDNSTSSA

SEQ ID NO: 145164 - protein, 499 aa, Glycine max
  Coding DNA Sequence Number=SeqID_28386
  Gene Ontology: Mol. function=methyltransferase activity; Cellular component=cellulose and pectin-containing cell wall
  Homolog annotation: Hit_ID=Q1SBL8; Match level="QueryCoverage=95%, HitCoverage=76%, E-value=0.0, Identity=64%"; Hit description =Putative methyltransferase
  Pfam annotation: Domain name=DUF248; Domain location=76-499; Score =699.2; E_value=2.9e-207; Accession=PF03141.7; Description=Putative methyltransferase
  Pfam annotation: Domain name=Methyltransf_11; Domain location=193 -288; Score=41.6; E_value=2.6e-09; Accession=PF08241.2; Description =Methyltransferase domain
  Pfam annotation: Domain name=Methyltransf_12; Domain location=193 -286; Score=11.3; E_value=0.043; Accession=PF08242.2; Description =Methyltransferase domain
  Pfam module annotation: Pfam domain module=DUF248::Methyltransf _11::Methyltransf_12; Domain location=76-499::193-288::193-286
MGHQLQLGCGHKDSKSLDVAATIMGDSIAVEITKHTDCSVLSDLNYETHHDDDSGTPNSSDTQVREFKPCDDRYIDYTPCHDQARAMTFPRENMAYRERHCPPDDEKLYCLIPAPRGYSTPFSWPKSRDYVPYANAPYKSLTVEKAVQNWIQYEGNVFRFPGGGTQFPKGADAYIDELASVIPLDNGMVRTALDTGCGVASFGAYLFKKNVVAMSIAPRDSHEAQVQFALERGVPAIIGVLGTIMLPFPSGAFDMAHCSRCLIQWGANDGKYMKEVDRVLRPGGYWILSGPPINWKNSFQAWQRPEDELEEEQRQIEDTAKLLCWEKKYEKEYLTNIVYLGSDFFNPLWKVTSVVLTFGLWTIGFNNNCLKGLTMYRYKKMKDCVTPSKPSGPWKPFQERLNVVPSRITSGFVPGVSEEAFEEDNRLWKKHVNAYKRINKIISSGRYRNIMDMNAGLGSFAAALESPKLWVMNVVPTIAEKANLGVIFERGLIGIYHDW

SEQ ID NO: 145165 - protein, 288 aa, Glycine max
  Coding DNA Sequence Number=SeqID_28387
  Gene Ontology: Mol. function=RNA-directed DNA polymerase activity; Biological process=RNA-dependent DNA replication
MVISIFIANFMVSKAWQCYAESLKVVFYPPIRELANPHPTSRGNDNQLISVDEESSNQTLTVYEAIRGDQDDAFDVDLCNDTIDKDPKPIKELVKLQLGPTHGQCIQLSRDLTSHEYKRITEVLRRNEDLFARQPFDMAGIRPSIICHALAICSQAKPVSHKKRKTGEERHKAVKEEASQRGHGQKATDKWCMCIDYTNLNKACPNDVYPLPTINILVDSASSGGKFLGSMIIHWGIEVNPDKFLLKLIKKARPFYKLLRKIESFLSTNPLPFYCGTCKNYQPRGGYD

SEQ ID NO: 145166 - protein, 474 aa, Glycine max
  Coding DNA Sequence Number=SeqID_28388
  Gene Ontology: Mol. function=transferase activity, transferring hexosyl groups; Cellular component=integral to membrane; Biological process=carbohydrate biosynthetic process
  Homolog annotation: Hit_ID=Q2R1U9; Match level="QueryCoverage=92%, HitCoverage=79%, E-value=1e-140, Identity=53%"; Hit description =Glycosyl transferase family 8 protein, expressed
  Pfam annotation: Domain name=Glyco_transf_8; Domain location=156-448; Score=279.0; E_value=9.1e-81; Accession=PF01501.10; Description =Glycosyl transferase family 8
MTDVNVEVIDKKSSPKAIQHRQSSRSQSQRVTNQKVLEIKDQIIRARAYLGFAPPGSNSHLMKELKLRIKEMERAVGEATKDSDLSRSELHSALQKMRHMEASLSKANRAFPDCTAMAAKLRAMNHNAEEQVRSHQHEGTYLIHLAARTTPKGLHCLSMQLTADYFALKPEDRKLPNENKIHDPKLYHYAVFSDNLLACAVVVNSTVSNAKKKEKLVFHVVTNSLNFPAIWMWFLLNPPGKATVHIQSIENFEWLPMYNTFNKHNSSDPRYTSELNYLRFYLPDIFPTLNKILLFDHDVVVQQDLSGLWNANLKGKVIAAVGTCQEGGTSFHRMDMLINFSDPFIAERFDANACTWAFGMNLFDLQQWRRHNLTALYHRYLQMGSKRPLWNIGSLPLGWLTFYNKTKVLDRRWHILGLGYDSGVDKNEIEGAAVIHYDGIRKPWLDIAMGRYRSYWTKYMNFDLPILQRCNLQA

SEQ ID NO: 145167 - protein, 95 aa, Glycine max
  Coding DNA Sequence Number=SeqID_28389
MALDQYKIEFHVVGFGVWWGLGRGSVATWWLQHELDRGSWFVEEEHNGVMDDVDSDGEQRHLPPETPQSLSSPMSQSFALASTIRITVQCRHPSP

SEQ ID NO: 145168 - protein, 61 aa, Glycine max
  Coding DNA Sequence Number=SeqID_28390
MDEAAVGNGSDRWRWMIIGNGSGLHCAPLGSVSCGRVHDSGWIGYVDRASALGRNVKVLTN

SEQ ID NO: 145169 - protein, 192 aa, Glycine max
  Coding DNA Sequence Number=SeqID_28391
  Gene Ontology: Mol. function=metal ion transporter activity; Cellular component=membrane; Biological process=metal ion transport
  Homolog annotation: Hit_ID=Q10D38; Match level="QueryCoverage=81%, HitCoverage=40%, E-value=2e-45, Identity=63%"; Hit description =Magnesium transporter CorA-like family protein, putative, expressed
  Pfam annotation: Domain name=CorA; Domain location=20-191; Score= -16.7; E_value=2e-05; Accession=PF01544.9; Description=CorA-like Mg2+ transporter protein
MALAGSVVELQASSVKKKTAVSRSWILLDHYGKGTVLDADKYAIMRLVQIHARDLRILDPLLSYPSTILGREKHIKAIITADEVLLRDPTDDDVVPIVEELRRRLPKVSAAEQGQGEEEACAQDGEGGEENEFPFEIRALEVLFEAICSFLDARTRELETSAYPALDELTSKVLNCGHGLDFVALIDIIEKP

SEQ ID NO: 145170 - protein, 47 aa, Glycine max
  Coding DNA Sequence Number=SeqID_28392
MEDNNNNQFVVEKYRIKLGREVEYLEILAQRTIRTQRDTVAQWTTLA

SEQ ID NO: 145171 - protein, 299 aa, Glycine max
  Coding DNA Sequence Number=SeqID_28393
MTPTRNKVVVIPTINNEEDAKNVFLEESFIPGRWMQAFKEKFNPKVKNNHVPYGMFFTQIIRNIGVDVSGMALFGKAVQLKRMAFLKMRITDNFPEYAQKHIKRKVKNEPKGGTPDYVSTSFIAKKKSLAEACKKDNLDETLERNEALELEEVVHASIRALLVKEHNRKLANDANIFALAGKISKHTIVEEVQRQTTEKATMMDIDGESVPEAIIIESIQAESKQEMKKNEMDELERVQSTVKLRAKIMSFDATQRQVKMEATIVAKDMDPVEKKALEETMLQFVIEASLREQKMTLLK

SEQ ID NO: 145172 - protein, 185 aa, Glycine max
  Coding DNA Sequence Number=SeqID_28394
MACLARSCSLNKIPSRVGIALSMPCSLIERPNFVIFKIPMVKLWKIVLGNSRQNLKMIQRWAKSTSTSTLSATDVLSHCTILQLTPFNSLSATSHAKRASYAHQARDSSLSESCRLSAHHALSTTPQKLVLVLPRRRQWYRQLTLLLEKQIDVAFVKKFYSNIYDPDDGSSKQCRVQGKIIKFDT

SEQ ID NO: 145173 - protein, 191 aa, Glycine max
  Coding DNA Sequence Number=SeqID_28395
  Gene Ontology: Mol. function=RNA-directed DNA polymerase activity; Cellular component=intracellular; Biological process=RNA-dependent DNA replication
MGLKSTLRLIRTLGPSLASLAQSTWSFLSNALAGASAEAYVEANLVLNWEKSHFMVLEGIVLGHKISARGIEVDIEKIDVIEKLPPPINVKGIRSFLGHVDFYWRFIKDFSKIAKPLTNFLNKDATFKLDEEFLVVFQTLKDRLVSAPVMVALDWSKELELMRDASDYAVGVVLGQQRDKIFRTICYAARS

SEQ ID NO: 145174 - protein, 142 aa, Glycine max
  Coding DNA Sequence Number=SeqID_28396
MSLRLLSAKMSIPVWIGLEPKNKPFAEGFHHEVGHYYQTLNHSCFTEETPFNMVCSWKGDFYVVFDHNFLFVLHLPHSRFTSTYHVQSIIEEVDSDVEVDVDLDAMVVQVYDHPPLTEYVCLVDVELLKMKEALAQDLESRA

SEQ ID NO: 145175 - protein, 113 aa, Glycine max
  Coding DNA Sequence Number=SeqID_28397
  Gene Ontology: Mol. function=DNA binding; Biological process=DNA integration
  Homolog annotation: Hit_ID=Q1S785; Match level="QueryCoverage=84%, HitCoverage=13%, E-value=3e-11, Identity=38%"; Hit description =Integrase, catalytic region
GVSSLSSFSIPLPFIFQEAKESIDEEDPRPTSSNGAYINNQPKEVKEPTRRLLRKHYPESHIISDPKDKKLVELPKRKSAIGAKWVFRNKLDEIGKVVRNKARLVAKGNSHQE

SEQ ID NO: 145176 - protein, 125 aa, Glycine max
  Coding DNA Sequence Number=SeqID_28398
  Subcellular localization annotation: CTP_CleavageSite=36; ConfidenceScore=5.20e-01
MKEGKFVDDMFGSSRTHVHHSSNKSTDSRQLSQAVRTKNKSHPRSYLKTLAWDELLELRSSSKEIFCCPKARETSSRRGEKKSSYKALKVQMAQIIVMEDPQMMNPYVQKVQTNAKKERKISTFL

SEQ ID NO: 145177 - protein, 159 aa, Glycine max
  Coding DNA Sequence Number=SeqID_28399
MALLPGQQLGSSGIGGNMNNNEGHLSMLSGLNPNYRTTVIGISESQASFREWMIKIFERWMVGSARPHRFEVLAPWWDPAADYCPNQCTMLLTNSASVGHHVRAGNLTVGHLPSPVVGPVGAGVVCHVHDAASEVGTEGQQTEKHAYPPLIDATPLSLD

SEQ ID NO: 145178 - protein, 188 aa, Glycine max
  Coding DNA Sequence Number=SeqID_28400
  Gene Ontology: Biological process=regulation of transcription
  Homolog annotation: Hit_ID=Q1SCJ0; Match level="QueryCoverage=87%, HitCoverage=38%, E-value=9e-42, Identity=60%"; Hit description=TCP -domain protein
  Pfam annotation: Domain name=TCP; Domain location=69-186; Score =121.5; E_value=2.3e-33; Accession=PF03634.4; Description=TCP family transcription factor
MKGGSDDFHHHHHHHHHNHHRQNFPFQLLEKKEDQQDPSSCSTSSPYPPLAILAEPSTSNNNNQLLPTPSSEPSPKKPPPKRTSTKDRHTKVDGRGRRIRMPALCAARVFQLTRELGHKSDGETIEWLLQQAEPSVIAATGTGTIPANFTSLNISLRSSGSSMSVPSQLRSSYFHNSNFSLQPRRAYS

SEQ ID NO: 145179 - protein, 206 aa, Glycine max
  Coding DNA Sequence Number=SeqID_28401
  Homolog annotation: Hit_ID=Q70I19; Match level="QueryCoverage=35%, HitCoverage=18%, E-value=3e-33, Identity=97%"; Hit description=TCP -domain protein
  Subcellular localization annotation: CTP_CleavageSite=37; ConfidenceScore=5.42e-01
MVPLYKAALLLTPGNVHKGGASPLTPPPRTSLVMKIRAIRAWVGRWRVVVGLEMEECVVVGGVLGDVEGGEVSGDSAGAGGSNDGWLRLLEEPLDGLAVRLVSQLTRELEHPSGAESRHSNSTTATVDLRVPVFGGGSFGGWFFGGGFGGGVQLRWLGEGMGKRWSKKKGLVGLLSSQGVGMGSFVGGGYGDGGDGGGGSHHYLPS

SEQ ID NO: 145180 - protein, 159 aa, Glycine max
  Coding DNA Sequence Number=SeqID_28402
  Gene Ontology: Cellular component=membrane
  Homolog annotation: Hit_ID=Q9M7R1; Match level="QueryCoverage=59%, HitCoverage=33%, E-value=1e-11, Identity=38%"; Hit description =Purine permease
MPVLKVNKITTFVKCGEAKLHFNDEGGSGDRKSRHVLGIEVVVEFDGFDNGGGAMAAKVRDGEGEDHVGDVDDFEEAGEPDMVATMEEVETHDEGPTKGADEGGKVIGDATSRRICVKNKLTTIGSHDKSLKVEEDEWREREREREERNFKREKRENEV

SEQ ID NO: 145181 - protein, 105 aa, Glycine max
  Coding DNA Sequence Number=SeqID_28403
MGEGYFISETVATYPSAGGQRLARGMRVPRKEYARSRHQRLFEENVGKTGKDAIYELLSERFGSCIYARGSGDHFKALDLINDPFYSVRNCNDKLQKPIFMDELD

SEQ ID NO: 145182 - protein, 325 aa, Glycine max
  Coding DNA Sequence Number=SeqID_28404
  Gene Ontology: Mol. function=CoA-transferase activity; Cellular component=mitochondrion; Biological process=metabolic process
  Homolog annotation: Hit_ID=Q93QC5; Match level="QueryCoverage=53%, HitCoverage=79%, E-value=1e-76, Identity=83%"; Hit description =Succinyl-CoA transferase
  Pfam annotation: Domain name=CoA_trans; Domain location=1-200; Score =147.9; E_value=2.6e-41; Accession=PF01144.13; Description=Coenzyme A transferase
MAQRVAQELRDGYYVNLGIGIPTLVANYVPAGMDVMLQSENGLLGMGEFPTEQQLDADMINAGKQTVTARLGASIFDSAQSFAMIRGGHVDLTVLGAFEVDVEGNIASWMIPGKMVKGMGGAMDLVAGVGRVVVLMEHVAKKKDGTEDIKLLPECNLPLTGVGVVDLIITDLGVMEQHADVRDAVLDVFVGDRHEAVAAVVALEPGLRAQIDRRAGPQPRHFVLGAAHQLVAQARATRRRRRDDAADDRLAIIERRLQQAAIGQQFPVFPCHQVFRLPQQVLAVHVEEDAILFHHEDFRAQAQHGVQLGQGQFGVGFAGPGGHSR

SEQ ID NO: 145183 - protein, 173 aa, Glycine max
  Coding DNA Sequence Number=SeqID_28405
  Homolog annotation: Hit_ID=Q8YFC2; Match level="QueryCoverage=34%, HitCoverage=60%, E-value=8e-14, Identity=60%"; Hit description =UREASE OPERON 23 kDa ACCESSORY PROTEIN
VCAASLNKADTPGLDLLLNPAALIPPGVTFPSFPGEAADFHVPAFLRALFEHVPDAKKTSTWKDFAYVLFGYAQLFAPGQIELGRHDPDFLAGRTDNLNGLHGPVTAPSLEAGKEIRAGVIFADDTGMIGQHHFLGGLEGGCLYEARIAQTPLHGLAGGCQHQEIRPGATHAD

SEQ ID NO: 145184 - protein, 63 aa, Glycine max
  Coding DNA Sequence Number=SeqID_28406
MGQGITTTSVLRRLPESGTLATCCSMSTGQYCCLVLFFAAMKTTTTTLEGKLDPPVPQWIEPK

SEQ ID NO: 145185 - protein, 176 aa, Glycine max
  Coding DNA Sequence Number=SeqID_28407
  Homolog annotation: Hit_ID=Q57L17; Match level="QueryCoverage=59%, HitCoverage=57%, E-value=2e-12, Identity=41%"; Hit description=Large repetitive protein
MDAIKLITARDIDKMNNISVTPKGGTIATEVSGNQVNLTAPSVVKLNLNQADIKSFTRNGSDLVVTTKSGEVVVIHKFYDANGDSDLVLQDDKGALWWVEDPGTEGFQFVSIDSTEGLLAENVTGDGTLTAFGIAGAALAGIGALIAGNNGGGGGGGGDNGGGDNGGGGDTTAPAA

SEQ ID NO: 145186 - protein, 73 aa, Glycine max
  Coding DNA Sequence Number=SeqID_28408
MHGNSSCLSGHVSPVHVNGPECSLSLSRILLSNVADRQNAIDEARTPEIPSGCRKDKVRTGRLMARTAQHCAG

SEQ ID NO: 145187 - protein, 90 aa, Glycine max
  Coding DNA Sequence Number=SeqID_28409
  Homolog annotation: Hit_ID=Q9FVY6; Match level="QueryCoverage=54%, HitCoverage=20%, E-value=2e-07, Identity=65%"; Hit description =Putative senescence-associated protein
MAVSVTHGSEKGTIASSHRKLLTNGCFHVLLVQLLAIAVIIFGVWMSTHHDGCRKSLTMPVIGLGAICSWLFGCPEKHLHTIMDCILIPC

SEQ ID NO: 145188 - protein, 63 aa, Glycine max
  Coding DNA Sequence Number=SeqID_28410
MEEEEEEEEDSGESFVLCAVESTVSFRCCVFIINDASESMKSRGGTRVFWGPTEQQQDKFTTN

SEQ ID NO: 145189 - protein, 115 aa, Glycine max
  Coding DNA Sequence Number=SeqID_28411
MPNDHVGRDSRHKNTQDAKFTDKLSVGIEGHFRHSNQAVLVQVLPIKAMRKHEAKPHCLKWLSRGFGYGDFSIALGVTSRKLYSTSIAGTTVAIATPNKISCSPPLKTLLVYSFT

SEQ ID NO: 145190 - protein, 41 aa, Glycine max
  Coding DNA Sequence Number=SeqID_28412
MTMVAIIVMSMKMMIMVRWNRGGDDGDDSGGMVTVMIVAVE

SEQ ID NO: 145191 - protein, 224 aa, Glycine max
  Coding DNA Sequence Number=SeqID_28413
  Gene Ontology: Mol. function=RNA binding
  Homolog annotation: Hit_ID=Q58T16; Match level="QueryCoverage=42%, HitCoverage=16%, E-value=2e-25, Identity=62%"; Hit description=FLK
  Pfam annotation: Domain name=KH_1; Domain location=126-172; Score =43.3; E_value=8e-10; Accession=PF00013.19; Description=KH domain
MAEHGFDGHDVGYVPEDPNFPQNHSDEHDVGTVIDSSGFPHLLPDEDDAGNLMEDANFPENDFVGHEHDVGGLAGDADSPPEEHVEEVHGAGDVPEDFDSLPKQGSEIDSKGNEIKKWPGWPGENVFRMLVPVQKVGSIIGRKGEFIKKITEETKARIKILDGPPGISERAVSFDFSVILCIEGWPWIYISVCLKNMMLIYYVYLLGALNTIKHTFTSIMVTLD

SEQ ID NO: 145192 - protein, 64 aa, Glycine max
  Coding DNA Sequence Number=SeqID_28414
MTARERDRGTKRDKDRKRIRRNGRHRARLNDNGRGHKWGRRGRRMQKNEVTQKAKVVEICFGEF

SEQ ID NO: 145193 - protein, 62 aa, Glycine max
  Coding DNA Sequence Number=SeqID_28415
MDDENGRWNKGTLVMFQLWALEHFCSYQIQYTNCGILTMKNTYQEIRSRLNIPLLRCNRHRK

SEQ ID NO: 145194 - protein, 58 aa, Glycine max
  Coding DNA Sequence Number=SeqID_28416
  Subcellular localization annotation: CTP_CleavageSite=52; ConfidenceScore=5.08e-01
MDVASPNGISSVAWMQSAIVVQRNQPLTWHKVLLMARLRLASLHVKVKKLVNASLLQF

SEQ ID NO: 145195 - protein, 167 aa, Glycine max
  Coding DNA Sequence Number=SeqID_28417
  Gene Ontology: Mol. function=RNA-directed DNA polymerase activity; Biological process=RNA-dependent DNA replication
  Homolog annotation: Hit_ID=Q1STT2; Match level="QueryCoverage=89%, HitCoverage=37%, E-value=3e-10, Identity=26%"; Hit description =Lipocalin
MTMKKDNGGMGFKQLQDFNLVMLGKQVMKEGLQWRIGNGEFIHVWSQPWLKNGIHPYVSPNPHNDNFNLKVADLIRHDLGAWKAYLVEENFNHSYAQRIKALPFLNTSKNDKLIWRFSPAVYGNPEITSFKMKFTDSTVAYSSNVVLDSMEACSDHNINKPNSATID

SEQ ID NO: 145196 - protein, 83 aa, Glycine max
  Coding DNA Sequence Number=SeqID_28418
  Homolog annotation: Hit_ID=Q1RY42; Match level="QueryCoverage=84%, HitCoverage=8%, E-value=5e-25, Identity=78%"; Hit description =Ribosomal RNA methyltransferase RrmJ/FtsJ
  Pfam annotation: Domain name=Spb1_C; Domain location=1-78; Score= -90.6; E_value=0.039; Accession=PF07780.3; Description=Spb1 C -terminal domain
MRKLEKVRKKANAISDRTEIFDRSKRKQIEQLYKRVVPKRPKKEYVVAKKGVQVRAGKGKVIVDRRMKKDALLYLKKKVKEGK

SEQ ID NO: 145197 - protein, 333 aa, Glycine max
  Coding DNA Sequence Number=SeqID_28419
  Gene Ontology: Mol. function=RNA binding; Biological process =gynoecium development
  Homolog annotation: Hit_ID=Q58T16; Match level="QueryCoverage=83%, HitCoverage=48%, E-value=4e-65, Identity=50%"; Hit description=FLK
  Pfam annotation: Domain name=KH_1; Domain location=225-287; Score =59.8; E_value=8.8e-15; Accession=PF00013.19; Description=KH domain
  Pfam annotation: Domain name=KH_1; Domain location=45-112; Score =64.9; E_value=2.6e-16; Accession=PF00013.19; Description=KH domain
  Pfam annotation: Domain name=KH_2; Domain location=45-90; Score=7.5; E_value=0.015; Accession=PF07650.7; Description=KH domain
  Pfam module annotation: Pfam domain module=KH_1::KH_1::KH_2; Domain location=225-287::45-112::45-90
MVSAKEEPDCPIPPAVDGLLRVHKQVINVDRDLADSALAAGRSVVTRLLVADTQAGSLIGKQGSTIKSIQDGSGCTIRVLGSENLPIFALRDDSIVEIQGESAGVHKAVELIAVHLRKFLVDRSIMQMSDVRVNQNLPPHQNWGPPPQGFPAPAGGGGGGGPAFAPNHQYMPPSHHYDSYYPPTELPPMDKHLHQGPPPAYARDASMGIHSSSAQPQQSVVTKVTQHMQIPLTYADAVIGASGTNISYIRRASGASITIQETRGVPGEMTVEISGTSSQIQAAQQLVQILILTNILHPKTICLTSLVPTMFMIDSSSTPLAATIHIPAVETPF

SEQ ID NO: 145198 - protein, 512 aa, Glycine max
  Coding DNA Sequence Number=SeqID_28420
  Gene Ontology: Mol. function=oxidoreductase activity; Cellular component=endoplasmic reticulum; Biological process=electron transport
  Homolog annotation: Hit_ID=O81117; Match level="QueryCoverage=91%, HitCoverage=91%, E-value=0.0, Identity=71%"; Hit description =Cytochrome P450 94A1
  Pfam annotation: Domain name=p450; Domain location=45-505; Score =171.3; E_value=2.4e-48; Accession=PF00067.12; Description=Cytochrome P450
MIENILLNLQLLAPFFLLFIFPVLLFFFFSSSGSKKKEASITTIPKPYPLIGHYLDLKGVGNRRIQWLSDIVKISPAATFTLHRPLGSRQVITGNPATVEHILKTRFSNYIKGSIFINNLSDFLGTGIFNADGNTWKFQRQVASHEFNTKSLRKFVEHVVDVELSDRLVPVLASAAQQDQTLDFQDILQRFAFDNICKIAFGYDAEYLTPSTEQSKFAVAYEEATEISSKRFREPLPLVWKIKRLLNIGSEKRLRIAVKEVRDFAKKIVREKKKELKEKESLEQVDMLSRFLSSGHSDEDFVTDIVISFILAGKDTTSAALMWFFWLLSKNPGVEKEVLKEIMEKPETPAYDEVKDMVYIHAALCESMRLYPPVSMDSKEAVDDDVLPDGTVVKKGTLVTYHVYAMGRMESIWGEDWAEFKPERWLEKVETGKWKFVGRDSFTYPVFQAGPRICLGKEMAFMQMKRLVAGILRRFTVVPAMAKGVEPHYFAFLTSQMEGGFPVKIIDREASC

SEQ ID NO: 145199 - protein, 553 aa, Glycine max
  Coding DNA Sequence Number=SeqID_28421
  Gene Ontology: Mol. function=RNA-directed DNA polymerase activity; Cellular component=chromatin; Biological process=chromatin assembly or disassembly
  Pfam annotation: Domain name=zf-H2C2; Domain location=368-409; Score =10.1; E_value=0.017; Accession=PF09337.1; Description=His(2)-Cys(2) zinc finger
  Pfam module annotation: Pfam domain module=RVT_1::zf-H2C2; Domain location=23-252::368-409
MKRVNRRSCTTTSISFPHLPHTSPYSSPVLLVKKKDDTWRMYVDYRALNPVTIRDRFPIPTIDEFLDELGQASWFSKLDLWQGFHQILMHEPDIEKTAFRMHHGHYEYRIMPFGLSNAPSTFQAAMNNLLTPFLGVEPEPSKIQAMLQWPTPTSVKELRGFLGLTGFYRKFIKDYASIATPLTTLLCKDAFEWTEASQAAFDKLKLAMTRAPILALPNFSKPFVVEIDASQTTMGAVLVQKGHPVAFFSKVFGPRMTHASTYIRERHTIVMAVRKWRQYLLRRSFTILDHKSLQELMTQVIQTPEQHYYLSKLLGFDYTIRYKAGASNVVADALSRAPPSPSQLLLLSGRIWITRTNPYIPTILLEYHATPLGGHMGVAKTTHRLESSFFWQGLKDDVKRFVRECKDISMDFITHLPASHGFTVILVIVDRYSKGVHLGALPTHFSAFKVATLFLDLTDGQKEVMNRILEQYLCFFVHSQLANWFRYLALAKWSYNTSLYTSSGFTPFEVLYSKPLPTLPHYILGTTNNEAVETLVTGRQEIHTKLQQRLLKA

SEQ ID NO: 145200 - protein, 334 aa, Glycine max
  Coding DNA Sequence Number=SeqID_28422
  Homolog annotation: Hit_ID=Q9LRT0; Match level="QueryCoverage=39%, HitCoverage=50%, E-value=2e-18, Identity=45%"; Hit description =Nodulin MtN21-like protein
MSKIIKEMLPPDVRVARDAQDLLIECCVAELSIVVLHCCVAAVGPSIEAHPLPGVLWIAATFTAICFVQLIHKLTGVAIALKTTSVWQNHPGFDHNIEGWTVFGKGAIKERISNASSRFIVAHNRTHPLDSFSQKVQLKKGMLYTFSSNFTFSIVELYDISFTSIHFMNVSEGSDIVSVMFKTKGSKMVRGGQVIAKHGRTDMDNQKLPCRACDSAHSRYISCYAIYPTLTDFGNFWVSLRSIVHIWVMSKKGPLYVAMFKPIGIIFAVIMGIAFLGDSIYLGSVLGAAIAVIGFYAVIWGKSQEQAKEECEVYDDSESYSPVVPLLENKRMEE

SEQ ID NO: 145201 - protein, 76 aa, Glycine max
  Coding DNA Sequence Number=SeqID_28423
MGRDLDEHGAAFLKHGETSQSLSLSDIFTLKDGSFRLCFMELFGQQLMTIFHVQPANPPVRANVLYLSTEFSVPIA

SEQ ID NO: 145202 - protein, 48 aa, Glycine max
  Coding DNA Sequence Number=SeqID_28424
MTVPKKTNHTPPISKAHKTNNCNNMPSAVTGTEGATMIEKIENKNLMR

SEQ ID NO: 145203 - protein, 76 aa, Glycine max
  Coding DNA Sequence Number=SeqID_28425
MAFLGETSSQTVENSTLGFIFPNGSIVHNDSGVSFQASTPVPIRVPNGCDFQTLKTRIHNTLKLTDKQFLDKIYYW

SEQ ID NO: 145204 - protein, 48 aa, Glycine max
  Coding DNA Sequence Number=SeqID_28426
MSSVIYTFKRRQCLHLHFEDNNVFSHFMLSKGFTAWTSGNGQLDGEIP

SEQ ID NO: 145205 - protein, 88 aa, Glycine max
  Coding DNA Sequence Number=SeqID_28427
MSEIEEVQEQMKADMEPMKKQMTTMMEAMMSMRRMMEVNVATVVAVSTAIELDPTHPPGFNQVNHPASDMVGQGGKALGSMGGPHFVQ

SEQ ID NO: 145206 - protein, 138 aa, Glycine max
  Coding DNA Sequence Number=SeqID_28428
MGFKLKRHVGKLSVAMHQAKCTLCAKPECHSVEAELSAASCAKPVLCLSEADLSAPAVLSSSPLLWHQRRERNLPHLPKSDMTDPGSLLLRPWKGTLILWYPERYSLSEICFDEGNIDVAIVKEFYANLYDPEDKSPK

SEQ ID NO: 145207 - protein, 183 aa, Glycine max
  Coding DNA Sequence Number=SeqID_28429
MAIWFKEAFTKFELRHIVRENNERVNLLSKLASTKKKCQYRIIIQETIVEPSLDKAIMSRHQGQSPCSACAPPPKACGRHKALLDLRRELDDYVPHPSTTSIFDLLGTPSTNTIMGNNHCRHHSMPHWTSCLCTNINSLKALYTSFLIHDPPTTTSSSSSFSNPTPNCAKGSSRRWERCARSK

SEQ ID NO: 145208 - protein, 225 aa, Glycine max
  Coding DNA Sequence Number=SeqID_28430
  Gene Ontology: Mol. function=RNA-directed DNA polymerase activity; Biological process=RNA-dependent DNA replication
MALKLGPFSDTLPATLHELRVRVAKFIQMEEMTRFKEKTHHVKRCEIESENTIGLVRQRKHSVRARIPHLKTQLLGVINPIVGGFAGRGSSNLARKCYVRNLKSVNLVLVEKRPIRILPPITFMDEDFEGINRSHNDPMVVKIEVANFLVCKVLLDNRSSIDVLYWLAFKQLGLPKSQIEPFSKKFIATKFPSEDGKIITDRADQMIARECYVASLMIAKGKKMA

SEQ ID NO: 145209 - protein, 71 aa, Glycine max
  Coding DNA Sequence Number=SeqID_28431
MTSRDQVWSFCTLVSSRGGGPDDTRRYLTVIRTLVSSRGGGLDDTRRYPSGYPYKHSFAICKTERLIACRG

SEQ ID NO: 145210 - protein, 214 aa, Glycine max
  Coding DNA Sequence Number=SeqID_28432
ELERHNPHKRLFNLQDGSIDVAVIKEFYANLYTIEEQAPKQGESLPTYSRFCRLRTNPQEIEPRLCIPHKGFILNAEGQSWKLLRKDLTTLGQSVFSYSNLAPTSHTSDLNMDRARLVYGLVTNMDMNIGALISGQISSIAQSNSFRLKFPALITALWKARGVASDSLTYESLSLAINLAYIKKNYWNMDDLTVNFRGARKARTDKERLGLPTG

SEQ ID NO: 145211 - protein, 214 aa, Glycine max
  Coding DNA Sequence Number=SeqID_28433
  Gene Ontology: Mol. function=aspartyl esterase activity; Cellular component=cell wall; Biological process=cell wall modification
  Homolog annotation: Hit_ID=Q43111; Match level="QueryCoverage=99%, HitCoverage=41%, E-value=3e-16, Identity=27%"; Hit description =Pectinesterase-3 precursor
  Pfam annotation: Domain name=PMEI; Domain location=71-198; Score =53.4; E_value=7.8e-13; Accession=PF04043.6; Description=Plant invertasepectin methylesterase inhibitor
MDSLKMFKGYGKVEHEQHHLEDHCNPKPKPKFSKPFIATISIFAILFLTLTFAFALASILHHTKSQQQLLINLVESIRFVCNVTRFPSACLPAIPPSANIANPLQSLNSMLETKNSRALANCRIHLDDVLGRLSDSLLAWAALTEVTISDVQTWASMAMTDQETCLDGLEEVGDVATMEEMKKIMKRANEYTSNSLAIVANIHNLLQRFYMALH

SEQ ID NO: 145212 - protein, 159 aa, Glycine max
  Coding DNA Sequence Number=SeqID_28434
  Gene Ontology: Mol. function=structural constituent of ribosome; Cellular component=mitochondrial ribosome; Biological process =translation
  Homolog annotation: Hit_ID=Q658I1; Match level="QueryCoverage=82%, HitCoverage=91%, E-value=1e-44, Identity=66%"; Hit description =Ribosomal protein L29 protein-like
  Pfam annotation: Domain name=MRP-L47; Domain location=37-123; Score =183.9; E_value=3.9e-52; Accession=PF06984.4; Description =Mitochondrial 39-S ribosomal protein L4
  Pfam annotation: Domain name=Ribosomal_L29; Domain location=61-123; Score=8.5; E_value=0.0096; Accession=PF00831.13; Description =Ribosomal L29 protein
  Pfam module annotation: Pfam domain module=MRP-L47::Ribosomal_L29; Domain location=37-123::61-123
MFLSRTLGRTLFAAAARSKQYATTAAAAAGREGHNPLQEFFEADRSPDDDKPVVYGRSWKASELRLKSWDDLHKLWYVLLKEKNMLMTQRQMLNAQNLRFPNPERIPKVRKSMCRIKHVLTERAIEEPDPRRTSTFADVRFANLKHCPKILFMKEFTRE

SEQ ID NO: 145213 - protein, 92 aa, Glycine max
  Coding DNA Sequence Number=SeqID_28435
  Subcellular localization annotation: CTP_CleavageSite=42; ConfidenceScore=5.24e-01
MLFSKTNNSKKQQQLPKTSKMSPTTKRRHWNGVPLHRVTWLGANNGRDIYVVDADGRIVLLFGVGFKGVIRVLEGTLFEYAEPFKIVFEKPS

SEQ ID NO: 145214 - protein, 183 aa, Glycine max
  Coding DNA Sequence Number=SeqID_28436
MGCYTKEGVTSGVEDQTLCILIIPLTLCTQGHKLPRHPLACSAVFPSHKEHDAAIGIHNVDVATVVSSEPSSALDDAFDFVVGLIFDVFGSCCCFLLLLVLENNIDGTEARGFMANDFGTCDAKFAIIDKDETIQAEAKREYPFYLVEVFVSLVLERVENHDWIGYDPEVGLYLSWLVSQLIS

SEQ ID NO: 145215 - protein, 84 aa, Glycine max
  Coding DNA Sequence Number=SeqID_28437
MRWDYVAITVVAVTKIAKREGKSEKEKGEKESMRKGEDFDDVKVESNNKVVSTNIQRLSIASRIIQGQSKQDQEKDKASNNLIG

SEQ ID NO: 145216 - protein, 56 aa, Glycine max
  Coding DNA Sequence Number=SeqID_28438
MAFAPLGNSTRLAGGVSLSEACALSESHALSETLSSLRELGESGGESEKHLHSARH

SEQ ID NO: 145217 - protein, 136 aa, Glycine max
  Coding DNA Sequence Number=SeqID_28439
  Subcellular localization annotation: CTP_CleavageSite=32; ConfidenceScore=5.15e-01
YLVASDPGLRDFIWGSRTGTSRSKASSRIVVRLAVKGLGVCFAPFTLLFDLVDFIPEFGHFFYLDVTLGSFVRLIHATSQGHAMRPTGGVLHTESFDEGVEAIYGSWFVYVRKASKCSSGSVVSSYRSRLSDFHPK

SEQ ID NO: 145218 - protein, 47 aa, Glycine max
  Coding DNA Sequence Number=SeqID_28440
MVSRASVASVASVKFPKILAILGKKARLREEESSRSASVTLLRRFRE

SEQ ID NO: 145219 - protein, 80 aa, Glycine max
  Coding DNA Sequence Number=SeqID_28441
MANEELKLQDPRCRIQCPDILPENTGVAVQCKIKIFQKKIDLLQHQAVAAQKRKLLYNHGGCTSSVPSPGLKSYFVSFGT

SEQ ID NO: 145220 - protein, 75 aa, Glycine max
  Coding DNA Sequence Number=SeqID_28442
MERSERKTFNDKKANKAYVTWEDNNMDSSEEEKGHGASTCYFRKNSNNIKLIWAPKGSFIKADIQGPEKVWVPKS

SEQ ID NO: 145221 - protein, 229 aa, Glycine max
  Coding DNA Sequence Number=SeqID_28443
ASNTAREAEPVLQPAINLGRDRNATGFNRRYSPQAYPYGLPPYFTPRTAPDDLSQASTFEGQLPPHADYPMQEDDEGDAHLGPLLPLKEPAPHELPQPNIVRHVPSPSAPVKELVPFAKDKGKIDLLEERLRAVEGLDNYPFSDLVDLCLVPDIIIPPKFKVPDLINIKGRRDQKVIFDVLSKDGGIFYGRKAVNALLSRQLSRSGSGVVHQSGSFSDPVMERLGNCLH

SEQ ID NO: 145222 - protein, 171 aa, Glycine max
  Coding DNA Sequence Number=SeqID_28444
MELVKVVMRKTNNRKIPIISTESGNSRTSGSRFDVISDNGKQVFESTNYVDIEATFNSKCRVHGGDNSGVFGCIRKQKEYGPTLASRIVQANFKGDNEKQVKVWNVYGRKNPQKGKGKELNKEGKANFKKNNTPKIKYKEQVGVVIKVTVSAKEVPVEEKKKRNYDETFNF

SEQ ID NO: 145223 - protein, 149 aa, Glycine max
  Coding DNA Sequence Number=SeqID_28445
  Gene Ontology: Mol. function=RNA-directed DNA polymerase activity; Cellular component=extracellular region; Biological process=RNA -dependent DNA replication
MGNQCTDDLGKYLRVPIFHKKVSRGTFQLIMDEVHQRLSTWKARTLFFAGRVTLAKSVLQALPFHVMQITLLPKMVCDDIDKACRRFILGDIDNGKKIHLVAWDTVFSPKDKGSLCLRKARDVNMAFMFRANWRFCNRDPPPLSAIIQE

SEQ ID NO: 145224 - protein, 58 aa, Glycine max
  Coding DNA Sequence Number=SeqID_28446
MKGLFVTKLESNEVLLSPIALKVVGPFLLDSNSSRDGTNPPSNSLYGNPQTRKQRDKQ

SEQ ID NO: 145225 - protein, 185 aa, Glycine max
  Coding DNA Sequence Number=SeqID_28447
MALLEKSIVPYGSTLVTRERQPAAFALGTVADPKDPHRYRPWDPGGPRQTQNTLRTRFLALEARLFPFPCLVRNTISREACVPVGRCSAEIRDVPEDVLNASVECMNPPRTEAGLDTIAWKGTADGSFTLKSAYGVVCDLQVTSDINLFKLRMRIGMSVNDACSACQAEAEALLHLFRDCNDCKQ

SEQ ID NO: 145226 - protein, 174 aa, Glycine max
  Coding DNA Sequence Number=SeqID_28448
  Gene Ontology: Mol. function=hydrolase activity, acting on ester bonds; Cellular component=cellular_component; Biological process =lipid metabolic process
  Homolog annotation: Hit_ID=Q8LB81; Match level="QueryCoverage=92%, HitCoverage=44%, E-value=2e-70, Identity=72%"; Hit description =Putative GDSL-motif lipase/acylhydrolase
MVKERKLINALWQNLYELGARRVLVTGTGPLGCVPAELAMHSQNGECATELQRAVNLFNPQLVQLLHELNTQIGSDVFISANAFTMHLDFVSNPQAYGFVTSKVACCGQGAYNGIGLCTPASNLCPNRDLYAFWDPFHPSERANRLIVDKFMTGSTEYMHPMNLSTIIALDSTT

SEQ ID NO: 145227 - protein, 142 aa, Glycine max
  Coding DNA Sequence Number=SeqID_28449
  Gene Ontology: Mol. function=hydrolase activity, acting on ester bonds; Biological process=lipid metabolic process
  Homolog annotation: Hit_ID=Q5J7N0; Match level="QueryCoverage=87%, HitCoverage=34%, E-value=4e-51, Identity=78%"; Hit description=GSDL -motif lipase
MHINRVMYVGEKIGSEPTLPYLSPQLNGERLLVGANFASAGIGILNDTGIQFINIIRITEQLAYFKQYQQRVSALIGEEQTRNLVNKALVLITLGGNDFVNNYYLVPFSARSREYALPDYVVFLISEYRKILAVMIDTYRYF

SEQ ID NO: 145228 - protein, 139 aa, Glycine max
  Coding DNA Sequence Number=SeqID_28450
  Subcellular localization annotation: CTP_CleavageSite=30; ConfidenceScore=5.22e-01
MATPLASPPPPPPPPPFPSPPAVALLPVVNADPTTGKADGPFKKKLRTYLGVVTYETWMEVPATQKDLIWEDIQFKSDLTRKWALAVDQDGVDDTDVQKKAQAIQKQKTVPHELSHGGYEYLEQKLMAKKTKKKLEEAA

SEQ ID NO: 145229 - protein, 149 aa, Glycine max
  Coding DNA Sequence Number=SeqID_28451
MACTKKTRQMTSEAAKKIAEKIDSLEEQASQGSFVPHGQHPGRVHAAGASVTIKQYFGLDPRMSRSSSSLPLEDLQQLTQQIKDQLEESITQKVTRQLMASFSQMQSQFQSQMQSQGVALPPEPMVGPSGPRVSTKESCVDPSGNDPET

SEQ ID NO: 145230 - protein, 51 aa, Glycine max
  Coding DNA Sequence Number=SeqID_28452
MVAAEVDHGVGSLSGIIYQSSTANRQKSTITRHQLSVVISGISSQLLDIRC

SEQ ID NO: 145231 - protein, 100 aa, Glycine max
  Coding DNA Sequence Number=SeqID_28453
  Homolog annotation: Hit_ID=Q1SDG1; Match level="QueryCoverage=52%, HitCoverage=4%, E-value=6e-10, Identity=54%"; Hit description =Integrase, catalytic region; Zinc finger, CCHC-type
MVVGNKTIEKPREQWSEEEKKLVQYNLKAKNIITFVLGMDEYFRVSNCKNAKDMWDTLQEHEMELMRLNQHEENDKTKKGIAFKASSSTQEEVIKKIQLK

SEQ ID NO: 145232 - protein, 72 aa, Glycine max
  Coding DNA Sequence Number=SeqID_28454
  Gene Ontology: Mol. function=RNA-directed DNA polymerase activity
MELEQLDVKTTFLYGNLEADILVQQLKGFEMQGKKSYVSRLKRSSYGSKETPRQWYFHVCNDVHQTEPSISN

SEQ ID NO: 145233 - protein, 125 aa, Glycine max
  Coding DNA Sequence Number=SeqID_28455
MKVAHLGELLLHSEATLLTQGSKNKDTNFVRAILLFIGQLAKTKEVKLRKHEDIEVLLFSFVEAKLHGESKVIQRCFDDNNDDDKSDDKKLKDQSKNNSSESQESRSRFKTQDSRIKRRLNQDKY

SEQ ID NO: 145234 - protein, 244 aa, Glycine max
  Coding DNA Sequence Number=SeqID_28456
  Gene Ontology: Mol. function=RNA-directed RNA polymerase activity; Cellular component=mitochondrion; Biological process=RNA-dependent DNA replication
  Homolog annotation: Hit_ID=P92567; Match level="QueryCoverage=62%, HitCoverage=77%, E-value=1e-47, Identity=62%"; Hit description =Hypothetical mitochondrial protein AtMg01410
CWQASYIRNRKLCERLLKPIHHWFAEVLRRIPMDDQTAPLIRLVPSKTCLSYDLKSATDWWPLVFLFERLALLFDRSFASSVVNTTLGTNVFEVPFVKRALSQVSFVTGQPLGYYGYWPLFAFTHHVLVWWAAEQVRPGILFDRYAILGDDVLITDPLVAEQYRLGLQRLGVKISTHKSLISSTGAVEFAKQFLVKDMRVNLSPVLDGVQSVWRESFLLNAMILSVLSSPALVSGLMVARAKNP

SEQ ID NO: 145235 - protein, 480 aa, Glycine max
  Coding DNA Sequence Number=SeqID_28457
  Gene Ontology: Mol. function=RNA-directed DNA polymerase activity; Cellular component=chromatin; Biological process=RNA-dependent DNA replication
MAGRPNNTTAQLLARMTQVLETLVQDRDAKLVEYRGLFAFTKHNSPKFEGNILPSNERVIAWDMFKESFIGNYFLRDLLNQEPYYRNGENGEDICAQFENGLRANICIVGSKHILHLEGHRGVTRSTICITRIHSATKPSSGRWHRDCWSTPKRNDNNGSGAKVDYKNNNKVKPKVTGRVFAMNGSKVATSNDFIQDFPVSSLHYEVVVSTLTDKLITTSSACLDCSMMDVSELPLERELEFAIDLVLGSSPILIAPYRMSLMELAEVNQQVRKKDIPKVAFRMRYEHYEYLVMPFGVTNAPIVFMDYMNQIFINTWTKLKKRLMSAPILILLDPEKNFEVYCDALEQGLGCIVRQEKKVIAYASRQLRPHKGIYLTHDLQLAAVVFVLKIWRHYLYRERFEVLNDRKSLKYLFDLKELNMRQKRWMKFLKDYDFELSYHHGKANVVVDALSKKLLHMSIMMVKELQLIEEFRDVNFSVE

SEQ ID NO: 145236 - protein, 51 aa, Glycine max
  Coding DNA Sequence Number=SeqID_28458
MAVILYVFCSVYLTSFTNVNFSFLYSDHMLPEVEVKNFRMDAQAILNTRQI

SEQ ID NO: 145237 - protein, 85 aa, Glycine max
  Coding DNA Sequence Number=SeqID_28459
MVAVVDSSYGWNLNLLLTSISELSYVLGVEDKAVMLEKCGAPIRYNPDAIGSSDVMLIGGNFKDYMAEAILRLKRDYEMTVRSDD

SEQ ID NO: 145238 - protein, 111 aa, Glycine max
  Coding DNA Sequence Number=SeqID_28460
  Gene Ontology: Mol. function=protein kinase activity; Cellular component=nucleus; Biological process=protein amino acid phosphorylation
  Homolog annotation: Hit_ID=Q9SYX2; Match level="QueryCoverage=75%, HitCoverage=8%, E-value=5e-29, Identity=71%"; Hit description =Phytochrome A supressor spa1
MVHVLGRKSSPEMPRRIQSSVGCLGSFFEGLCKFAHYSKFEECGRLRNRDLLSSANVMCVLSFDRDEDHIAAGGVSKKIKIFDLNAISSDSVDIQYPVVEMSNKSKLSCVK

SEQ ID NO: 145239 - protein, 235 aa, Glycine max
  Coding DNA Sequence Number=SeqID_28461
MDNAFLMDLSSLEQTFWDIIKHDVFASTFNSLGKGILTIETWFLWPGRKFALLYGKEIKTSTNHWALLARARIFKGDFVAHNYVKSSLCHYFAAPFSTSSSSSPSSFLFFAFVLLLPVFLLLIPLDIPASSSLFVDPAPSLVLHLHSPSRPITFAHRQRQQMRVVEYPPTAAEELNEEQPQPPVEEGVTNERPELKLSSHGRKMAKFGRPASEIEGLVAANRLSPSITCSLDTGN

SEQ ID NO: 145240 - protein, 351 aa, Glycine max
  Coding DNA Sequence Number=SeqID_28462
  Homolog annotation: Hit_ID=Q1SK92; Match level="QueryCoverage=13%, HitCoverage=5%, E-value=2e-12, Identity=80%"; Hit description=AAA ATPase, central region; DEAD/DEAH box helicase, N-terminal
  Pfam annotation: Domain name=Prefoldin; Domain location=84-216; Score= 43.5; E_value=7.4e-10; Accession=PF02996.8; Description=Prefoldin subunit
MVVRDILIVEVGSPTFGLMIVEDRAVQSVWIMVWCLEEKKVGEGWVQSIGDEAANEVVVDIRPRTEFPPSQSRKKSASLLFMSTKNKIEVTKVPLGTLEAILECVLEIKKIIDTIAEEGVSDLTRIPLPSRGGAEGDQVPFGKAAFFPSCLIHTNEFLVLLGEGYYDERTSKQTVEILQRRGKSLDSRVDSLEVNIKDLEAEASFLNATASFLVARIMVGLPSLENREKILRNLLAKEKVDNEVEFKELATMTEGYTGSDLKPHSRTIQRWLVLIDYLQSWEFHVNQAYNQYTPQRLRMSTFKDVVEVSTLLECVLSKTVLTSATSLKVGIQRRCLPQQRLRMPTFKDVAK

SEQ ID NO: 145241 - protein, 88 aa, Glycine max
  Coding DNA Sequence Number=SeqID_28463
MGLHSPQFGSFDTHHILGNLNRECVPLEGLGVDSMGCRRKCSKQEKTTYTAASLLMGKDQRKWKKQERAKGMLLRPPPSWTCGSNDSS

SEQ ID NO: 145242 - protein, 130 aa, Glycine max
  Coding DNA Sequence Number=SeqID_28464
MRLLLHLPLVKVTRPKGEGSSEEIYPQEEGQPLMDLVRKSLNPCALLVPKIGIIRHQIPNIGDMMNVLSGATLFCKLTHVPNIFKIRVDRDLLGVEERIPEFQEPLDLRSNPFQGGMMQSYPLRALDRRL

SEQ ID NO: 145243 - protein, 173 aa, Glycine max
  Coding DNA Sequence Number=SeqID_28465
MSEVEEVQEQMKADMEAMKDQMATMMEAMLSMKKIMENNATAVAVTSAAVEVDPTHPSGLIQVNPLVSDIVGQGGEALGSTGGPHVVQSNNSFPSYNLPPNYAAPNVVPVLEEDTDNFAPIPIEGEQPEFDHAHVSLMEACLCSFYGGWIFELQCGPSMVIFHHGDAAEGKGE

SEQ ID NO: 145244 - protein, 441 aa, Glycine max
  Coding DNA Sequence Number=SeqID_28466
  Gene Ontology: Mol. function=phosphoprotein phosphatase activity; Cellular component=intracellular; Biological process=electron transport
  Homolog annotation: Hit_ID=Q00IB6; Match level="QueryCoverage=93%, HitCoverage=85%, E-value=1e-113, Identity=55%"; Hit description =Carboxyl-terminal phosphatase-like 4
  Pfam annotation: Domain name=BRCT; Domain location=349-424; Score =37.1; E_value=5.9e-08; Accession=PF00533.16; Description=BRCA1 C Terminus (BRCT) domain
  Pfam annotation: Domain name=NIF; Domain location=128-348; Score =19.3; E_value=2.9e-09; Accession=PF03031.8; Description=NLI interacting factor-like phosphatase
  Pfam module annotation: Pfam domain module=BRCT::NIF; Domain location= 349-424::128-348
MNVSRTKRRKFESIEETEGSTSEGIVKRSLEASSEVDVCCTHPGSFGNMCIRCGQKLDGESGVTFGYIHKSCWSWVRIRKQPLCICKGKAAYNIPPPYLRIAKSLRAMGYEGLRLHDEEISRLRNTDMKSLLGRKKLYLVLDLDHTLLNSTHLAQLTSEELHLLNQTDSLTMIDVSKGSLFKLEHMNMMTKLRPFVRPFLKEASEMFEMYIYTMGDRPYALEMAKLLDPQGEYFNAKVISRDDGTQKHQKGLDVVLGQESAVIILDDTEHAWMKHKDNLILMERYHFFGSSCRQFGFNCKSLAELKSDEDETDGALAKILKVLKQVHCMFFDKQEDFDDQDVRQVLSSVRREVLSGCVIIFSRIVHGAIPSLRKMAEQMGATCLTEIDPSVTHVVATDAGTEKCRWAVKEKKFVVHPLWIEAANYFWQKQPEENFSLKKKQ

SEQ ID NO: 145245 - protein, 175 aa, Glycine max
  Coding DNA Sequence Number=SeqID_28467
  Homolog annotation: Hit_ID=Q84JL5; Match level="QueryCoverage=44%, HitCoverage=16%, E-value=2e-25, Identity=76%"; Hit description =Putative alkaline/neutral invertase
DTWYGIIKLQFTLACIKMGRPDLAQKAVDSAEKRLSADRWPEYYDTPNGRFIGKQSRMVQTWTIAELCLHAKQKWQKEVFPFCCKHEDLGNYTEARPNVSDLKLDVIAEEHDDVVWWMEVADLFETVGAHCIHRVLLLDQPLQPIDFGVDNGDFVVEGANGELVWKLNWKMVSCE

SEQ ID NO: 145246 - protein, 84 aa, Glycine max
  Coding DNA Sequence Number=SeqID_28468
MEYYYPSSTCLRWQFLPEVLRLAAPPASEGLSQCPILISLHSSTLSGTRFPSFSFYSADLINLTVDEMDTCMDHPGLPTLSHGN

SEQ ID NO: 145247 - protein, 175 aa, Glycine max
  Coding DNA Sequence Number=SeqID_28469
MGRLAMMTTCDSGSILPGTVEAQTHLWEGASENESDGECEDTWGGVGFAFLLYSLSLHKFTWLWKLTQQQTLTKIHTDVLTKARDSCYNARDAFYACLEKESDKKPTEIASVGLLYPVECKQCRNEYVKQCRSSWVKHFDRQYCQNKRVQRLLDDKGSRRGPLTLPQPFTFKPIA

SEQ ID NO: 145248 - protein, 87 aa, Glycine max
  Coding DNA Sequence Number=SeqID_28470
MKLKTPFISFEKGKFAGQVSNVPNPGTLGKGTKWVIKESDDVVRIGMFERRRVKPSVRVFKLLEIFKWIRRQVGAPRPYSHNKSAQF

SEQ ID NO: 145249 - protein, 204 aa, Glycine max
  Coding DNA Sequence Number=SeqID_28471
  Gene Ontology: Mol. function=catalytic activity; Biological process =metabolic process
MRYYLVDGIYPEWMTLVNTITRSQGDKRKLFAQHQEATRKDVECTFGLKEVSFLVRPWKPLNRVASLESFNAPVSSTTGTLQSREKKAPNLHQRKTLITFDPFFSSYESIKCWLEVIKSNPDAYYTVELHKKEMRDRDRKQGSKLNNPNLVGVEDITLPKMGGYEVSELRHLALIHQNSEKRSMVNCLQLMMKKGSQEIDATKH

SEQ ID NO: 145250 - protein, 362 aa, Glycine max
  Coding DNA Sequence Number=SeqID_28472
  Homolog annotation: Hit_ID=Q8S3D6; Match level="QueryCoverage=45%, HitCoverage=52%, E-value=1e-51, Identity=64%"; Hit description =Putative bHLH transcription factor
  Pfam annotation: Domain name=HLH; Domain location=197-246; Score =43.1; E_value=9.7e-10; Accession=PF00010.16; Description=Helix-loop -helix DNA-binding domain
  Subcellular localization annotation: CTP_CleavageSite=64; ConfidenceScore=5.11e-01
MQGPNTTNSLFNNNTTCSNQPQIHFDTTSNDDFLKQMLSNLPSSSWTLDQTTPDNNVVFPYDVEHANLASKFRNHQITTDNDKASALMLHHHLLLSSSAAAANSQLLHMPFDSSAPNDVVDAPSFKSLTPVGEPASVQALYNGFSGSLQPNNQTHHFQQHPQPQVQVQGQNFGASAPGNGGGSGQPKQKVKARRGQATDPHSIPERLRRERIAERMKALQELVPNANKTDKASMLDEIIDYVKFLQLQVKVLSMSRLGGAAAVAPLVAEGGGDCIQAKRSNSNDSLAMTEQQVAKLMEEDMGSAMQYLQGKGLCLMPISLASAISKATCHPFINGDGPSSPRMSALTLANAVVKDAASVSKS

SEQ ID NO: 145251 - protein, 56 aa, Glycine max
  Coding DNA Sequence Number=SeqID_28473
MAASSIRVVVVVGDVHDYWNPEQDSKALELLQGGGGCGRGTEAVSFHGVVENLALL

SEQ ID NO: 145252 - protein, 105 aa, Glycine max
  Coding DNA Sequence Number=SeqID_28474
  Gene Ontology: Mol. function=peptidase activity
  Homolog annotation: Hit_ID=Q9ATW4; Match level="QueryCoverage=68%, HitCoverage=21%, E-value=6e-24, Identity=68%"; Hit description =Hypothetical protein hypro3
MYYDIQALYNCLKNEYGVKQEELIFYGRSIGSGPTLHLASKLQKLRGVVLHSAILSGIRVLYPVKMTFWFDIFKRASPGAAVKLCLGDLLVMGSNPETASLHMQG

SEQ ID NO: 145253 - protein, 184 aa, Glycine max
  Coding DNA Sequence Number=SeqID_28475
  Gene Ontology: Mol. function=transporter activity; Cellular component= outer membrane; Biological process=transport
  Homolog annotation: Hit_ID=Q38JC8; Match level="QueryCoverage=99%, HitCoverage=100%, E-value=1e-84, Identity=77%"; Hit description =Temperature-induced lipocalin
  Pfam annotation: Domain name=Lipocalin; Domain location=18-161; Score= -2.3; E_value=0.046; Accession=PF00061.13; Description=Lipocalin cytosolic fatty-acid binding
  Pfam annotation: Domain name=Lipocalin_2; Domain location=12-159; Score=269.9; E_value=5e-78; Accession=PF08212.2; Description =Lipocalin-like domain
  Pfam module annotation: Pfam domain module=Lipocalin::Lipocalin_2; Domain location=18-161::12-159
MATKAMEVVKGLDVKRYMGRWYEIACFPSRFQPSDGVNTRATYALRDDGTVNVLNETWSGGKRSFIEGTAYKADPNSDEAKLKVRFWVPPFLPLFPVTGDYWVLYIDQDYQFALIGQPSRNYLWILSRKNHMDDETYNELVQRAKDEGYDVSKLHKTPQSDSPPEEEGPQDTKGVWWIKSLLGK

SEQ ID NO: 145254 - protein, 114 aa, Glycine max
  Coding DNA Sequence Number=SeqID_28476
  Gene Ontology: Mol. function=peptidase activity
  Homolog annotation: Hit_ID=Q84SE0; Match level="QueryCoverage=75%, HitCoverage=23%, E-value=2e-11, Identity=38%"; Hit description =Putative TPA: Cgi67 serine protease
MEVSSELDEEVVHLTRVSGITVRVHEGEPGKRVFPEGGEDLVATFGVENVSVDVFVGGDTRHCWVTSVRLPYVVACGPNGVPLESPQQLVLESMVQVAGVWELGVRIPEYFSSA

SEQ ID NO: 145255 - protein, 754 aa, Glycine max
  Coding DNA Sequence Number=SeqID_28477
  Gene Ontology: Mol. function=glycerophosphodiester phosphodiesterase activity; Cellular component=anchored to membrane; Biological process=glycerol metabolic process
  Homolog annotation: Hit_ID=Q9FGT9; Match level="QueryCoverage=96%, HitCoverage=97%, E-value=0.0, Identity=53%"; Hit description =Arabidopsis thaliana genomic DNA, chromosome 5, TAC clone:K21L19
  Pfam annotation: Domain name=GDPD; Domain location=357-643; Score =64.6; E_value=3.1e-16; Accession=PF03009.8; Description =Glycerophosphoryl diester phosphodiesterase family
  Subcellular localization annotation: CTP_CleavageSite=16; ConfidenceScore=5.01e-01
MFRSLFLIPLLLHTILAKKTALPNLPTPQVPPQQWSTLSGNEPLVIARGGFSGLFPEGSPDAIGLAQGISVFLCNLQLTKDGGAFCVTGTTLDNTTIISLVDPKEKTYNVDGKDVQGHFSFDYTGLLIEQNVSMTQAIYSRPNFYDGASPVLNLDALLSGKSPPRTWLNVQNAALYIENGVQVVDIVLELLKVYQIEFVSSSDIGFLKSISGKSNKATKVVFKLLNNNKVEPSTKKPYGSIVKDLVTIKSFASGIMVPKEYIWPVKPDKYLGLPTTLVADAHKSGLEVYASGFANDFFTSYSYDYDPVAEYLQFVDRGDSVDGVVTDFPATASNAIACFAHNNTLPKKAPTLIISNNGASGVYPGSSDLAYQKAIDDGADIIDCSVQMTKDGIAFCSESTDLTSDTTAMPKFMSRSSSVPEIQPKSGIFSFDLTWKEIQTLKPQMVSKSSDFLRNPANKTSGKIVTLSEFLELAKAKAVPGILVNIQNAPYLASKKGLDIVDAVSIALINATFDKQTKQQVLIQSDDSSVLSRFKDIPSYKRVMLLIDKMGDVPKQSAEEIKKHADAVNLPKTSILKISNAILVGMTSIVQELKDANLTVFVHSLKNEYTTLAFDYWSDPNVEIATYIQIAKVDGIVTDFPATASRFMRSPCSIPTNDPSILPAKPGDLLNTIPTEIQPPALAPLPPLEVANVVDPPLPAVTKSSKNSTVAEPADAGATPASPPLPSGARANVASSGLSIITILVFAMLFAAHQ

SEQ ID NO: 145256 - protein, 645 aa, Glycine max
  Coding DNA Sequence Number=SeqID_28478
  Gene Ontology: Mol. function=binding; Cellular component=nucleus; Biological process=metabolic process
  Homolog annotation: Hit_ID=Q94E87; Match level="QueryCoverage=58%, HitCoverage=74%, E-value=8e-71, Identity=34%"; Hit description=PPR -repeat protein-like
  Pfam annotation: Domain name=PPR; Domain location=161-195; Score =26.9; E_value=7.3e-05; Accession=PF01535.11; Description=PPR repeat
  Pfam annotation: Domain name=PPR; Domain location=229-263; Score =14.0; E_value=0.16; Accession=PF01535.11; Description=PPR repeat
  Pfam annotation: Domain name=PPR; Domain location=366-400; Score=7.2; E_value=1; Accession=PF01535.11; Description=PPR repeat
  Pfam annotation: Domain name=PPR; Domain location=62-96; Score=3.6; E_ value=2.8; Accession=PF01535.11; Description=PPR repeat
  Pfam module annotation: Pfam domain module=PPR::PPR::PPR::PPR; Domain location=161-195::229-263::366-400::62-96
MDGCNEIKKPITLPRHRRGCLTATDPSDLTKVDACLFFHKQLRRGRALLARILVTGSISSTQLANTLINLYAKCSHFSKANLVFDTINNKDVVSWSCLINAFSQQQSHTPSLHVMHLFCQLTIAHKNVVPNTHTFVGFFTAITLFDAQALAIKIACSHDVFAASSLLNMYCKTGFVSEAHELFDEMPERNVVSWATMIFGYASQELTDEALELFELVQAHSLAMKNGLVCFVFVANALVTIGDSDKALKLFYDMHYSGELPCEFTLVGVINACSDTCAIVEGRQMHAYSLKLGYESQLYVLSALVDMDYEGALNLYGKMQLGGVIPNDLTMASVLKACSSLAASDQGKQMHARIIKSNFSLEIPIGSALSAMYAKCGSLDDGEALELFEKMCLEGTEPDNVMFVNLLSACSHMGLVDRGRAGKLHEVKEFIESALSRARRYIISFNASTTLVVEGMEFVKCEVGGQSFMLHQIREMIGMTVAIMRNCVLDKALQQDVNINLPTAPEVGLYLDECFFTSYNQKWKDHEELSMKAYEKEAEFKMKYIYSHIASTEQKEGTVVPWLHSLNHRNYPDLRVINGEAIPDNKSADPEEAITHNKSADPEEAITDNKGADLEEPITNNKSADPEVVTQWNRVPVVQYELFSF

SEQ ID NO: 145257 - protein, 231 aa, Glycine max
  Coding DNA Sequence Number=SeqID_28479
  Gene Ontology: Mol. function=hydrolase activity, hydrolyzing O -glycosyl compounds; Cellular component=extracellular region; Biological process=carbohydrate metabolic process
  Homolog annotation: Hit_ID=O81862; Match level="QueryCoverage=94%, HitCoverage=56%, E-value=7e-65, Identity=55%"; Hit description =Putative chitinase
  Pfam annotation: Domain name=Glyco_hydro_18; Domain location=2-210; Score=54.1; E_value=4.6e-13; Accession=PF00704.18; Description =Glycosyl hydrolases family 18
MTNYGFLIREWRTALVNEARNSGKQILLLVGAVFYSSNYYSLNYTIQDVINAFDFVNVMAYDFYGPNWYPNFTAPPAALYALNHPAANRVSGDMGIRDWIGSGMPASKLVLGVPFYGYAWRLLNSNNRGLFDRANGSAFGGDGSMGYSQIREFVSQNRAACTFNSTVVSDYCSSGTTWIGYDDVQSVSAKVAYAKTNNLGGHFVWHVGADYNWVLSQAGAVYPDMYCCYRV

SEQ ID NO: 145258 - protein, 627 aa, Glycine max
  Coding DNA Sequence Number=SeqID_28480
  Homolog annotation: Hit_ID=Q10Q34; Match level="QueryCoverage=31%, HitCoverage=19%, E-value=3e-15, Identity=35%"; Hit description =Expressed protein
  Pfam annotation: Domain name=CaM_binding; Domain location=494-611; Score=66.0; E_value=1.2e-16; Accession=PF07839.2; Description=Plant calmodulin-binding domain
  Subcellular localization annotation: CTP_CleavageSite=23; ConfidenceScore=5.07e-01
MAVKGELIGFNGSLTPRFFFPLKSKLLTKSFKHLLPFPPHLKGFLSIAGVSEIVASSLIKVMAEESTVNQLKSEKIEPEVVDDKANPNERLTITKVPPKILSRYLSARKSSCHDLCKYGIPHEVEAKPWSPTQRRVTKKERKTKVPQENVTSLEGTEKSESSSKPSQTSKIEKANIPVDTKQVTYKKTVTSEINSPPFEETHVSSENNNSDLMQAQSEPSLPVKESSKSQAKREMVKNKSPSDSSSRKETESKINSSKQKKTSFTGGKEKPTPPSLPLSPKHNVKKPQSLSSKSLKNMARESSLKPHENVEIKPELASSDNILHVTEPASENSSEDPTVACGASKLSSPSPSSSGNKSLKHTNEKTGKSALSASSRKGLGSVAGNKGKVNMRSVSRPLSVSSYVSTSNSSLRKQNNAASKSNKRGHDHEGENVKMGYKIRPKVSTKVGAANKSVLAARKLNFRRGKVIELQPQSNDVPRRLKFRPARILGDDMRRDINSARKKTIVDNKVGGDGEVNASNTKSEKVVAKLQTVEESNRRIVGRKVGGDRSKIEASKSGSDEKVVLRHQNVEGKKQNPRLYNNVIEETASMLAELRKSKVKALVGAFETVISLDSPRDATAAEVSTTC

SEQ ID NO: 145259 - protein, 2005 aa, Glycine max
  Coding DNA Sequence Number=SeqID_28481
  Homolog annotation: Hit_ID=Q67V89; Match level="QueryCoverage=52%, HitCoverage=98%, E-value=1e-166, Identity=39%"; Hit description=Zinc finger protein-like
  Pfam annotation: Domain name=Remorin_C; Domain location=1902-2002; Score=-6.0; E_value=0.0042; Accession=PF03763.4; Description=Remorin, C-terminal region
  Subcellular localization annotation: CTP_CleavageSite=82; ConfidenceScore=5.22e-01
MDDNEVVDDQNSGWFQVKKKHRNTSKFSLQSWVGGLSGTNASNSLHTQHSMTKTVDNSHSQQKTHLSRSGENFSQNPVPGSVASSISESNENEGTHCLNTGVVRHNTESQKSSTLLTMDSQGKHEEVRKLYQTVKPDLAQKTRWGDLEEGGLALPHENLIGVGIKFGSIGDYSLLSCRKNGNIPDPCDSYHPQEKNLTTTTIDAEAVSDQIPSMRCEDNKLGENGKDVKNISLEHLNIQETNGEIIGPEDDILHCVKKNDEVNKTTTNSAINNDILSSKDATVVANQVHVSINVLSDIKVSEVPEQKGSLSEAVTAQGTESQVPEIVNGSVASADVVRGPQDGNAENVVPTSHNTSSLEEGDSNESKERFRQRLWCFLFENLNRSVDELYLLCELECDLEQMKEAILVLEESASDFRELITRVEEFEKVKKSSQTIDGGPVILKSDHRRPHALSWEVRRMTTSPHRADILSSSLEAFRKIQQERASLQSGTTENAMSKCVTSESIGNTNKSRVNDGTDVAKYSVTKSRKQVGSSDAKQGNLNGKKRNIEGGKPFDSITGQNICNPPESILTSEGKLSKLSPLENSSASATTKGKRDQLGLGSDKTLYKKDKAPTEVVNEKNPRSTDNLRRQMPLPEKDKEKRSSAPGKSLNAWKEKRNWEDILSSPFRISSRLPYSPSLSRKSAERVRTLHDKLMSPDKKKKTTSDLKREAEEKHARAMRIRSELENERVQKLQRTSQKLNRVNEWHADRHMKLREGMYARHQRSESRHEAFLAQVAKRAGDESSKVNEVRFITSLNEENKKLMLRQKLHESELRRAEKLQVLKSKQKEDLAREEAVLERRKLIEAEKLQRLAEIQRRKEEAQVRREEERKASSAAREARAIEQLRRKEERAKAQQEEAELLAQKLAERLNESEQRRKIYLEQIRERANLRDQSSPLLRRSINKEGQGRSTPTNSSDDSQTNIVSGIGSSLGIGNVTLQHSIKRRIKRIRQRLMALKYEFLEPPLGGESASLGYRVAVGAARAKVGRWLQELQRLRQARKEGATSIGLIISEMIKGKDPELQASRQAGLLDFIASTLPASHTSKPEACQVMLHLLKLLRVVLSTPANRSYFLAQNLLPPIIPMLSAALENYIKIAASLSIPGNISLPPSKASVENFESISEILNNFLWTVTAIFGHINSEERQLQMRDGLLELLISYQVIHRLRDLFALHDRPQMEGSAFPAPILLSIQLLVVLTSISGRLSYIGWGSSPVAMEQEIVSERAKFADSAHFVVNNSWENYNPLSVTNGSSVVHLPDVPEDRPLDEMIKVNKSDESISIGKDCELEHDSSVKLKNDDMEKIDDLDESKKNQNGDITNLSVLQKDEKHTVVNITVQKNERISNFAQPIVFLLSAISETGLVSLPSLLTAVLLQANNRSSSEQASYILPSNFEEVAAGVLKVLNNVALLDLVFLQQMLARPDLKMEIFHLMGFLLSHCASKWKAPNDQVGSLVLESLSLLGHFALFHPGNQAVLRWGKSPTILHKVCDLPFVFFSDPELMPILAGTLVAVCYGCEQNKFVVQQELSVDMLLSLLRSCRNAAPATQLNSTLDNSTTDESGECNQLGTEIKKPQVDFPVKNSRSNGKGTRASSGKSGASGNNIKNCRIRSQRDGKITKNSEEVAPKHGEPSNLMLHCRFPPSFIDKVEQFFSAEIANGFKERVLCILWRLLVKPILLCLSACCSTHKASSLFIFTQSNGLETREVQDREVYTDFNFKEWKIDSTKEVSFSDSRPTKHHGSSGSRNDKAWNWLPRITSHDDYIRDDEYITSVAATAFAIHSLEEAELRDLPKMRERSKSSRSQTMRREENDIPKRPSYGETSMKRSFGQEPGTKESAFPVRRPSGISPPTPRSLSPALGYQRQQQGIPLQHKNAKTRPETWEKAMIKMIQKQYEKMKSKIFSWEFVKMIQAKVQRAMEMQNYQNKLAREDRVAQGAGAGLEDRRRKESEARKKSNKNRKTSKDLVECLCFNS

SEQ ID NO: 145260 - protein, 580 aa, Glycine max
  Coding DNA Sequence Number=SeqID_28482
  Homolog annotation: Hit_ID=P46486; Match level="QueryCoverage=6%, HitCoverage=18%, E-value=8e-07, Identity=81%"; Hit description =Photosystem I reaction center subunit III, chloroplast precursor
  Pfam annotation: Domain name=LTV; Domain location=10-500; Score= -108.5; E_value=0.00025; Accession=PF04180.4; Description=Low temperature viability protein
  Subcellular localization annotation: CTP_CleavageSite=38; ConfidenceScore=5.02e-01
MGGRKKKFIDKKNSATFQLIARDTSDPSFSQSDRVFVRVDNNPVSFPVADDSAFDDSPDDYYYDDGGGGVSGGPLPEGVRREILELGFPDDGYNYLNHLREIKNTGAGAAFFHNPKFKLQHLPRDVKAYDASRLQISEADGEAVENTIYSVASKTTSVRVQKAVDPEVAALLDDDDLSRLGSDVEDLEEDFVVQANLLEEEDEEDEEKDPICNETSFSEESAIHRNGNNAHTLQVSSCSRVTDDSGPLDGVTDGVPGEDCVGEKPGARRLLDEQFDLLEHQEYGTDDDDDGGDYYENYQADEDESLAEKLKHSLKNHVMDDLELDGKYKVPSDLLKNKEAPHEEQEDFAADVIRRCKEYAEGYEVEDDNKDVVLVEESSDESEVWDCETIVSTYSNLDNHPGKIEAPGVARKKKLAETVSAALSSSSQIISLRGKEKLPVDFLPGGRKPATEKVKDQSIAKTEQYKRKQHGLESKEEKKERKAAVKEERREARRNKKEMKELYKCEAHRAQRAAAVSGTGARELPYCDQGREETHHERDHHRRSSSGDSAGPLLPTENSLPRMSKLNLNGSHSFPKPHSN

SEQ ID NO: 145261 - protein, 533 aa, Glycine max
  Coding DNA Sequence Number=SeqID_28483
  Gene Ontology: Mol. function=ubiquitin-protein ligase activity; Cellular component=intracellular; Biological process=protein modification process
  Homolog annotation: Hit_ID=Q9LUV3; Match level="QueryCoverage=92%, HitCoverage=50%, E-value=0.0, Identity=76%"; Hit description =Arabidopsis thaliana genomic DNA, chromosome 3, P1 clone: MGD8
  Pfam annotation: Domain name=HECT; Domain location=243-533; Score =331.6; E_value=1.4e-96; Accession=PF00632.15; Description=HECT -domain (ubiquitin-transferase)
MTKISYSSDFKNVFLGYSPSHKGYKCLAAGGRHMLMIVDNEEFYEQEKPLSLKDIRSLIIILRQVLWQLLWVNHITSANSVKSVPVSSASKGQSVQTIQQRVCIVVSELLSQLQDWNNRRQFTSPSNFHADGVNDLFSSQAVIENTRANEILKQAPFLIPFTSRVKIFSSQLAAVRQRHGPQAVFSRNRFRIQRDHILEDAYNQMSQLTEDSLRGSIRVTFVNEFGVEEAGIDGGGIFKDFMENITRAAFDVQYGLFKETADHLLYPNPGSGMIHEQHFQFFHFLGTLLAKAMFEGILVDIPFATFFLSKLKQKHNYLNDLPSLDPELYRHLIFLKHYKGDISELELYFVIVNNEYGEQTEEELLPGGRNLRVTNENVITFIHLVANHRLNFQIRQQSSHFLRGFQQLMQKDWIDMFNEHELQLLISGSLDSLDIDDLRLHTNYAGGYHNEHFVMEMFWEVLKGFSLENRKKFLKFVTGCSRGPLLGFRYLEPMFCIQRASGNAVEESLDRLPTSATCMNLLKLPPYTRFGLG

SEQ ID NO: 145262 - protein, 1827 aa, Glycine max
  Coding DNA Sequence Number=SeqID_28484
  Gene Ontology: Mol. function=peptidase activity; Cellular component =cell surface; Biological process=homophilic cell adhesion
  Homolog annotation: Hit_ID=Q9FF08; Match level="QueryCoverage=97%, HitCoverage=100%, E-value=0.0, Identity=30%"; Hit description =Arabidopsis thaliana genomic DNA, chromosome 5, P1 clone:MXM12
MVDLEVVATCFNILHFDSLCAPILQLAENFGGEGLNGNSSELSSEKLCAGLSMPGNEVGDRVHNFFGQENLPQGQYHSQAVDGNWPGLSNNLWAGSQRPTVAPFISNLKNFNLQQSDFEQGHTSTPHLRHGLNLAQSNLRPDSGRNQLPNQQTTVNGYIQGHQVFQSRQNEANILGMDTETDLHGMPNLSRGISVLDSQQGSGLEHYKKNLTRSDASESPVNYDFFGSQQQMSGRHSGMLQSFPRQQSGMNDMQLLQQQAMLNQMQELQRLQQFHQLEARQQSSMNPASSISKQTIASHSASLINGIPINEASNLVWQQPEVVATNANWLQHGGSAVMQGSSNGLVLSPEQLRLMGLVPNQGDQSLYGLPISGSRGTPNLYSHVQADKPAVSQVSIQHQHQHQHQHQYSCIEGDKPTLPHISASGHSFPVHQYGSILDQTNTNDGTSVSRQDIQGKSMFGSLAQGINNGLNMENLQLVNSEQRKVPIEDFNGRQELAGSSDTSQDKVVAQVPPSQNVATLDPTEEKILFGSDDSLWDGLGWSAGFNMLDSTDSFGGVPSVQSGSWSALMQSAVAETSSSEMGIQEEWSGLSVRNTERSSGSERPSTMDSTKQQSGWADNNLQSAPNRNSRPFLRPDDLSRPSTTVTYSGLPGFHQSGSDTAQEQQDRLQTGSSQRSIPQFLESGKWLDCSPQQKPIAEGSHSYGNAANSLEVNEKVISGSWAHQQMLSSPNNRGEPFNRSNGWNAIKSPTPSNNSSMKIRENENVLQPHHDKAMQEDLGQVPAIWEVDSDTNSSVGLEHAKSPGNMQVCGEDSGMNGIAAIPNSGSTWVSRQSSQQLPNADVWRQTDTVGSQRRNESAGKYKHHMEKNPLVLESLKNEKSEGEAHGMENSNKKDKSATGGLRENPSFDGDLRSPKLSGQGNRRPPVTRKFQYHPMGDVGVDTEPYGNKHVINSQPMPHQPIGGLKGQDQSYPGQSKYSHSDGNCNETEKGDSKTIDDNASKSTLPGHMLKTLTPFDRSVGNYALNKTASPSQNILELLHKVDQSREHGVATNTSTSNRPLSSRVMDTESSDGSAAHHQRNQSSLSQGFALQLAPPTQRHHMASSHATPHVASETGDKGPTWLAASQTFPSQESSHELRNNISGSSGQMFDKTSQYSALGNIQQAFTSGFPFSRIHTQNQNVANLGGQIANTQCDNSTFVDRTASTNQVDEYCERAQTGQSELQSAQDMSQKDSMNQIRAGDPTMKISTLEAGTAPHAPVTSSLQSAPSKVLHNVWTSVSGKQHPNAYKIPSHPQPNNICETTIGPQKPGIEDSEKGNLSEQWVLPESVDAVEETASASQVKEHVKYTPDTSQSGPAATSKDIEDFGRSLRPNNFLHHNFSMLNQVQSMKNMEIDPSNRDVKRFKVSDNVMDKQLVDSISNRGQQSYGYNNIVKDVSDNSSSVPPSDPNLLRFSTKPGDARDTSASSQEVVGYGQRNALNVANNNKVTSVRSEHSVINPQMAPSWFEQYGTFKNGKMLQMYDVRTMTPQKVMEQPLIIRNQSGSLHLANSMEQVNSLSDAGQNSMLTSVANEHLPSQLLLPAAEPDLSSMRPKKRKSSTSELLPWHKELSQGSERVQDISAAELDWAQAANRLVEKVEDDAELVEELPIMKSKRRLVLTTQLMQQLLNPPPAAVLSADVKLHHESVVYSVARLALGDACSSVSWSGNDTLMSPGSKNPLPDKPKASEKIDQYILKVEDFVDRARKLENDMLRLDSRASVLDLRLECQDLERFSVINRFAKFHGRGQNDGAETSSSDATANAQKSCPQKYVTAVPMPRNLPDRVQCLSL

SEQ ID NO: 145263 - protein, 104 aa, Glycine max
  Coding DNA Sequence Number=SeqID_28485
METRRSMERSGLIPLVKMILAECVISSCGRSREPSIFTRSWHVTTGFYATGLHNLSTDDGNGDEPIALEVTPPTFGISIQYHTTLGLHGILTSAQPRSPALKSS

SEQ ID NO: 145264 - protein, 268 aa, Glycine max
  Coding DNA Sequence Number=SeqID_28486
  Gene Ontology: Mol. function=oxidoreductase activity; Cellular component=membrane; Biological process=electron transport
  Homolog annotation: Hit_ID=Q3C211; Match level="QueryCoverage=82%, HitCoverage=55%, E-value=2e-65, Identity=54%"; Hit description =Flavonoid 3'-hydroxylase
MVVEIMVLGGVFNIGDFILALEWLDLQGVQAKMKKLHAKFDAFFTSIVEEHKISRSENHQDMLSTLLSLKEAPENGEKLTDTEIKALLLVVVKETFRLYPSTPVSLPCVAAESCEIFGYHIRKGVTLLVNVCAIARDPNEWPNPLEFKPKRFFSSGEKTVVDVRGNNFEFIPFGVGSRICARMSLGLRMVKLLTATLAPYAFYLELENGLNPKKLNMDEAYVAYPPKSSAIIAPPSPKALITRVLVIIVFLIWSLALCDFVFSPPSFY

SEQ ID NO: 145265 - protein, 714 aa, Glycine max
  Coding DNA Sequence Number=SeqID_28487
  Gene Ontology: Mol. function=diacylglycerol kinase activity; Cellular component=integral to membrane; Biological process=intracellular signaling cascade
  Homolog annotation: Hit_ID=Q39017; Match level="QueryCoverage=99%, HitCoverage=100%, E-value=0.0, Identity=72%"; Hit description =Diacylglycerol kinase 1
  Pfam annotation: Domain name=C1_1; Domain location=149-210; Score =50.8; E_value=4.7e-12; Accession=PF00130.12; Description=Phorbol estersdiacylglycerol binding
  Pfam annotation: Domain name=DAGK_acc; Domain location=493-650; Score= 153.0; E_value=7.7e-43; Accession=PF00609.10; Description =Diacylglycerol kinase accessory domain
  Pfam annotation: Domain name=DAGK_cat; Domain location=359-475; Score= 113.1; E_value=8.1e-31; Accession=PF00781.14; Description =Diacylglycerol kinase catalytic domain
  Pfam module annotation: Pfam domain module=C1_1::DAGK_acc::DAGK_cat; Domain location=149-210::493-650::359-475
MDDDRDFELLFYSWNNKNPTDQLFVISCVVAALVGILTIAYTAFQWRRNINLSWMKAIARSKKNPKARHKIPAAPHTWDLESASRAKNLNCCVCFKSMSPSQTLGPIVASEGFIHRCCTCGAVAHLSCSSSAHKDCKCVSMIGYEHVTHQWTVRWIDVADQPDETALCSYCEEPCGGTFLSGSPIWSCLWCQRLVHVDCHSTMSNETGDICDLGQFRRLILSPLYVKELNWNLPGGFLSSITHGANEIASSVRASIRNQSKKYKHGNEPSVESGNSESIGEVSTESTGDSHQIHNGHHEVGEKSSSNKEVRHQDSELDNKLDRKPTLRRNSSINQKDESHSLGVKQKYDLIDLPPDARPLLVFINKKSGAQRGDSLRMRLNILLNPVQVIELSSTQGPEMGLYLFRKVSHFRVLVCGGDGTVGWVLNAIDKQNFVSPPPVAILPAGGLGPVERQGGLTTFLQHIEHAAVTVLDRWKVTISNPQGKQQLQPTKFLNNYLGIGCDAKVALDIHNLREENPDKFYNQFMNKVLYAREGAKSIMDRTFADLPWQIRVEVDGVEIEVPEDAEGVLVANIGSYMGGVDLWQNEDENYDNFDQQSMHDKILEVVSISGTWHLGKLQVGLSRARRLAQGQSIKIQLFAMFPVQIDGEPWFQQPCTINITHQGQAFMLKRVAEEPLGPASAIIAEVLENAETHNVINTSQKRALLHEMALRLS

SEQ ID NO: 145266 - protein, 111 aa, Glycine max
  Coding DNA Sequence Number=SeqID_28488
MSMPGLFNNMACRGEHVTPKYDCNEVHTLNISNLSLNINKLWTLVQRKGKPNKIGVCMDSMLNNIAKMLEYNRLDIKFQSFSMPFTIMSRSVFPFMLLFWHRPLGVRAQVQ

SEQ ID NO: 145267 - protein, 36 aa, Glycine max
  Coding DNA Sequence Number=SeqID_28489
MEIEEELKNITKGDPPQRERSEKIAIKKKFKKMAQG

SEQ ID NO: 145268 - protein, 96 aa, Glycine max
  Coding DNA Sequence Number=SeqID_28490
MEEEKGVPNYDELTCKGERVAWFKLGLRFSSSAAKDDVPKPSSSFLSKFVKASSESKKQAQLQSIHDNLKKSLLSSLGFRAGIGTTIEVEDEVGAE

SEQ ID NO: 145269 - protein, 415 aa, Glycine max
  Coding DNA Sequence Number=SeqID_28491
  Gene Ontology: Mol. function=oxidoreductase activity; Cellular component=membrane; Biological process=electron transport
  Homolog annotation: Hit_ID=Q2PEY1; Match level="QueryCoverage=96%, HitCoverage=79%, E-value=1e-167, Identity=71%"; Hit description =Putative flavonoid 3'-hydroxylase
  Pfam annotation: Domain name=p450; Domain location=1-396; Score =209.6; E_value=7.4e-60; Accession=PF00067.12; Description=Cytochrome P450
MTTYMTYNPKDLAFAPYGPRWRFLRKISSVHMFSVKALDDFRQLRQEEVERLTSNLASSGSTAVNLGQLVNVCTTNTLARVMIGRRLFNDSRSSWDAKADEFKSMVVELMVLNRVFNIGDFIPILDRLDLQGVKSKTKKLHKRFDTFLTSILEEHKIFKNEKHQDLYLTTLLSLKEAPQEGYKLDESEIKAILLDMFTAGTDTSSSTIEWAIAELIRNPRVMVRVQQEMDIVVGRDRRVTELDLPQLPYLQAVVKETFRLHPPTPLSLPRVATESCEIFDYHIPKGTTLLVNIWAIGRDPNEWIDPLEFKPERFLLGGEKAGVDVMGTNFEVIPFGAGRRICVGMGLGLKVVQLLTATLAHTFVWELENGLDPKNLNMDEAHGFILQREMPLFVHPYPRLSRHVYSSSSSPSSSS

SEQ ID NO: 145270 - protein, 101 aa, Glycine max
  Coding DNA Sequence Number=SeqID_28492
  Homolog annotation: Hit_ID=Q8LKU0; Match level="QueryCoverage=85%, HitCoverage=32%, E-value=8e-24, Identity=57%"; Hit description =Putative expressed protein
MDSYSDFKFSLIFIARPTFYNYVAVMFVFSVITLFACGLAAIGAGLGNWLYDLTVLCYHSLYLPFLYVTFLADFFQEEDFLLDNAYYSEMKDAGFFDADWE

SEQ ID NO: 145271 - protein, 107 aa, Glycine max
  Coding DNA Sequence Number=SeqID_28493
MALEGKIDPECCCSTSMASNVGSYARESCASKMGRKNQEPIYCPTEVRRIKLGIHLSGMLNFEPSTVYVNGTYVEKYWSMDVDELSYIDMKNLIEKMGYKKYKFIWY

SEQ ID NO: 145272 - protein, 214 aa, Glycine max
  Coding DNA Sequence Number=SeqID_28494
  Pfam annotation: Domain name=NC; Domain location=73-143; Score=34.8; E_value=3e-07; Accession=PF04970.4; Description=NC domain
MAGIYVGEGMVIHFTRRAGQETRSGTILDRLLISSPPLRATFDTPCPRCGDQARSDGVICSCLDCFLSGGDLYLFEYSVSPAFFLAKARGGTCTTAFSDPTDEVLHRALFLLENGFGGYHVFKNNCEDFAIYCKTGLLVVTNISVGRSGQAASCFAAASAVVSSPLRFMTASFGGLALVGCGMYCVSRYVSDIGVRGDVAKVPVEKISEMAKEQ

SEQ ID NO: 145273 - protein, 119 aa, Glycine max
  Coding DNA Sequence Number=SeqID_28495
MVIHFIRGPGQNRFLSCSSSSLLVLLMAFRAQYVERKQELKRLACSRRHGGRAEWTSITGYAVAGSMVFSAAGIVTNNCGGALVGFGSYCYGRYIYDIGVRSVVTKVPVEEIPKMAKEN

SEQ ID NO: 145274 - protein, 77 aa, Glycine max
  Coding DNA Sequence Number=SeqID_28496
  Homolog annotation: Hit_ID=Q1SLH3; Match level="QueryCoverage=56%, HitCoverage=17%, E-value=9e-07, Identity=56%"; Hit description =Thaumatin, pathogenesis-related
MTMMGMDVSLPPRINVIARCIVTQNNLMFDVKECNDGNVILSATLAKFTLNNADELHFFDMDLIDGYNLSMIMKPQD

SEQ ID NO: 145275 - protein, 81 aa, Glycine max
  Coding DNA Sequence Number=SeqID_28497
MARRGETRNESLLTRAVAAVFAFVRHAEFEILFFLFFFIAYLLFKDIVSLVVGKGGLRVEGRREERDIMSLNPLTDISNKN

SEQ ID NO: 145276 - protein, 209 aa, Glycine max
  Coding DNA Sequence Number=SeqID_28498
  Gene Ontology: Mol. function=hydrolase activity; Cellular component =cytoplasm; Biological process=regulation of transcription, DNA -dependent
  Homolog annotation: Hit_ID=Q8RX28; Match level="QueryCoverage=77%, HitCoverage=24%, E-value=1e-60, Identity=69%"; Hit description =Histone deacetylase-like protein
  Pfam annotation: Domain name=Hist_deacetyl; Domain location=14-208; Score=-21.7; E_value=6.3e-09; Accession=PF00850.10; Description =Histone deacetylase family
MERENENSVNAQRRVGLLYDETMCKHHTPDDEDHPENPNRIRAIWNRLQSAGVLQRCVILEAKEAEDKHLLLVHSINHVNLIKNISSKQFNSRRHKIASKLGSIYFNEGSSEAAYLAAGSAVEVVKRVASRELDSAVAIVRPPGHHAEQQEAMGFCLFNNVAVAARYLLDERVSNVTPPTNSIFGKLLAFNLTVGYCIDTFAFLVLPSA

SEQ ID NO: 145277 - protein, 391 aa, Glycine max
  Coding DNA Sequence Number=SeqID_28499
  Homolog annotation: Hit_ID=Q01DI1; Match level="QueryCoverage=42%, HitCoverage=64%, E-value=2e-16, Identity=31%"; Hit description =Homology to unknown gene
  Pfam annotation: Domain name=DUF1517; Domain location=21-381; Score =77.5; E_value=4.3e-20; Accession=PF07466.2; Description=Protein of unknown function (DUF1517)
MALLRRYATASAIALFVLLLLLVTCNLNMASALSGGVMGGNFFDSDSESSSSESYTRDSESYRMGHHHHHYYNDDAPSPDTPAAKGSHSGLVFFLIFVLGMFLVSFYKGSTGNSVTVLKLQVAMLGGGMGSTIQRDLTRIAETADTSSRDGLTYLLTGYIFLKSLPPYPWLLVVGDQVYELYYFGNNASCTSLRSKSPQLKLTRFSLMVWDLDTIQSLVRHLGNCIAGYSFVDLKRSKEDGEKYYNQLSNEERAKFDEETLVNLNNTEKRSTKIQSDVFSNVYSMFDGKGIKEESKKFEEEKLLNEIGSEYIVITILVAAKGAHKLPNINGTKDLKEALQKLRTLLSSKLLAGKVLWTPQNEDDTLSKRKLLEDYPQLARSMTNFLVKKHE

SEQ ID NO: 145278 - protein, 640 aa, Glycine max
  Coding DNA Sequence Number=SeqID_28500
  Gene Ontology: Mol. function=oxidoreductase activity; Cellular component=integral to membrane; Biological process=hydrogen peroxide catabolic process
  Homolog annotation: Hit_ID=Q5ENY3; Match level="QueryCoverage=78%, HitCoverage=65%, E-value=1e-124, Identity=43%"; Hit description =Respiratory burst oxidase 2
  Pfam annotation: Domain name=FAD_binding_8; Domain location=464-552; Score=72.7; E_value=1.2e-18; Accession=PF08022.2; Description=FAD -binding domain
  Pfam annotation: Domain name=Ferric_reduct; Domain location=265-423; Score=136.5; E_value=7.2e-38; Accession=PF01794.9; Description =Ferric reductase like transmembrane component
  Pfam annotation: Domain name=NADPH_Ox; Domain location=61-164; Score=- 32.3; E_value=0.02; Accession=PF08414.1; Description=Respiratory burst NADPH oxidase
  Pfam annotation: Domain name=NAD_binding_6; Domain location=558-640; Score=-35.6; E_value=0.066; Accession=PF08030.2; Description=Ferric reductase NAD binding domain
  Pfam module annotation: Pfam domain module=FAD_binding_8::Ferric _reduct::NADPH_Ox::NAD_binding_6; Domain location=464-552::265 -423::61-164::558-640
  Subcellular localization annotation: CTP_CleavageSite=41; ConfidenceScore=5.64e-01
MDGLVKSQVPHERSLLALFKSSPSSSSLSSSFSSSWTSEVVLQTRSKIRREGEPNNVADLRSEQTRSHIIENEAIQGVGFINGIDGHSGMEWKDLEKRFDQVARTGSGAEPVVTWSEFGFCIGENSKLKSTVHTILLTASTNKLSVTHDEAEDYASLIMKFLDKKNKGYIEATNLSNSKAHSPMKQVSSVGSSTHNVLHNTSGDFCEEQQEPMSRTEVLFRTYWRRAWIVLVWLLACLGLFVWKFVQYRHRSGFEVMGYCLPTAKGAAETLKLNMALVLLPVCRNTITWLRKHRPINSVVPFNDNINFHKLIAGGIVVGVILHGGTHLACDFPRISESDKSIFRQTIAAGFGYHRPTYTQILATTEVASGIGMVVLMGIAFALAAKWPRRRSPVLPVSLRRVTGYNTFWYSHHLFVLVYALLIIHSMFLFLTDKLMEKTTWMYIAFPVLLYAGERIFRAIRSGSYEVDILKASICPGKVLYLKMQKPEGFKFHSGMHPFSLTSGPQDDYLSVHIRTLGDWSYQIYDLFQEAVLSRSKGCPKLYIDGPYGSAAQDHVKYDILVLIGLGIGATPFISILKDVVKGVQTTQNDHSVVEMHNFLTSVHPEGDIRSALLSVIQALHVAKNGTDIVSRTQVSESSP

SEQ ID NO: 145279 - protein, 510 aa, Glycine max
  Coding DNA Sequence Number=SeqID_28501
  Gene Ontology: Mol. function=heat shock protein binding; Cellular component=intracellular; Biological process=protein folding
  Homolog annotation: Hit_ID=Q9C911; Match level="QueryCoverage=93%, HitCoverage=73%, E-value=1e-123, Identity=50%"; Hit description =Putative heat shock protein; 32627-30541
  Pfam annotation: Domain name=DnaJ; Domain location=10-76; Score =111.9; E_value=1.9e-30; Accession=PF00226.21; Description=DnaJ domain
MASSSAAKRCHYEVLGLPRDCAPDEIRSAYRRLALQRHPDKLVKSGLSQEEATAQFQELQHAYEVLSDPKERAWYDSHRSQILFSDPNTVSNSFVPDLFSFFSNTVYSGYTNTAKGFYKVYSDVFDKIHANEINFARKLGLDSDAVRQAPVMGNLDSPYAQVTAFYSYWLGFCTVMDFCWVDEYDVMAGPNRKSRRIMEEENNKVRRKARREYNDTVRRLGDFVKKRDKRVIDMKVKRSVEEERKKEEERERKRRLEKEKKERAMAYEEPEWAKVDEDVEEVVEEEVEERENEELYCVLCKKKFKSDKQWKNHEQSKKHKERVAEFRGSIGDDEEDLEEEEEGEEGLESAEVGVNDETDNGIGDLEARIKNGLNVEEGETRNGIELNDDDEFIDASRVKEGEEAGVSVSFDEDGNEEEEEEEEEGDIENGVLEAMVAGHKNRKPRASTHKPKTSVAPLPIENENDDELGPMEYNNQKGARKKRRAKKEKGRKNWEESQEAADSGDYEDII

SEQ ID NO: 145280 - protein, 241 aa, Glycine max
  Coding DNA Sequence Number=SeqID_28502
  Homolog annotation: Hit_ID=Q339I7; Match level="QueryCoverage=53%, HitCoverage=82%, E-value=3e-34, Identity=52%"; Hit description=UMUC -like DNA repair family protein, putative
  Subcellular localization annotation: CTP_CleavageSite=61; ConfidenceScore=5.61e-01
MTLPWPSSGMNLYHNSFLSLNPPFQTRIQLPFSANIPFSHPLTSISPHFNSNSLQKPRFPRASANATTNEAVIMPSMAEILDASRAQKLDLQLKTLGPFFRITARSMVTGTELGRAEGLVRFWVGGKILHLDSIKLQRETLDMEKSIFGLGLFIGAVAIRHGYDSGCKTAQLLAINDSDLYHSKLVRFYTRLGFKAVYEVTGSSVGDVGHMLVWGGVGTRMDASVEELMIKWCTRFKAPHK

SEQ ID NO: 145281 - protein, 168 aa, Glycine max
  Coding DNA Sequence Number=SeqID_28503
GVADRAKERESKRGSLGYDGRKRSMMEEQAKEELKLLEAQYPNHHEHLKNELRSFIFQLQTNHHDSEQLPENNNFSTHLAFFDTEESTSLEELRKRSDYDLELGLADRVVIEKIDGSSKLETPKSVVVKHFSSRKNKRKDRVDLVLERAQVQSGRGHNGCIPMEKYSL

SEQ ID NO: 145282 - protein, 725 aa, Glycine max
  Coding DNA Sequence Number=SeqID_28504
  Gene Ontology: Cellular component=ribonucleoprotein complex; Biological process=mRNA metabolic process
  Subcellular localization annotation: CTP_CleavageSite=38; ConfidenceScore=5.55e-01
MGACLSKKKGSSSTATKSASSTAHVAVPELKNNPPSVSGVTVSKPKVETETAPEVKLNKDNSKKVEEKHETVPEPEGHVKKEIFIIKHRKSHDDRERNSNSKSPSFTEESMADKTAPTPSTNMGVVGVRTSSCTKEEVDAILIQCGRLSRSSSGNAAAAASGEHRRRYSGSKRSYDFDHCDNDTVSNDDDSKKANANESNSDLCEEERHQQRPRQRQSPSRRPSSSQERRRRTPSREREQQQRSSSRERRVSRSPGRRSSENTTPSNARNNNCSNTSSRPGKMVSVPATVSSLVMDKSNNNGGGGGGGESGATTGIKRITVKRNVGAASPRSQSPARANGNAASGNKAFNENQQQPSLSRSNSRKAEQSPYKRNPLSEIEPNSLAFPHSTANNSSSKVQNRPKKEFETEANQKTNGSRTALDKGMNVNCKTKVQQEEDVKVQSSITDNVVVKTMVPPGVDNLKPPYTLTRSRSSRQSRDLDLNPEALLNPPQSYASLLLEDIQNFHQKNTPPVSLPACVTKACSILEAVADLNSNAGLNFCGAEDRRSPLAFQCSRNDYNVSLTTHDYGKREPDAEDPVVESMLLFNDDDVMEQSLHKYVTVNRGGLLGGVDMDDQESSGSNSFTVSSGQQRWGVSSSSWEPSSVESKDCWTSRSNYSKEEGQKLGLEGRVASEAGLDAGEAKKKLNSQRRECDHHQHGSGIGHGRLGANKVLHNRPVVTAAAST

SEQ ID NO: 145283 - protein, 347 aa, Glycine max
  Coding DNA Sequence Number=SeqID_28505
  Gene Ontology: Mol. function=oxygen transporter activity; Cellular component=chloroplast thylakoid membrane; Biological process =chloroplast organization and biogenesis
  Homolog annotation: Hit_ID=Q8GT66; Match level="QueryCoverage=91%, HitCoverage=63%, E-value=5e-77, Identity=53%"; Hit description =Chloroplast protein translocon component Tic40
  Subcellular localization annotation: CTP_CleavageSite=62; ConfidenceScore=5.38e-01
MHAGNTVQEKLIVKHFASISSSNTQEATSTGVNPQLSPSSTIGSPLFWIGVGVGLSALFSVVASRLKVNATLLQGIDISWTGSMHQEAEIKPTKKVLQKYAMQQAFKTMMGQMNSQNNQFGNAAFSPGSPFPFPMPTAAGPTAPASSATTQSRAPSASSASQSTITVDIPAAKVEVAPTTNVKDEVEVKNEPKKIAFVDVSPEETVQESPFESFKDDESSSVKEARVPDEVSQNGAPSNQGFGDFPGSQSTKKSVLSVDALEKMMEDPTVQKMKSNLRTADDSSTGICDVQNWGLNYLPEEMRNPTTFKWMLQNPQYRQQLEEMLLPALPLTYEGGNACSYLQTSLF

SEQ ID NO: 145284 - protein, 338 aa, Glycine max
  Coding DNA Sequence Number=SeqID_28506
METGGDNKETGKHDLHQTSQSKEQEHEITNNSHLDDKAHPSSSTPPSQNPSDASESSQNKSSKCETIPTNVESHTPTKSGEDDDVQNSSIIPKHEHGEVAVTEDNQGSSEIQNPPVQVMERPGESGTSPQYVFPSHVFSKSNANSTVEWSTASNESLFSIHMGNMSFSSELVCFKSGELDKSGDVSMHDHQPIINASPPTQQPDAPPAENKFNDISKITYELQLLHEKSSKATEAKAAETMREVIMESSRTTENVGKGDDKASNSCRQSNGSTNSYSFQSSKGRDKSVSSKGAAGEKQNQQKQSEEDETPNAADQAPKSSTNAPNKWLNCFSCFTCCN

SEQ ID NO: 145285 - protein, 308 aa, Glycine max
  Coding DNA Sequence Number=SeqID_28507
  Gene Ontology: Mol. function=nucleic acid binding
  Homolog annotation: Hit_ID=Q9FNR1; Match level="QueryCoverage=49%, HitCoverage=38%, E-value=4e-29, Identity=46%"; Hit description =Similarity to RNA binding protein
  Pfam annotation: Domain name=RRM_1; Domain location=31-103; Score =97.8; E_value=3.4e-26; Accession=PF00076.12; Description=RNA recognition motif. (a.k.a. RRM, R
MAFFGRIGNLLRQTASRQAIRCMSSAPSTKLFIGGVSYSTDEQSLREAFSKYGEVVDARIIMDRETGRSRGFGFITYTSVEEASSAIQALDGQFSVGDDEVVMAHQAHAILSIQFSARYLLHVYLVRIILSNFPVMYGNDLHGRPIRVNYANERPRGYGGGGGGFGSYGAVGGGGYEGGGGSGYRGNVSDGYGGGNYSRNDGGGYGYGAGSYGSGGNYGDSGPGNNYSGGYSGSNSGHFGDAGSVGNHESSTGFAGNGYDGSVVDGGVGAGSEFGSSGQLDSKTSSNGDEGFGDYRDDNDADNFAKRA

SEQ ID NO: 145286 - protein, 612 aa, Glycine max
  Coding DNA Sequence Number=SeqID_28508
  Gene Ontology: Mol. function=nucleic acid binding; Cellular component= nucleus; Biological process=DNA replication
  Homolog annotation: Hit_ID=Q9FME0; Match level="QueryCoverage=98%, HitCoverage=98%, E-value=0.0, Identity=66%"; Hit description =Replication protein A1
  Pfam annotation: Domain name=Rep-A_N; Domain location=5-105; Score =111.3; E_value=2.9e-30; Accession=PF04057.3; Description=Replication factor-A protein 1, N-terminal domain
  Pfam annotation: Domain name=Rep_fac-A_C; Domain location=457-603; Score=207.2; E_value=3.7e-59; Accession=PF08646.1; Description =Replication factor-A C terminal domain
  Pfam annotation: Domain name=tRNA_anti; Domain location=187-277; Score=31.3; E_value=3.4e-06; Accession=PF01336.15; Description=OB -fold nucleic acid binding domain
  Pfam module annotation: Pfam domain module=Rep-A_N::Rep_fac-A_C::tRNA_ anti; Domain location=5-105::457-603::187-277
MAAKTVTPDAVSMLLANTCPDSSSDLPEIVVQVLDLKATGNKYMFTANDGKTKLKAMISSDMCSQVLSGAIQNLGLIRVLDYTVNVIPNKSDKYLIVTKCEPVSPALEIEIKSEESGSGILLKSKVEGGVNTEGPAAAGILLKPKQVVTKSANQILREHGNSAPAARMAMTRRVRPLVSLNPYQGNWTIKVSVTSKGNMRNYKNARGDGCVFNVELTDEDGTQIQATMFNNAARKFYDKFILGRVYYISKGTLKVANKQFKTVQNDYEMTLNENSEVEEVAGEASFVPETKFNFVQIDQLGPHVNKSELVDVIGIVKNVSSTMTIRRKSDNESIPKRDITIADDTKKTVVVSLWNELATTTGQELLDIVDKSPVVAIKSLKVGDFQGKSVVLVNPVIPEAKNLRSWYDFEGKDAAMDSVGSGSSPTSNNGIRSVYTDRVLLSDITSNPSLGDGKPAFFSLRGHISFIKPDQAMWYRACKTCNKKVTESVGSGYLCDGCQKSDEQCSLRYIMVAKVSDASAETYISAFNQEAEKIIGCSADDLDNLKSQEGEVNPYQMTLKEATWAQHLFRVSVTPNEYNGEKRQRITVRAVVPVDFAAESRFLLEDLSKMRA

SEQ ID NO: 145287 - protein, 457 aa, Glycine max
  Coding DNA Sequence Number=SeqID_28509
  Gene Ontology: Mol. function=hydrolase activity; Cellular component =integral to membrane; Biological process=intracellular signaling cascade
  Homolog annotation: Hit_ID=Q9SIK7; Match level="QueryCoverage=98%, HitCoverage=99%, E-value=1e-121, Identity=56%"; Hit description =Presenilin-like protein At2g29900
  Pfam annotation: Domain name=Presenilin; Domain location=8-448; Score= 146.7; E_value=6.3e-41; Accession=PF01080.8; Description=Presenilin
MAQTQTQRPCSSVLDSLGEEIVRIVAPVSICMFLVVILVSILNTDSSLFVASMSMVTIAYNETTSDSTWDKFLGALLNSLAFVVLVTFATFVLVLLFYFRCTRFLKLYMAFSTFIVLLFLGGEVSIFLIQKFSTPIDCITFFLVLCNFAVVGVLTVFISKMAILVTQGYLVVVGILVAYSFTMLPEWTTWALLVAMALYDLAAVLLPIGPLRILVELAISRDEEIPALVYEARPVKHGSLDPREVAQRRLWRERRVQSLNANNSVLAHGPNNAESHSDSGANAGDNWDGANLVRENASLNSNLNADSSGGSYGYGNLVSVEEGWLRVQETDSDLSAPLMDRGMNVQLGRGEDTVSIDNLMLEGIGLASSGSIKLGLGDFIFYSVLVGRAAMYDYMTVYACYLAIIAGLGITLMLLAFYQKALPALPVSVGMGVLFYFLTRLLLEVFVVQCSLNLLLF

SEQ ID NO: 145288 - protein, 195 aa, Glycine max
  Coding DNA Sequence Number=SeqID_28510
MFGSGIRSKGVIKFLQPDPDFVAEFAQGELQTDVIAGKDFVHSELNEDDSDTVVPLSNPDSRDVYRSLRLPSKIARGNYGLWNLSMRVIPLTKDDCEPITEPGAYIDTSYEEIIKIDDFEENSPSSIHISDYKVDSHSHDLHALGVQNCGANDLLTHSTVNEERLSRELSSGEVTMLEGLSSSNYELNDVTGDEN

SEQ ID NO: 145289 - protein, 57 aa, Glycine max
  Coding DNA Sequence Number=SeqID_28511
MKGIHPKWRKNTIEDKWYGYYEIFGDSRSDRQKRKKENAEEKEKGEGILKSKKGLTG

SEQ ID NO: 145290 - protein, 50 aa, Glycine max
  Coding DNA Sequence Number=SeqID_28512
MDHMLEYCSSMACRENVMVLRVKSNLIEDGFQLTSTALPFRGLRDVLLVS

SEQ ID NO: 145291 - protein, 95 aa, Glycine max
  Coding DNA Sequence Number=SeqID_28513
  Gene Ontology: Mol. function=oxidoreductase activity, acting on single donors with incorporation of molecular oxygen, incorporation of two atoms of oxygen
  Homolog annotation: Hit_ID=Q9FT14; Match level="QueryCoverage=83%, HitCoverage=30%, E-value=4e-26, Identity=67%"; Hit description =Naringenin 3-dioxygenase like protein
MGLSTNRKFFWHQIITNGKYRSCEHRAITNPDRARLSVATFHDPAKTVKISPASELINDSSLAKYRDVVYGDYVSSWYTKGPGGKRNIDALLLDP

SEQ ID NO: 145292 - protein, 394 aa, Glycine max
  Coding DNA Sequence Number=SeqID_28514
  Gene Ontology: Mol. function=glycerophosphodiester phosphodiesterase activity; Cellular component=periplasmic space; Biological process =glycerol metabolic process
  Homolog annotation: Hit_ID=Q6AUZ6; Match level="QueryCoverage=90%, HitCoverage=84%, E-value=1e-141, Identity=73%"; Hit description =Putative phosphodiesterase family
  Pfam annotation: Domain name=GDPD; Domain location=65-363; Score =201.5; E_value=2e-57; Accession=PF03009.8; Description =Glycerophosphoryl diester phosphodiesterase family
MQGLCIHFPAKVVMGVGSPYKLFALITLLIAVQTESFLKKRVLHTWQNVDDMMNIIVIFGLCFLKNESFLQRAIEEGADFIETDVLSSKDGVLICFHDVTLDDTTDIANHTGFANRKRTYEVQGINMTGFFPVDFTLKELKSLRVKQRYSFRDQQFNGKFQIITFEEFITIAQDAPRVVGIYPEIKNPVFINQQVKWSHGKRFEDKFVETLQKYGYKGSYLSKDWLRQPVFIQSFAPTSLVYISNKTDLPKIFLIDDVIVPTQDTNQSFWEITSDEYLDYIKQYVVGIGPWKDTVVPVVENYMTNPTNLVARAHAHNLQVHPYTYRNEFPFLHFNFSQDPYMEYDYWINKIGVDGLFTDFTGSLHRYQEWTSNHKDDDDKNLLHKIALLVSSYE

SEQ ID NO: 145293 - protein, 210 aa, Glycine max
  Coding DNA Sequence Number=SeqID_28515
  Homolog annotation: Hit_ID=Q1SIK1; Match level="QueryCoverage=81%, HitCoverage=48%, E-value=4e-12, Identity=32%"; Hit description =Cyclin-like F-box
MSWKRKTSICGQIVHSNIHSLQEGKIQLNEKIIKISVTKQTPQTNTAPEKIKLLFLPALEPTIEKAQSFERNEIKGCWGLGGYVCKLEGGEGLTDRELRKLLYDAFSEDAENLDAGGDGGCEGNIVNDGIYNMPIIIEFIVAREVEGVDVGGSVSEGEEVVDERVEKERVVELEDWEGSPKVNESLTQNARLNRRNCVQKVKYAVDDVVR

SEQ ID NO: 145294 - protein, 47 aa, Glycine max
  Coding DNA Sequence Number=SeqID_28516
MNKTCAMGYGYSVLFRFYLIIKKLLRAAGLFAGSILLMRNYGDLMAI

SEQ ID NO: 145295 - protein, 531 aa, Glycine max
  Coding DNA Sequence Number=SeqID_28517
  Gene Ontology: Mol. function=pepsin A activity; Cellular component =cellulose and pectin-containing cell wall; Biological process =proteolysis
  Homolog annotation: Hit_ID=Q9SJG1; Match level="QueryCoverage=99%, HitCoverage=98%, E-value=1e-134, Identity=47%"; Hit description =Putative chloroplast nucleoid DNA binding protein
  Pfam annotation: Domain name=Asp; Domain location=169-531; Score= -117.0; E_value=1.1e-06; Accession=PF00026.14; Description=Eukaryotic aspartyl protease
MLMKVSLILVLLSIFCVTFKPYTEVDVQNDHNNDPTLANKEFCKKAKSSESTRLNKEEDGDDAISAKPHKRSAKFHLKRRPINHGNEPKTHALDSALRDLVRIQTLHRKVIEKKDTKSMSWKQEVKVITIQQQNNLANAVVASLKSSKDEFSGNIMATLESGASLGTGEYFIDMFVGTPPKHVWLILDTGSDLSWIQCDPCYDCFEQNGPHYNPNESSSYRNISCYDPRCQLVSSPDPLQHCKTENQTCPYFYDYADGSNTTGDFALETFTVNLTWPNGKEKFKHVVDVMFGCGHWNKGFFHGAGGLLGLGRGPLSFPSQLQSIYGHSFSYCLTDLFSNTSVSSKLIFGEDKELLNHHNLNFTKLLAGEETPDDTFYYLQIKSIVVGGEVLDIPEKTWHWSSEGVGGTIIDSGSTLTFFPDSAYDVIKEAFEKKIKLQQIAADDFIMSPCYNVSGAMQVELPDYGIHFADGAVWNFPAENYFYQYEPDEVICLAILKTPNHSHLTIIGNLLQQNFHILYDVKRSRLGYSPR

SEQ ID NO: 145296 - protein, 234 aa, Glycine max
  Coding DNA Sequence Number=SeqID_28518
  Homolog annotation: Hit_ID=Q9SFV5; Match level="QueryCoverage=22%, HitCoverage=6%, E-value=8e-08, Identity=46%"; Hit description =Putative RNA-binding protein
  Pfam annotation: Domain name=DUF1675; Domain location=28-214; Score= -59.2; E_value=0.0015; Accession=PF07897.2; Description=Protein of unknown function (DUF1675)
MASPFSSWISMEEGFYSKKPYTYTNSEHIDLTLKLSPCGQNAEEEEEEEEEEEEKMVEKGLVRFGDLQTMRRVKTWKRLLMKKMRMAAAKEAEKSLPVSPGGGAQTLPHSIYNSLKTFANPCGDAWHEGAMQEMTLWPSETMIENERPAKKLKHVNSYQESDAMPSVITTGDGTITGKRTVCIVCVCHGSFPSPTEFVMHAGGKEVADPMKHITVCSDSFGINGDGAAFITHPF

SEQ ID NO: 145297 - protein, 169 aa, Glycine max
  Coding DNA Sequence Number=SeqID_28519
MAKSASNSLMQSLKRFIKKPWEITGPCADPEYKSALPLAVEYRLSCPATVKEKPIIPNSLPETVYDIKYFTRDQRRNRPPIRRTVLKKPDVEKLMKEQTFAVSDFPPVYLNSAVEEDINARGGGYQLTFGGKVLNIGRGRIRIPVSLRLLILRTNAITVALRSGTVKKP

SEQ ID NO: 145298 - protein, 337 aa, Glycine max
  Coding DNA Sequence Number=SeqID_28520
  Homolog annotation: Hit_ID=Q9FJV7; Match level="QueryCoverage=61%, HitCoverage=69%, E-value=2e-33, Identity=37%"; Hit description =Arabidopsis thaliana genomic DNA, chromosome 5, P1 clone:MFO20
  Pfam annotation: Domain name=DUF607; Domain location=137-319; Score =309.2; E_value=7.6e-90; Accession=PF04678.4; Description=Protein of unknown function, DUF607
MWGRWCWCAGGGFLRQRVSSIGSVTSIGSFSHGYGEKLHPLDPPLLGLRGVVEVMCGGRRGGGGGAPLSVVLNQIKRGVSTSTGDGDVSNGNNGTTEDSISFSEAKKLMRLVNVESLKMKLGMEGKEVICYSELLEACESMGIARSPEEAAAFARVLDEAGVVLLFRDKVYLHPDKVVDLVRRAVPLALTADNDPMREELKKLQDKKEEIDVLAHKQVRRILWSGLGFGVITVGFFFRLTFWEFSWDVMEPIAFFTTTTGLVIGYAYFLFTSRDPTYQDFMKRLFLSRQRKLFKRQNFDIERFKELQCKCKTPLHASTVLKNRIGVELDLEDALHRD

SEQ ID NO: 145299 - protein, 496 aa, Glycine max
  Coding DNA Sequence Number=SeqID_28521
  Gene Ontology: Mol. function=nucleic acid binding; Cellular component= intracellular; Biological process=transport
  Homolog annotation: Hit_ID=Q9FME2; Match level="QueryCoverage=87%, HitCoverage=81%, E-value=3e-94, Identity=49%"; Hit description =Similarity to RNA-binding protein
  Pfam annotation: Domain name=NTF2; Domain location=17-133; Score =172.3; E_value=1.2e-48; Accession=PF02136.11; Description=Nuclear transport factor 2 (NTF2) domain
  Pfam annotation: Domain name=RRM_1; Domain location=304-371; Score =37.9; E_value=3.4e-08; Accession=PF00076.12; Description=RNA recognition motif. (a.k.a. RRM, R
  Pfam module annotation: Pfam domain module=NTF2::RRM_1; Domain location=17-133::304-371
MAMPETIPPTTPSAQVVGNAFVEQYYHILHQSPELVHRFYQDSSFLTRSDSNGVMTTVTTVQEIHEKIISLKYEDYTAEIKTADAQESHKGGVIVLVTGCLTGKDNVRRKFSQTFFLAPQEKGYYVLNDVFRFIEENDTPQINSSSVSVINENAEAVHEPESEDLHAPKHLVEDNATLAEGENLNNGAEVYHPQDEEEGSVIDEEVAEPPTDLSQNDIVTVDDSTSAVLDDAPRRSYAAIVMKSHVASGHVYVPSRAARIASAKSSEQWPTTAKSTPVPEALAPSSDSAPGSSDVHEEAEGHSIYIRNLPFNATVEQLEEVFKKFGPIKHGGIQVRSSKHGFCFGFVEFEELSSMHSALEWYRLALACSNVACISQGSASDWSSSGAGMFRKRICSASFAHKKLCLLLNWKASPITVGERQAVVEEKRTTTRAVVGEGGTQEEVVSEATVSEHVGNLVVDGVMAEMNSETKENSQGNLGVLNGQIKMEVDGAVDVK

SEQ ID NO: 145300 - protein, 829 aa, Glycine max
  Coding DNA Sequence Number=SeqID_28522
  Gene Ontology: Mol. function=RNA binding; Biological process=RNA processing
  Homolog annotation: Hit_ID=Q3LHL4; Match level="QueryCoverage=68%, HitCoverage=81%, E-value=1e-146, Identity=52%"; Hit description=Pre -mRNA splicing factor
  Pfam annotation: Domain name=DUF618; Domain location=460-533; Score =3.1; E_value=0.0033; Accession=PF04818.4; Description=Protein of unknown function, DUF618
  Pfam annotation: Domain name=Extensin_2; Domain location=132-446; Score=-120.8; E_value=0.013; Accession=PF04554.4; Description =Extensin-like region
  Pfam annotation: Domain name=Surp; Domain location=268-311; Score =57.8; E_value=3.6e-14; Accession=PF01805.10; Description=Surp module
  Pfam module annotation: Pfam domain module=DUF618::Extensin_2::Surp; Domain location=460-533::132-446::268-311
MYEYIYIQHQRVTRRRVFSDRHVTDPCNIPKKLKKGSLTNNPQLPLPFSHSCVPSPPVAIASALRTAVADVVRTSHQPRPPSFSHPAKNFHAGLSWKCKQASQNPSRLLSSFVSYISAAEVMERQGHDYAAASAMAYAQQQRQAANMQQQQQFGFHPQHQQFPSSMHGPPFIPSGPGPGPGPAPPPMQQFPYHPALQQQQQQQQQPLPQLHPHAPPPPHLLLQQQQHQGPPTFPSHYPPPLVPSPFYDSAPAPPPVAPPSDPELHKRIDKLVEYAVKNGPDFEAMICEKQRDNPSYSFLFGGEGHGYYRYKLWLSTRPPGGPFNPSFPSSSMPMMHPPNPMMNLSPLNASPMNPAGIGSSPSMLGPPHFQQFYDQQHHHQHPQSFGLPGRPEYDPSSKSFKGVFGPLPSDVAMELSNVLNNLNGTKESIKGAKLWFMQRSPFAPALAEALRDRVFALDEVERQLHIIYLANDILFDSLNRRTSSNDLDNEALAFKPVLGSMLARIYHNPQSNEEYRKRMQQMVEFWSSKKVYDQETISLLKGEMIGGPQSTSFPGASKDLSSASAESGSGILQTPNHVAQQWQTDRLGAGSSALDQDRLDKLAASAQSLSVPLAAQQFLPSSAPPGAFPGSMAIPSSVQSANQAPGAHLLPPPSSNTSEQLPPYPLFPPGLIPGMVKKMQIGSGVPYSPLSPLDIPTIIPPSTVPPSEILQRVSNFFKEIGEVNPSEGPMNSDSRDDDEYDREYEREPPVRKGGACIPPPPTLQVDPETGTYADGTVERKPGSSGSGRLGLGATANPNEVSQYDDVYTSYRKQRSTNYHSSMSARAATR

SEQ ID NO: 145301 - protein, 1101 aa, Glycine max
  Coding DNA Sequence Number=SeqID_28523
  Gene Ontology: Cellular component=cytosol
  Homolog annotation: Hit_ID=Q10JI7; Match level="QueryCoverage=93%, HitCoverage=97%, E-value=1e-46, Identity=23%"; Hit description =Expressed protein
MWRPAPLTCSCLMNRVLELTSECKGRERSFLYIFKHNLDEKLSLIGEEEVDMAAKLLHSLADDNPDLQKQIGCMTGVFQLFDRHHIIPPRHITQKMLPPGNSHSNYDNLERGSNRIHQRQSAADIRGVSEKQRISTESSRTSFSSSCSSSMSSLEYKAQAGAPFNRNGYPKSPMREPVMNQTSSSPDLRCQSLDLRDVAKDSMYREARGLSKEKDSPTHFQLSKSIKGKQTPIHLRESLRVLAKLREAPRHYVEAKELPRLSYEVKGHWHSISKDAPRFSYDGRETSGTSFESHDSFKCPPKLKELARHSLDSREGSWRAYGSDSKSSNPSRNFNAGDASTSVDNVSSRQQPSASQSRPPSVVAKLMGLEALPESYNASDTNFSLSETGSAQGNDQFLKNGLVKPLRVHNSPKISLKDTTSPRWKNPDLAVKPILSSRFPIEPAPWKQQDGNQSSEKLTSRAIKATARSPDSFPSVYCEIEKRLKDLEFKQSGRDLRALKRILEAMQVKGLLETREEEQALNVGNKRDYELNPSLIQHSISVRQQTARETESVKAIESPIVIMKPGKLIEKSGISASSVFPIGELSDSHKLRSGGVHAHDKRGTASNQIAKDQSLRNSHWNAPTSFSEKKENSIRTIKSAQSQPRSKQLPKENSPSSVKNSGSVSLRMQQKKLESEKQSNLPTPPSDSNNPRRQSFKQPTESGSPSQKLRPKVASSRYCDDRLSETSNELRSLSSQWDEISLQSDSITVDSKMDTEVTSSLQSAEIIESQCSSMKPIEHLVSGSMHKKSTLRWNEDESIAEPATYASDHPSLDSVDDVSVYKYDMPSPVKSKSNAPKADNAQENKANDNTDQWNPADGFFVNNTINCKKLQSIDCLIQKLRQLNSSHDETRNDYIASLCENTNPDHRYIAEILLTSGLLLRALSSELLTFQHHSSGHPINPELFLVLEQTKLSSLLSKDKSRFGKAAYMKLNTEKWQRKLIFDAVNEILGEKLGSFLEPCLKPNELVAMKFVSAQKLLKELCFEVQKLQYVKPDCSLEDEGDELKSMLREDVMCHSENWTGFSVQLPGVVLDAERQIFKDLIDELVIDEMASLQVKSGRHR

SEQ ID NO: 145302 - protein, 47 aa, Glycine max
  Coding DNA Sequence Number=SeqID_28524
MVVSKIVDSGQSQGYTCFLRGNVGNLMKSAKDYQSVMTEEEIVDMEW

SEQ ID NO: 145303 - protein, 428 aa, Glycine max
  Coding DNA Sequence Number=SeqID_28525
  Gene Ontology: Mol. function=protein binding; Cellular component =membrane; Biological process=vesicle docking during exocytosis
  Homolog annotation: Hit_ID=Q94D04; Match level="QueryCoverage=75%, HitCoverage=49%, E-value=2e-37, Identity=32%"; Hit description =Putative p40
  Pfam annotation: Domain name=Kelch_1; Domain location=128-179; Score =28.0; E_value=3.3e-05; Accession=PF01344.15; Description=Kelch motif
  Pfam annotation: Domain name=Kelch_1; Domain location=184-230; Score =38.5; E_value=2.2e-08; Accession=PF01344.15; Description=Kelch motif
  Pfam annotation: Domain name=Kelch_1; Domain location=235-281; Score =38.9; E_value=1.7e-08; Accession=PF01344.15; Description=Kelch motif
  Pfam annotation: Domain name=Kelch_1; Domain location=27-73; Score =20.0; E_value=0.0085; Accession=PF01344.15; Description=Kelch motif
  Pfam annotation: Domain name=Kelch_1; Domain location=78-123; Score =28.5; E_value=2.4e-05; Accession=PF01344.15; Description=Kelch motif
  Pfam annotation: Domain name=Kelch_2; Domain location=128-179; Score =38.0; E_value=3.3e-08; Accession=PF07646.5; Description=Kelch motif
  Pfam annotation: Domain name=Kelch_2; Domain location=184-230; Score =37.7; E_value=4.1e-08; Accession=PF07646.5; Description=Kelch motif
  Pfam annotation: Domain name=Kelch_2; Domain location=235-281; Score =20.6; E_value=0.0058; Accession=PF07646.5; Description=Kelch motif
  Pfam annotation: Domain name=Kelch_2; Domain location=27-73; Score =19.3; E_value=0.014; Accession=PF07646.5; Description=Kelch motif
  Pfam annotation: Domain name=Kelch_2; Domain location=78-123; Score =18.6; E_value=0.023; Accession=PF07646.5; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch_2; Domain location=128-179::184-230::235-281::27-73::78-123::128 -179::184-230::235-281::27-73::78-123
MRWEKVEVKAIGTTTEGGGGGGPGKRWGHTCNAVKGGRLVYVFGGYGKDNCQTNQVHVFDTVKQTWSQPALKGSPPTPRDSHTSTAVGDNLFVFGGTDGMNPLKDLHILDTSLQTWVSPTIRGEGPPAREGHSAAVVGKRLFIFGGCGKSADNNNELYYNDLYILNAETFVWKCATTSGTPPSPRDSHSCSSWRNKIIVIGGEDGHDYYLSDVHILDTDTLIWRELSTSGQLLPPRAGHSTVSFGKNLFVFGGFTDAQNLYNDLYMLDIDTGVWTNVTTATNGPSARFSVAGDCLDPFRSGVLIFIGGCNKSLEALDDMYYLYTGIARESEQRPEKLSLKKQLKLKCLEQNPNPSQNQVLVRYGVGSDVGQTMKVLNYSQQSLALATSMYQILDMECSYGKSVMTKIMIPLKVLILIIYDPGGQKELK

SEQ ID NO: 145304 - protein, 129 aa, Glycine max
  Coding DNA Sequence Number=SeqID_28526
  Gene Ontology: Cellular component=integral to membrane; Biological process=electron transport
  Homolog annotation: Hit_ID=Q9C540; Match level="QueryCoverage=87%, HitCoverage=50%, E-value=8e-29, Identity=56%"; Hit description =Cytochrome b-561, putative
MVLTEMPNILNDVSILDLVSVQWLIGFLNFWHRGEVRSVRIRILPWHVFLGLYTYALAIATAETGLLEKLTFLQTKRNVPKHSTESMVVNSLGLGLALVGGFVILAAVSPKYQTHQSKLWYSETKCLSS

SEQ ID NO: 145305 - protein, 116 aa, Glycine max
  Coding DNA Sequence Number=SeqID_28527
  Gene Ontology: Cellular component=integral to membrane; Biological process=electron transport
  Homolog annotation: Hit_ID=Q9C540; Match level="QueryCoverage=48%, HitCoverage=24%, E-value=1e-17, Identity=73%"; Hit description =Cytochrome b-561, putative
  Subcellular localization annotation: CTP_CleavageSite=61; ConfidenceScore=5.13e-01
MKKQIPGLQRGIHKPNPSMNVGYRNLPQSHLCPGILSKSQRSQKLKPPLEATNAPISLTPLIQMRSCWESEVVRKLDLKARAHMRTSTATASPKTLAKKRRESRREGETLVSITIH

SEQ ID NO: 145306 - protein, 392 aa, Glycine max
  Coding DNA Sequence Number=SeqID_28528
  Gene Ontology: Mol. function=ATPase activity, coupled to transmembrane movement of substances; Cellular component=integral to membrane; Biological process=transport
  Homolog annotation: Hit_ID=Q8LKU6; Match level="QueryCoverage=92%, HitCoverage=53%, E-value=1e-110, Identity=60%"; Hit description =Putative ABC-transporter-like protein
  Pfam annotation: Domain name=ABC_membrane; Domain location=60-349; Score=199.9; E_value=5.9e-57; Accession=PF00664.13; Description=ABC transporter transmembrane region
MNGLRSERAPLLEAERAGRGKRDGASEGQASDLEHGDAVPAANVGFCRVLSLAKPEAGKLVIGTVALLIAATSSILVQKFGGKIIDIVSREMKTPEEKDEALNAVKNTILEIFLVVVFGSICTALRAWLFYTASERVVARLRKNLFSHLVNQACTLSMMSFQEIAFFDVTRTGELLSRLSEDTQIIKNAATTNLSEALRNFSTALIGLSFMFATSWKLTLLALAVVPVLSVAVRKFGRYLRELSHKTQAAAAVASSIAEESFGAIRTVRSFAQEDYEVTRYSEKVNETLNLGLKQAKIVGLFSGGLNAASTLSVIIVVIYGANLTIKGSMSSGDLTSFILYSLSVGSSISGLSGLYTVVMKAAGASRRHCFTPIHIVYDVQTKESSFWNLVL

SEQ ID NO: 145307 - protein, 143 aa, Glycine max
  Coding DNA Sequence Number=SeqID_28529
MQSWIDELRFSLPILRWCNHRMMEEANLRDKHRPWVVRNLLRERMMKLKHEGGNHLLPKFVIEPKEEIELFNIARETFELMNDINGCFKFSASESKVGKDFVRHCTSVSNDKKINKEIAVKAWLLVNQEGYTVRPSNGKDTIL

SEQ ID NO: 145308 - protein, 471 aa, Glycine max
  Coding DNA Sequence Number=SeqID_28530
  Gene Ontology: Mol. function=GPI anchor binding; Cellular component =anchored to membrane; Biological process=root hair cell differentiation
  Homolog annotation: Hit_ID=Q94KT8; Match level="QueryCoverage=88%, HitCoverage=92%, E-value=0.0, Identity=77%"; Hit description=Protein COBRA precursor
  Pfam annotation: Domain name=Phytochel_synth; Domain location=78-242; Score=370.2; E_value=3.3e-108; Accession=PF04833.5; Description =Phytochelatin synthetase-like conserv
  Subcellular localization annotation: CTP_CleavageSite=28; ConfidenceScore=5.04e-01
MVSLWLSTAGSVVHRGDFFTILLLPLLLCTTFTSTVCSLRITSSTFHGCSYTEAYDALDPIGNITIKWDVISWTPDGYIAVVTMYNFQQYRHIQAPGWILGWTWAKKEVIWNVMGGQTTEQGDCSRFKGNIPHCCKKDPTVVDLLPGTPYNQQIANCCSGGVLTSWAQDPENAISSFQLSVGSAGTTNKTVKLPKNFTLKAPGPGYTCGPAKIVKPTKFITKDKRRTTQALMTWNVTCTYSQFLAQKTPTCCVSLSSFYNNTVVNCPTCTCGCQNKTEPGSCVDPNSPHLASVVSPPGKATNTPLVRCTNHMCPIRVHWHVKLQYKEYWRVKITITNFNYRMNYSQWNLVVQHPNFDNVTQVFSFNFKPLTPYVGLNDTGMLWGVKFYNDLLTSAGPLGNVQSEVLFRKDKSSFTFDKGWAFPRRIYFNGDNCVMPPPDAYPWLPNASSKLIFSLLSTLLGTLACVAMLLT

SEQ ID NO: 145309 - protein, 331 aa, Glycine max
  Coding DNA Sequence Number=SeqID_28531
MLTSSFIRPEMLPSGVMCSEKYGMSDFWRPIKAEHGTGFRNLSSMAATNGHPLPRSLFSSYNGKQFPFLHENSSTSTTGSIFCESNSHYPSALGAQNSGLRPLFQDTVGNEDFSVFDTSPNVQGLSGISDSCCALSLLSSQSQNSSSQSSGIPLAHSLVIPSSHSHHYNMSQVSDKIGISSQTSSSRVSDSFPPELNHADGSHLSPVLISGNNDIINFDMADGIFQGSDYLNVKDRLSDEDGATIDLLQLSSQLQRVEHERQSLQTRLRWHFAAGHGDKVKERDIVANFPFVKKLVVKHVKDTPMPIILRQCRPQGNRNFKWCHSVANYLH

SEQ ID NO: 145310 - protein, 205 aa, Glycine max
  Coding DNA Sequence Number=SeqID_28532
  Gene Ontology: Mol. function=DNA binding; Cellular component=nucleus; Biological process=regulation of transcription, DNA-dependent
  Homolog annotation: Hit_ID=Q94JW8; Match level="QueryCoverage=41%, HitCoverage=19%, E-value=3e-18, Identity=56%"; Hit description =Squamosa promoter-binding-like protein 6
  Pfam annotation: Domain name=SBP; Domain location=166-205; Score =17.1; E_value=0.00026; Accession=PF03110.5; Description=SBP domain
MESWSYIPEEKECVSNEAPSPPNTLGRSKNSFLGWELKTPCGFSTDMLGLGHHSIENQGFEELGFPEMLGKHMSDDLVASVPTRKVDGNRQQQQHHSDRITGTVVDAPSGFSQRGDSNSLIDLKLGRFAEHGDFTDPAFSKVLSSSESSTPPKRVRTSGLHSQTAYCQVYGCNKDLSSCKDYHKRHKVCEVHSKTAIVIVNGIEQ

SEQ ID NO: 145311 - protein, 159 aa, Glycine max
  Coding DNA Sequence Number=SeqID_28533
MAVLVVEFQQKLAQMAQEMMLTIPEPLQHPYEVLVKAELKKLYLVQAAIIDLGLGEKGKLEPEIACGLLEMGGTIAFISGPEMVSDGKLAANIAAEVETLGALFVTDTGKFSEASVAEGTGDKAEDAGDRADGAGGKADGAGGKAEGAGGKLDGGKEAD

SEQ ID NO: 145312 - protein, 321 aa, Glycine max
  Coding DNA Sequence Number=SeqID_28534
  Gene Ontology: Mol. function=oxidoreductase activity; Biological process=electron transport
  Homolog annotation: Hit_ID=Q6YW66; Match level="QueryCoverage=97%, HitCoverage=97%, E-value=1e-121, Identity=66%"; Hit description =Putative Signal peptidase I
  Pfam annotation: Domain name=TauD; Domain location=20-318; Score= -36.2; E_value=0.00013; Accession=PF02668.6; Description=Taurine catabolism dioxygenase TauD, TfdA family
MEFSCKDFKVGKCEGEKVVDGETMPLVLQPPVPNKSDLESLLLALKNNKEWFEQMIIKNSAVLLRGFDVKNAEDFNEIVETFEWEDIRYVGPAPRTHIHKRVWTANEGPLSEFIYYHHEMVLIKEYPKKVILFCEIPPPEGGETPFVPSFKVTEKMMEEFPEEVKEIEEKGLKYTFTAPSANNVSSMRGRGWEDTFGTSDRKEAEKRAKALGMDVEWLPNGGIKTILGPRCLTKVFEGRKGRKMWFNTVVGMHGKEISSAIMADGTEIPEHVVKRCEEIIEEESIQFKWEKGDVLFFDNYALLHGRRPSLPPRKVLVATCK

SEQ ID NO: 145313 - protein, 49 aa, Glycine max
  Coding DNA Sequence Number=SeqID_28535
MEESKMQTGFQRKRQQRSQMQKGTPARKASVTVTTLSAFYNKMKGQNNL

SEQ ID NO: 145314 - protein, 68 aa, Glycine max
  Coding DNA Sequence Number=SeqID_28536
MEENKTNKWKLKRVRERESLGIVEDGSLKCEENIVAWHGRWKMEVEEVGIESCYFWRKTMRVDSFPPC

SEQ ID NO: 145315 - protein, 66 aa, Glycine max
  Coding DNA Sequence Number=SeqID_28537
  Homolog annotation: Hit_ID=Q651K5; Match level="QueryCoverage=50%, HitCoverage=4%, E-value=8e-10, Identity=91%"; Hit description =AlphaSNBP(B)-like
MASESASRSSSAADSYIGSLISLTSKSEIRYEGILYNINTEESSIGLRNDWVCLRDVNSCHREGIL

SEQ ID NO: 145316 - protein, 134 aa, Glycine max
  Coding DNA Sequence Number=SeqID_28538
  Gene Ontology: Mol. function=ribonuclease H activity; Biological process=DNA integration
  Homolog annotation: Hit_ID=Q1S8I9; Match level="QueryCoverage=59%, HitCoverage=16%, E-value=1e-21, Identity=57%"; Hit description =Probable integrase-common tobacco
MAEYEACALGIQAAIDFDYIENKEYPPGIFDNEKRTLRRLATGFFVSGTILYKRNHDMTLMRCVDAKEANYMIEGIHGGSLGTHANGHAMARKILRAGVVGDGLRPMLHPEAMGHATLPPLSCYSCLNMRPPNA

SEQ ID NO: 145317 - protein, 119 aa, Glycine max
  Coding DNA Sequence Number=SeqID_28539
MDNEEGVQEQMKADLSALKDQNGFYHGGLPPDFNPGTAPEDLSQAPTFEGQLPPHAGYPLQEDDEGDAHLGPLLPLKDPAPHELPQPNIVCPIPSPSAPVKELVPLAKDKGKIDLLKRG

SEQ ID NO: 145318 - protein, 229 aa, Glycine max
  Coding DNA Sequence Number=SeqID_28540
  Gene Ontology: Mol. function=electron carrier activity; Biological process=electron transport
  Homolog annotation: Hit_ID=UPI00005F72E0; Match level="QueryCoverage =99%, HitCoverage=36%, E-value=2e-86, Identity=67%"; Hit description =COG3519: Uncharacterized protein conserved in bacteria
RLPAHARRPVAHLAALLAVEGEFGKAIQRHQPAAHAFQHAAEQPRAGTGKRLFVDLQRDADAARKHHRARFRHPAIDRAKLAVANTVNLARHRRFGEISVKAQQLAQRGGALTVAAVHQAQVVHLQVADQTPRGEPFGQRRTRWRRAFTQLQLTDRDRIRHDEIALLLLQQHQRQIAAGAEHVCRQVAHVVAPRRVMLIHQRQKHFRADIAGARAVTLRLLRQRTLLAA

SEQ ID NO: 145319 - protein, 72 aa, Glycine max
  Coding DNA Sequence Number=SeqID_28541
MKFGGAVPFLIPMKKGIINCGNIKVEDNYRRGGGHNPLFEDSHSESGSEAATVRYGLISNDTHEARCKCKAV

SEQ ID NO: 145320 - protein, 67 aa, Glycine max
  Coding DNA Sequence Number=SeqID_28542
MKFGGAVPFLIPMTMCIINCGNIKVEGGGHNPLFEDLPSECGSGAATVRYGLISNDTHEARYKCKAV

SEQ ID NO: 145321 - protein, 75 aa, Glycine max
  Coding DNA Sequence Number=SeqID_28543
MYNYHVKGRAPDLESVLADFMTYQASSKDYQWESEWQPYFHNEAVGLSNLDDLLMAFKGTIDSMQQAFKRAETQI

SEQ ID NO: 145322 - protein, 166 aa, Glycine max
  Coding DNA Sequence Number=SeqID_28544
  Gene Ontology: Mol. function=hydrolase activity; Biological process =intracellular signaling cascade
  Homolog annotation: Hit_ID=Q69L69; Match level="QueryCoverage=88%, HitCoverage=20%, E-value=2e-11, Identity=27%"; Hit description =Calcineurin-like phosphoesterase-like protein
MWAWERCTTLAPKRTPPVLENKPLEHRWLRRGNQHIGNDYLIVFRRKLDIMKQHEFLWEPYTATVMSMLPPICLIGSVAWCAVVPLICFHVVEWYQPDRVLRQFRMQQPIPESPSQPQNIHGLTLKGKQGENWFQLLALMISQWNNRADFRGEVAETLQYMVSPQG

SEQ ID NO: 145323 - protein, 253 aa, Glycine max
  Coding DNA Sequence Number=SeqID_28545
  Gene Ontology: Cellular component=integral to membrane; Biological process=vesicle-mediated transport
  Homolog annotation: Hit_ID=Q1S712; Match level="QueryCoverage=76%, HitCoverage=87%, E-value=2e-55, Identity=56%"; Hit description =Longin-like
  Pfam annotation: Domain name=Synaptobrevin; Domain location=127-215; Score=72.2; E_value=1.7e-18; Accession=PF00957.11; Description =Synaptobrevin
MGILYGMVARGQVVLAEFSATQSNASVVAKQILSKINQGSDNNNDSNVSFSHDRYVFHVKRTDGLTVLCMADDAFGRIAPFAFLEDIHKKFVKTYARAILSAPAYAMNDEFSRVLNQQMEYYSNDPNADRLNRLKVNFKVRTVMIDNIDKVLERGGRLELLVEKTSAMNSNSIRFKRQSRRYKNNLWWSNVRLTGISSCALLMKPVYTQFIEILGFETFHSFLQLLNCTIKVWGVDIGPYPIADGLYHFLKLR

SEQ ID NO: 145324 - protein, 96 aa, Glycine max
  Coding DNA Sequence Number=SeqID_28546
MELDLEWFGSVDFACGMKKIWGRISKSKQLPRKEIQASEHKDGILGNECQSAVASTLSMPPKTCKGSIHHTQVEIPNSETGNPKHVTVKGFLNHGI

SEQ ID NO: 145325 - protein, 102 aa, Glycine max
  Coding DNA Sequence Number=SeqID_28547
KYCMPRQAQGDALQAADALPPPRQADLAGSFGMEHLSLQSQGFAPFACPTPDQFRAEVAWPGDWSEAQAGEAPTEAPGDADEARMDEEMTDLLDFLGGSGAT

SEQ ID NO: 145326 - protein, 110 aa, Glycine max
  Coding DNA Sequence Number=SeqID_28548
GGVVLAEVLLAESRFTRPDMGFHPTKLNFVPSDADEAPLDVSICLHAFGIVGCDPFHPGLFVGDAGGFQSPTREPLNVGGLVPPHCSLKSVVSDDACPGACFVQRDATTL

SEQ ID NO: 145327 - protein, 77 aa, Glycine max
  Coding DNA Sequence Number=SeqID_28549
MQKKAKMQEIEYEREDARNALRIMGKWLGLVLQPTFGGRATRGSRVRLPWEENARSRHQRLFEENVGKTGKGVVYKL

SEQ ID NO: 145328 - protein, 98 aa, Glycine max
  Coding DNA Sequence Number=SeqID_28550
MNSLPSAVHVSSVIKRGASGDWEICFSVIFRIGSFAKHKKKEGVETRVVITERAGRMKSVSYLCFPLISDERSFLQKAVASGGSNLARLGELSSPGRV

SEQ ID NO: 145329 - protein, 88 aa, Glycine max
  Coding DNA Sequence Number=SeqID_28551
IAPTRRPVGPKKSNRALGFPALESLSQRHPVDPEKSNRALGFLALVMGLYSPTGCPFPPARSRHHRDRACKTPSGPEEVQQGLGVVKL

SEQ ID NO: 145330 - protein, 182 aa, Glycine max
  Coding DNA Sequence Number=SeqID_28552
  Homolog annotation: Hit_ID=Q9LJK0; Match level="QueryCoverage=82%, HitCoverage=96%, E-value=4e-08, Identity=35%"; Hit description =Arabidopsis thaliana genomic DNA, chromosome 3, P1 clone: MZN14
MSKSCGFGMTGPLDESISCFLIGGTLGTSYPHRERTTRPRLRGLHVLTIRGLHALTSRGLHVLALRGLHALTLGTCYPHRQRTTRPHHQRAARPYLQRTTCPRLERATRPHLGGLHVLANRGLHALTFRGLHVLALRGLHALTLGLHILTIRGLHALTSRGLHVLALRGLHALTLGTSYPHR

SEQ ID NO: 145331 - protein, 164 aa, Glycine max
  Coding DNA Sequence Number=SeqID_28553
  Homolog annotation: Hit_ID=Q1SWX1; Match level="QueryCoverage=46%, HitCoverage=15%, E-value=1e-08, Identity=37%"; Hit description=IMP dehydrogenase/GMP reductase
MTTLEIITKGLVSSLPYRSLEYGPEADTLRAIFHTAMHKCHVLSSQGQEPRDHQSKRVRAVYGSAPAASFSQSLRQLMGQLQRQAFRKAYGKIWDLAMVEVSTEAIASLAQYYDQPLRCFTFGDFQLSPMVEEFEEILGCPLGGRKPYLFLGFYPSLARISKIV

SEQ ID NO: 145332 - protein, 90 aa, Glycine max
  Coding DNA Sequence Number=SeqID_28554
MTKNRVMKEHNKTFLDWFKDTIFADEPKRNVAKFDIPEASDLRTKKKILQTVGERWRQFKSNLMSKWALAANKESVVGIICEKYGISKEK

SEQ ID NO: 145333 - protein, 53 aa, Glycine max
  Coding DNA Sequence Number=SeqID_28555
MKSGDMRRYPSRYPYKRFLLILTREVRRRYPSGYPYENSFAIRQTQSLIACRD

SEQ ID NO: 145334 - protein, 245 aa, Glycine max
  Coding DNA Sequence Number=SeqID_28556
  Gene Ontology: Mol. function=nucleic acid binding; Cellular component= nucleus; Biological process=DNA replication
  Homolog annotation: Hit_ID=Q9FHJ6; Match level="QueryCoverage=63%, HitCoverage=23%, E-value=1e-39, Identity=47%"; Hit description =Replication protein A1-like
MFGMDNFIFKTLALPLECFCMTLLLKTNLPRDDRVLMVFSFDVVDYDGGEIGATCFNAVADQFYNVIQAGKTFNYHPISEIESLENNSIVDVIGVVTSIRPTTSIMRKNGTEVQKRTLQLKDMSGRSVELTLWGNFCIVEGQRLQTICHAREFPVLATKAVRLNDFNGKSVETIATSKVYKGTMTKNLNVAMKHIINDDGNVDTFVRLITSLSHVRHPNISSCKQSQFTWCQLKVELNKEYTESA

SEQ ID NO: 145335 - protein, 201 aa, Glycine max
  Coding DNA Sequence Number=SeqID_28557
  Gene Ontology: Mol. function=protein binding; Biological process =response to stress
  Homolog annotation: Hit_ID=UPI00005F9A37; Match level="QueryCoverage =71%, HitCoverage=100%, E-value=1e-44, Identity=62%"; Hit description= COG0589: Universal stress protein UspA and related nucleotide-binding proteins
  Pfam annotation: Domain name=Usp; Domain location=58-201; Score=69.8; E_value=8.8e-18; Accession=PF00582.16; Description=Universal stress protein family
MAKELTLSLKAIYCDTAQAEGKTEIRAEVMTRKEYRKLLELIMGNIGGNKIMASEGHMYNSILVPIDISEDSLTHMVIPFVQAHTALNTAKVHFLTVIPSLPYYSSLGLAYSVEMPKMKEFQHAALAKLDEIVKQFKIPSDKIQTHAVTGSPKDQILKLADTIGADLIIIASHKPDISTYLLGSNAAAVVRHAKCPVLVVR

SEQ ID NO: 145336 - protein, 63 aa, Glycine max
  Coding DNA Sequence Number=SeqID_28558
MSRNLTDYAIIPSLASRMLRNFTDCTLTRPFNSRHVAELHGLPNDGCQVLNPKAYKSIFSPSP

SEQ ID NO: 145337 - protein, 85 aa, Glycine max
  Coding DNA Sequence Number=SeqID_28559
MADLALWRRAGVDRYEVLSTSYGMESEAYWPCGGAGEGSALMRVRALSSGPNRNENGPFDSHEGAEGAVVVSVLRAHCAGMQSSS

SEQ ID NO: 145338 - protein, 283 aa, Glycine max
  Coding DNA Sequence Number=SeqID_28560
  Gene Ontology: Mol. function=oxidoreductase activity; Cellular component=membrane; Biological process=metabolic process
  Homolog annotation: Hit_ID=Q1BKN8; Match level="QueryCoverage=63%, HitCoverage=67%, E-value=7e-81, Identity=81%"; Hit description=Short- chain dehydrogenase/reductase SDR precursor
  Pfam annotation: Domain name=YCII; Domain location=200-280; Score =6.7; E_value=0.01; Accession=PF03795.4; Description=YCII-related domain
LFRSVRQLDVLVNNAGYMVTGLAEETPVELGRQQFETNFWGTIKVTNALLPRLRAQKHGQIITISSIVGLIGPPNLSYYTASKHAVQGYFKSLRFELDPFNIQVSMVEPVWFKTNLAHNSVSQSSGRIADYNAYRKQADAATQKGIDEAEAPDAVVNTITKLIETKKPKFSNPVGKMTGMILGAEMKYYLCKFVPPRANFLATMSGEEKTWMRQHGEYMNGLLEQGVIVAHGPVIDDGDGYGVSLYQIADNQEIGSFTSEDPIVKNGIGHYEHYTMASLTSRS

SEQ ID NO: 145339 - protein, 137 aa, Glycine max
  Coding DNA Sequence Number=SeqID_28561
  Gene Ontology: Mol. function=oxidoreductase activity; Cellular component=membrane; Biological process=metabolic process
  Homolog annotation: Hit_ID=Q0K0A2; Match level="QueryCoverage=85%, HitCoverage=51%, E-value=2e-15, Identity=37%"; Hit description=Short- chain dehydrogenase of various substrates pecificities
MTSSLIAGASSGIGAVYARRFAARGHDLVWVARTTDRLNALLPESSQGICAATKSYMLAFLQSLAAEAGPRGVYIPAVLPAATRTEIYERSGGDVMDGELVTIPPVPEAAAWDAFEQARGYLAQVFSNSKPATRYLT

SEQ ID NO: 145340 - protein, 191 aa, Glycine max
  Coding DNA Sequence Number=SeqID_28562
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=89%, HitCoverage=15%, E-value=6e-94, Identity=100%"; Hit description=DNA -directed RNA polymerase beta chain
  Pfam annotation: Domain name=RNA_pol_Rpb2_1; Domain location=34-190; Score=119.0; E_value=1.4e-32; Accession=PF04563.6; Description=RNA polymerase beta subunit
MKNGSKSVEYSSIKFTGKLKMLGDGNEGMSTLPGLNQIQFEGFCRFIDRGLPEGLFKFPKIEDTDQEIEFQLFVETYQLLEPLINEKDAVYESLTYSAELYVSAGLIWKSSRDIQEQTIFVGNIPLMNSLGTSIVNGIYRIVINQILQSPGIYYRSELDPSGISVYTGTIISDWGGRLELEIDRKARIWAR

SEQ ID NO: 145341 - protein, 43 aa, Glycine max
  Coding DNA Sequence Number=SeqID_28563
LANGNVRIRFLHYDKPEEKFQDTKDQLKRPITILRSRNRLRCE

SEQ ID NO: 145342 - protein, 191 aa, Glycine max
  Coding DNA Sequence Number=SeqID_28564
MIMRGQDIYSSQDETTTSPSSSESEEAKGEASSEEIYPQEERQPLMVKESVRRQPPHFLLCKKTLVSIATPLGLEFILLVKELLDEGLVRKSLNPCALLVPKIGIIRHRIPKIGGMMNVFSGATLFCEINRAPNNFMICVHRDSLGGNNQHKNKEKGMFYSITFLNFLNSDQGLPMDPKRIKVIPEWPTPP

SEQ ID NO: 145343 - protein, 97 aa, Glycine max
  Coding DNA Sequence Number=SeqID_28565
  Homolog annotation: Hit_ID=Q6ZC71; Match level="QueryCoverage=91%, HitCoverage=22%, E-value=3e-18, Identity=52%"; Hit description=Sac domain-containing inositol phosphatase 3-like
NWLFGQRKYEEGSSAAKVASRESDVEGSQANGFCDLNWLSSGNDMNEEDVFQRYLTMTSTNEANGWYGGSLLGDQDESSEIYKHYAELCQELKLLLK

SEQ ID NO: 145344 - protein, 86 aa, Glycine max
  Coding DNA Sequence Number=SeqID_28566
MVVILPKENLVVWFSSLHNRLDNYLKGIINNALKGLDDTPQPKSKAATARWIVVKYFNDVRPLEAERLKALCIQWAQYYLKVKNQT

SEQ ID NO: 145345 - protein, 97 aa, Glycine max
  Coding DNA Sequence Number=SeqID_28567
MARVAKVVKISTQELDRVKKNRNGVVGLPRKRLEEKAEALVDQGEWTSFIDILALRADAILPRKGPVTRAMSKRLQEDWARAAEEGPRVLMNLRVDF

SEQ ID NO: 145346 - protein, 102 aa, Glycine max
  Coding DNA Sequence Number=SeqID_28568
  Homolog annotation: Hit_ID=Q1STZ2; Match level="QueryCoverage=75%, HitCoverage=16%, E-value=2e-08, Identity=41%"; Hit description=IMP dehydrogenase/GMP reductase
MGSNQAPSFKKRFYHVKVKSLDLASLRELGQRMDQVRCQAFHKAYGKIWDLALIEVSVEAIASLSQYYDQSLRCFTFGDFQLVLTIEEFEGILGCLLGGRNE

SEQ ID NO: 145347 - protein, 59 aa, Glycine max
  Coding DNA Sequence Number=SeqID_28569
  Subcellular localization annotation: CTP_CleavageSite=15; ConfidenceScore=5.20e-01
MSSSLISNIVAVGTTSDNVSSKRKNQDEASLLSSKSETQHNHRSTSTSYVSTDLGAMRA

SEQ ID NO: 145348 - protein, 88 aa, Glycine max
  Coding DNA Sequence Number=SeqID_28570
MVRTEYRTLRELVLLGGLVGACTLSATLARLACISEFRLSARLLAQRNDSSGALSGMTPRSANMHSSSFFQILPRAQPKECCSQRMAR

SEQ ID NO: 145349 - protein, 140 aa, Glycine max
  Coding DNA Sequence Number=SeqID_28571
MKETEDSFKKVMKLSRERIVDQSSMFEFDDDDNTIMHQWKSHEEENGVASKPSANQLDNLSEYQKVWEQFHTTFLQDNQDLKSVLSIPDVRKQIKEICEELDKYEDGICLRMTNKPWTHLIQSSRMGIHHKRNSMPVKLA

SEQ ID NO: 145350 - protein, 245 aa, Glycine max
  Coding DNA Sequence Number=SeqID_28572
  Gene Ontology: Mol. function=transcription factor activity; Cellular component=intracellular; Biological process=regulation of transcription, DNA-dependent
  Homolog annotation: Hit_ID=Q92XK4; Match level="QueryCoverage=82%, HitCoverage=50%, E-value=2e-30, Identity=35%"; Hit description =Putative ROK family transcriptional regulator
  Pfam annotation: Domain name=ROK; Domain location=49-232; Score =127.7; E_value=3.3e-35; Accession=PF00480.10; Description=ROK family
MKLSKAAISTLIKEMLSAGLLEESIPESNGQGRPSVLLKMRADSAYFLGASLLGDDVYLVLTDMHGRILASTHMPLNPDPVQLAGALAAAIPDLIAQKGISADQLIGLGVTLSGFVDEHQAVCVQSALLGWKNVPLAALLNAQTGLEVSLENDAKALAVSEKIFGVAKKARNFTLISHGDGIGSAHFFQGQLHRGAHGGAGEIAHCTVEPGGRPCRCGKRGCLDTLASLTAMRESMRDKQLPCTS

SEQ ID NO: 145351 - protein, 411 aa, Glycine max
  Coding DNA Sequence Number=SeqID_28573
  Gene Ontology: Mol. function=transporter activity; Cellular component= periplasmic space; Biological process=transport
  Homolog annotation: Hit_ID=Q21TU1; Match level="QueryCoverage=83%, HitCoverage=67%, E-value=5e-49, Identity=35%"; Hit description =Extracellular solute-binding protein, family 5 precursor
  Pfam annotation: Domain name=SBP_bac_5; Domain location=71-408; Score= 244.6; E_value=2.2e-70; Accession=PF00496.12; Description=Bacterial extracellular solute-binding proteins, family 5
  Subcellular localization annotation: CTP_CleavageSite=40; ConfidenceScore=5.10e-01
MQSTLKHFRVLTLAAGILASFSSASVLAAQLVIMQNEPPRSMDPGNQTATFTGTVLDPMYEGLTRLGDDGKIMPALALSWHADDSGLHWEFTLRPNVKFHDGTPFNADAVVENFQRHLDTKRGLAGSGKIRTFIQDVQKKDDLTVTFTLKKINPAFLTVLASGPGLMVSPQADKAGTINNKADGTGPYKLAQYKSGEFVLEQKNPDYWGKSAGPDEIKWTWSSEPSVMNMALQSGQVDIINPVPPQFAGMLKNNPGVQLKQSPGAAVFWIDLNTQSKALSDVRVRQALNFATDQQALVKAVMFGYAQPANSPLAPVDANYDKALHDYPYDVQKAKDLLKAAGYADGFAMSIAVQAPDARTAQVLQGMWSKIGVKLSVRQMESGVWAKAAFADAKEKAAQGTDAVLASWSSG

SEQ ID NO: 145352 - protein, 440 aa, Glycine max
  Coding DNA Sequence Number=SeqID_28574
  Gene Ontology: Mol. function=transporter activity; Cellular component= integral to membrane; Biological process=transport
  Homolog annotation: Hit_ID=Q2L1N2; Match level="QueryCoverage=64%, HitCoverage=78%, E-value=1e-100, Identity=59%"; Hit description =Probable transporter
  Pfam annotation: Domain name=MFS_1; Domain location=1-260; Score= -20.5; E_value=0.0027; Accession=PF07690.6; Description=Major Facilitator Superfamily
PLLAILGARASRLNFLMTLMGLFALGNLLSAVVPGYPAMLAVSMVLLGLTIANLIGVPAVTAIGQWFGWRDAFAIVGGLALLTLLLVWLWVPNVAGDKQASPLRELSALTRKQVLLTLAIGAIGSGGMFSVFSYVKPTMMELAHLPENLVPAILALFGLGMIIGNLVGGRLADRGLEKTIRIVLVWSLLVLSAFVFAAHYALAGALNVMLVGTMVALGSVLQIRLMDVAGDAQTLAAALNHSAFNIANALGAWLGGITISAGLGWQSTGWVGAILSVLGLLIHAIATSAVVTAGRHYSRITAGAVSCCRRLADAAAPQCAKSGAVAAAKQRCASGIPAQSCQGRVRYRVFQPGTVPVIGRFAIAGGNPHAPDYGVPVRSLALEFQLAHGEQWRTGMNALPFFPVSTPQAFYDQQQASRPLPQTGKPDAQKLMAFTVAHPE

SEQ ID NO: 145353 - protein, 85 aa, Glycine max
  Coding DNA Sequence Number=SeqID_28575
  Homolog annotation: Hit_ID=Q1S082; Match level="QueryCoverage=77%, HitCoverage=8%, E-value=1e-21, Identity=73%"; Hit description =Ribosomal RNA methyltransferase RrmJ/FtsJ; Spb1, C-terminal
MEHEICKNIPVIILICLFEKVEVDKPAASRSESAEIYVWGLGYKAPAKIDSRLLDVKHLFQGSVEPQPKVVDVLRDTKQKRHHDE

SEQ ID NO: 145354 - protein, 115 aa, Glycine max
  Coding DNA Sequence Number=SeqID_28576
MKKVEQKSNRRGNPTKRSTVGDLIHIDLEISATCRKRNSERIRNVLQDLEAATTPEEEPRSSEASSSFPIAGHSHIEHVEDTIIAEEPRRVTLEDYSSSNLPQFFTSIAQPEVQA

SEQ ID NO: 145355 - protein, 37 aa, Glycine max
  Coding DNA Sequence Number=SeqID_28577
MAMGETGTGIVSPIPDPDSPTCLIPRMCLQKSLRKEY

SEQ ID NO: 145356 - protein, 92 aa, Glycine max
  Coding DNA Sequence Number=SeqID_28578
MRECCGIFEKFECSFMHLKARHHVRVCSWRERRWHQRRERARVRRSRVAAAASAAVGVGLVLRGGGGVRLSGRRRAVAVAGRLVEIAGHDEI

SEQ ID NO: 145357 - protein, 261 aa, Glycine max
  Coding DNA Sequence Number=SeqID_28579
  Gene Ontology: Mol. function=hydrolase activity, hydrolyzing O -glycosyl compounds; Biological process=tricarboxylic acid cycle intermediate metabolic process
  Homolog annotation: Hit_ID=Q7CFV6; Match level="QueryCoverage=64%, HitCoverage=38%, E-value=2e-80, Identity=90%"; Hit description =Phospho-beta-glucosidase
HVGDHVMHADRHVAQADDLRFGKAGHRLGDDAGRVGEVDDPGVRRQFFHPASDVQHHRDGAQRLGEAADAGGLLAEQLVFQAQPFVGGARRQLPDAELGQHEGGAANGVVQRKVHTDLHLLQPVARQHAAGQGGDGFHFLPARFDVHQRQLGDRQLLDALDQPIDQFGELDHVVGQILDHHGVHQMILRMHGDQVDRQFAAAFVQADQLGLDQRHQRIAARAAGEHQQFHDGAFKLGADFSHQFTHVISPGVARRRRRGML

SEQ ID NO: 145358 - protein, 106 aa, Glycine max
  Coding DNA Sequence Number=SeqID_28580
MASRKHKSIGSRPTTQYDTRRFHSFGPWNRYMDNVLGRHILPERKVKIYHTKLDKFKAELDRRNFHKRHTNLVDNNIDSALVKEFYANLYSSEDPSPKQVRVRGHL

SEQ ID NO: 145359 - protein, 57 aa, Glycine max
  Coding DNA Sequence Number=SeqID_28581
MEEKKKKQLEEAAQFGSIDTVIDPPSPIRRHVKWNMAHTKKIGQMTFEAQRKSLTKI

SEQ ID NO: 145360 - protein, 102 aa, Glycine max
  Coding DNA Sequence Number=SeqID_28582
MSKLSSVRLIGVASMRKHIMEMRDLAAQLKLLWVEIFESFMEEGRLAQEIGEDALTVTQDKRERKENNHIPPIAKIKKESRASQARGSQMKVNVLVKWPQIS

SEQ ID NO: 145361 - protein, 315 aa, Glycine max
  Coding DNA Sequence Number=SeqID_28583
  Gene Ontology: Mol. function=nucleic acid binding; Cellular component= cytoplasm; Biological process=DNA integration
  Pfam annotation: Domain name=rve; Domain location=3-153; Score=93.4; E_value=6.8e-25; Accession=PF00665.16; Description=Integrase core domain
MDSHGQKYFISFIDDYSRYMYLYLLNNKYEALDAFKVFKAGVEKQCGKQIKIVRSDRGGKFYGKYTENGQAPGPFAKFLQEHDIVAQYTMPGSPNQNSVAGRRNRTLRDMVRSMLSNSKLPRSLWNEALKIVVYILNRVPTKAVPKTPFELLKGWKPSLKHVCVWGCPGEVRIYNPNEKKLDPRSISAYFIGYAERSKGYRFYSPTHSTRIVESRNRKFLENNVASGSDLTQRIGLEKNQCEEVVPTSSYKLVVFGDTHQNRVTQAPHQVDPVLENPVEQHQTQNVEQLVEQHQTQDVEQPVEQQPECVDVTLRI

SEQ ID NO: 145362 - protein, 53 aa, Glycine max
  Coding DNA Sequence Number=SeqID_28584
YIKFLLVVIDYFTKWIKARPLLEISANEVEKFLTMLGVHAPRDFYRTPQGQRS

SEQ ID NO: 145363 - protein, 185 aa, Glycine max
  Coding DNA Sequence Number=SeqID_28585
MASNSQQFSARSDAIIIRGVHEVATNSSGETKKLEGKLDALVNLVTQLAMNQKSAPVARLCGLCSSADHYTDLCPSEAIEQPEAYAANIYNRPPQPQQQNQPQQNNYDLSSNRYNLGWRNHPNLRWSNPSQQQQQQQPYFQNATGPSRPYVPPPIQQQQQLQPRNSKHPQPSLEELVRQMTMPNM

SEQ ID NO: 145364 - protein, 131 aa, Glycine max
  Coding DNA Sequence Number=SeqID_28586
MYPPLFSLNNLVDVPSTRTDPQEMYPPLFSVTTTQVDVPSSCTTKDGKGRIKRILRLYRFEFFDKGEGRHKRIQAVSPRSFGKGRRETQKEFRRLVLGEFFLAKGEGRHKRIQAVSPSFFWKREKRDTKRI

SEQ ID NO: 145365 - protein, 110 aa, Glycine max
  Coding DNA Sequence Number=SeqID_28587
MDNSFLDNIVSSDHNQLAQSSPQVRLDSSEVSSDPISDNTNVDETDREIVSLDPTLDNTNLDGTNHEIDPCLCEITSNPNNESTIVQYNLPPCSNCGQPPAKYEPDLQAK

SEQ ID NO: 145366 - protein, 277 aa, Glycine max
  Coding DNA Sequence Number=SeqID_28588
KVRKAWEVVQKKDKELRGSNNGPIGGYRKWLRAHVQGLDWLLSLRTAKREEVEAPEEDEEVQALKAELEQAQTVKERFKSVALRIRKENAELRDINTATAKALEQETKRARKEEHGRDKFRGALWGSNNELKLRREERDQSQVHSMALKEELAACSRSKRSLAQHLEAMEQSMLAIIRQYKEELNQSLAHEQKLVEDFAQAYAEKEARGRVIDALHQEATMWMDRFALTLNGSQDLPRLLAKARAKAEVCSAPEEIHGLINYCQHMIDLMAHIIRNR

SEQ ID NO: 145367 - protein, 157 aa, Glycine max
  Coding DNA Sequence Number=SeqID_28589
MRLHCDQASRRPNMTINRPPLLMVHIDSGIGPNISMCVQGVGAIPQWSRQLSQPTLRRGCEKAKTNKAKAFVSKRENEQSRHQRLFEENVRKTKKDKRDEEGMHEEAKQGIRDEGSSPRRAELPQANCYFILKQPCSPRQAGYFTMKLFWWPRRARG

SEQ ID NO: 145368 - protein, 33 aa, Glycine max
  Coding DNA Sequence Number=SeqID_28590
MALGTMAARPSKLMLHPKSHEWPVHNSIRIHFF

SEQ ID NO: 145369 - protein, 45 aa, Glycine max
  Coding DNA Sequence Number=SeqID_28591
AVCYDEESSLIAVPPGPLSSVESASDVDIISYGESTSGSGSSSSS

SEQ ID NO: 145370 - protein, 102 aa, Glycine max
  Coding DNA Sequence Number=SeqID_28592
MGSKIYPKVHENPKAFFINSSPILLEPLAHGSGNWSFPREDCINLLDTQQGLSAALSLIQREMRQADAMHDLEARKRSSKGRGNRSRSYPNQINIKNAVSRK

SEQ ID NO: 145371 - protein, 86 aa, Glycine max
  Coding DNA Sequence Number=SeqID_28593
MSEKHMEKKAQEKEELIAALMKDKVAPTQAEAFAKVVDDTIVRGVINDLINTGVMDETPEASNVVVADEVVPLRQETCVQAIHNLK

SEQ ID NO: 145372 - protein, 135 aa, Glycine max
  Coding DNA Sequence Number=SeqID_28594
  Gene Ontology: Mol. function=protein serine/threonine kinase activity; Biological process=protein amino acid phosphorylation
  Homolog annotation: Hit_ID=Q67U98; Match level="QueryCoverage=76%, HitCoverage=11%, E-value=8e-19, Identity=48%"; Hit description =Putative S-receptor kinase, homolog
MIIGRLNKHYKDAILKLVKFFQDCPEQHFFLVEKSELDVALDKDAPTGKRCLTTIVSVGFWKVSQREPLDLSSNTRFPISGSTSLLTCDFSDGVDHLVLPSSSRIVVPLKDRNVLPESEMGPSLLANQMIVLEVA

SEQ ID NO: 145373 - protein, 42 aa, Glycine max
  Coding DNA Sequence Number=SeqID_28595
MGLKRKIMMNIIISLKVEVVRVQVQQQLLAYSSELVEDSKEE

SEQ ID NO: 145374 - protein, 991 aa, Glycine max
  Coding DNA Sequence Number=SeqID_28596
  Gene Ontology: Mol. function=protein serine/threonine kinase activity; Cellular component=integral to membrane; Biological process=protein amino acid phosphorylation
  Homolog annotation: Hit_ID=Q9SD64; Match level="QueryCoverage=99%, HitCoverage=97%, E-value=0.0, Identity=42%"; Hit description =Receptor kinase-like protein
  Pfam annotation: Domain name=LRRNT_2; Domain location=8-48; Score =62.6; E_value=1.3e-15; Accession=PF08263.3; Description=Leucine rich repeat N-terminal domain
  Pfam annotation: Domain name=LRR_1; Domain location=101-123; Score =10.3; E_value=3.3; Accession=PF00560.23; Description=Leucine Rich Repeat
  Pfam annotation: Domain name=LRR_1; Domain location=125-147; Score =12.7; E_value=1.2; Accession=PF00560.23; Description=Leucine Rich Repeat
  Pfam annotation: Domain name=LRR_1; Domain location=149-171; Score =14.9; E_value=0.28; Accession=PF00560.23; Description=Leucine Rich Repeat
  Pfam annotation: Domain name=LRR_1; Domain location=173-195; Score =7.3; E_value=12; Accession=PF00560.23; Description=Leucine Rich Repeat
  Pfam annotation: Domain name=LRR_1; Domain location=197-216; Score =1.6; E_value=1.5e+02; Accession=PF00560.23; Description=Leucine Rich Repeat
  Pfam annotation: Domain name=LRR_1; Domain location=221-244; Score =9.2; E_value=5.4; Accession=PF00560.23; Description=Leucine Rich Repeat
  Pfam annotation: Domain name=LRR_1; Domain location=246-269; Score =8.5; E_value=7.2; Accession=PF00560.23; Description=Leucine Rich Repeat
  Pfam annotation: Domain name=LRR_1; Domain location=270-291; Score =16.0; E_value=0.13; Accession=PF00560.23; Description=Leucine Rich Repeat
  Pfam annotation: Domain name=LRR_1; Domain location=293-315; Score =7.2; E_value=13; Accession=PF00560.23; Description=Leucine Rich Repeat
  Pfam annotation: Domain name=LRR_1; Domain location=323-345; Score =13.1; E_value=1; Accession=PF00560.23; Description=Leucine Rich Repeat
  Pfam annotation: Domain name=LRR_1; Domain location=348-370; Score =15.4; E_value=0.21; Accession=PF00560.23; Description=Leucine Rich Repeat
  Pfam annotation: Domain name=LRR_1; Domain location=372-394; Score =5.8; E_value=24; Accession=PF00560.23; Description=Leucine Rich Repeat
  Pfam annotation: Domain name=LRR_1; Domain location=396-418; Score =5.7; E_value=24; Accession=PF00560.23; Description=Leucine Rich Repeat
  Pfam annotation: Domain name=LRR_1; Domain location=420-442; Score =10.9; E_value=2.6; Accession=PF00560.23; Description=Leucine Rich Repeat
  Pfam annotation: Domain name=LRR_1; Domain location=444-466; Score =18.5; E_value=0.025; Accession=PF00560.23; Description=Leucine Rich Repeat
  Pfam annotation: Domain name=LRR_1; Domain location=469-491; Score =6.8; E_value=15; Accession=PF00560.23; Description=Leucine Rich Repeat
  Pfam annotation: Domain name=LRR_1; Domain location=493-515; Score =7.6; E_value=11; Accession=PF00560.23; Description=Leucine Rich Repeat
  Pfam annotation: Domain name=LRR_1; Domain location=517-539; Score =13.0; E_value=1; Accession=PF00560.23; Description=Leucine Rich Repeat
  Pfam annotation: Domain name=LRR_1; Domain location=53-75; Score=5.2; E_value=30; Accession=PF00560.23; Description=Leucine Rich Repeat
  Pfam annotation: Domain name=LRR_1; Domain location=541-563; Score =17.3; E_value=0.057; Accession=PF00560.23; Description=Leucine Rich Repeat
  Pfam annotation: Domain name=LRR_1; Domain location=565-588; Score =6.3; E_value=19; Accession=PF00560.23; Description=Leucine Rich Repeat
  Pfam annotation: Domain name=LRR_1; Domain location=77-99; Score=4.2; E_value=48; Accession=PF00560.23; Description=Leucine Rich Repeat
  Pfam annotation: Domain name=Pkinase; Domain location=682-956; Score =129.3; E_value=1.1e-35; Accession=PF00069.15; Description=Protein kinase domain
  Pfam annotation: Domain name=Pkinase_Tyr; Domain location=682-981; Score=71.9; E_value=2e-18; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=8-48::101-123::125-147::149-171::173-195::197-216::221 -244::246-269::270-291::293-315::323-345::348-370::372-394::396 -418::420-442::444-466::...
  Pfam module annotation: Domain location=469-491::493-515::517-539::53- 75::541-563::565-588::77-99::682-956::682-981
MIAFASGNDTDYLALLKFRESISSDPLGILLSWNSSSHFCNWHGITCNPMHQRVTKLDLGGYKLKGSISPHIGNLSYMRIFNLNKNYLYGNIPQELGRLSQLQNFSVGNNSLEGKIPTNLTGCTHLKLLNLYGNNLIGKIPITIASLPKLQLLNVGNNKLTGGIPPFIGNLSALLYLSVESNNIEGDVPHEMCQLNNLIRIRMPVNKLTGTFPSCLYNVSSLIEISATDNQFHGSLPPNMFHTLPNLQRFYVALNQISGSIPPSIINVSKLSVLEISGNQFTGQVPPLGKLRDLFHLRLSWNKLGDNSANNLEFLKSLTNCSRLEMLSIADNNFGGHLPNSLGNLSTQLSQLNLGGNQISGEIPETIGNLIGLSFLTMQDNRIDGIIPTTFGKFQKMQVLDVSINKLLGEIGAFIGNLSQLFHLEMGENKLEGNIPPSIGNCQKLQYLNLSQNNLTGTIPLEVFNLSSLTNLLDLSYNSLSSSIPEEVGNLKHINLIDVSENHLSGYIPGTLGECTMLESLYLKGNTLQGIIPSSLASLKGLQRLDLSRNHLSGSIPDVLQNISFLEYFNVSFNMLEGEVPTEGVFRNASGFVMTGNSNLCGGIFELHLPPCPIKGKKLAQHHKFWLIAVIVSVAAFLLILSIILTIYWMRKRSNKLSLDSPTIDQLAKVSYQSLHNGTDGFSTTNLIGSGNFSSVYKGTLELEDKVVAIKVLNLQKKGARKSFIAECNALKSIKHRNLVQILTCCSSTDYKGQEFKALIFEYLKNGSLEQWLHPRTLTPEKPGTLNLDQRLNIMIDVASAIHYLHHECKESIIHCDLKPSNVLLDDDMTAHVSDFGLTRLLSTINGATSKQTSTIGIKGTVGYIPPEYGVGCEVSTNGDMYSFGILILEMLTGRRPTNEIFEDGQNLHNFVENSFPDNLLQILDPSLALKHEEATINEAHNQKLTPSVEKCLVSLFKIGLACSVKSPKERMNMMDVTRELSKIRTTFLSG

SEQ ID NO: 145375 - protein, 205 aa, Glycine max
  Coding DNA Sequence Number=SeqID_28597
  Homolog annotation: Hit_ID=Q9AVH2; Match level="QueryCoverage=22%, HitCoverage=16%, E-value=7e-20, Identity=97%"; Hit description =Putative senescence-associated protein
FSMCPVVGFGPWLGLGKPLVEILPPGQLRGFCPLLAWLGSAVLGYGPVLSFGLVGPLLPPVISFVARILPTLACAPLAKSGRDESKRQGAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 145376 - protein, 184 aa, Glycine max
  Coding DNA Sequence Number=SeqID_28598
MTGPLDESISCFLIKVGPWVLVPNTFRGLYVLAIRGLHILACRGLHALAFRGLRVLIFSVLHIHTLREYKGSCPQDAQWTRRSPTGPWGFQLWLRASVVLQGARFPLVDGSVGLCRHDIGIVPTKTPSGPEEVQQGPGVSSSGYGPLSILQGARSPRIAPTKTPSGPGEVQQGPRVSSSGYGPL

SEQ ID NO: 145377 - protein, 59 aa, Glycine max
  Coding DNA Sequence Number=SeqID_28599
MEVKESLIGLRLPLHYRADTGGWCLVLDVQQVDFMADLGVAFVDDWAFLVGRVVSNRKD

SEQ ID NO: 145378 - protein, 196 aa, Glycine max
  Coding DNA Sequence Number=SeqID_28600
  Homolog annotation: Hit_ID=Q4HIX7; Match level="QueryCoverage=27%, HitCoverage=45%, E-value=2e-18, Identity=81%"; Hit description=Cell wall-associated hydrolase, putative
EPTTEAPVNGGRNYNGPKVAKFLVGLGEIDMSVKMRTTCTWTERPYEASLFPGIGFGLFLRSLGGGQRRPPSGGPEPSVRYHSGRARILTLCQDLRAEGQSQASQKVTEACKGFLGPDGDWPSSAKAEGSLMQDPPVEQDETHIDGKVWHLDVGSSPPGAVVCSKGWAVRPLKRYVSWVQNVVRQFGPYPVWALEH

SEQ ID NO: 145379 - protein, 102 aa, Glycine max
  Coding DNA Sequence Number=SeqID_28601
MTKLGLCVPTDTTVSEWQRGADNRKVSPRIIMTKLGLCVPTDTTVSEWQRGADNRKVSPRIIMTKLGLCVPTDTTVSEWQRGADNRKNDQTWSLRAIGHDCV

SEQ ID NO: 145380 - protein, 111 aa, Glycine max
  Coding DNA Sequence Number=SeqID_28602
  Gene Ontology: Mol. function=nucleic acid binding; Biological process= RNA-dependent DNA replication
MKVEQLFACQHISEERKVPLATLRFQVEYWNDLKSALRKRHIPFYYEMELIDNIQRLRQRSMSVEEYRQQMELLLLRARLREEERTSIARFLSGLNMEVRDQVELLPYKDL

SEQ ID NO: 145381 - protein, 359 aa, Glycine max
  Coding DNA Sequence Number=SeqID_28603
  Homolog annotation: Hit_ID=Q9LVC4; Match level="QueryCoverage=83%, HitCoverage=91%, E-value=2e-20, Identity=30%"; Hit description =Arabidopsis thaliana genomic DNA, chromosome 5, P1 clone:MJB24
MGRGWGYPIPDGYGDETINLNSSGIAYGYENMLESQGEDHDPRRKRTTKDRPVDVEFASMGTKIEYSINLLASSVDSNNFIVGGVDVWEHYQNKGETNKHCSIGVNKLQDPMDRMLDRNNIESIKKTMQMHEEIFKYQVRELHRVYSVQKILMDDLRKETKQKKFWTPMNGIDISHSHFLQQQQQTTTTLISYGPDFHVQSLREDLCSKERSGSCSGETIKRQRGFDLERPAERDIFGGGCDEHEAGLSSYTALERCKISSNNDDGYDEDMEVDLTLSIGGGSQVNDKKNSSSKKPYLLPLGCSDSPNGKTRELNSSVSFQSDRVGDFSDPTTPMSSSSVTFDQERKGPHWLSQGLKLK

SEQ ID NO: 145382 - protein, 78 aa, Glycine max
  Coding DNA Sequence Number=SeqID_28604
MEKKESTEETSCSKQKMENLSKGKTQRQVKLEETNHKIEEKKQTGEGGEMTKHSSEETTGEGWRRRHVEQPKLEAEIK

SEQ ID NO: 145383 - protein, 166 aa, Glycine max
  Coding DNA Sequence Number=SeqID_28605
  Gene Ontology: Mol. function=oxidoreductase activity; Cellular component=cytosol; Biological process=biological_process
  Homolog annotation: Hit_ID=Q1SVN8; Match level="QueryCoverage=84%, HitCoverage=47%, E-value=2e-50, Identity=66%"; Hit description =Aldo/keto reductase
  Pfam annotation: Domain name=Aldo_ket_red; Domain location=6-166; Score=68.7; E_value=1.9e-17; Accession=PF00248.11; Description =Aldoketo reductase family
MNLFLTNTSIVQYFYGLAGDEIGAALKKLFADGVVKREDMFITSKLWCNDHLPENVPEAFDKTLQDLQLDYLDLYLIHWPVSAKNGKLTKPDIPSTWRAMEALYNSGKAQAIGVSNFSVKKLQDLLDVASVPPAVNQVELHPSLQQPELHAFCKSKGVHLSVSVQI

SEQ ID NO: 145384 - protein, 360 aa, Glycine max
  Coding DNA Sequence Number=SeqID_28606
  Gene Ontology: Mol. function=isomerase activity; Cellular component =cytoplasm; Biological process=carbohydrate metabolic process
  Homolog annotation: Hit_ID=Q9LVC5; Match level="QueryCoverage=92%, HitCoverage=97%, E-value=1e-141, Identity=73%"; Hit description =Apospory-associated protein C
  Pfam annotation: Domain name=Aldose_epim; Domain location=34-340; Score=250.9; E_value=2.6e-72; Accession=PF01263.10; Description =Aldose 1-epimerase
  Subcellular localization annotation: CTP_CleavageSite=39; ConfidenceScore=5.04e-01
MSTEKEKTSAPSSSSSSSSSSPSVELCKGVNGLEKILLRESRGSSTEVYLYGGHVTSWKNDHGEELLFLSNKAIFKTPKAIRGGIPLCFPQFGGLGTLDQHGFARNRFWAIDDDPPPFPTNTLSKAFVDLILKPSEEDTKIWPHSFEFRLRIALGPGGDLMLTSRIRNTNSEGKPFSFTFAYHTYFSVSDISEVRVEGLETLDYLDNLQNKERFTEQGDALTFESEGWALLSMFWLMICHPFHIWWVLAKPNPFISVDKIYLSTPTKIAIIDHEKKRTFVVRKDGLPDAVVWNPWDKKAKALADFGDDEYKHMLCVEAAAIEKPITLKPGEEWKGRLELSAVPSSYCSGQLDPQRVLLGS

SEQ ID NO: 145385 - protein, 331 aa, Glycine max
  Coding DNA Sequence Number=SeqID_28607
  Gene Ontology: Mol. function=RNA-directed DNA polymerase activity; Cellular component=chromatin; Biological process=RNA-dependent DNA replication
  Homolog annotation: Hit_ID=Q1SJI4; Match level="QueryCoverage=55%, HitCoverage=35%, E-value=2e-20, Identity=48%"; Hit description =Peptidase aspartic, catalytic
MGQRGLLTWGSHVLGLNHLVQQLLKAVMICNNGEMVPGKGLLKKAMGCPYCKRTTPMPMLDASVSMVNGSLKSGLYGGSLDHGCNNGGITMDKATIEPSEAHKASKSFNGTRSGPLLNHNNFGSNWFNPFMQDQVAEMVEMILRNAAIDENVVEKDDDEVSEPCNRSSMEKQRAPSSSSKSSSIVGIGNRSLTVRAFKARNHGDVEARGIARFTAQASKVRLSHHPHSSILISSQFDQATLVKELYDVEVYREGGYLEVDRDRLTKPTTLQLLVVTHHNRKRSSGAKRESELGDEVLLDEIVGAPTVHQEEHHLARNLTHHSDGLECQMAR

SEQ ID NO: 145386 - protein, 348 aa, Glycine max
  Coding DNA Sequence Number=SeqID_28608
  Gene Ontology: Mol. function=peroxidase activity; Cellular component =vacuole; Biological process=response to oxidative stress
  Homolog annotation: Hit_ID=Q1T1I2; Match level="QueryCoverage=87%, HitCoverage=93%, E-value=1e-145, Identity=82%"; Hit description=Haem peroxidase, plant/fungal/bacterial
  Pfam annotation: Domain name=peroxidase; Domain location=63-312; Score=424.0; E_value=2.1e-124; Accession=PF00141.13; Description =Peroxidase
MVDLGINSYEQKVNRTEQLVMGDPCFFVVLSSLLLLIVSTQTSSAQLTRGFYLNTCPNVEQLVRSAVEQKFQQTFVTAPATLRLFFHDCFVRGCDASILLASPNNKAEKDHPDDISLAGDGFDTVAKAKAAVDSDPQCRNKVSCADILALATRDVINLAGGPFYKVELGRRDGRISTIASVQRQLPHPDFNLDKLNSMFSFHGLTQTDMIALSGAHTIGFSHCNHFSRRIYNFSPKKLIDPTLNLHYAFQLRQSCPLRVDSRIAINMDPVTPQKFDNQYFKNLQQGMGLFTSDQVLATDERSRGTINLFASNEQAFYNAFIEAITKMGRIGVKTGRQGEIRFDCSRVN

SEQ ID NO: 145387 - protein, 55 aa, Glycine max
  Coding DNA Sequence Number=SeqID_28609
MIGRGSKLRQERFAREKQVRDEWQRVRRARCILCGDEDGDLLIEFHNIEDATCRN

SEQ ID NO: 145388 - protein, 90 aa, Glycine max
  Coding DNA Sequence Number=SeqID_28610
MVPDDTIDYVYGKNGSNLACLRQNPNKATRGRTLESTRNATIANGKHLGDYIEVSQPMMIIMLEMERLSLSQGVTFSGIRAGRTFRPCML

SEQ ID NO: 145389 - protein, 771 aa, Glycine max
  Coding DNA Sequence Number=SeqID_28611
  Gene Ontology: Mol. function=actin binding; Cellular component =cytoskeleton; Biological process=cytoskeleton organization and biogenesis
  Homolog annotation: Hit_ID=Q67U26; Match level="QueryCoverage=97%, HitCoverage=70%, E-value=1e-175, Identity=46%"; Hit description =Putative villin 2
  Pfam annotation: Domain name=Gelsolin; Domain location=160-237; Score= 8.2; E_value=0.1; Accession=PF00626.12; Description=Gelsolin repeat
  Pfam annotation: Domain name=Gelsolin; Domain location=22-97; Score =42.4; E_value=1.5e-09; Accession=PF00626.12; Description=Gelsolin repeat
  Pfam annotation: Domain name=Gelsolin; Domain location=266-336; Score= 9.8; E_value=0.071; Accession=PF00626.12; Description=Gelsolin repeat
  Pfam annotation: Domain name=Gelsolin; Domain location=441-521; Score= 42.8; E_value=1.1e-09; Accession=PF00626.12; Description=Gelsolin repeat
  Pfam annotation: Domain name=VHP; Domain location=736-771; Score =70.0; E_value=7.5e-18; Accession=PF02209.10; Description=Villin headpiece domain
  Pfam module annotation: Pfam domain module=Gelsolin::Gelsolin::Gelsoli n::Gelsolin::VHP; Domain location=160-237::22-97::266-336::441 -521::736-771
MACDLQRIPTKTWFNLCFEKGQAEPVETDSLKRELLDTNKCYILDCGFEVFVWMGRNTSLDERKIASGVADELVSGTDQLKPQIIRVIEGFETVMFRSKFDSWPQITDVTVSEDGRGKVAALLKRQGVNVKGLLKADPVREEPQPHIDCTGHLQVWRVNGQEKILLQASDQSKFYSGDCFIFQYTYPGEDKEDCLIGTWIGKNSVEEERASANSLASKMVESMKFLASQGGLSEGYKTYIAQKEIPDDTYNENGVALFRIQGSGPDNMQAIQVEPVASSLNSSYCYILHNGPAVFTWSGNSTSAENQELVERMLDLIKPNLQSKPQREGSESEQFWDFLGGKSEYPSQKILREPESDPHLFSCHFSKDASLINLTLSENLSSWSPLILNIFFPHIIIFKLVHDSSILVSYPHLSCVHSVRISPSVNSSYAFPALTGIHNVVLQVTEVYNFSQDDLMTEDIFILDCHSEIFVWVGQQVDSKSRMQALTIGEKFLEHDFLLEKLSHVAPVYVVMEGSEPPFFTRFFKWDSAKSSMLGNSFQRKLTIVKSGGAPVLDKPKRRTPVSYGGRSSSVPDKSSQRSSRSMSVSPDRVRVRGRSPAFNALAANFENPNARNLSTPPPVIRKLYPKSVTPDSAILAPKSAAIAALSSSFEQPPSARETMIPKSIKVSPVMPKSNPEKNDKENSVSTRVESLTIQEDVKEDEIEDEEGLVIHPYERLKITSTDPVPNIDVTKRETYLSSAEFKEKFAMSKDAFYKLPKWKQNKLKMAVQLF

SEQ ID NO: 145390 - protein, 218 aa, Glycine max
  Coding DNA Sequence Number=SeqID_28612
MVLAKGESLPAYSRYCRMPTDIREIEVALCIPGQGFILNVEGHPGKILRKDLTTLAQVWSVLSYSNLALTSHTSDLTMDRARLIFGLVTQLDMNVRALISGQITSMAQSNSSKLGFPALIIALCRTRGVTSNTLVFECLSRVINLAYIRKNCWNPDDPTIIIRGARRPRARTAEALSTSAAPPPARIVAALSTLPPANFQCFEAYIRGRLFCCKVSRW

SEQ ID NO: 145391 - protein, 126 aa, Glycine max
  Coding DNA Sequence Number=SeqID_28613
  Gene Ontology: Mol. function=DNA binding; Biological process=DNA integration
MKLLIFHKLAKFIQNEKGHNTVSIKSDHGGFQDKDSGLKGETKVEELEQSKEITATPPKELLREWRTQKDLSLDNIIGEISKGVSTYSRLKILCNNMAFVSQIEPINIYEALYDEHWLMAMHEELN

SEQ ID NO: 145392 - protein, 252 aa, Glycine max
  Coding DNA Sequence Number=SeqID_28614
  Gene Ontology: Mol. function=DNA binding
  Homolog annotation: Hit_ID=Q1S0F5; Match level="QueryCoverage=95%, HitCoverage=47%, E-value=6e-28, Identity=34%"; Hit description=IMP dehydrogenase/GMP reductase
MVEEFEEILGCPLGGRKPYLFAGFYPSLARISNIVQISAQELDHRKQVENEVVGILRKYLEAKARILAGKGEWAPFIDILALLIFGGVLFPNVDGLVDLEAIDVFLAYHNHKESPVVAMLADLYDTFDRRCEKSNTRIVCCTLALYVWLVSHLFRQEVRHACPLESHRSCTEKGGANWDQLLANQEGASINWFPRWKERRVGVLISCGGFLNVPLMGTGGCISYNPVLAIRQLVYPMRGAPLEEELAPVISR

SEQ ID NO: 145393 - protein, 93 aa, Glycine max
  Coding DNA Sequence Number=SeqID_28615
  Subcellular localization annotation: CTP_CleavageSite=66; ConfidenceScore=5.03e-01
MARSVSAPCPYSRDLYGRQLKGLLVIIPRVVISLLMVSRVPSGVATCRNLPFGGRAKRDSRVRVPRKEYVRSRHQRLFEENVGKNGKDVIYEL

SEQ ID NO: 145394 - protein, 498 aa, Glycine max
  Coding DNA Sequence Number=SeqID_28616
  Gene Ontology: Mol. function=transcription factor activity; Cellular component=intracellular; Biological process=regulation of transcription, DNA-dependent
  Homolog annotation: Hit_ID=Q7N443; Match level="QueryCoverage=50%, HitCoverage=99%, E-value=4e-69, Identity=50%"; Hit description =Similar to hypothetical transcriptional regulator YgbI of Escherichia coli
  Pfam annotation: Domain name=DUF1670; Domain location=193-367; Score=- 107.1; E_value=0.073; Accession=PF07900.2; Description=Protein of unknown function (DUF1670)
  Pfam annotation: Domain name=DeoR; Domain location=317-473; Score =155.7; E_value=1.2e-43; Accession=PF00455.13; Description=Bacterial regulatory proteins, deoR family
  Pfam annotation: Domain name=GntR; Domain location=247-299; Score =0.9; E_value=0.05; Accession=PF00392.11; Description=Bacterial regulatory proteins, gntR f
  Pfam annotation: Domain name=HTH_11; Domain location=247-298; Score =35.9; E_value=1.4e-07; Accession=PF08279.2; Description=HTH domain
  Pfam annotation: Domain name=HTH_5; Domain location=244-292; Score =6.1; E_value=0.091; Accession=PF01022.11; Description=Bacterial regulatory protein, arsR family
  Pfam annotation: Domain name=HTH_DeoR; Domain location=247-303; Score= 47.1; E_value=6e-11; Accession=PF08220.3; Description=DeoR-like helix- turn-helix domain
  Pfam module annotation: Pfam domain module=DUF1670::DeoR::GntR::HTH _11::HTH_5::HTH_DeoR; Domain location=193-367::317-473::247-299::247 -298::244-292::247-303
RQHAHQLPARQLRLYVALRAVAETVTAGDRINNHVALIERQRARHIDLIHRPDAAAAARRAGNRVTPPRSSAVWASAAWRSYLSVRGAVANPGVIAAADDIHQIVIHRNFQTELRIGRHKARQDRPKQQLPGITRDVQIVQRQLNLRKAGFQMAQKSGTGVRRHHRPAGAVEQAHAKTRFKTAQRVADGRRGDPEFQRGEAETLAPANQQKNIQIGHEAAVPDAMRAWHGRQNVTVNPELIMLPEDRKDAIYRYLFAKRSATIHELATLMAVSAMTIRRDIKFLQDAGLVVSIHGGVRLPAVVHQALPYVEKAQLNVHAKQSLGRYAASLVEDGQVVYLDAGTTSYEIARALGDQVSLTVLTNDFTIAAWLMRHSHITLFHTGGKVDKRHIASVGAMAATALAAFNIDLAFLSASAWDVTHGLSTPDENTLLVNQAVLAASAQRYLVADSSKYGRYSVYSVCKLQQLDGVITDDDCPCAAVEEMKQRDIRLHRVNRRG

SEQ ID NO: 145395 - protein, 200 aa, Glycine max
  Coding DNA Sequence Number=SeqID_28617
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=P69829; Match level="QueryCoverage=78%, HitCoverage=96%, E-value=4e-70, Identity=84%"; Hit description =Nitrogen regulatory protein (Enzyme IIA-NTR) [Includes: Phosphotransferase enzyme IIA ...
  Homolog annotation: Hit description=component (EC 2.7.1.-) (PTS system EIIA component)]
  Pfam annotation: Domain name=PTS_EIIA_2; Domain location=51-195; Score=196.5; E_value=6.1e-56; Accession=PF00359.12; Description =Phosphoenolpyruvate-dependent sugar phosphotransferase system, EIIA 2
MGRVTAPFCHLRKRLQSPALPVRGVPVRALRLCEHASETMMNNDLTLELSAVLSLDCTRSGVHCQSKKRALEIISELAAKQLNLPHQTLFEAILTRERMGSTGIGNGIAIPHGKLEEDTLRAVGVFISLDQPIAFDAVDNQPVDLLFALLVPADQCKTHLHTLSLVAKRLADKTVCRRLRAAQSDEELYAIITEAQEDHA

SEQ ID NO: 145396 - protein, 269 aa, Glycine max
  Coding DNA Sequence Number=SeqID_28618
MYKARLVYGLVSGMDMNIGALISGQISTIAQSNSSRLGFPALIIALCRAIGVTSDSLTYESLSPAINLAYIKKNCWNMDYLIVNFKGARKVRARLIDIPSSSTPFAPSTSATHTPVPPTSATLAPIAQDSQFFEAMLQSIHQGHILLLQSLQVVAPPGSILSVEQFIEKVSWPRTLPSVVREGEGPSAQVPQQVQDESYEVTIPEAFDFSGAGVEMRPDEVIPPKPIVPIIHETFEAGESQLRQEAATPERTPQTPEGPLSPGMDLSFA

SEQ ID NO: 145397 - protein, 73 aa, Glycine max
  Coding DNA Sequence Number=SeqID_28619
MQKSGPVPVPTDEVSLVGQALHTFLAWSTHLVKSLSQQRFEQLKNPRKKSEQHTSNSMINNEDLLTIYIYFTN

SEQ ID NO: 145398 - protein, 319 aa, Glycine max
  Coding DNA Sequence Number=SeqID_28620
MKGYDYKSLRTLVLDDQSLGGSNFVGDDFVVGVGKLVQQDQIIDLTNQTMQFDKEKEKEKEQDKGNEQEKKQALDSNVNLIAQVDNGGNENNKLDLNVQVKNNGKKTTFEVPNPSPLPQDMQVAPNIVLLWNVDLTGPHACYSLELERIVVVSNEKIRVMHEQLKIMKANVSKTKQLGIALAKSKELVTKLKIDLDEHVSSISTKCMENDTLSIRVVALKKVVVYAKVKFDNSSQFIVKKAKSKSAKEEKKSVKDKLTSTNVELVNLKQTVAKLESELQDKDKAKSDLIFELEEIVRESQPYSNEEEEEKNEVDSTMAS

SEQ ID NO: 145399 - protein, 364 aa, Glycine max
  Coding DNA Sequence Number=SeqID_28621
  Gene Ontology: Mol. function=RNA-directed DNA polymerase activity; Biological process=RNA-dependent DNA replication
GYATILVKIKDLDPGVALHSMITALKPGPFADKCVALKDKIEELILEGALNNYIYNPNNNMGGNQGEKQEHGGNKPEQSNQATGGNGVRRGVINTITGAQHMAKKSLPPITFTNEDFVGVDPNQDDLMVIIIRIANWDVKKVLIDQGSLTRVLFLSAFKRLDISLKLIKPHQEPLLGFTKGQVHTCDYVELETTFGVGKLSQIVLVQYIIVDANTSCNILIKRPSLDALGAIPPSFSLPCITSNKKVKVVDVNHVVELYPIDWVDFESRNEEDKKPTTIEELNSFQVGKEPHKCTKIRKEMDKDLKRKIEEVFKQFVCLKKLNEEKKRVVQEEYEKLIKARFIKEVKYSTWHADMAMVKKSNGK

SEQ ID NO: 145400 - protein, 94 aa, Glycine max
  Coding DNA Sequence Number=SeqID_28622
  Subcellular localization annotation: CTP_CleavageSite=43; ConfidenceScore=5.19e-01
MFFSVKNMIFQSSSLQTLTQTLTPSYPPPTTTGGHHKPPLLVVGSPHEEEHFNQRGILKIHLKDLIEKQALNPFFHNISENYAFGPTNMNVRGL

SEQ ID NO: 145401 - protein, 52 aa, Glycine max
  Coding DNA Sequence Number=SeqID_28623
MARKCNINIQYEFNNPALEVHALLSLNITTKKVKSPLLQICGRDPTVNKMEA

SEQ ID NO: 145402 - protein, 116 aa, Glycine max
  Coding DNA Sequence Number=SeqID_28624
MVDEVLKVQIDGFLHDIKIVEDPNFRCCSIGNSQSSSNSSLMVDLDIEAGFMLEEFDSDNGIVTLFEGPKMMTKSPKNDFKNESTSSRSSLISSFMRRNQEDSRIKRRLISRFKRR

SEQ ID NO: 145403 - protein, 288 aa, Glycine max
  Coding DNA Sequence Number=SeqID_28625
  Homolog annotation: Hit_ID=Q1SL66; Match level="QueryCoverage=83%, HitCoverage=36%, E-value=6e-57, Identity=48%"; Hit description =Aldehyde oxidase and xanthine dehydrogenase, a/b hammerhead; Membrane attack complex ...
  Homolog annotation: Hit description=component/perforin/complement C9
  Pfam annotation: Domain name=MACPF; Domain location=157-284; Score= -29.0; E_value=0.0024; Accession=PF01823.10; Description=MACPerforin domain
MGEHVAAVHTATNALQALGRGFDVNFDTRLLYCKGVSGSRVVEIDEEHRRELWLYEDVAVPDVSRDIGCYQEAMVRQSSGVRSFKEYRGHIFGVFDEFNSGYELLFMIVDKRWSWCNEIEMVEYFNERANVSGKFPIGSFNSAFSFTGSKHVDEAATKTLSSDGFYIPLAKVQLQKSHLRLQGNVKKAVPVNWDPLSLASFIENFGTHVITSITMGGKDVIYVKQHHTSPLSKLEMKNYIQDIGNQRVLIPFHSIVKGFIPNPRLQHILLGKKYVMVVFTIISKIMAI

SEQ ID NO: 145404 - protein, 356 aa, Glycine max
  Coding DNA Sequence Number=SeqID_28626
  Homolog annotation: Hit_ID=Q1SL66; Match level="QueryCoverage=99%, HitCoverage=57%, E-value=1e-124, Identity=62%"; Hit description =Aldehyde oxidase and xanthine dehydrogenase, a/b hammerhead; Membrane attack complex ...
  Homolog annotation: Hit description=component/perforin/complement C9
DVTVIFRRRGGDDLEQNHSKWLSTIKSSPDIIEMTFCPITDLLDEIPAKEHLTRAIGLYLEYKPPIEELTYFLEFQIPCVWAPLQDKIPGQQRKEPVCPSLQFSIMGQKLYVSQEQVKHPEKFVHRFKKFSVSHWCLVAKFIYILATWITVGRRPVTGLHLCLEGSKQNRLSVHVQHLVSLPKILHPYWDSHVAIGAPKWQGPEEQDSRWFEPVKWKNFSHVSTAPIENLETFIGDFSGVYIVTGAQLGVWDFGSRNVLYMKLLYSRLPGCTIRRSLWDHIPNKPPKTVNAGNTSNLDNSTLKENATGNKLVKYVDLSEMTKGPQDPPGHWLVTGGKLGVEKGKIVLRVKYSLLNY

SEQ ID NO: 145405 - protein, 174 aa, Glycine max
  Coding DNA Sequence Number=SeqID_28627
  Gene Ontology: Mol. function=transition metal ion binding; Cellular component=cytoplasm; Biological process=DNA integration
MIRDLGQKSFQQEHAPMYDTLQTDSKKPLYPGCKNSLKLLSVVLSLVNVKARYGWSDKSFSSLLQVVHNILPKENTLPKSYYQAKKILCPMGMKYQKIHACPNDYILYKHEFHEMHKCPRYGVSRYKVKDDDECSSNENSKKGPPVKVLWYLPIIPRLSVCLLMETMQKTLHGM

SEQ ID NO: 145406 - protein, 113 aa, Glycine max
  Coding DNA Sequence Number=SeqID_28628
  Subcellular localization annotation: CTP_CleavageSite=41; ConfidenceScore=5.31e-01
MPWPTVSQGFIMPLPIPSKANTIKKSGNLISNVQPNQIKTTVELLSNGLNRVKEGGVNLQGCWCDKDATTRVQAQSSRAHRHHPDPPLLVVVFVREGEEGEKGKKDKRKKVMT

SEQ ID NO: 145407 - protein, 67 aa, Glycine max
  Coding DNA Sequence Number=SeqID_28629
MKTPQSASKLKSCLSVICARCDFEPRKGKKVKVREKKKGGNKEEKRKVVDVLESHSMLENDHDEGEG

SEQ ID NO: 145408 - protein, 238 aa, Glycine max
  Coding DNA Sequence Number=SeqID_28630
  Gene Ontology: Mol. function=monooxygenase activity
  Homolog annotation: Hit_ID=Q6D2J8; Match level="QueryCoverage=66%, HitCoverage=46%, E-value=2e-65, Identity=77%"; Hit description =Monooxygenase
MRIGQGVVAVMCQVRIPVETIRIPHRQRQHAKQLIKVRQARRMAMNQLMLQRQIPGRQFAAPEPAARQLMHHFALLRTEDVLLQSIDLAVAAEELGADGAYFRVHHFARQLSSPFPLLAAVGAKTSRIEIGTGVIDMRYENPLYMAEDAGAADLIANGRLQLGLSRGSPEQVIEGYRYFGFNPREGETDADMGRRHTEELLEVLRGEGFAKPNPQPMFPNPPGLLRLEPYSEGLRERI

SEQ ID NO: 145409 - protein, 169 aa, Glycine max
  Coding DNA Sequence Number=SeqID_28631
  Homolog annotation: Hit_ID=UPI00005F9459; Match level="QueryCoverage =61%, HitCoverage=40%, E-value=7e-26, Identity=55%"; Hit description =COG3221: ABC-type phosphate/phosphonate transport system, periplasmic component
MAPAVPESQLSFCTSRSARFTLGFRVAGYGEWMKRFWRQPIDVNAHPGHHKDAQNAHHLFTDAEVQWHEDLLPHWRDDNLLLSQTCGYPLVALLPDVQLVGTFQSNAPGCHDLRYRSWLVARQEDENLSLVDFRGRRAVCNSNDSHSGYNSLRYVVAPLVQDGKFFATT

SEQ ID NO: 145410 - protein, 315 aa, Glycine max
  Coding DNA Sequence Number=SeqID_28632
  Homolog annotation: Hit_ID=Q10MP8; Match level="QueryCoverage=65%, HitCoverage=32%, E-value=4e-51, Identity=53%"; Hit description =Transducin family protein, putative, expressed
MQAYLCRRRLQTEQQATDTRCCLSETKLFVGEEGGLHVKPLTIQSRVFERTVVVLERLQSCGLHLKPPTIQRRGSVRCMLFTEEGKYVLSSAIGERYVAVWRIEGAKKQSASCVLAMEHPAVFLDSRCIDSGEHDEVGICVLAISEIAICYLWFGNSIEELCNTKPTKISLSLEGMPSRNYKGALPAIYAAKLQGIQKPASGQVFLVYGLLVKPSFRKILVHSGADIKLNVSHDGVLLPMSQSLVKYKKGTNAQTATALDRANAEEALLPIPKVFDSHEKEKAFQNSLDKDVIDDFHRSSKDDSVEIEGIDMIFS

SEQ ID NO: 145411 - protein, 129 aa, Glycine max
  Coding DNA Sequence Number=SeqID_28633
MWKSRTLICVAKLYSGFDNESPRSKVVESLWQDPDVNDSGLTEGSETEEDVGFHSDEEDIGINGQPISEDSLHLSSFDLHLQHNLSKEEIDSQRNRKFSWETPAIGMSNCKWIGVEANDFDVLMMIMMI

SEQ ID NO: 145412 - protein, 93 aa, Glycine max
  Coding DNA Sequence Number=SeqID_28634
MKPSSQVEVEVDGMVVKLLGPWLVVVGLMFIQGERSSCGEDHTLSGEKCYIMSLWMLSLMSRLRGINMIAYYGILMPQALSQWPPPIGSFFNP

SEQ ID NO: 145413 - protein, 81 aa, Glycine max
  Coding DNA Sequence Number=SeqID_28635
  Homolog annotation: Hit_ID=O22633; Match level="QueryCoverage=76%, HitCoverage=79%, E-value=1e-19, Identity=71%"; Hit description=NOI protein
  Pfam annotation: Domain name=NOI; Domain location=12-81; Score=97.8; E_value=3.3e-26; Accession=PF05627.2; Description=Nitrate-induced NOI protein
MERVYTMDIKPLNSEKGRPLPKFGEWDVNDPTSAEGFTVIFNKARDEKKTGGNPDSPGKTATDPHSKPAVEPGKTQTVRCS

SEQ ID NO: 145414 - protein, 102 aa, Glycine max
  Coding DNA Sequence Number=SeqID_28636
MTTFKCYFLAKKRKGDEVGQRWNGTVETVAFKAEAVELGEGGEVENGVGEVEVFKDEAGNMVVVVVVEVGDFMLGLLAVQRTTCFISLKVLVLANGTVLFVI

SEQ ID NO: 145415 - protein, 375 aa, Glycine max
  Coding DNA Sequence Number=SeqID_28637
  Gene Ontology: Mol. function=transition metal ion binding
  Subcellular localization annotation: CTP_CleavageSite=51; ConfidenceScore=5.20e-01
MVTLPRSPLQSDGNLEPQPKKTPQSPRLRRLTLRSLDQPRPIVNVDPATGRASGPEKQKFHSFLGVVAREKIPIVHSNWKNVPETLKDMAKFDIPEAEKAKKKVMSTMGTRWRQFKSSLTTKFVYADTQAGQEENPSVKYGMDKQTWDEFVASRKTPDWQEIRKKAKESQKYNDCPHVLSRGEEQMTQGSFVPHGRDDILNMAIGKPEHLGRVRAAGSGMTLTQFYGRATRTSSSSSATLMQQQWVDIIGNIKEQVRNEYEEQHKRSLEEFKKELSSQIFIQLSQMGSQYSPLIEVDLQALAARLSTKGSNVETADVDPSGDKNVSLKPTMGLYVQRQHTTVLVALGKICEGGSAIHNVTDADDVVRVSVDKVIE

SEQ ID NO: 145416 - protein, 500 aa, Glycine max
  Coding DNA Sequence Number=SeqID_28638
  Homolog annotation: Hit_ID=Q4WTH1; Match level="QueryCoverage=25%, HitCoverage=18%, E-value=6e-25, Identity=44%"; Hit description =DUF1253 domain protein
  Pfam annotation: Domain name=DUF1253; Domain location=159-500; Score=- 85.8; E_value=2.1e-11; Accession=PF06862.2; Description=Protein of unknown function (DUF1253)
MEDLQRLTIHVQQQDMWSWEGDSCGRYTVRSAYEFLNRNLLLESQDETFKALWEIKVPSKATIFACRLIRERLPTKNNLRKRNVETNDVTCPFCRSHDQDKAHLFFTCANILPLWWESRSWVNVVGAFSENPKQHYYYNISGLRPQRWQTWWIALTCFRLDGYLAVSQIFGDLIQVLILLPLASIVYRVVKRLIQLTPSAYMVNVEHMDRFSTKFGSEEHKGDIENGKESENAKPHKSSKVADFQILFGVCPPMLFVVIFSIGEWWMPGIDVGTVGVPNNNKSLIPLGKVGYMGHFMTFSSVKDKIFRDIIFHEVSLISFSQCHSWKTVKLFSDFHTSDIIIALALCLVNKIEEAGSNKEKDVDFLSSLEVLIIDHADVTSMQNWYHVHTVIEHLNRLPSKQPGTDVMRIRPWYLDDHSRFYRQTVILGFYSNPDVNASFNHQCLNYEGKIQVPLHYRSLHWILVELQFSINGIVLFTILLLAAETASTLADMMEDGRMI

SEQ ID NO: 145417 - protein, 114 aa, Glycine max
  Coding DNA Sequence Number=SeqID_28639
  Homolog annotation: Hit_ID=UPI00004C0A2C; Match level="QueryCoverage =54%, HitCoverage=8%, E-value=8e-07, Identity=41%"; Hit description =PREDICTED: similar to dJ434O14.5 (novel PUTATIVE protein similar to YIL091C yeast ...
  Homolog annotation: Hit description=hypoyhetical 84 kD protein from SGA1-KTR7 intergenic region)
MIGVLPRINDLDQIRGVQNLIIYSLPERKEFYPEIVNMLDGSDNMTCTALFSYLDKLRLERIVGTTPAKRMVVAEKVASWISICDHGCQEALENDFDEKMSGKIVLPRMLMSGK

SEQ ID NO: 145418 - protein, 140 aa, Glycine max
  Coding DNA Sequence Number=SeqID_28640
  Gene Ontology: Mol. function=pyridoxal phosphate binding; Cellular component=mitochondrial matrix; Biological process=arginine metabolic process
  Homolog annotation: Hit_ID=Q38IW9; Match level="QueryCoverage=80%, HitCoverage=24%, E-value=5e-57, Identity=95%"; Hit description =Ornithine aminotransferase
  Pfam annotation: Domain name=Aminotran_3; Domain location=1-140; Score=-119.9; E_value=1.3e-05; Accession=PF00202.11; Description =Aminotransferase class-III
MNLFTHGHLFQAIIVSCCGCFHGRTLGVISLSCDNEATRGFGPLLPGNLKVDFGDVEALERIFKEKGEHIAVFILEPIQGEAGVIFPPDGYLKVVRDIGSKYNVLMIADEIQTGLARTGKMLAYIAHVYSKFIGPLPGES

SEQ ID NO: 145419 - protein, 105 aa, Glycine max
  Coding DNA Sequence Number=SeqID_28641
MFSPPAVGRNNNGFSSSYSGKVEQEPPTNDSSTHHGHGRHHHDEELDLELRLGNNNWNFFVFPFSSTNINCAPVAAIWLEEMVKKRKEKGAPRTVKKRKKKTTHM

SEQ ID NO: 145420 - protein, 73 aa, Glycine max
  Coding DNA Sequence Number=SeqID_28642
  Gene Ontology: Mol. function=protein-tyrosine kinase activity; Biological process=protein amino acid phosphorylation
  Homolog annotation: Hit_ID=Q9T020; Match level="QueryCoverage=70%, HitCoverage=5%, E-value=3e-11, Identity=61%"; Hit description =Putative receptor-like protein kinase
MAQGLCCYLSLQEMKQATKNFDESNVIGVGGFGKVYKRVIDNGFKVAIKRSNPQSRSCTLFEEGSFGYFNSQL

SEQ ID NO: 145421 - protein, 159 aa, Glycine max
  Coding DNA Sequence Number=SeqID_28643
MGTRGCINYNPVLAIRRLGYPMRGAPSEEGLTPFITRGFNSTNTGVLQRVHKAWEISQRKYKELRGSSNGPIDSYHRWLKAYAQDLDWLLSLRNTKGVEIETPEEDEEENAELRDVNIAPTKALEQETKSNSELKLRREERDQSRVDGLIPKDELRVCL

SEQ ID NO: 145422 - protein, 334 aa, Glycine max
  Coding DNA Sequence Number=SeqID_28644
  Gene Ontology: Mol. function=nucleic acid binding; Biological process= DNA integration
MKFWLTELDLYSVISKREIKTSTSSTDIVQTDATIKHDVSDKDILCHGRILSALADNIYKIFCHTKTSVELWEALELKYGSAEKGLSRYSCEKMIEFQMIDGKSISDQIHEFENIVYDMKLKGIVLPDIMLVAFMISKLPPSWTDFARSLKHKHESFTFDDLLVCLHIEDKHRSSQKHLQKSDSHSKAYLVESSSKPFSKSFKRHGFNKNKFGRKPSFSKNKNNAFNNNNKPKDKNLGNEIFCFVSGRANHLAKNCFQRHRQPTSFPKPQANVVTTNATSDSPSDKLRGSCSLIKHTYCEHGEWEYGTCVRRRSSEARAIFGKLYCFRWCLSYF

SEQ ID NO: 145423 - protein, 183 aa, Glycine max
  Coding DNA Sequence Number=SeqID_28645
  Gene Ontology: Mol. function=RNA binding; Cellular component=voltage -gated potassium channel complex; Biological process=regulation of translation
  Homolog annotation: Hit_ID=Q4KSL4; Match level="QueryCoverage=64%, HitCoverage=23%, E-value=2e-41, Identity=47%"; Hit description=PUF -domain RNA-binding protein
  Pfam annotation: Domain name=PUF; Domain location=100-131; Score =32.5; E_value=1.4e-06; Accession=PF00806.9; Description=Pumilio -family RNA binding repeat
  Pfam annotation: Domain name=PUF; Domain location=55-89; Score=44.1; E_value=4.6e-10; Accession=PF00806.9; Description=Pumilio-family RNA binding repeat
  Pfam module annotation: Pfam domain module=PUF::PUF; Domain location =100-131::55-89
MTEGETSNKGRQSLISEEQRLSENKGRWSPENKEKGAQHVLERGKPQERSQILSKLSGHIVQLSQHKFASNVVEKCLEYGDATERELLVAEIFGHDDQCDNLLTMMKDQFANYVVQKVIDICSENQRAMLLSHVRIHAHALKKYTYGKHIVARLEHQFGGVYSSTLVDKIEILVLFGILVTYN

SEQ ID NO: 145424 - protein, 753 aa, Glycine max
  Coding DNA Sequence Number=SeqID_28646
  Gene Ontology: Mol. function=RNA binding
  Homolog annotation: Hit_ID=Q9M6S0; Match level="QueryCoverage=100%, HitCoverage=93%, E-value=1e-134, Identity=39%"; Hit description =Pumilio domain-containing protein PPD1
  Pfam annotation: Domain name=PUF; Domain location=661-695; Score =35.4; E_value=2e-07; Accession=PF00806.9; Description=Pumilio-family RNA binding repeat
  Pfam annotation: Domain name=PUF; Domain location=697-731; Score =41.3; E_value=3.4e-09; Accession=PF00806.9; Description=Pumilio -family RNA binding repeat
  Pfam module annotation: Pfam domain module=PUF::PUF; Domain location =661-695::697-731
MATESPIRISEAGGKWPSHKEAAAFGSLSRNMATEDLGILLKGHRYQGGGKDVAPNRSGSAPPSIEGSFLAIENLLPQHNTTQNASFANLSSAMQNCESEEQLRADPAYLAYYNSNVNLNPRLPPPLTSWENRHLGRHIISFRNNWRMSTTDDSGKSSLHLPQRTLSTHKEESEDDSPQQPYDHELVKASGIWRSPDAASLASQHKNMVDLIQWVVITIMEDFPRTMSPVYNKSLSVSHGLVDKPIDLEAGSSSSHGPPVTTIKAGKPTIGADDIRVSSSVDTHAPVASSSSLESTGSIGVSDIATVESQLKALGVSNVPNSESLSYEEKWKASYQNNLMRHPGFQQQNNPYDVPSANSQNLNSVYVGREQFPFNSSKFSNVQPLLQSSGFTPPLYATAAAYMSSANPFYTNMEASGIYTPQYVGGYTVNPTAFPPYTAYPPHGVLPLVVDGATSSNYTPLTPGVSIGGNISHGAEMVQTNKYLGQFGFPPQPSFGDPMYMQYHQQPFVEGYGISGHFDPLAPRASGVSQISPYDSQKRSSTGAYLDDKKLTDQRTSANMNSRRGGVSIPSYFGHMPNMGFVMQYPSSPLPSPVLSGYPEGSPGLPGVRNEIKLSPASGRNGGVISGWQGHRSFDSAHDPKMVNFLEDLKSGKGRRFELSDIIGHIVEFSSDQHGSRFIQQKLESCSGEEKALVFKEVLPHASKLMTDVFGNYVIQKFFEYGSSEQRRELADRLVGQILPLSLQMYGCRVIQK

SEQ ID NO: 145425 - protein, 74 aa, Glycine max
  Coding DNA Sequence Number=SeqID_28647
MRDTRIRVVRVVVQVEGKLRELEKNKKKKTKKTVMGQLKTEQGIRGRFVRYKPTRNKTLEVGTKPGFRILRTMA

SEQ ID NO: 145426 - protein, 231 aa, Glycine max
  Coding DNA Sequence Number=SeqID_28648
  Gene Ontology: Mol. function=transferase activity
  Homolog annotation: Hit_ID=Q1T1H8; Match level="QueryCoverage=72%, HitCoverage=54%, E-value=6e-59, Identity=69%"; Hit description =Glutathione S-transferase, C-terminal-like
MDQIPYFEVGDSVTYNNEKEGIIECLKRNVDDDLDTGVSSLPDWITTKVMLTTWLADALEYELWVGCDGSSAYNIYYSDLPWPIGKILFWKKAYWVNQKHGISKDNAEVKEEEIYGRANSAYDALSTWLGEQNFLFENRPSSLDAIFLAHALVVLQALPELMLKKILFKKGPSARGLQVLPSGIREEWGFDICSLTPGSQEAVYKMGTHGIQFTRQQPYHCTKACPQLYVI

SEQ ID NO: 145427 - protein, 69 aa, Glycine max
  Coding DNA Sequence Number=SeqID_28649
MEMQCKRRRWKEGRRESKRNKRKAGKDGTYIALEVSLKSRWLMKAGHQRAGLEHYQKLLPFWLSDQHIG

SEQ ID NO: 145428 - protein, 172 aa, Glycine max
  Coding DNA Sequence Number=SeqID_28650
MYHENMMIHEKYACSKWFFRPSKVDIVIEIKISAAKNYHKINQDVHLSSGDGGSPMVLGGSGYGYTVDLSDDGVFGGCLGHGCGLEVADLSCFRRIWVTKLDGGHAHSVVVWMVLGIVGVYGLWWLSAKVRIERFEVGPESVRKAHLLVVHLRPDVKKLNLRVGVLMWLKWD

SEQ ID NO: 145429 - protein, 942 aa, Glycine max
  Coding DNA Sequence Number=SeqID_28651
  Gene Ontology: Mol. function=RNA-directed DNA polymerase activity; Cellular component=chromatin; Biological process=chromatin assembly or disassembly
  Pfam module annotation: Pfam domain module=RVT_1::Retrotrans_gag; Domain location=479-648::103-193
MADHTTRKTTTDRLEEAIARLTSSQVSISDKYSDLAGKVDSILDHLRLRETSHTQLSSNPPFNHRSSIKHDIPRFDGRDPLGWIFKIQQMFDYQNTPEEERITVASFYLNGAALSWYQWMFSNGFITSWTGFLQALESRFAPSFYEDPKGALFKLSQKGSVNEYLTEFKRLANRVIGLPPPFLLSCFISGLSPEIKREVLALQPISLPQATALAKLQEDKLRDRRSTSSRSFNPPLPAHNPPNQPQKPRQPFVQRTPEEMAFKRDKGLCYNCDEKWHSGHRCKGKIQLFIAENPASDLTEPEQPSISKITEPISDDPETNCSHFLHLPTKPTLPLRVLVGNGSVLDCNEVCPNTQLFLQGHSFEITFHLLPISGADAVLGSTSTLFHLSIITTSPITPPPSTLSHPIPEINTLLHQYQQLFQPPSTLPPPRQVTHHINLLPGTSPINVRPYRYPHYQKSEIEKQVSELLSSSLIRLSTSPYSSPVLLVKKKDGTWRLCVDYRALNTATVRDRFPIPTIDELLDELGSASWFSKLDLRQGFHQISMHEPDIEKTVFRTHHGHYEYLVMPFGLSNAPSTFQAAMNGLLQPFLRRYAAVFFDDILVYSDSLPAHIEHLQDIFKALLRDQFYLKQNKCLFAQRKLEYLGHLVSGNGVEPEPSKVQAMTQWPTPSSAKDLRAFLGLTGFYRKFIKHYASIAAPLTTLLRKDAFEWSLNAQTAFDQLKRAMTSAPVLALPNFAEPFVVESDASTTTMGTVLLQHGRPIAFFSKLFNPRLLLASTYIRELHAIVVAVRKWRQYLLGRPFTIMTDHKSLRELMTQLLGFDYTIQYKAGTANTVADALSRIPQDSGQLLLLSVPHLDFMDDIRRTLYDNPEFQQLISRIRSNPSDHPEFCIHRDLLFFKGRIWLNKDNPSIPSHLLEHHSTPLGGHMGVTKTTYRLETSFF

SEQ ID NO: 145430 - protein, 47 aa, Glycine max
  Coding DNA Sequence Number=SeqID_28652
MDSVRSKFLTMKSYLWGGKACEAKGVENGKGRRRERNEELKGYLVKK

SEQ ID NO: 145431 - protein, 104 aa, Glycine max
  Coding DNA Sequence Number=SeqID_28653
QNRGGACHPARPGEQGCFLQKQQLSGGRIWKAQVGQIAISFEEVTETHGLRKNTFFRFPPHHGISRIALACFLLISDTSRDFIYCATKDAKYLKAANQRLHVNK

SEQ ID NO: 145432 - protein, 55 aa, Glycine max
  Coding DNA Sequence Number=SeqID_28654
MQIGEASASVVKEVVGSSKLSIWQEVHHYKLKSLDVIHQAEAERGAYEEMDTTVE

SEQ ID NO: 145433 - protein, 124 aa, Glycine max
  Coding DNA Sequence Number=SeqID_28655
  Gene Ontology: Mol. function=hydrolase activity; Biological process =antibiotic biosynthetic process
  Homolog annotation: Hit_ID=Q2CJE9; Match level="QueryCoverage=100%, HitCoverage=15%, E-value=2e-26, Identity=51%"; Hit description =Penicillin acylase
MAPEWKAYGAHAEEICSAFANGINTYIDACDAGSIPLPPEFTLLGHRPDRWKAEDVVRVRTHSLTRNASSELLRSKVMAAVGSELGARLDGLRKQLSHGVVSKPVDGFDPAIMTDRVLRDFNLA

SEQ ID NO: 145434 - protein, 494 aa, Glycine max
  Coding DNA Sequence Number=SeqID_28656
  Gene Ontology: Mol. function=transporter activity; Cellular component= periplasmic space; Biological process=transport
  Homolog annotation: Hit_ID=UPI0000669CD1; Match level="QueryCoverage =99%, HitCoverage=92%, E-value=0.0, Identity=64%"; Hit description =probable ABC transporter, periplasmic binding protein
  Pfam annotation: Domain name=SBP_bac_5; Domain location=37-417; Score= 223.0; E_value=6.8e-64; Accession=PF00496.12; Description=Bacterial extracellular solute-binding proteins, family 5
MHSDLRILDPIITTAHITRDHAYMIYDVLIAVDENFKPQPQMADWTVSDDKKVYTFTLRDGLKFHDGAPVTAADAVASLERWSKRDAGGQLIMDITDSLKATDDKTLVWTLKEPFAPFLDTLAKQAALPPFIMPARIAATPADTAITEHIGSGPFKFVPGEFQPGVGVSYVKNEDYVPRKEPANWMAGGKVVNVDKVRWVTMTDAQTAVNALTSGEIDYIEQVPVDLVPLLEGDDSVVLEQRDPLGYQTMGRLNFKHPPFDNPDIRRAAFLAMSQEPVLAALMADPNYYKVCGAIFGCGTPNATNVGSESITGQGNIEEAKALLQKAGYDGKPVVLMQPTDVTSLSPQPVVAAQQLRAAGFNVDMQPMDWQTLVGRRASKDEPSKGGWNIFFTNWQIPEIWTPLNSVMLNGRGDQGWFGWPQDDKIEALKKEYISAQTPEDQKAVVEKIQAHTLENVLYIPLGEYNPPQGRRANIVEMLGSPVPVFWNVKKNEE

SEQ ID NO: 145435 - protein, 91 aa, Glycine max
  Coding DNA Sequence Number=SeqID_28657
MGLSGACITTYGAFHAILVHCFVNINKGCDQVFCIDPLFVRRQRVIACRVMYANRVCDPGLVVCSQCPKRALVVQVHGRYNTVKSCFGASN

SEQ ID NO: 145436 - protein, 99 aa, Glycine max
  Coding DNA Sequence Number=SeqID_28658
ESIDEEDPRPTSSNGACISMGHNQKRKWALLAPLKRRHPKQKNSEALPLSHAAFFFSSSSTIVAQQSSNLWPSFLLQITKGGHFRSREVRVYEWDFEIS

SEQ ID NO: 145437 - protein, 101 aa, Glycine max
  Coding DNA Sequence Number=SeqID_28659
MFNNHRHGIRKVSGCFGEKPSKNTKMGVYLAKWGCVNRLLQPNFIRGLLLIALEGLTPIIVESVKFREVSEGNQPKNMKMGWKQPSSLGRAGRQPPPPFLL

SEQ ID NO: 145438 - protein, 131 aa, Glycine max
  Coding DNA Sequence Number=SeqID_28660
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=79%, HitCoverage=19%, E-value=3e-46, Identity=96%"; Hit description=NADH -plastoquinone oxidoreductase subunit 2
  Pfam annotation: Domain name=Oxidored_q1; Domain location=5-122; Score=-117.5; E_value=0.069; Accession=PF00361.10; Description=NADH -Ubiquinoneplastoquinone (comple
MFQFMFLSTIWDIPRKDVRSNEATTKYLLMGGASSSILVHGFSWLYGSSGGEIELQEIVNGLINTQMYNSPGILIALLFITVGIGFKLSPAPSHQWTPDVYEGVRCYIVGSHPSETTSIIGASVNKRITLR

SEQ ID NO: 145439 - protein, 254 aa, Glycine max
  Coding DNA Sequence Number=SeqID_28661
  Homolog annotation: Hit_ID=Q1SKV6; Match level="QueryCoverage=80%, HitCoverage=46%, E-value=7e-08, Identity=26%"; Hit description=RNA -directed DNA polymerase
MTTQLESNLISKGKGTNDYNFLFIKEFLELLKCDVLRLLKEFHRHGVLPRVNGSPTQEFKCSKGLTQGVPLVPFLFLGVAEGLSGLMKEVKLLKEVWRKLVGMERRFLWGGNDENKKIVLVNWKEGLMRDGELSRDPLWWRDLKKIIPNLETERGINWWNRFLEGGHMVLGFKMEKGVFESENRLFQDFNNVLQAIQVIKHVADSWFWRPISSSDHTTNSTYVLSVQAIGEDNNNDLISQTWSIIIPNNVTFLI

SEQ ID NO: 145440 - protein, 1090 aa, Glycine max
  Coding DNA Sequence Number=SeqID_28662
  Gene Ontology: Mol. function=nucleoside-triphosphatase activity; Cellular component=membrane; Biological process=peroxisome organization and biogenesis
  Homolog annotation: Hit_ID=Q9FQ60; Match level="QueryCoverage=88%, HitCoverage=90%, E-value=0.0, Identity=53%"; Hit description =Peroxisome biogenesis protein PEX1
  Pfam annotation: Domain name=AAA; Domain location=558-736; Score =17.1; E_value=1.1e-05; Accession=PF00004.19; Description=ATPase family associated with various cellular activities (AAA)
  Pfam annotation: Domain name=AAA; Domain location=822-997; Score =216.1; E_value=7.8e-62; Accession=PF00004.19; Description=ATPase family associated with various cellular activities (AAA)
  Pfam annotation: Domain name=AAA_2; Domain location=818-947; Score= -41.8; E_value=0.014; Accession=PF07724.4; Description=ATPase family associated with various
  Pfam annotation: Domain name=AAA_3; Domain location=822-950; Score= -12.6; E_value=0.0078; Accession=PF07726.2; Description=ATPase family associated with various
  Pfam annotation: Domain name=AAA_5; Domain location=822-956; Score= -13.5; E_value=0.019; Accession=PF07728.4; Description=ATPase family associated with various
  Pfam annotation: Domain name=PEX-1N; Domain location=96-172; Score =129.1; E_value=1.3e-35; Accession=PF09262.1; Description=Peroxisome biogenesis factor 1, N-ter
  Pfam module annotation: Pfam domain module=AAA::AAA::AAA_2::AAA _3::AAA_5::PEX-1N; Domain location=558-736::822-997::818-947::822 -950::822-956::96-172
MELEVQVVGGIDSCFVSLPLSLIQTLQSTRSSPIPQILALELRSPTHPPHTWFVAWSGATSSSSSAIEVSPQFAECVSLPNHATVQVRAAPNVPHASLVTIEPHTEDDWEILELNADQAEAQILSQVRIVHEGMRFPLWLHGHTVITFQVASVFPKNVVVQLMPGTEVAVAPKRRKKSSDSAGDSHLDSSNKEHTAKMLLRLQDPDGLCSTSTHVKGVELHVGLTSVAFVHPETAKKYSFNMLQLVSIVPRVTKENVNISRSNIMKAKSGPATNEVENGYTDKTEYRQTIVQLLISESVAEGHVMVAKSLRLYLRASLHSWVYLKACDIILEKSIPSTSLFPCQFKLLKQENAVEKDGLEVFHGHKNHIDENLHAKPTSGVFVDTIDWSIQNEVAAALSDESSYKAEEEATNQSQNQRGLQSLVRLWYIMQLKAITSISGMEVSSLIIGNKTLLHFEVSCYKLRNNGKVQLAYNSSENSGKAAEMLFLLTFGEEYLHHGKLNAYEVALGGRLNNINIGDLKLFERMKLCDPVSIHSIEERASEDHISSNVSSLGWMEKAADDVINSRIFVSCSKLALEKVPVIRQELANHVTEALNHAPSVVIFDDLDSIISTPDSEGSQLLMSVAGLTDFLIDIMDEYREKRQKSCGFGPIAFIASIQSLEKIPQSLSSSGRFDFHIKLPAPAASERRAMLKHEIQRRQLQCDDDILLDVAVKCDGYDGYDLEILVDRTVHAAVCRFLPSNAAIYEHESPALLREDFSQAMLDFLPVAMRDITKSASDDGRSGWDDVGGLVDIRNAIKEMIELPSKFPKTFAQAPLRLRSNVLLYGPPGCGKTHIVGAAAAASSLRFISVKGPELLNKYIGASEQAVRDIFSKAAAAAPCLLFFDEFDSIAPKRGHDNTGVTDRVVNQFLTELDGVEILTGVFVFAATSRPDLLDAALLRPGRLDRLLFCDFPSLHERLEILAVLSRKSGNWESPGARSLDYLEELCTIVYLHFLISDLLPIEGVFHDAYEHGGQIDSKPGMIWILKKSCQKKLEDILEGMSCNFQGDGNQMNLPIGTNTSGAGCDGKHGSRLGNGIKTENGIGALEAA

SEQ ID NO: 145441 - protein, 122 aa, Glycine max
  Coding DNA Sequence Number=SeqID_28663
MPVSKCILSSSSVPGFPVEGSKREGGCGGVSEGGRGALGEGEGGGGCGGGEWGKRPLPRRRRLRPRKKRLASGRVALENGVPLPLLPDPKANLQWDEVKPLSGKPYWHSVLSPTNLQPRYNL

SEQ ID NO: 145442 - protein, 159 aa, Glycine max
  Coding DNA Sequence Number=SeqID_28664
MIKNGLEGKNNEVEERNGSVGAERDEVSEKIGVIKVGEDEGADDKDVGHGEEGSDVEVVMPSKGRESHESGPRKRDTVTNSHSTVTYSRRTLWEKSAEDEEKTRKGNKLRMIMKISPLLMTPGRCYLMMLHFVVAPSSLWSLTVGKQKGEEKKMKEEKK

SEQ ID NO: 145443 - protein, 101 aa, Glycine max
  Coding DNA Sequence Number=SeqID_28665
  Gene Ontology: Mol. function=nucleic acid binding; Cellular component= intracellular; Biological process=response to DNA damage stimulus
  Homolog annotation: Hit_ID=P42698; Match level="QueryCoverage=100%, HitCoverage=31%, E-value=2e-19, Identity=47%"; Hit description=DNA -damage-repair/toleration protein DRT111, chloroplast precursor
LAQHLGLAGFALEVAAVFLVVVGPGRVVLLEDGGLDANEGGLEGGVFRGKGGGGGGEDGLGGGLGLGGGGLAERGGSHLGAGGPDVGGGLVVFLGGRRWRK

SEQ ID NO: 145444 - protein, 54 aa, Glycine max
  Coding DNA Sequence Number=SeqID_28666
MAVESIFEGVNCIFCGIFLFMANPVLKQLDVVSKLTRSSSKNETKATRAWDMKV

SEQ ID NO: 145445 - protein, 197 aa, Glycine max
  Coding DNA Sequence Number=SeqID_28667
  Gene Ontology: Mol. function=RNA binding; Biological process =regulation of transcription, DNA-dependent
  Subcellular localization annotation: CTP_CleavageSite=50; ConfidenceScore=5.80e-01
MEGVLLPVCPSPSSSSAAPKPRIPIPQRSSFPSSLPTHLSLPQNAAFSLRTSLRTSTFALAPHETPVLDKPDNNSSSPSLPKIDKTGRFCSPRAARELALSIIYAACLEGMDPVRLFEKRMNARREAGYKFNEEKLLEYNHMSFGGSPVTVGSDEEANELLRHIEEESAIVGEDAWIVLESSMSLFCFSFSLTFATF

SEQ ID NO: 145446 - protein, 33 aa, Glycine max
  Coding DNA Sequence Number=SeqID_28668
MVDSSGKNHIGLTLWLWVEVGRTAYWEPMAQPV

SEQ ID NO: 145447 - protein, 118 aa, Glycine max
  Coding DNA Sequence Number=SeqID_28669
  Gene Ontology: Mol. function=nucleic acid binding
MMTYNNNNNNNNNNNNQFIVEGASLTRPPGFIGEDYPYCINYEGTKDVQLRKPATLTHQYESFSMKEGEYADDMFGRVQVLLNGLKALGHTFTKGQINLKIQDSFPKVWKPKTSHPGS

SEQ ID NO: 145448 - protein, 50 aa, Glycine max
  Coding DNA Sequence Number=SeqID_28670
MWRSLSGSAALWRSHRLALSCGSGEEVEVWRRIVSEDYEVFILCAKDCYP

SEQ ID NO: 145449 - protein, 413 aa, Glycine max
  Coding DNA Sequence Number=SeqID_28671
  Homolog annotation: Hit_ID=Q6ZGL2; Match level="QueryCoverage=86%, HitCoverage=81%, E-value=3e-92, Identity=48%"; Hit description =Putative pentatricopeptide (PPR) repeat-containing protein
  Pfam annotation: Domain name=PPR; Domain location=228-262; Score =10.5; E_value=0.42; Accession=PF01535.11; Description=PPR repeat
  Pfam annotation: Domain name=PPR; Domain location=300-334; Score=2.9; E_value=3.4; Accession=PF01535.11; Description=PPR repeat
  Pfam annotation: Domain name=PPR; Domain location=335-369; Score =13.3; E_value=0.2; Accession=PF01535.11; Description=PPR repeat
  Pfam annotation: Domain name=PPR; Domain location=371-405; Score=6.7; E_value=1.2; Accession=PF01535.11; Description=PPR repeat
  Pfam module annotation: Pfam domain module=PPR::PPR::PPR::PPR; Domain location=228-262::300-334::335-369::371-405
RKPSKDNRYRPRPKQPPEFGVNLFLKKPSTTSKPTEDDMDSNEENDEEEDGNIGVVWESDELEAISSLFQGRIPQKPGKLDRERPLPLPVPYKLRPLGLPTPKTQVKLTAPAVVSSRASMAKKVYKSPRFLVGLAREISRLGPDEDVSKILGKWVQFLRKGSLSLTIRELGHMGFPERALQTFLWAQNQPHLFPDDWILASTVEVLARNHELRIPFNLNQYTGLASRVVLEAMIKGFIKGGNLRLAWKVLIVARRDKRMLDSSIYAKLILELGKNPDRHRHVLPLLDELAERDELNLSQQDCTAIMKVCVKMGKFEVVECLFSWFKQSGYHTSVVMFTSVIHSRYTEKKYREALAVVWEMESSSCLFDLPAYCVDMLHIYMASGRIAKCKELCKEAEMSGFKLDKYLVSQLDR

SEQ ID NO: 145450 - protein, 610 aa, Glycine max
  Coding DNA Sequence Number=SeqID_28672
  Homolog annotation: Hit_ID=Q6Z797; Match level="QueryCoverage=57%, HitCoverage=90%, E-value=3e-20, Identity=26%"; Hit description =Putative BRI1-KD interacting protein
  Pfam annotation: Domain name=TPX2; Domain location=380-440; Score =74.4; E_value=3.5e-19; Accession=PF06886.2; Description=Targeting protein for Xklp2 (TPX2)
MQVDSIHSGSISFGRFENETLSWERRSSFSHNRYLEEVEKCSKPGSVIEKKAYFEAHFKKKGIFGFIPSTGHEGSSVRAISENDGSERIGKQEDFESNDGHYVQFDEMSQKDFELDEGDHYIEMDQSSQEDFVTIEDDHYVQFGEIPANSNYHGECGMDEYEREETVTESLMDSFSGLQQMESAANDSNDFEDPGKISITLDKAHHQSENETSNILLDDDKVIIEVKKNDDVTVNTDESSTNMIMPVNEPAQGVEETISHDPANPSTKERKIKPQRNSEVNNVQVRKSTPPRSVKDPARIPRGESPRRTNMEKNSSKLATPTTCLASKTTKEVSKSAEKLVRESKSENASKVRKGAESQLSASKTASRGIQEAESLGLRLSTSNVASERKDGNRQFYMKLEEKMYAKEAEINQMQAMSQEKTEADIKKLRKSLNFKATPMPSFYCTPSPSQPHGNKAVSNNTRSKKEHNKPKCPGSGADAAFPSRSKVGNDLETDESVTAREPHGISVKECAKNKASKASLISPAPSTNNSCLADSTTSSHTSGKKEGAKVSLQKHRVTDSCKGAKQQSNERNKNGETAKHRNDIMRKGVGNVGLRSSSKSGNLAVRVAS

SEQ ID NO: 145451 - protein, 117 aa, Glycine max
  Coding DNA Sequence Number=SeqID_28673
MPLSMLPTTHWNGYSHNSFRWFHCPPAPPQPGLLYPPPSGNYPYYPTPPFGGGGVGGNDGSGGGGFGTPPPPDPILPYFPFYYRKPPHKPEDNSASTTAMHKWTGMGKGKNIGGMIR

SEQ ID NO: 145452 - protein, 218 aa, Glycine max
  Coding DNA Sequence Number=SeqID_28674
  Gene Ontology: Mol. function=nucleic acid binding; Biological process= DNA integration
MADNVVVNNATFANLLNPYYTHPNENPGVAIIAQVLNGANYHSWSRAILLALKTKKKVQFVDGSLPRPTLNDPNFTIWDHCNTLVVSWLHHSLDPDILQTIMWMETASDIWNTLKKCYYQGDVFCISDLQEEIYLLKQGDTTITIYFTKLKGLIQELDNFRPIPSCTCVVVCACDLIPVIKSYREGDYVIRFLRGLNEQYSTVRSNIMMMDPLLDLDQ

SEQ ID NO: 145453 - protein, 175 aa, Glycine max
  Coding DNA Sequence Number=SeqID_28675
  Homolog annotation: Hit_ID=Q1S3Q9; Match level="QueryCoverage=46%, HitCoverage=15%, E-value=6e-09, Identity=40%"; Hit description =Cyclin-like F-box; F-box protein interaction domain
MGCTVGLAKYQKDTVLFSGTRRKSYDPSSDKYKVVAIALTMLSLEVSEKTEMKVYGAGDSSWRNLKDLEKETCRSLFLLDDFCFFDTNIGVFRDSMCVWQDSNTHLGLWQMRKFGDDKSWIQLINFSYLHLNIRPYEEKSMILPFCMSNNGDFFMLKFTRNADDEYQTILYNQRD

SEQ ID NO: 145454 - protein, 75 aa, Glycine max
  Coding DNA Sequence Number=SeqID_28676
MEYRTYITRFHVDLRDGSEADIFYQLKGSEIKEFHSLHTHLNWIKGFMGRRDKISLLISLQRSDDHGFFSGHMFL

SEQ ID NO: 145455 - protein, 251 aa, Glycine max
  Coding DNA Sequence Number=SeqID_28677
  Gene Ontology: Mol. function=hydrolase activity; Cellular component =nucleus; Biological process=response to DNA damage stimulus
  Homolog annotation: Hit_ID=Q8LQQ4; Match level="QueryCoverage=59%, HitCoverage=39%, E-value=4e-38, Identity=53%"; Hit description=DNA cross-link repair 1B-like protein
  Pfam annotation: Domain name=DRMBL; Domain location=153-219; Score= -8.6; E_value=0.036; Accession=PF07522.4; Description=DNA repair metallo-beta-lactamase
  Subcellular localization annotation: CTP_CleavageSite=23; ConfidenceScore=5.06e-01
MFFTSHILRQLERTVLEYSPLTVATAPAPPPLSSSLRGRGRSPSPPGPHQTLAASSTPATSGGKPCASEQPSPSMFPLLTLFTLTTPTPILSMIFRLAMSRLNRLSISSHRIPITTSLSGLTHWGSKICWLRFHIWVWPQRLRTMHLLGYDGIFTMNTSFTRVIAVPVYSFSINTLEELNYVCPTIGIMPLGLPWIKKSLQKNELQTDSKWIPANNVVNQYAEALAKAWSEYNNPRCAYVGILVPKDAKRL

SEQ ID NO: 145456 - protein, 209 aa, Glycine max
  Coding DNA Sequence Number=SeqID_28678
  Gene Ontology: Mol. function=RNA-directed DNA polymerase activity; Cellular component=extracellular region; Biological process=RNA -dependent DNA replication
  Homolog annotation: Hit_ID=Q1S4V6; Match level="QueryCoverage=80%, HitCoverage=21%, E-value=1e-23, Identity=36%"; Hit description =Ribonuclease H
MRVSFSTNVSWPVRDQLSIALGFKCIDDLGKYLRVKLNHDRVFRGLIGKVVENMKHRLNLWKAKILSFAVCLTLTKLIMFSISLYVMQSVHLPQSVCDEGDQVYRNFLWGDLENGRQIHLVAWDRVCQPEEAGGLGIFMLCERLNASGNISYFLLKASKGLLEKFISTPELLGVKEVGWWSPQMVGWHKLNLNIAVRYSDNEVASCGVI

SEQ ID NO: 145457 - protein, 285 aa, Glycine max
  Coding DNA Sequence Number=SeqID_28679
  Gene Ontology: Mol. function=protein serine/threonine kinase activity; Cellular component=cell surface; Biological process =protein amino acid phosphorylation
  Homolog annotation: Hit_ID=Q7G6W1; Match level="QueryCoverage=89%, HitCoverage=34%, E-value=7e-90, Identity=62%"; Hit description =Putative receptor-like protein kinase
  Pfam annotation: Domain name=Pkinase; Domain location=3-265; Score =41.3; E_value=5.1e-11; Accession=PF00069.15; Description=Protein kinase domain
  Pfam annotation: Domain name=Pkinase_Tyr; Domain location=20-265; Score=-20.7; E_value=3.4e-11; Accession=PF07714.7; Description =Protein tyrosine kinase
  Pfam module annotation: Pfam domain module=Pkinase::Pkinase_Tyr; Domain location=3-265::20-265
MLFTWFNEIGWDKEGTKENTHLLEEIEKNVTGRDAEFWAEVTIIARMHHLNLVRLWGFYAEKGQRVLVYEHIPGGSLDKYLFRSMRYIIALGMARAIAYLHEECLEWVLHYDIKLEKILLCDDFCPKISDFRLAKLRKKEDMATMSRRKGTLGYMALEWITADPITSKADVYSFGMVLLELVSGIRNCEIQGFVVRSEEWYFPGWAFDKMFKKMRGEEILDGQIRDAYDSRAHFKMVNRMVKTAMWCLQDRPELRPTMGKVAKMLEGTVEITEPKKPTVFFLGEE

SEQ ID NO: 145458 - protein, 65 aa, Glycine max
  Coding DNA Sequence Number=SeqID_28680
  Subcellular localization annotation: CTP_CleavageSite=57; ConfidenceScore=5.13e-01
MKVINLRAKSRPQNLLPQNINLSDFNPQQHQSPTINKPNSNSVHHANPMSVSTPHTKTSTNKAIL

SEQ ID NO: 145459 - protein, 460 aa, Glycine max
  Coding DNA Sequence Number=SeqID_28681
  Gene Ontology: Mol. function=transporter activity; Cellular component= membrane; Biological process=oligopeptide transport
  Homolog annotation: Hit_ID=Q9M817; Match level="QueryCoverage=96%, HitCoverage=74%, E-value=1e-119, Identity=47%"; Hit description =Peptide transporter, putative
  Pfam annotation: Domain name=MFS_1; Domain location=7-398; Score= -53.9; E_value=0.093; Accession=PF07690.6; Description=Major Facilitator Superfamily
  Pfam annotation: Domain name=PTR2; Domain location=1-382; Score =243.7; E_value=4e-70; Accession=PF00854.12; Description=POT family
  Pfam module annotation: Pfam domain module=MFS_1::PTR2; Domain location=7-398::1-382
MIPELRPSCQSLMLGCNSASAAQLAVLFLSLGLISIGAGCVRPCSIAFGADQLTIKVRSNDERLLDSYFNWYYTSVGVSTVFSMSVIVYIQENLGWKIGFGIPAVLMLVSAISFILGSPFYAKVKPSHSLLTSFAQVVVVAVKNRKLTLPDCNFDQYYHDRDSELMVPTDSLRCLNKACIIRNPETISNPDGSVSDPWSQCTVEQVESLKSMLRILPMWSTGIFMITASQTSFSIIQANTMDRRLFGNFEMPAGSFSLISVITLTIIIPTYERVMVPLLAKYTGLPRGFSCKTRIGVGFLFVCVTKATSAIVETMRRNAAIKEGFEDQPNAVIQMSVLWLVPEFFFLGIAEAFSSVGQLEFFYSYIPKSMSSFAMAIFTLELAAANTVASVLVSIVDKVTSVGGNKSWLSTNINSGHLNYYYALLSFLSIINYLYFLAVCWAYGPAPGPNLEASAGKEEE

SEQ ID NO: 145460 - protein, 113 aa, Glycine max
  Coding DNA Sequence Number=SeqID_28682
  Homolog annotation: Hit_ID=Q1SDG1; Match level="QueryCoverage=66%, HitCoverage=6%, E-value=6e-10, Identity=39%"; Hit description =Integrase, catalytic region; Zinc finger, CCHC-type
MCKLALLSVLYFSTSWVEYLTVTEEKILSKQAMEEGYPTNKHPLFKGIKYDYWQERIIAHFESMHIDMWDVVENRDHIPLVEELNEFSRNRWADEQKQRFYLTQKHKMIFYVH

SEQ ID NO: 145461 - protein, 116 aa, Glycine max
  Coding DNA Sequence Number=SeqID_28683
MDESTKDCDACKTLRIKETKLSLENETISKEKTTLLEDFQELENKLKVLQKELNELHSHQKDEREPIDKSRNGYEGDVYNHDKETIVCYFCGKISLTTGRTRPSWYLDNGFSRHMT

SEQ ID NO: 145462 - protein, 78 aa, Glycine max
  Coding DNA Sequence Number=SeqID_28684
MERCKKIEGRGTLRYSGHRGSKNLGELASGDYSAFGALIWHEELTGLTLLLLIGSETIHFGFGSSRIDIRCTCMWQSL

SEQ ID NO: 145463 - protein, 86 aa, Glycine max
  Coding DNA Sequence Number=SeqID_28685
  Subcellular localization annotation: CTP_CleavageSite=24; ConfidenceScore=5.32e-01
MKPSFQRQQGQGSRSGKTPLTLMKVARKFSYEPRTQIWSFEGKSLKNTCMRLRRRRKWILLHPLKNMCKTMENEGSKFDLFGEVKR

SEQ ID NO: 145464 - protein, 35 aa, Glycine max
  Coding DNA Sequence Number=SeqID_28686
EKKEVVAAQLAQASWVASTRRHHLLLEDPGRPKLA

SEQ ID NO: 145465 - protein, 102 aa, Glycine max
  Coding DNA Sequence Number=SeqID_28687
MSRVVGRDKLWSFCPPFCHPEAIVSDGTQRQIMVILCLSIQARSCPMARRDKLWSFCALCQEERIRQYQDDVGRSVLIIFKIFAGSAGGVIDRPNGVSLERN

SEQ ID NO: 145466 - protein, 196 aa, Glycine max
  Coding DNA Sequence Number=SeqID_28688
  Gene Ontology: Mol. function=calmodulin binding; Cellular component =alpha-glucosidase II complex; Biological process=protein kinase cascade
  Homolog annotation: Hit_ID=Q9FM96; Match level="QueryCoverage=82%, HitCoverage=25%, E-value=2e-64, Identity=69%"; Hit description =Arabidopsis thaliana genomic DNA, chromosome 5, P1 clone:MCD7
MKLLIALLLVLCAPFSSSSKPKDPFLGISPEDDKYYKASDVIRCKDGSGKFTKAQLNDDFCDCADGTDEPGTSACPGGKFYCRNAGHSPVYLFSSRVNDGICDCCDGTDEYDGQVKCPNTCWEAGKVARDRLEKKIATYQEGVKLRKLEMEQAKVAMEKDEAELSKLKKEESILKGIVKQLKGITFWLSCSCECFT

SEQ ID NO: 145467 - protein, 170 aa, Glycine max
  Coding DNA Sequence Number=SeqID_28689
MTKNPSIAQKKANSSKRKQGECSQASINRLDTWFIDENKKNDFKMIYAVKNMKGTFYSELVKAFYTCACTDMEEMVIDVAVWKAIVRLDMGGVRNFEEFFNGYSKMQTYRDIMLKSHQLVDYEFPYVVLASRFIYYFNINFSNEIVDFIKASNEITERHLKKLGMRFAEH

SEQ ID NO: 145468 - protein, 489 aa, Glycine max
  Coding DNA Sequence Number=SeqID_28690
  Gene Ontology: Mol. function=zinc ion binding; Cellular component =nucleus; Biological process=transcription
  Homolog annotation: Hit_ID=Q1SW42; Match level="QueryCoverage=89%, HitCoverage=82%, E-value=1e-88, Identity=43%"; Hit description=Heavy metal transport/detoxification protein
  Pfam annotation: Domain name=FAR1; Domain location=45-162; Score =24.4; E_value=2.1e-08; Accession=PF03101.5; Description=FAR1 family
  Pfam annotation: Domain name=SWIM; Domain location=393-425; Score =19.2; E_value=0.0031; Accession=PF04434.8; Description=SWIM zinc finger
  Pfam module annotation: Pfam domain module=FAR1::SWIM; Domain location=45-162::393-425
MEEVCLNSEPLFDERNEVDVEGNSSIAEHDLESLNSQTNNSPLPTVAIHGLDRKKKECYRAKLSCSSAGFKKKSEANNPRPKTRTGCPAMIVIRMVESKRWRIVEVELQHDHQVSPQSKRFYKSHKEMILEASKSRPLPEPVTEVHTIRPRIAYNYFNDTVTIDTNCLANKYEIPLMSFVGINHHGHSVLLGCGFLGHESVDYFVWIFKAWLQCMLGRPPHVITDQCKPLQIAVARVFPHARHCYSLQYIMQRVPEKLGGLQGYGPIRRKLYNAVYESLKIVEFESSWADMIKCHGLKTGPYDVFDGYVHKYTSFKEFLDKYDLALHRKHLKEAMADLESRKVSFELKTRCNFEVQLAKGFTKEIFQKFQSEVDGMYSCFNTRQGVKSFEDLYETTELDIRCICSLFNYKGYLCKHALNVLNYNSIEEIPSQYILNRWRRDFKQTFNQFHVSDNIDTYNPVDLYTHLFNSALPVLEVGAQSREHYMVAV

SEQ ID NO: 145469 - protein, 294 aa, Glycine max
  Coding DNA Sequence Number=SeqID_28691
  Gene Ontology: Mol. function=calmodulin binding
  Homolog annotation: Hit_ID=Q9FM96; Match level="QueryCoverage=90%, HitCoverage=41%, E-value=1e-80, Identity=57%"; Hit description =Arabidopsis thaliana genomic DNA, chromosome 5, P1 clone:MCD7
  Pfam annotation: Domain name=PRKCSH; Domain location=212-261; Score =71.8; E_value=2.2e-18; Accession=PF07915.3; Description=Glucosidase II beta subunit-like prote
MGSLSLAQNTITISLEGGYFQQYTGNDASENTEGLSREELGRLVASRWTGENTDKSSAEPDTTLDNEDHEDLPKGTNNEEYEGYASETDDDIDSNKYDDDSHKYDDEDEVDEEYREDEHDDLTSSYKSDSDNEPDLSDNPSWLEKIQRTVRNIFQAVNLFQAPVNQSDAARVRKEYDESSAKLSKIQSRISSLKQKLKHDFGPAKEFYSFYDHCFEGKENKYTYKVCPYKQASQEEGYSNTRLGSWDKFEDSYRVMVFSNGDKCWNGPDRSLKVKLRCGLKNEITDVDEPSRCE

SEQ ID NO: 145470 - protein, 143 aa, Glycine max
  Coding DNA Sequence Number=SeqID_28692
  Homolog annotation: Hit_ID=Q5NAR8; Match level="QueryCoverage=77%, HitCoverage=83%, E-value=7e-41, Identity=60%"; Hit description =Purine rich element binding protein B-like
  Pfam annotation: Domain name=PurA; Domain location=1-125; Score= -89.9; E_value=0.002; Accession=PF04845.4; Description=PurA ssDNA and RNA-binding protein
MEGNSGGGGGGNDVELLCKTLQVEHKLFYFDLKENPRGRYLKISEKTSATRSTIIVPFSGISWFLDLFNYYVNSDDQDLFSKELQLDTKVFYFDIGENRRGRFLKEGDTSGTKLMVCSGKISEERETDGCVSKRKEDRNRGGD

SEQ ID NO: 145471 - protein, 55 aa, Glycine max
  Coding DNA Sequence Number=SeqID_28693
MALPRMSQHHLLKFLSSQPWEDLSRQRICKELDLKQFTKNFGQEENGLIIKKEIV

SEQ ID NO: 145472 - protein, 243 aa, Glycine max
  Coding DNA Sequence Number=SeqID_28694
  Gene Ontology: Cellular component=mitochondrion
  Homolog annotation: Hit_ID=Q10M34; Match level="QueryCoverage=59%, HitCoverage=62%, E-value=1e-19, Identity=47%"; Hit description =Expressed protein
MDIEIAELFLLSDGLMIAKENPALSAGLAVSGALLAMRVSLVLTSHWLAFELLMTGKLGLDVTNVIWLGLGNMQFTCCNSVTKLLFSTFLASNGTKDMLQEGFCFVIHWVDSKVRRYYSVEQSRCIPYLCSYVRYARTEKNVKDLGLSVDLLKKESVKLLQRTALAEKEMKYGHTELVSAGTQFQQLAKSAYKVETRAADLLDKLRYIPSREALVASMASNLKRQRSSLNKRIMKINELGVPV

SEQ ID NO: 145473 - protein, 79 aa, Glycine max
  Coding DNA Sequence Number=SeqID_28695
  Subcellular localization annotation: CTP_CleavageSite=31; ConfidenceScore=5.12e-01
MARFSTHPSSQLPFIWSSLSFVFLMAPENCKAPSYSDAAESFFRIFPLSIPNLPPKSNLKSSSNHWKVWQNGNLGTTTC

SEQ ID NO: 145474 - protein, 79 aa, Glycine max
  Coding DNA Sequence Number=SeqID_28696
MQTVVGPQNNLNCLARVWFPSSMNFALSSYSFICIKHPLEGEMEGMLNAFGNEISCMKYLVRTISNCSMEVNALENKER

SEQ ID NO: 145475 - protein, 152 aa, Glycine max
  Coding DNA Sequence Number=SeqID_28697
MGHKRFNMVAGFDVVGERFVTKPEFFSKSRSEPLKDAFPELFAISSQQLVSVGNTGSWRRDQWTWGLTWKRQLNSNEEESLHSLETILVDVHLVAESHDRWKWSLHNSKLFTVHNNSIFKEEEKDIPKTINQIKHICWAWFMGKVGGVGFAS

SEQ ID NO: 145476 - protein, 107 aa, Glycine max
  Coding DNA Sequence Number=SeqID_28698
WWQWWHGSGVCNNEDNPYGRGGMVVVTVMSVIYHGGGSDVNDNVMIVVVIMTITIMMGVTIIVDGDSSTINRCGDGGFRGDNDRDDINNTVVVGVTLATMMIVMVMN

SEQ ID NO: 145477 - protein, 237 aa, Glycine max
  Coding DNA Sequence Number=SeqID_28699
  Gene Ontology: Mol. function=protein binding; Cellular component =integral to membrane; Biological process=xylan catabolic process
  Homolog annotation: Hit_ID=Q1S5Q1; Match level="QueryCoverage=94%, HitCoverage=79%, E-value=2e-41, Identity=38%"; Hit description =Leucine-rich repeat; Leucine-rich repeat, cysteine-containing type
  Pfam annotation: Domain name=LRR_1; Domain location=121-142; Score =11.6; E_value=1.9; Accession=PF00560.23; Description=Leucine Rich Repeat
  Pfam annotation: Domain name=LRR_1; Domain location=49-71; Score =10.7; E_value=2.9; Accession=PF00560.23; Description=Leucine Rich Repeat
  Pfam annotation: Domain name=LRR_1; Domain location=73-95; Score =14.4; E_value=0.43; Accession=PF00560.23; Description=Leucine Rich Repeat
  Pfam annotation: Domain name=LRR_1; Domain location=97-119; Score =14.3; E_value=0.45; Accession=PF00560.23; Description=Leucine Rich Repeat
  Pfam module annotation: Pfam domain module=LRR_1::LRR_1::LRR_1::LRR _1; Domain location=121-142::49-71::73-95::97-119
MKTMAGEDDFFANPLSYSYGSDFSYNHYKETLVLVPKGDELEYRDNLILVRMIDLSSNKLSGAIPSEISKLSALRFLNLSRNHLSGGIPNDMGKMKLLESLDLSLNNISGQIPQSLSDLSFLSVLNLSYNNLSGRIPTSTQLQSFEELSYTGNPELCGPPVTKNCTDKEELTESASVGHGDGNFFGTSEFYIGMGVGFAAGFWGFCSVVFFNRTWRRAYFHYLDHLRDLIYVIIVLK

SEQ ID NO: 145478 - protein, 230 aa, Glycine max
  Coding DNA Sequence Number=SeqID_28700
MHFEHSEYSVAGDSEYSDFEHLTTNFHTENIAQPPPHERTLREMTAPDFTYESLCIQYPDEGVPYVLKTGLIHLLPKFHGLIGEDPHKHLKEFHIVCSTMKPPDVQEDHIFLKAFPHSLEWQKIDYTTLLPGWRNHPNLRWTSPPQQQQSIPPFQNAAGPSKPYVPPPMQQQQQQSQQRQQATEAPPQPSLEELVRQITIQNMQFQQETRASIQSLTNQMGQMATQLNQA

SEQ ID NO: 145479 - protein, 187 aa, Glycine max
  Coding DNA Sequence Number=SeqID_28701
  Subcellular localization annotation: CTP_CleavageSite=20; ConfidenceScore=5.42e-01
MDRLTTMMSALLSAQNSQAAAAAVEQPLVSTTPLSTVTSPPLFLPPGCTWGMPPPVCGSPQPAVSEVPLPFAQQSAPVPQPGTSFPQAAMTYSAPLIHTIQQEVEPIFQAENVVAFDKMEELQERFDGMQREVEALRGRDLFGKDACELCLVPNVTIPHKFKVPDFEKYKGNSCPHSHLVMYARKMS

SEQ ID NO: 145480 - protein, 63 aa, Glycine max
  Coding DNA Sequence Number=SeqID_28702
MVKREKITQFRAQNSNDLVYVIKTIDHSFDEIEFDNEWDDDGDGDESDDIHGNDPIRGCDMVL

SEQ ID NO: 145481 - protein, 274 aa, Glycine max
  Coding DNA Sequence Number=SeqID_28703
  Homolog annotation: Hit_ID=Q47522; Match level="QueryCoverage=18%, HitCoverage=70%, E-value=4e-14, Identity=70%"; Hit description=LacZ protein
GHQDLLFCEVISVTGIYSAQSASAVPPVQLLTGWCVTAKAPPDISAGKCSGHAARRVPFAIQAAQLLGRAIGAGLFAITPAGERGMCCKAIKLGIRSCLALLYGGALIPVQRTDTGTEKWPEQALGSLALHPFQVSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 145482 - protein, 114 aa, Glycine max
  Coding DNA Sequence Number=SeqID_28704
  Gene Ontology: Cellular component=chloroplast
MNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDT

SEQ ID NO: 145483 - protein, 199 aa, Glycine max
  Coding DNA Sequence Number=SeqID_28705
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=88%, HitCoverage=16%, E-value=5e-30, Identity=32%"; Hit description =Putative retroelement
WEEEDEPALQPDPPDEVETAGDPNSGSSDNFLQPRLAQCLKLPVEPIPNLQVLVGNGNALTIEGLIQDLEVKIQGHTLKLPVYLLPVSGADLVLGAAWLATIVPDLSDYSTLTLKFYLGNQFITLHGLPPRRTHNHSIPLVQGAGPVKVKPYRYPHSRKDQIEDGTWRFCTDYRALNAITIKDSFPIPTVDELIDELRG

SEQ ID NO: 145484 - protein, 177 aa, Glycine max
  Coding DNA Sequence Number=SeqID_28706
MPSSFIDLVFAGERIDAGPRKEKFSYVASMNPGNREPDRSGERKKEGELHVVAEVPAWPNFPLPPYNPMYQYPPQQYHHSANISPAHYPPPYQPRTPNQPQRPPVNWPQNPPVAQPRLNTTPNTNQNTNQRRNFPKKKSIEFTLILISYADLLLYLLNNAMVATSPTNSTSIHQGYN

SEQ ID NO: 145485 - protein, 142 aa, Glycine max
  Coding DNA Sequence Number=SeqID_28707
  Gene Ontology: Mol. function=thiamin pyrophosphate binding
  Homolog annotation: Hit_ID=Q0I5A4; Match level="QueryCoverage=99%, HitCoverage=22%, E-value=2e-55, Identity=76%"; Hit description=Myo -inositol catabolism protein
  Pfam annotation: Domain name=TPP_enzyme_N; Domain location=2-140; Score=-50.0; E_value=7.5e-05; Accession=PF02776.8; Description =Thiamine pyrophosphate enzyme, N-term
MAQALVKFLDNQYLEVDGEAQKFVKGIFAIFGHGNVLGLGQALEENSGELRVYQGRNEQGMAHAATGFARQSLRRQIIACTSSIGPGAANMITAAATATANRIPLLLLPGDVFATRQPDPVLQQIEQSYDLSITTNDAFRAV

SEQ ID NO: 145486 - protein, 133 aa, Glycine max
  Coding DNA Sequence Number=SeqID_28708
MRLFNGPRNVNGSSGNEYDHFNDEDCGSEIHDNDFLSDFEEIIHIVGNHHHSNDEIIEIYKENGIFGKSHEIPQNGRIHLEVGQLFMDLNHFRQVPKDFSIQEGFQLKRIKNVPSRATEFWMMPVSERKDKSG

SEQ ID NO: 145487 - protein, 646 aa, Glycine max
  Coding DNA Sequence Number=SeqID_28709
  Gene Ontology: Mol. function=RNA-directed DNA polymerase activity; Biological process=RNA-dependent DNA replication
  Homolog annotation: Hit_ID=Q2HRL0; Match level="QueryCoverage=21%, HitCoverage=28%, E-value=2e-33, Identity=40%"; Hit description=RNA -processing protein, HAT helix
  Pfam annotation: Domain name=Exo_endo_phos; Domain location=390-625; Score=9.4; E_value=0.0031; Accession=PF03372.13; Description =EndonucleaseExonucleasephosphatase family
MQETDQKILNNFSSDGIRWEARCAYLTCRVAGMQTLLAALRLDEDNCEEKEMMAKRGRGRPPNTVPPPPVNHPQPATNLVVETENHELQKHEETIEEFEATTKCPEILIEEPKEVTDRKLWVDVLNNNHNPSNGVTMEFVAPKLINGEVEVEIEAEDIASELLFWENAMILYVLGGSLSMNMLKNYMVKMWNFVTLPDMLYHDDGYFLLCFKNREDRETVMMRGPYTIRNMPIILKEWTPDFNLSKDLERTMPIWVKLPQLPLCLWGLKSLNKIGSAIGNPLMTDECTAQKLRVSYARILVEVDITQKLVEEITISDRTGGKIKQIVEYEWKPEFCEKCQKAGHQCGKKKVVKKWIPRNKQADEVKADPLPKIPVQNIETEGEDKPEGWITMGKAARHTGKAIEVIGKLKEISSRLLKLRPTIAILIETRVKNKNAKKIRDKLKLPHNYLDNYKWYDNGRLWIEWDNSKIDVRHVKCSSQYVHVGVYNLQGEFKFWLTAVYALNQLDRRKVMWKDLEAIHKHQQGPWCVIGDFNNVTKAQDRIGGKAVTESEYIDLLNMMETTGLAEMDTTGEFYTWTNKQVIGTIYSRIDRVLGNLDWFQDNLDTVLTVLPASVSDHALLYVSKKDPIIKNNKNFRFSNCLIEME

SEQ ID NO: 145488 - protein, 136 aa, Glycine max
  Coding DNA Sequence Number=SeqID_28710
  Gene Ontology: Mol. function=carbon-sulfur lyase activity; Cellular component=nucleus; Biological process=metabolic process
  Homolog annotation: Hit_ID=Q6ERD5; Match level="QueryCoverage=95%, HitCoverage=88%, E-value=6e-40, Identity=58%"; Hit description =Putative nuclear protein p30
  Pfam annotation: Domain name=DUF636; Domain location=30-124; Score =48.5; E_value=2.3e-11; Accession=PF04828.4; Description=Protein of unknown function (DUF636)
MDAEKVWHTGGCHCKSVRWKVIAPSSVVAWDCNCPNCYMKVIAPSSAVNFELLGDSHKFLTTYTFGTHTAKHTFCKICGITSFYYHPRSNTDGIAVTFKGVDPGTLTHVEIRHADGKNWERAVIETDIASYSKVQK

SEQ ID NO: 145489 - protein, 63 aa, Glycine max
  Coding DNA Sequence Number=SeqID_28711
MSKVHPYLKFEVPQRRGVLHDSENGFLLQFGVEVMSNFGALMEASMERKKKRKAMWEGGGKAF

SEQ ID NO: 145490 - protein, 141 aa, Glycine max
  Coding DNA Sequence Number=SeqID_28712
MPLELEVILQVKELLDEGLVRKSLTPCALLVPKIGIMRHQIPMIGDMMHVLSGATLFCKITHASNIFMIHIHRDSLGRNNQHKNTEKAVSRIFPLDLMMKSVQFQLSSARLSTQLALSLNPLTCAKRKGGAKRKIMGSEPI

SEQ ID NO: 145491 - protein, 118 aa, Glycine max
  Coding DNA Sequence Number=SeqID_28713
MYQYPFQGHHTDTSASQQSFGGVAETQAHFSWPTMTPSQQYHGPIPTPNAPLGTQWNVPGQIPNTGDLFGVDLRHAFSAEADEEKAGRHRGRRNPDRQARRWDRPCGTSSRHHGHQNE

SEQ ID NO: 145492 - protein, 75 aa, Glycine max
  Coding DNA Sequence Number=SeqID_28714
MKNGETISKLQTRFTHTMNHLLSPGKMFEDDELNIKILIYLTRTWEPKITAINKFKDLASMLMEALFKKTAYVST

SEQ ID NO: 145493 - protein, 155 aa, Glycine max
  Coding DNA Sequence Number=SeqID_28715
  Gene Ontology: Mol. function=transporter activity; Cellular component= membrane; Biological process=transport
  Homolog annotation: Hit_ID=Q664M7; Match level="QueryCoverage=53%, HitCoverage=30%, E-value=2e-37, Identity=91%"; Hit description =Putative nitrite transporter, FNT family
MAGEQLGTGDDHQRQRDAEGGAHHQRSHAWVDQVAEGEDQDDAEADVGARHRRADPKAERALLRQADDARRVGGAFVDRVGKHVASRKVMPRLARCRRPPGWRSWRRNGCRLPDSGRRTGGNAVSSAGWRPIVRPDARRSGRATARWPGRTGRYC

SEQ ID NO: 145494 - protein, 56 aa, Glycine max
  Coding DNA Sequence Number=SeqID_28716
MQPELEGAKLCEQQVNDINVNVGSYTNKIHGKIRKDIDTTQGGQIRNGNEATSLAK

SEQ ID NO: 145495 - protein, 43 aa, Glycine max
  Coding DNA Sequence Number=SeqID_28717
AWLSARIRPLSEVYRFEKLQLSLSQALAGLAKMMHLKYRGACA

SEQ ID NO: 145496 - protein, 41 aa, Glycine max
  Coding DNA Sequence Number=SeqID_28718
MVEAKIIKTSQKAENNKSKSSKSSEAFNQTPCFGLGITFNC

SEQ ID NO: 145497 - protein, 159 aa, Glycine max
  Coding DNA Sequence Number=SeqID_28719
  Gene Ontology: Mol. function=nucleic acid binding; Biological process= DNA integration
  Homolog annotation: Hit_ID=Q1T010; Match level="QueryCoverage=93%, HitCoverage=12%, E-value=2e-30, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MGQDGGNVMENLPILDDKNWHRWYAHIKVILRYQEVLEIVEKGYSSLAEDATKEQKSVDNSHFEKIIGEKTSLEAWKILKKGTEGAKQLKKVHLQTMRMQFELMQMEENERVVEFFNRVFTLTNAMKSCGEKIIDLTILEKVLRTLNPKFDYIVVAIEE

SEQ ID NO: 145498 - protein, 283 aa, Glycine max
  Coding DNA Sequence Number=SeqID_28720
  Gene Ontology: Mol. function=transferase activity; Cellular component= nucleus; Biological process=DNA integration
  Homolog annotation: Hit_ID=Q1S0E3; Match level="QueryCoverage=84%, HitCoverage=35%, E-value=4e-44, Identity=34%"; Hit description =Peptidase S8 and S53, subtilisin, kexin, sedolisin; Zinc finger, CCHC- type; Peptidase ...
  Homolog annotation: Hit description=aspartic, catalytic; Polynucleotidyl transferase, Ribonuclease H fold
  Pfam annotation: Domain name=rve; Domain location=96-258; Score=39.3; E_value=1.3e-08; Accession=PF00665.16; Description=Integrase core domain
MAKEADSEDDVLLKSQIRFTNNRIIQAEVTGDILIRRKDGNQAMIKDVLYVPAMKGNLISINIGQLIEKGFSMNLHQGILELYKHRKVLKNPTPSQQNIPNVCGPFKVSSLGGNKYFVSFVNEFSKKLWTYPLKAKSEVFDTFKVFKILVEKQSGKNLKILRINGGGEFTSGEFENFYRDNGIIHEMTTQYTPRHNGSYKLYNPKKKKVIYNRDVQFDELKYWKDKHNQKEQATVNVQVPMENSVKHQDEAIPHGEDKGEFMNIALMAATEPVKFQDAVKEKL

SEQ ID NO: 145499 - protein, 180 aa, Glycine max
  Coding DNA Sequence Number=SeqID_28721
  Homolog annotation: Hit_ID=Q949Q9; Match level="QueryCoverage=55%, HitCoverage=18%, E-value=3e-21, Identity=50%"; Hit description =Putative growth regulator protein
  Subcellular localization annotation: CTP_CleavageSite=36; ConfidenceScore=5.09e-01
MDTQIARDHLQYFLPNFQHQYGLRSPGRSSAVATVVAAVPARSEQEQRLGFVEGEQFHGEVGLYSYVGSFQKASIKNGVVLVHKRAPPGSVYRSPQLFQNLWPLMEADNGTTLNVLMKAWTKNELREWKPCANASLPETELPKSNGFLIIEANGGLNQQRLSASLYRTMNEAWNTITSEK

SEQ ID NO: 145500 - protein, 368 aa, Glycine max
  Coding DNA Sequence Number=SeqID_28722
  Homolog annotation: Hit_ID=Q00XE1; Match level="QueryCoverage=64%, HitCoverage=87%, E-value=2e-22, Identity=32%"; Hit description =Homology to unknown gene
  Pfam annotation: Domain name=DUF179; Domain location=175-368; Score =238.0; E_value=2.1e-68; Accession=PF02622.6; Description =Uncharacterized ACR, COG1678
  Subcellular localization annotation: CTP_CleavageSite=51; ConfidenceScore=5.20e-01
MDLCAAHAKNLFHTNSFYHRPIPSNLGRSRVFEITVSRRNPYSKGYRLFVVSATGKNNHDHNSSSSVFVMNGSNIYLLLPSNLDLHFPLAISGQSNDEWSIPEEDGTRGNNSSDGNKSDNNSEKCHHTNLDWREFRAKLYRDELKEISDADTHNQGGTLPISKPLGAQWAHPIPVPETGCVLVATEKLDGVRTFERTVILLLRSGTRHHQGGPFGIVINRPLHKKIKHMKPTNHDLLTTFSDCSLHFGGPLEASMVLLKTEEKMKLPGFEEVIPGLCFGSRNSLDDAAGLVKKGILKPHDFRFFVGYAGWQLDQLRDEIESDYWYVAACSSSLLCGALSDSSESLWEEILQLMGGHYSELSRKPKQDM

SEQ ID NO: 145501 - protein, 443 aa, Glycine max
  Coding DNA Sequence Number=SeqID_28723
  Gene Ontology: Mol. function=hydrolase activity
  Homolog annotation: Hit_ID=Q1T171; Match level="QueryCoverage=70%, HitCoverage=95%, E-value=1e-122, Identity=68%"; Hit description =Dienelactone hydrolase
  Pfam annotation: Domain name=DLH; Domain location=226-441; Score =69.6; E_value=1e-17; Accession=PF01738.9; Description=Dienelactone hydrolase family
  Pfam annotation: Domain name=Peptidase_S9; Domain location=253-440; Score=-73.4; E_value=0.018; Accession=PF00326.11; Description=Prolyl oligopeptidase family
  Pfam module annotation: Pfam domain module=DLH::Peptidase_S9; Domain location=226-441::253-440
MGDGGGKNKKLWHEDIIVEFIGKSLSFFMMHGRLKTIWKLTGNFEVVDDRENVISRGLWMIFDHYIVVQNWVLDFVSSKEIIKSTLVWLPFLSLAMEENLLLALVIVIYRPVKVDIRTADALRGKFVRGVKWKMGLSTARTSIGSVCVCAISKPLRRHCHFLPTSVSPVFSCLQKKCKLNFQKPVQDAADSKISCSLVNVEDGIDDEACELVSGVELSLEEGDENIRAYLFKAVKNNNGTGLLLLSDVFGFEDSFTRDFAYRVACNGYNILVPDLFRGNPWTKDQQDPDVFEKWIARQNPERIAEDITRWTKWLVDEFMAVGISKKLGIIGFCFGGGQVLKVLAKDQGACFGTGVSFYGTRIDPLAASDIKAPVLFILGDNDPLCQVSEIENVEKKIASGSKVVLFPGRGHGFAHRPGSPEEDVDAEQAYVIMRDWLYDRLVV

SEQ ID NO: 145502 - protein, 77 aa, Glycine max
  Coding DNA Sequence Number=SeqID_28724
  Homolog annotation: Hit_ID=Q949Q9; Match level="QueryCoverage=91%, HitCoverage=12%, E-value=1e-22, Identity=74%"; Hit description =Putative growth regulator protein
MEVEMQAVRIAPFSNRLAQAVPSKIQGLRCFANFGALRFSEPIRTLAESLVDRMVKYSSQSGGKYVSVHLRFEEVFF

SEQ ID NO: 145503 - protein, 44 aa, Glycine max
  Coding DNA Sequence Number=SeqID_28725
EQQAEWVNTQRQILCPLSFRNSEASDKRAETNYAPFVIQISRVG

SEQ ID NO: 145504 - protein, 93 aa, Glycine max
  Coding DNA Sequence Number=SeqID_28726
  Homolog annotation: Hit_ID=Q949Q9; Match level="QueryCoverage=50%, HitCoverage=8%, E-value=5e-13, Identity=63%"; Hit description =Putative growth regulator protein
MMKDEPALFSLMGQTGVQPFRFVCFLSINVNSQIDLWEVFKQQMTDMLRHSDQKGTEIKKAGGSLYTFPMPDCMCKQVEPKSENGNMTKYIKL

SEQ ID NO: 145505 - protein, 515 aa, Glycine max
  Coding DNA Sequence Number=SeqID_28727
  Gene Ontology: Mol. function=phosphotransferase activity, alcohol group as acceptor; Cellular component=nucleus; Biological process =nucleobase, nucleoside, nucleotide and nucleic acid metabolic process
  Homolog annotation: Hit_ID=Q6ZND8; Match level="QueryCoverage=99%, HitCoverage=92%, E-value=0.0, Identity=80%"; Hit description=CDNA FLJ16191 fis, clone BRTHA2013610, moderately similar to Arabidopsis thaliana ...
  Homolog annotation: Hit description=deoxyguanosine kinase -related (At1g72040) mRNA
  Pfam annotation: Domain name=dNK; Domain location=258-416; Score =82.4; E_value=1.4e-21; Accession=PF01712.9; Description =Deoxynucleoside kinase
  Subcellular localization annotation: CTP_CleavageSite=31; ConfidenceScore=5.55e-01
MSAAFTSSSLNPQLSYSRYLALSTNTCSVCRCLSLTHSHTRNNNKTLLLLNPSRNLSLHSASEGSFITQHDPVEDAKEKKPFNFRLNRRQKGSSSSSPAPSNPDLLAIPGVGPRNFRKLVQKGIAGVAQLKQLYKDKFFGKSSDKMVEYLQSSVGIIHKNHAESITTFIKKSVDDDEEKLEDNSSSSVQKKRLTFCVEGNISVGKTTFLQRIANETIELRDLVEVVPEPISKWQDVGPDHFNILDAFYAEPQRYAYTFQNYVFVTRVMQERESSVGIKPLRLMERSVFSDRMAYALLSHCSMKVFVRAVHEANWMNGMEISIYDSWFDPVVSSLPGLIPDGFIYLRASPDTCHKRMMLRKRAEEGGVSLDYLRDLHEKHESWLFPSQSGNHGVLSVNQLPHHIDNSLHPDIRDRVFYLEGGHMHSSIQKVPALVLDCEPNIDFSKDIEAKRQYARQVAEFFEFVKKRNEVSSKEGSSQAQPQVLLPHEGGLWLPDGKPFPQEALKSLDFRRAASF

SEQ ID NO: 145506 - protein, 177 aa, Glycine max
  Coding DNA Sequence Number=SeqID_28728
  Homolog annotation: Hit_ID=Q851B2; Match level="QueryCoverage=68%, HitCoverage=36%, E-value=7e-19, Identity=37%"; Hit description =Putative ATP synthase subunit
MKQIQSQYKNNLYHLHQAYLKEKGRPKYVSPEDWNWLIKNKWSGSKFQKEDSIFGEWLDAVEVWKATHMRSNGTWCIPKEEEIMEALENVGDIYQEEISKAPVPLVEHFAMVLGRKSNHSLGVGSAPITKKFSHKKIIQNQLENAQNRVNNLELEVQKLTNITKKQEDVITQLHIEV

SEQ ID NO: 145507 - protein, 281 aa, Glycine max
  Coding DNA Sequence Number=SeqID_28729
  Gene Ontology: Mol. function=cysteine-type peptidase activity; Biological process=proteolysis
  Pfam annotation: Domain name=Transposase_21; Domain location=159-281; Score=68.3; E_value=2e-20; Accession=PF02992.5; Description =Transposase family tnp2
MELNKSWMQIIDRMTPLYDKGVQEFLDFAFNSFEKGKDYVIWEHHGEVISEPDDDDDQNNCNDGVRDMLHDLGSAMNIENITGAEEKNYTTSTDTNSVNEEEDNGKEIDALLSLLAKAFQQGNKIHVSYYEARKFIRELGLAYVKIDACLNDCILYRGGTKRKIEDGLLRHPADSITWKTLDSKYSSFVADPRNVRLGLASDGPTAPGNDIDVYLQPFIKELKELWEKGVVTYDASTKETFRLYASILWTINDFPTYGNLSGWSTKGRYAFPCCNMDTWSS

SEQ ID NO: 145508 - protein, 312 aa, Glycine max
  Coding DNA Sequence Number=SeqID_28730
  Gene Ontology: Mol. function=nucleotide binding
  Homolog annotation: Hit_ID=Q1SL19; Match level="QueryCoverage=89%, HitCoverage=51%, E-value=1e-20, Identity=33%"; Hit description =Nonsense-mediated decay UPF3
MRGHYWKGGIENREGDMLNSDNQRHVSNASKTVHGIEGPFSGISLTSDSGKKKILLLKGKQREIPSAIEGTVKQQNIQSGNSPISAPAKQNQRREASGRLIRSILLNNESRQSLSTTGAQHKIQILSSENGKRPPRTFGSRSGLNDQVSNNDAAQVNSEGDSKMALDKKFVKRDLHGLGSGEKTEKRTRNKDRPDRGVWTPLRRSDVSNAGNDHSSSSLAQPTQSNPESAEGEVKENVPSGNRGGEFSASAGGRGNPSIENDSQRNFTRRGASYIVKDDGAVSISEGKPSKKSVGHSAHEKQVWVQKSSSGS

SEQ ID NO: 145509 - protein, 90 aa, Glycine max
  Coding DNA Sequence Number=SeqID_28731
  Homolog annotation: Hit_ID=Q2HT17; Match level="QueryCoverage=65%, HitCoverage=7%, E-value=8e-11, Identity=56%"; Hit description =Cellulose synthase
MESYTTFYTLSIKSLAWQDFKDLSMGEQTPSIEEMLFMAFILKKLKVREKVIESFANLTFTLVLTRCCKSPLGQCKGYNGEAGEEASSHK

SEQ ID NO: 145510 - protein, 252 aa, Glycine max
  Coding DNA Sequence Number=SeqID_28732
  Gene Ontology: Mol. function=nucleotide binding
  Homolog annotation: Hit_ID=Q1SL19; Match level="QueryCoverage=78%, HitCoverage=32%, E-value=2e-42, Identity=50%"; Hit description =Nonsense-mediated decay UPF3
  Pfam annotation: Domain name=Smg4_UPF3; Domain location=3-203; Score =187.8; E_value=2.6e-53; Accession=PF03467.6; Description=Smg-4UPF3 family
MKVRSEREKTKVVIRHLPPSLSQSDLSQHIDSHFASRYNWFSFRPGNNRYQLPFIQTINSLATITSVSLYPNPNPNPYCSHTRQRHSRAYIDFKCPDDVFEFAEFFDGHVFVNERGAQHKVIVEYAPSQRVPKPSAKKDGREGTIYKDPDYLEFLKLIAKPQEHLPSAEVQLERKEAEQAGANKETRIVTPLMEFVRQRRAVDSGMQLIMCNSCAIVPECRVMALYCSSKGHRVAPGHHGWRPGAVLLRPKL

SEQ ID NO: 145511 - protein, 90 aa, Glycine max
  Coding DNA Sequence Number=SeqID_28733
MVQQSSSIPKIEDTKQIFCAWLEKDEREAEGQENAEGTETNTARNYMKQVFWFGCWELVRCKVQRVRNRHMQLCNCKNRGEVVAICCTRW

SEQ ID NO: 145512 - protein, 104 aa, Glycine max
  Coding DNA Sequence Number=SeqID_28734
MTIICLCVSSGPPPLDDKRCRMTIICLRVSSAPPPVDHKRRRMTIIYLCVPSDMIVSGRQKVSGMTIICLRVSSGPPPLDDKRRRMTIICLCVPSDTIVSGWEK

SEQ ID NO: 145513 - protein, 100 aa, Glycine max
  Coding DNA Sequence Number=SeqID_28735
  Gene Ontology: Mol. function=peroxidase activity; Cellular component =chloroplast; Biological process=response to oxidative stress
  Homolog annotation: Hit_ID=Q5QHW7; Match level="QueryCoverage=58%, HitCoverage=15%, E-value=2e-22, Identity=87%"; Hit description =Chloroplast thylakoid-bound ascorbate peroxidase
LVNALKLLQPIKDKYSGVTHADLFQLAGEEEARGPKILMKYGRVDVSGPEQCPEEGRLPGNNHISCGSLTAIENSLLCLSVGRMTWIEQSTVNFGINKIR

SEQ ID NO: 145514 - protein, 126 aa, Glycine max
  Coding DNA Sequence Number=SeqID_28736
MLRPSFPTLSYESEKLDVNTISEVIAIVNNMEDWGLGLHEERSYSLGPKYNQKQLYKSFTTDISSFSNRYDLRQKIVTLFDPYQRIDLLPPPMGEELSYDALGKDLRPSLDWCPEKGWTMPVPMPM

SEQ ID NO: 145515 - protein, 54 aa, Glycine max
  Coding DNA Sequence Number=SeqID_28737
MEEAMQDGVVFLPPSRGHLEEKGFLQVLPTLTRTFQELTNSLLSQVKLVVLSEK

SEQ ID NO: 145516 - protein, 74 aa, Glycine max
  Coding DNA Sequence Number=SeqID_28738
IGDGHFVSFWNQSWLPSGIRFWHFDILNDLLPKEILLEIAGTLSPRQLLAHDCPIWAPLLMGCSLQLQLIIPLK

SEQ ID NO: 145517 - protein, 51 aa, Glycine max
  Coding DNA Sequence Number=SeqID_28739
MLEGFEPSIDRVEENRQSRVCLRRRAVPVRMPIVDWRRLCKQEPQLASYIV

SEQ ID NO: 145518 - protein, 205 aa, Glycine max
  Coding DNA Sequence Number=SeqID_28740
DDMILLLGLTDTKAEELVNEETRHGLSPFHSLEKWNPTLRPGHGLVWVQCWGIPLVAWDIAQLRKIVAAIRDLVEVDDDGEELRRLDRARVLIRTPWRPILQHTFDIHMAGSALWSSDEIDSDDSDTGTLLSKMIRAFGTEYMPRSFTGDCIGRFTNQDNATIPNGPRDEEDPMSKDRGRKLVEHKNSNITGAEAQQSWYIGALK

SEQ ID NO: 145519 - protein, 114 aa, Glycine max
  Coding DNA Sequence Number=SeqID_28741
  Gene Ontology: Mol. function=hydrolase activity, acting on ester bonds; Biological process=lipid metabolic process
  Homolog annotation: Hit_ID=Q6ZCC3; Match level="QueryCoverage=53%, HitCoverage=16%, E-value=1e-22, Identity=80%"; Hit description =Putative GDSL-motif lipase/hydrolase protein
MDKGSSDHTSMAKFGLSPLLVLSILLLIMSGGAVRGQREMVPALFIFGDSLIDNGNNNNLPSFAKANYYPYGIDFNGGPTGRFSNGYTMVDEIVNGALKRIWALPAYLATLHSP

SEQ ID NO: 145520 - protein, 376 aa, Glycine max
  Coding DNA Sequence Number=SeqID_28742
  Gene Ontology: Mol. function=hydrolase activity, acting on ester bonds; Cellular component=nucleus; Biological process=lipid metabolic process
  Homolog annotation: Hit_ID=Q0R4F7; Match level="QueryCoverage=88%, HitCoverage=91%, E-value=1e-104, Identity=56%"; Hit description=GDSL- lipase 1
  Pfam annotation: Domain name=Lipase_GDSL; Domain location=44-358; Score=254.1; E_value=2.9e-73; Accession=PF00657.12; Description=GDSL- like LipaseAcylhydrolase
MKHLRDMTLTFTLTWIFWLSLISGRCLSQVVQPRVPPGQQVPCFYIFGDSLVDNGNNNGILTLARANYRPYGIDFPGGATGRFTNGRTYVDALAQLLGFPTYIAPYSRARGLELLRGANYASGAAGIREETGSNLGAHTSLNEQVANFGNTVQQLRRFFRGDNESLNSYLNKCLFFSGMGSNDYLNNYFMSDFYSTSSDYTVKAFATVLLQDYSRQLSQLYSLGARKVMVTAVGQIGCIPYQLARFHGNNSRCNEKINNAISLFNSGLKKMVQNFNGGQLPGAKFVYLDFYESSQDLSSNGTSYGFDVIDKGCCGVGRNNGQITCLPLQQPCENRQKYLFWDAFHPTELANILLAKATYSSQSYTYPINIQQLAML

SEQ ID NO: 145521 - protein, 65 aa, Glycine max
  Coding DNA Sequence Number=SeqID_28743
MTKEGNSVKVCNVYCYKVFGGARLMAIFSKVPLMDMWKDCRALQRCAIPVQLSVWFYFFQFFGSS

SEQ ID NO: 145522 - protein, 135 aa, Glycine max
  Coding DNA Sequence Number=SeqID_28744
  Gene Ontology: Mol. function=transferase activity, transferring glycosyl groups; Biological process=sucrose metabolic process
  Homolog annotation: Hit_ID=Q5EEP9; Match level="QueryCoverage=93%, HitCoverage=12%, E-value=9e-49, Identity=71%"; Hit description =Sucrose-phosphate synthase 1
MIRKIDELRQRLRMRGLRCNLVYTHAGLRLNVIPLFASRKQALRYLSVKWGIDLSKVVVFVGEKGDTDYEELVAGIQKTLVLKGAVEYGSERLLRSEDSYKREDVFSQDSPNIIYAEKSYEDCDISAILEHLKVS

SEQ ID NO: 145523 - protein, 229 aa, Glycine max
  Coding DNA Sequence Number=SeqID_28745
  Gene Ontology: Mol. function=glycerophosphodiester phosphodiesterase activity; Biological process=glycerol metabolic process
  Homolog annotation: Hit_ID=Q1FG43; Match level="QueryCoverage=54%, HitCoverage=36%, E-value=4e-10, Identity=28%"; Hit description =Glycerophosphoryl diester phosphodiesterase
MMQSSRSRKAALRVRVPSRKLMILSLAIFAILPPIFFHFRLRRLQQLQFTKCRWLNDPPLVCAHGGDSSKASPNTMASYFHALQSRVDCIEIDVSRSSDGVLFALHDRDLQRLTGSATSKVGYLNSKEIRELSASRQSTSKFTDQSILTIQDALMLTANSVRQIVLDVKVGPPFYEKELAKDVLSIACIIVFVVDFFPINMTIRLRPEGKIQFFLLILRSITINLTHQL

SEQ ID NO: 145524 - protein, 790 aa, Glycine max
  Coding DNA Sequence Number=SeqID_28746
  Gene Ontology: Mol. function=transferase activity, transferring glycosyl groups; Biological process=sucrose metabolic process
  Homolog annotation: Hit_ID=Q5EEP9; Match level="QueryCoverage=99%, HitCoverage=74%, E-value=0.0, Identity=75%"; Hit description=Sucrose- phosphate synthase 1
  Pfam annotation: Domain name=Glycos_transf_1; Domain location=408 -591; Score=86.8; E_value=6.9e-23; Accession=PF00534.10; Description =Glycosyl transferases group 1
MDMMQVTARRNTRERSNRLENMCWRIWHLTRKKKQIAWDDAQRLARKRLDREQGRNDAANDLSELSEGEKEKADANANANALEPFKDNNISRITSEMQLWSEEDDNSRNLYVVLISVHGLVRGENMELGRDSDTGGQVKYVVELARALANTKGIYRVDLLTRQIASPVEVDSGYGEPIEMLSCPSDGSDCGGAYIIRLPCGPRDRYIPKESLWPHLPEFVDGALGHIVNMARVLGEQVNSGKPTWPYVIHGHYADAGEVAAHLSGALNVPMVLTGHSLGRNKFEQLLKQGRLSREAINATYKIMRRIEAEELGVDAAEMVVTSTRQEIEEQWGLYDGFDLKLERKLRVRRRRGVSCLGRRTPRMVVIPPGMDFSYVTTQDSVEGEGDLNSFIGSDRAQSKRNLPPIWSEIMRFFTNPHKPTILALSRPDPKKNVTTLLKAFGECQALRKLANLTLILGNRDDIEEMSSSSSTVLTMVLKLIDKYDLYGQVAYPKHHKQSEVPEIYRLAAKTKGVFINPALVEPFGLTLIEAAAYGLPVVATKNGGPVDILKALNNGLLIDPHDQKAIEDALLKLVADKNLWLECRKNGLKNIHRFSWPEHCRNYLSHVEYGRNRHSTSRLEITPMTEESISDSLRDVEDISFRFSTEGDSKQNGEMDTAARQKQIIEAIMCRVSSTGKSNASYFPGRRQRLVVVGADCYDSDGNIAEEDFQAVIMNVMKSVRPGIRSGKVGVVLLTGLSFQETTEALNSFQVNIEEFDAVVCNSGSEMYYPWKDLMADADYEAHVEYAWP

SEQ ID NO: 145525 - protein, 584 aa, Glycine max
  Coding DNA Sequence Number=SeqID_28747
  Homolog annotation: Hit_ID=Q5DMX1; Match level="QueryCoverage=67%, HitCoverage=66%, E-value=1e-115, Identity=58%"; Hit description =Membrane protein-like
  Pfam annotation: Domain name=Sad1_UNC; Domain location=277-401; Score= 185.8; E_value=1e-52; Accession=PF07738.3; Description=Sad1  UNC-like C-terminal
MVVLGALLRIELFIFYWGVAVNWVDVQCRDHGKLFWKEGLYRRLQVGGTMSICIKFLCRWFLFCGVWSSSSAYGQAMAMVMECYQWWKDEILPYKHANAPYGTAMAGFPSQIAYGDHESREVPVGVSNWNEDEHRQCKKSNSADEYLTKETDDVYIPSETFCSDGAKTDGLIGESLSSGESINRVETGYKENYISPDTEEHEVERSKSAAKHQNDVQKYNHLSQAMPLGLDEFKSRAIGSKIKSGTNPSGSVIHRLEPGGAEYNYASASKGAKVLASNKEARGASDILSRNKDKYLRNPCSSEEKFVVIELSEETLVKTIEIANFEHHSSNFKEFELYGSLVYPTDAWIFLGNFTASNVKQAQRFVLEEQKWMRYIKLNLQSHYGSEFYCTLSIVEVYGVDAIERMLEDLIYAQDKPFASGEGNGEKRVASPLSNAAKADNVRPNTITGINSDPASEISSENQEAIIVKRNVPDPVEEIRQQVGRMPGDTVLKILMQKVRYLDLNLSVLEQYMEDLNSRYINIFKEYSKDMGEKDLLLEKIKEEISRFLERQDVMMKEFSDLDSWRSHFSVQLDHVLRDNAVLR

SEQ ID NO: 145526 - protein, 294 aa, Glycine max
  Coding DNA Sequence Number=SeqID_28748
MSRQTETPFLEEWLSIRCGINAAAAAAAATITKPTARAIVQAWTALRDSLQSQQQQHLQTLVNSQSSLHVAEPQAKLLLTLLQSSPTSSFPPLFTLLYTWLRKSPNPNSNIIDSAVEILSHFHPDDTFSPEGVLLLGAFSFVPSVSEKTKTRCLDMMLKVLLAAEKGKLLGELPRVLAGIGYALSCSVTVCCVEMLDLLFRIWGKGDGCVAHGLMVLYLFDWVVSNLIGFGYSDKNRVLVQEGFGSFKEKSHASLFVVFMAGVGVLRALERRGVRLSEHVSGMRIKDCVVGRIE

SEQ ID NO: 145527 - protein, 176 aa, Glycine max
  Coding DNA Sequence Number=SeqID_28749
  Gene Ontology: Mol. function=ribonuclease H activity; Biological process=RNA-dependent DNA replication
  Homolog annotation: Hit_ID=Q1RYI2; Match level="QueryCoverage=90%, HitCoverage=40%, E-value=8e-17, Identity=42%"; Hit description =Ribonuclease H
MAWKRICQPKCNGGLGLQTSKEANQAYLMKGGWELSSRKNDLWVQIIRSKYRYCPSIRAIPPPNVIRGEDQLCWKGNANGQFSVASAYESITEPLLVEIWKWRGPERIKILLWKFASNALLTNERRVNRRIASDPSCPRCGQNVENDDHVFRWNGNSKAIWYLDSRRSAAGGVFRN

SEQ ID NO: 145528 - protein, 60 aa, Glycine max
  Coding DNA Sequence Number=SeqID_28750
MESQLVDGNDDMGVSGDVGLSTYEVQMHQETYEVTIDVEGKRGEFTGLNPPVTKTDNTNN

SEQ ID NO: 145529 - protein, 76 aa, Glycine max
  Coding DNA Sequence Number=SeqID_28751
MPFLWFQSLVFLCTCRGQFSKVGNIYIKTLRMKPRAWFRGCHKEAHHHRRPWIRAWRKKEMNEGRGREEHENLCSK

SEQ ID NO: 145530 - protein, 222 aa, Glycine max
  Coding DNA Sequence Number=SeqID_28752
MEHPNGKVARASHSVFMAFMTMGKDSEKNDEVSLKEQLVFHYMQRSLLGYPGITPFEGMASGVVGMVQHLPAGSPAIFYCVHSLVEKANQLCSEVFTNEADAWKKWQGEPEPSKKLLDLLLRLVFLIDIQVLPDLMKLLAQLITKLPRDAQNIVLNELYSQVADSDDVVRKPTLVSWLQSLSYLCTKATNQNAANRKSESEDNPTLSSIADPYNSGRATARL

SEQ ID NO: 145531 - protein, 266 aa, Glycine max
  Coding DNA Sequence Number=SeqID_28753
MVLKKIGYCFRHSSLFVCLGLALLTEIFPLPRLYRSVFESSCDSGGVELREIREHLDGVLFKEAGGVTGVLCSQYVLADEESKNVVENLMWEYCRDVYFGHRRVAVMLKGKKDELLEGLEKLAESAFLMVVVFALAVTKHKLNSNFAQEIQMDVLLKILVSFSCVEYFRHVRLPEYMETIRKVVAGIKNEDACTSFVNSMPSYADLTSSPDCVCLLDQKTNYLWSKDEVQTARILFYLRVIPTSIECLPSLVFRNMVAPTMFLYPI

SEQ ID NO: 145532 - protein, 244 aa, Glycine max
  Coding DNA Sequence Number=SeqID_28754
EFYAKLYSPEGPSPKQVRIRGHLITIDADSLNAFLETPVVLAEGESLPAYSRYYRMPTDIREIKVALCIPGRGFILNVEGHPGKILRKDLTTLAQVWSVLSYFNLVPTSHTSDMTMDRARLIFVLVTQLDMNVKALIARQITSMAQSNSSRLRFPALITVLCRTRGVASDSLVFERLSPVINLAYIRKNCWNPNDPTIIIRGARRPRARPVEAPSTSAAPPPAHIVAAPSTLPPADFQCFEAKL

SEQ ID NO: 145533 - protein, 66 aa, Glycine max
  Coding DNA Sequence Number=SeqID_28755
MVVISLSMKLKERALFYWFFEATHKPEQKPVLLWLNGAKHKGYVSGSLSDEGKVVLGGHSGKLESS

SEQ ID NO: 145534 - protein, 44 aa, Glycine max
  Coding DNA Sequence Number=SeqID_28756
MDNHEHANHRDTAQARIKNKVSSLENQNYMSSTNDPAINREGND

SEQ ID NO: 145535 - protein, 257 aa, Glycine max
  Coding DNA Sequence Number=SeqID_28757
GVRDMRSWVRGLWIPFDADALSQFLGDPLVLEEGQECEFNQRRNRADGFDEEAIAQLLCTSGQDFTRTAAGRQVQIMHTNMTTLTHMWMALLLSNVLPSDHNSDLPLSKCQLVYAILTRMSVHVAQLIVDAIYLFTSMPPTRHPLDLDKSNRALGFLALITGLCQSFGVPVTPNKADAPQAADTPPPPHQADPARSLGMERYLQHLGFAPFTCPTPEQFSPRPIQGRHLPDSPADAEEARMDEEMTDLLGFLGGSGA

SEQ ID NO: 145536 - protein, 144 aa, Glycine max
  Coding DNA Sequence Number=SeqID_28758
  Gene Ontology: Mol. function=nucleic acid binding; Biological process= apoptosis
MTLQLADRSITRPYGVIEDVLVRVKHFIFPADFVVMDISEDIGIPVILGRPFMFTASCIVDMGKRKLELGFEDQKIDFDLFVEDKPTPEHNVFLQVMEGGQEVLKVRTKIPFIKRKPRAKRFFGHALSQESLALSAQPLHLRLI

SEQ ID NO: 145537 - protein, 185 aa, Glycine max
  Coding DNA Sequence Number=SeqID_28759
QTQEHRSLEQMDQWLALNSGFTCDSPQISASPHQLDLAPYASGPYNAQWNAPGLLNDKHTLRSSRILGEMEVDEPWLGLSRCKIHFLVGMTFVDNWAVGKEKVGYWLSNDIVGLVETWLYRNGSHSMGFSLILTLFICPMKTKSAKIEGKNLGCQIPPPLGVFFERSVPPFRTCSVVASYPKPLY

SEQ ID NO: 145538 - protein, 94 aa, Glycine max
  Coding DNA Sequence Number=SeqID_28760
MTWIWHGEMTDMQSRPQSEPFYVEMGDRLEDMICDLGQESFQQAYAPMYDTLQSDSKLQGQWTPAETIPHKSFLGGCSGGRDLLTSPYFSPAMT

SEQ ID NO: 145539 - protein, 81 aa, Glycine max
  Coding DNA Sequence Number=SeqID_28761
MILHEIRRPNSLKTIPSGVANCCSLPFGGRATRGSRVRLPWEENAWSRHQRLFEENVGKTGKGCLPRSYVFLNCDKEIRPT

SEQ ID NO: 145540 - protein, 88 aa, Glycine max
  Coding DNA Sequence Number=SeqID_28762
MSEEGELQEQIKADIKALKEKMTTMMEAMMSMKKIMEVNAAAVAATSAIAEVNPTPSSDLNQINRPISDMVGQGGKELGSTSGPHFVQ

SEQ ID NO: 145541 - protein, 223 aa, Glycine max
  Coding DNA Sequence Number=SeqID_28763
  Gene Ontology: Mol. function=helicase activity
  Homolog annotation: Hit_ID=Q1SN45; Match level="QueryCoverage=80%, HitCoverage=10%, E-value=5e-35, Identity=43%"; Hit description=AAA ATPase
MVESERLSYIRTTLKNLELTSYDRVTVVVVYDANGALENPITQNDEIKEYVDYRYISPCEATWRIFGFPIHARKPVVERLHFHLPGQHSVLYEDDDDIDDILSKPSISDSKFLAWMNSNKCFSEGRNLTYSQFVSKFMYNQKARSWNLRKKGNTIDRLIWVQPTTGELFYLRMMLTTCKGPTSFEVFYTLHIEKHASQWVFCKMTENLWKQSKKLRTGEQLII

SEQ ID NO: 145542 - protein, 44 aa, Glycine max
  Coding DNA Sequence Number=SeqID_28764
MALTMMKIEKESEEIFNIVHVIDQLYGEVSRSFVVKWKDELEPT

SEQ ID NO: 145543 - protein, 143 aa, Glycine max
  Coding DNA Sequence Number=SeqID_28765
LVQNAFWMLPVDPNGQNVGLCTRDFQVFCLCSVLLGCDSLCCLNVVLLGCCGSLGGLMGTRGWWVYARIVDVENLLCTIARPPPSTTCDGVKLPAFIVDHRVVPGDMSRGSGDLGDVRRAPGSQQIKGKQDHKARRLVVAGQL

SEQ ID NO: 145544 - protein, 110 aa, Glycine max
  Coding DNA Sequence Number=SeqID_28766
MTQNPTFFPRIEIIKDPFLDYTNPKIHYKKSALLKMPLVATYPSVGGRRGARGCVFQGRKMRGVTTNVYSRKTSEKLERCGLRTLSVKGSGVVFTHGEVDKGVSLAPTYP

SEQ ID NO: 145545 - protein, 34 aa, Glycine max
  Coding DNA Sequence Number=SeqID_28767
MAGKDRILILGPTGRLLIEDQIKINAAIKEAGTS

SEQ ID NO: 145546 - protein, 63 aa, Glycine max
  Coding DNA Sequence Number=SeqID_28768
  Gene Ontology: Mol. function=serine-type endopeptidase activity; Cellular component=mitochondrion; Biological process=proteolysis
  Homolog annotation: Hit_ID=Q9XKK8; Match level="QueryCoverage=53%, HitCoverage=15%, E-value=9e-09, Identity=82%"; Hit description=LON protease homologue
MNIPEVKARAPPRRVIKQEVQAYGSSGLTIVRPPRFDCREAAERVATPEVTVGLVWTAFGGEV

SEQ ID NO: 145547 - protein, 183 aa, Glycine max
  Coding DNA Sequence Number=SeqID_28769
  Gene Ontology: Mol. function=DNA primase activity; Cellular component= alpha DNA polymerase:primase complex; Biological process=DNA replication, synthesis of RNA primer
  Homolog annotation: Hit_ID=Q1SFA0; Match level="QueryCoverage=77%, HitCoverage=30%, E-value=7e-75, Identity=90%"; Hit description =Eukaryotic-type DNA primase, large subunit
  Pfam annotation: Domain name=DNA_primase_lrg; Domain location=1-137; Score=95.0; E_value=2.2e-25; Accession=PF04104.4; Description =Eukaryotic-type DNA primase, large subunit
MEKINEGVGINLDDALAFWRSEFSKKVGLEKFEKQYAYNIRHNYGKEGKRTDYTPYSCQKIISSTPGAGDHHGCPYRNFSEENLRAALSRMGVNSWAMEDVMDKVKNRHYQLACTLTFEALHGMTCDAGINHPNQYFSDSQKILKPKVCHTSVPLVMDLQRDNKVNHLSLPNSTEVGKPFKER

SEQ ID NO: 145548 - protein, 212 aa, Glycine max
  Coding DNA Sequence Number=SeqID_28770
  Homolog annotation: Hit_ID=Q2PXN5; Match level="QueryCoverage=30%, HitCoverage=100%, E-value=4e-28, Identity=85%"; Hit description=RW1 -like protein
MGFIMEFAENLVLKLMEDPKERDRRFREHVYRVKDRCEKTKEMWSYPMRPYGFWTFERHNSQLAWDAQISQVAGRRDPYDDILQHFSTPPNMSDFEHENPSLPSPKDLSSSVPITYAFSAVCFVMGIYGAYYFGQFQNLKDVFKLQKQIKELVPRCIHAFAGDIVLVGELREEQMGKVHQFELRAKMGGHTGVGVASIVEKKGSAIVEIEGD

SEQ ID NO: 145549 - protein, 514 aa, Glycine max
  Coding DNA Sequence Number=SeqID_28771
  Gene Ontology: Mol. function=oxidoreductase activity; Cellular component=integral to membrane; Biological process=electron transport
  Homolog annotation: Hit_ID=Q2R447; Match level="QueryCoverage=91%, HitCoverage=91%, E-value=1e-138, Identity=52%"; Hit description =Cytochrome P450 family protein, expressed
  Pfam annotation: Domain name=p450; Domain location=67-513; Score =235.1; E_value=1.5e-67; Accession=PF00067.12; Description=Cytochrome P450
MKPTATFFFLLSTTTLLVCLCLGTTTFQTTLFITFFTISLNYWLVPGGFAWRNYHSYHTNEKPNKKLTGPMGWPILGSLPLMGSLAHQKLAALAATLNAKRLMALSLGPTPVVISSHPETAREILLGSSFSDRPIKESARALMFERAIGFAPSGTYWRHLRRIAAFHMFSPRRIQGLEGLRQRVGDDMVKSAWKEMEMKGVVEVRGVFQEGSLCNILESVFGSNDKSEELGDMVREGYELIAMLNLEDYFPLKFLDFHGVKRRCHKLAAKVGSVVGQIVEDRKREGSFVVKNDFLSTLLSLPKEERLADSDMAAILWEMVFRGTDTVAILLEWVMARMVLHQDVQKKAREEIDTCIGQNSHVRDSDIANLPYLQAIVKEVLRLHPPGPLLSWARLAVNDVHVDKVLVPAGTTAMVNMWAISHDSSIWEDPWAFKPERFLKEDVSIMGSDLRLAPFGAGRRVCPGRALGLATTHLWLAQLLRHFIWLPAQPVDLSECLRLSMEMKTPLRCLVVRR

SEQ ID NO: 145550 - protein, 415 aa, Glycine max
  Coding DNA Sequence Number=SeqID_28772
  Gene Ontology: Mol. function=protein serine/threonine kinase activity; Biological process=protein amino acid phosphorylation
  Homolog annotation: Hit_ID=Q2R441; Match level="QueryCoverage=51%, HitCoverage=74%, E-value=1e-68, Identity=56%"; Hit description =Uncharacterized plant-specific domain TIGR01627 family protein, expressed
  Pfam annotation: Domain name=DUF579; Domain location=171-415; Score =452.4; E_value=5.9e-133; Accession=PF04669.4; Description=Protein of unknown function (DUF579)
MSKLIHRPCTPSPLRSTSMCSQQQRPSHHQPSHHHAQLHPQHLYVIIALWQGSRQGVAVNDDILGAMDVHDDKFHGFDDLLHGLNSQESPHSSWRAWSMVVRHGNDDFRWKRERKGDDVTQDISDKGYSMQLANERMKSRWFVWLLAVLGIIGATLFIVSLIQTSENNFLCSITRTMQQQQQQFTDGPTSMQLKAILHYATSQIVPQQSLSEITITFDVLQSLHRPANFLVFGLGRDSLMWASLNPHGTTLFLEEDPKWFGIVTKEAPYLRAHTVRYRTQLREADSLMSSYRSEPACFPATATLRGNERCKLALHNLPDEVYEKEWDLIMIDAPKGYFAEAPGRMAAIFSAAVMARDRKGSGVTHVFLHDVDRKVEKVYAEEFLCRKHLVKGVGRLWHFEIPPMGNNTRDYARFC

SEQ ID NO: 145551 - protein, 54 aa, Glycine max
  Coding DNA Sequence Number=SeqID_28773
MGWTVGGAGILQAASSLPLCSQQSLLGTKGTLSLLSFLTEDGELDMKINAKFND

SEQ ID NO: 145552 - protein, 149 aa, Glycine max
  Coding DNA Sequence Number=SeqID_28774
MACRGMLRSTILIEPSLLRSLNFNSNKHHIASLNQWSCRFHSPKPPYSSSQNETPLSQDPVLKAISEISKGEGRVGQTTNVIIGSTAADDSNNEWLALDQKVNSYPTDRGFTAIGTGGEDFVQAMVVAVESVIQQPIPQDKFFYISIAG

SEQ ID NO: 145553 - protein, 57 aa, Glycine max
  Coding DNA Sequence Number=SeqID_28775
MHTQTYKVTSDVSIFGTAEAARFAANNGPEKGSCKSRKLKQTQLALVEAYYRVDLRL

SEQ ID NO: 145554 - protein, 153 aa, Glycine max
  Coding DNA Sequence Number=SeqID_28776
  Gene Ontology: Mol. function=transferase activity; Cellular component= chloroplast; Biological process=carotenoid biosynthetic process
  Homolog annotation: Hit_ID=P37271; Match level="QueryCoverage=91%, HitCoverage=23%, E-value=2e-37, Identity=62%"; Hit description =Phytoene synthase, chloroplast precursor
  Pfam annotation: Domain name=SQS_PSY; Domain location=5-153; Score= -124.4; E_value=0.05; Accession=PF00494.10; Description =Squalenephytoene synthase
MGISLNSQATTESVYNAALALGIANQLTNILRDVEEEVLDHYKSISNSIPEDYDMHITSLRHMMSRLYRLTKKKKLDANGGRVYLPQDELAQAGLSDEDIFAGKVTDKWRNFMKNQIKRAKMFFDEAKKGVTELNEASRWPPFQDQWGWLREA

SEQ ID NO: 145555 - protein, 311 aa, Glycine max
  Coding DNA Sequence Number=SeqID_28777
  Gene Ontology: Mol. function=calcium ion binding; Cellular component =nucleus; Biological process=regulation of transcription, DNA -dependent
  Homolog annotation: Hit_ID=Q9FYG2; Match level="QueryCoverage=74%, HitCoverage=20%, E-value=9e-54, Identity=46%"; Hit description =Calmodulin-binding transcription activator 4
  Pfam annotation: Domain name=CG-1; Domain location=21-139; Score =261.3; E_value=2e-75; Accession=PF03859.7; Description=CG-1 domain
MSPAYLILLLSEGYEYDINDLHQEAQARWLKPAEVMYILQNHEKFQFTQEVPQQPTSGSLFLFNKRILRYFRRDGHNWHKKSGGRTVGEAHERLKVLNVEALNCYYARGEQNPAFQRRSYWMLDPAYEHIVLVHYRNTSEGKLSSGAGAQLSPSSSVYTQSPSPYSTQNPGSTSILGDSYEPNQSFSSPGSTKVTSEIFVLNNKMGHMDWADTESGTSSELEVTQALRRLEVQLSLNEDNFEDIVSFGSKHETVHDSNPKHDQRVISNQEQSAAFSRPDDQGLFYDGCNGRQDISVFYLFNCACSILHLHS

SEQ ID NO: 145556 - protein, 106 aa, Glycine max
  Coding DNA Sequence Number=SeqID_28778
MTEGCGEGFCLANLPGDAFSLWGNFFEAKKQMMADAKFAGLLGLGKPLVEILPPGQLRGFCPLLAWLGSAVLGFVGDLEGTGRIKATRADLSGSCSKPLCHLQYPV

SEQ ID NO: 145557 - protein, 59 aa, Glycine max
  Coding DNA Sequence Number=SeqID_28779
MFNPPGICESLKISEKNCFREENLSRGTSVTLPRRFRGRFREDFPPFFIVLRSFFSLQP

SEQ ID NO: 145558 - protein, 73 aa, Glycine max
  Coding DNA Sequence Number=SeqID_28780
MDLKPEMKHMSFGIHYDEGKEAFKLHNECRLCPSNVMQKDKTSDKHTPGCFLPSEMEEIAQFLKRSFSRMRNV

SEQ ID NO: 145559 - protein, 261 aa, Glycine max
  Coding DNA Sequence Number=SeqID_28781
  Homolog annotation: Hit_ID=P31701; Match level="QueryCoverage=26%, HitCoverage=17%, E-value=1e-14, Identity=45%"; Hit description =General secretion pathway protein D precursor
GPDHHAAVFCRDGGRYFRLALTPLNNRGAREQAVDRPSYSTFLPDKSGIHAPAGMANDDIGKIHDAHWFGRYQAAKNGEKAHGYKVGEWAIGAELLANAPEAAALGKIAGLLFSDNAKKSLVIVEHGGKQTGYGVGDRLAGSNAVIVRIVKNKILLDENGYYATLTFKDAGLWRALAAAAVMIALGGAARAEQFSANFKGTDIQEFINTLDEKQYYQFFLNVLDVYGYTVIGMPNNVLKAIAEWDEVVMRVVPLRNIAAKD

SEQ ID NO: 145560 - protein, 251 aa, Glycine max
  Coding DNA Sequence Number=SeqID_28782
  Gene Ontology: Mol. function=protein transporter activity; Cellular component=type II protein secretion system complex; Biological process=protein secretion by the type II secretion system
  Homolog annotation: Hit_ID=Q8GBE0; Match level="QueryCoverage=59%, HitCoverage=95%, E-value=6e-22, Identity=34%"; Hit description=Yts1J protein
HRRPGAQPERDRSQDRCAVGGGQPVDAAAARPASADAGLAFGHCGDGRIATRLWRCWPTGHCHETRFAMRFYAGGNAAGHRPVRHAVAHRAGALAGGAGVRGAADGGRGRGYTAAADPKRLAESTRSAAARHAGAGGVSLPAGAARASQLSEFGQPAGGGAQRAAAAGGDAVPPAFLPAGRMVDGLARRRAAAAGGGDRRRNPRAGGGAPHRHGAHREAIMKKQRGMALLMVLLLMSLMAIVAININDNWQ

SEQ ID NO: 145561 - protein, 116 aa, Glycine max
  Coding DNA Sequence Number=SeqID_28783
MKSSDANSTWIAKKLTSLLVADPHINYPTMRQVLLEKYGIVPSNDMQLSWVKRKGFVRVCRPWFGIDACNKGCSLLRLQWLRSRIKTLEGTFMKQWSMFFPIRDIVGNEKVEGVEL

SEQ ID NO: 145562 - protein, 92 aa, Glycine max
  Coding DNA Sequence Number=SeqID_28784
MVPIIEDDVCSNGNCPMRVDEVYVNDKDVTYEGLSEGYSCDNEYSPFGKHVESIDGDALNDSDELVDVIGAEVVHSNSDMEEIYEENEFHGK

SEQ ID NO: 145563 - protein, 68 aa, Glycine max
  Coding DNA Sequence Number=SeqID_28785
MSGFTRDSPQISASPYQLDFTLYASGSYNAQWNAQGLLHDKHTLRSSRILRKMEVVFVIGSAVDRLCG

SEQ ID NO: 145564 - protein, 98 aa, Glycine max
  Coding DNA Sequence Number=SeqID_28786
MGAILKVVVRMSLMTHQDFQVQAIGQFAQATCAPEFWTSKTVSIRDYSSCTLVGVAVKQRANKNIDVHVTSFYHSGKFVFLEKRVVKNRMLDKWPQLS

SEQ ID NO: 145565 - protein, 101 aa, Glycine max
  Coding DNA Sequence Number=SeqID_28787
MVEKVRNFITNHRETQKNSNILQLNGHEAEREHKSVHGSGPKAQEAKDQWIMFEEGSGADYIINARMTVEMSFMGLEKVDKTTKGYGSFLIILIVQKARKG

SEQ ID NO: 145566 - protein, 106 aa, Glycine max
  Coding DNA Sequence Number=SeqID_28788
  Gene Ontology: Mol. function=oxidoreductase activity; Cellular component=chloroplast; Biological process=metabolic process
  Homolog annotation: Hit_ID=Q1HBJ0; Match level="QueryCoverage=65%, HitCoverage=11%, E-value=1e-11, Identity=50%"; Hit description =Polyphenol oxidase
MNKQVPKNCSRHGSDKYVKFDVHIDDDEDNLSEPEQTEFVGTFVNLFHGQGHNIKVTSFKVGISKVVDCLEAEEDDVVLVTLVPKVGKGDVIIGGIKVEFIPKYKD

SEQ ID NO: 145567 - protein, 47 aa, Glycine max
  Coding DNA Sequence Number=SeqID_28789
MWAPRYRKIRNLKWTKLKPSQQQCCWGGVASSKGHNFTWENTRKSST

SEQ ID NO: 145568 - protein, 346 aa, Glycine max
  Coding DNA Sequence Number=SeqID_28790
  Gene Ontology: Mol. function=protein binding; Cellular component =membrane; Biological process=defense response
  Homolog annotation: Hit_ID=Q2L360; Match level="QueryCoverage=99%, HitCoverage=50%, E-value=3e-63, Identity=39%"; Hit description =Putative CC-NBS-LRR resistance protein
  Pfam annotation: Domain name=NACHT; Domain location=174-332; Score= -30.8; E_value=0.014; Accession=PF05729.3; Description=NACHT domain
  Pfam annotation: Domain name=NB-ARC; Domain location=133-345; Score= -26.1; E_value=1.3e-08; Accession=PF00931.13; Description=NB-ARC domain
  Pfam module annotation: Pfam domain module=NACHT::NB-ARC; Domain location=174-332::133-345
MAESLLFTVAESLIGKLTSRAIEEASLTLGVYRDLQDMKDKMALIKAFMLDAEHKKPHNNVLSEWLRQIKHVFSDAEDIVDDFECTALRKRVVNMVAAQVRMAREIKDINQRLAKVAAQRDMFGLQINEKDTHVVDMREMTHSHVNHLNVIAREDDKNKIIKLLLQDGHDKSLSVIPIVGMGGLGKTTLAKLVFNEITNIDECFPLKMWVCVSNNFELRIVLIKIRNSAPNPTSEKLENFETEQLQNHLRHTLQDQKFLLILDDVWEDDNARWDELKEIIIDTGVEGSKILVTTRSPLIATLMCSNSSNSYLLEGLSKDDSFYLFLKLAFKEGEDKKHSQLLEIGR

SEQ ID NO: 145569 - protein, 62 aa, Glycine max
  Coding DNA Sequence Number=SeqID_28791
MVTDLIWCANETFCKLEFWNLLSGVLVEWHCIVSLGSAFQFGSSSTMTALSWKSDLATPTSI

SEQ ID NO: 145570 - protein, 182 aa, Glycine max
  Coding DNA Sequence Number=SeqID_28792
MGAKHLKMTKYKLHATKPRSPDEIRGAEDDVSLCRLSGFRLTDRKKNVYTDNHSGISARQRDSKVSMTNLVSAEDDIAKKNVYTDKHSGISIRQRDSKVSMTDLVSAEDDAFRITDSKKVYTDNHSGISARQRDSKVSMTNLVSAEDDIAKKNVYTDKHSGISARQRDSKVSMTDLVSAEDD

SEQ ID NO: 145571 - protein, 111 aa, Glycine max
  Coding DNA Sequence Number=SeqID_28793
MPISPCESIGWSVPSRHRGHVHKTPSGPGKAYVSPIGCPSPPARSRRREIGKDHARKTLSGPGEVQKGPGFYEAPVAPNKVIRPPINRAFLEKHCAPRQAQGETPQQPRDG

SEQ ID NO: 145572 - protein, 60 aa, Glycine max
  Coding DNA Sequence Number=SeqID_28794
  Subcellular localization annotation: CTP_CleavageSite=42; ConfidenceScore=5.04e-01
MKRDQAAKRDNSGLATKDKPEESSSSLARAQRICNSLRETVFSSALSARLALSQISLARA

SEQ ID NO: 145573 - protein, 104 aa, Glycine max
  Coding DNA Sequence Number=SeqID_28795
MENIRNLLFTVELNLKLSFTDRSSGMKGFRGALTTLKEGVKNSYDTNTQPCEIQRRQSREKYGCSKILGYDGEVSRWQQREISESRIRSLDGEEESVRKIGFTF

SEQ ID NO: 145574 - protein, 717 aa, Glycine max
  Coding DNA Sequence Number=SeqID_28796
  Gene Ontology: Mol. function=nucleic acid binding; Biological process= regulation of transcription
  Homolog annotation: Hit_ID=P93755; Match level="QueryCoverage=98%, HitCoverage=95%, E-value=0.0, Identity=59%"; Hit description =Putative CCCH-type zinc finger protein
  Pfam annotation: Domain name=Ank; Domain location=100-135; Score =30.8; E_value=4.8e-06; Accession=PF00023.20; Description=Ankyrin repeat
  Pfam annotation: Domain name=Ank; Domain location=65-98; Score=20.9; E_value=0.0046; Accession=PF00023.20; Description=Ankyrin repeat
  Pfam annotation: Domain name=zf-CCCH; Domain location=279-304; Score =26.4; E_value=0.0001; Accession=PF00642.15; Description=Zinc finger C-x8-C-x5-C-x3-H type (and similar)
  Pfam module annotation: Pfam domain module=Ank::Ank::zf-CCCH; Domain location=100-135::65-98::279-304
ASQPKSLMMNNLTIETEDSFASLLELAANNDVEGFKRMIERDPSCVDEVGLWYSRQKGSRRMVNELRTPLMVAATYGSIDILDLILSLSGCDINKPCGLDKSTALHCAASGGSENVVDVVILLLAAGADPNSVDGNGHRPVDVIVVPPKHESVRNNLEALLQTDDSIAVCNLRVITAPSNAYSPPLSTSSENGSPSAPDFQLKSKLNDGFISSASDKKEYPVDPSLPDIKNSIYSTDEFRMYSFKVRPCSRAYSHDWTECPFVHPGENARRRDPRKYHYSCVPCPDFRKGACRRGDMCEYAHGVFECWLHPAQYRTRLCKDGTSCSRRVCFFAHIAEELRPLYVSTGSAVPSPRSSTSAMDFAAAMNMLPGSPSSMSVMSPSRFTPPMSPSANGMSHPSVAWPQPNVPALHLPGSNIYSSRLRSSFNARDIPVDDFDLLPDYDVQQQLLNEFSCLSKQPMNSNAMNRSGRIKTLTPSNLDDLFSSESSSPRFADPALASAVFSPTHKSAFLNQFQQQQSLLSPVNTNFSSKNVENPLLHGASFGGQSSGRMSPRNVEPISPMSSRISVLVQHEKQQQFRSLSSRELGSNSATVAAAAAAAGSPANSWSKWGSSNGTLDWAVNADELGKLRRSSSFEHGNNSEEPDFSWVQSLVKESPSEIKENPTMMTTTTTISSVAAAGSSSEVSNMSTQMDAVDHAVLGAWLEQMQLDQLVAQQN

SEQ ID NO: 145575 - protein, 70 aa, Glycine max
  Coding DNA Sequence Number=SeqID_28797
MNHVVDVNSNENDSENDKDIGVVNIKDKEDAVNDEYKRIADLMNGSRMEKEEREETPLQGEDESRRSSPP

SEQ ID NO: 145576 - protein, 101 aa, Glycine max
  Coding DNA Sequence Number=SeqID_28798
  Gene Ontology: Mol. function=RNA-directed DNA polymerase activity; Biological process=RNA-dependent DNA replication
MENLKANDIIDHMSHSWNLEFIESIFNEYDIISIKSTPLLSLQEDDNMVWKYTSHGAYSVRSAYHCIMDNTLKVDHLKAVGDWKATEVWMTPLPVKEDKSG

SEQ ID NO: 145577 - protein, 80 aa, Glycine max
  Coding DNA Sequence Number=SeqID_28799
MYIVVVKQGQDHLGLPSEVETKRERQKPIKVGYLRTDASGDGVTTDRSLPLLCAEQAENVAARQPRILCILQLSFTICLF

SEQ ID NO: 145578 - protein, 113 aa, Glycine max
  Coding DNA Sequence Number=SeqID_28800
  Gene Ontology: Mol. function=nucleoside-triphosphatase activity; Cellular component=protein complex; Biological process=protein catabolic process
  Homolog annotation: Hit_ID=O04019; Match level="QueryCoverage=93%, HitCoverage=25%, E-value=1e-40, Identity=81%"; Hit description=26S protease regulatory subunit 6A homolog
MVSAMVEDANFEDDQLANMTIDDIVRASRLLNNEIRILKEELQRTNLTLESYKDKIKENQEKIKLNKQLPYLVGDIVEILEMNLKDEVEENGANIDLGSQRKGKCVVLKTSFL

SEQ ID NO: 145579 - protein, 252 aa, Glycine max
  Coding DNA Sequence Number=SeqID_28801
  Gene Ontology: Mol. function=nucleic acid binding; Cellular component= intracellular; Biological process=regulation of transcription
  Homolog annotation: Hit_ID=P93751; Match level="QueryCoverage=80%, HitCoverage=81%, E-value=1e-31, Identity=40%"; Hit description =Putative C2H2-type zinc finger protein
MDNTEKETHDFMNVDSFSQLPFLRPAPPSKDKAAIRLFGHEFGDAHHSNPTHNSFIISNNNVSASEHTTNKDVNNNVENGESSRRFECHYCCRNFPTSQALGGHQNAHKRERQHAKRHLQSTLISDANAYSFMNYRFGSTAMSNYSYSSYPTWNSSNSSSAMLGNTGGTGRFYGNSYSQQLQTINGSPLGLWRIPTATNSTHSQSNPIFNRERSLQPLPLFSGEEMVNARIGHSGSQNRFGKLWFQAQRKRP

SEQ ID NO: 145580 - protein, 637 aa, Glycine max
  Coding DNA Sequence Number=SeqID_28802
  Homolog annotation: Hit_ID=Q338I4; Match level="QueryCoverage=92%, HitCoverage=51%, E-value=2e-41, Identity=54%"; Hit description=Colon cancer-associated protein Mic1-like containing protein, expressed
MTGKASASKPNIGLSGSDGLSHAYIQYPPLRFNVPGSSGLFYDDGNKFLLSPTADQVFSWKVGPFDPLSDPNTDSISEGPIIAIRYSLDTKVIAIQRSNHEIQFWDRETGGTFSHKCKPESESILGFFWTDSQQCDIVLVKTRSQVQILDIASKVLGIRLHTASCYGLPLDSDWRIGSCQRSWGQTQLVGLLGLKNSEVQEIPSFNKLQYAFMSMKALIKRFRDHYGSHVFERLNILKQEKQIETETHIKKWETSTKFLKERTNISELKHMLRKILNEEVDSHASQQDKNNMEGSGSEFSEAKASSWARKVELPSFDRSIEGGPDLKGSSFECDSDPLQFLKLENRSKEGSEEVDPSIKREKHKENGVTNVGCEDDFLDNPITDLIKKEVEYGDSTKPHCFQDSDFHKKIVMVKQKSFMKVVGTTMVLESWNVNLLGEPLALNFVASMADSLAMELRQKECIEPVKLQGGSLPIYSSRIAVSVVDNVLLIHQVDAKVVILYDLFADSRAPISAPLPLLLRGFPRSSTLSQSSGRESESSDGNVLSNHEAVTYANTWTFLVPDLVCDVANKLLWKFNLDLEAISASSSEVPSILEFLQRRKLEANKSTSQLCCNCNWNYAEECVLKTLFIGAATTVPV

SEQ ID NO: 145581 - protein, 193 aa, Glycine max
  Coding DNA Sequence Number=SeqID_28803
MRITERIAVRLQQLRSFFSNKEKIMSDQTVINPTSTAAQQELSPLESFANETASAPAAADSAADSVAQPAMPPAVATPAAQPAAPASAEQPFHADAPVDLDQQLATQDTQANGSASAGASAAATPGVRNAQAAAPAVAPDAPVAATAASDAVAQDISAGVKDFVQAFSFVEQGVLKLGSAAKDELIALAKKYL

SEQ ID NO: 145582 - protein, 180 aa, Glycine max
  Coding DNA Sequence Number=SeqID_28804
  Gene Ontology: Mol. function=microtubule motor activity; Cellular component=microtubule associated complex; Biological process =microtubule-based movement
  Homolog annotation: Hit_ID=Q9C7B9; Match level="QueryCoverage=61%, HitCoverage=9%, E-value=4e-18, Identity=48%"; Hit description =Kinesin heavy chain, putative; 55116-47986
  Subcellular localization annotation: CTP_CleavageSite=43; ConfidenceScore=5.81e-01
MASKHGVKSRRFGLSGSKAANSPSSSTASSSKQFQESSADGLSSSARSKPQHFAPETVAAAPPLDGQRVKENVTVTVRFRPLNCCDCVLRMPVNLIEVCAWDSPREIRQGEEIAWYADGETIVRNEYNPSIAYAYGIICKTDIYGYGFCSLHICSFGMEGEAYIMSMVLFRLNELEQHSI

SEQ ID NO: 145583 - protein, 202 aa, Glycine max
  Coding DNA Sequence Number=SeqID_28805
  Gene Ontology: Mol. function=microtubule motor activity; Cellular component=microtubule associated complex; Biological process =microtubule-based movement
  Homolog annotation: Hit_ID=Q6YZ52; Match level="QueryCoverage=96%, HitCoverage=32%, E-value=5e-73, Identity=74%"; Hit description =Kinesin motor protein 1-like
  Pfam annotation: Domain name=Kinesin; Domain location=1-189; Score =44.8; E_value=6.8e-17; Accession=PF00225.13; Description=Kinesin motor domain
GTYVEGIKEEVVLSPAHALSLIAAGEEHRHVGSTNFNLLSSRSHTIFTLTIESSPCGENSEGEAVTLSQLNLIDLAGSESSKAETTGMRRREGSYINKSLLTLGTFFFMRCSATSCVSTVIDRMMVISKLTEDKASHIPYRDSKLTRVLQSSLSGHGRVSLICTVTPSSSSTEETHNTLKFAHRAKYIEIRAAQNKNYIPTK

SEQ ID NO: 145584 - protein, 171 aa, Glycine max
  Coding DNA Sequence Number=SeqID_28806
MTTLTQIWMTLLLSNILPNDHNFDLPVPKCQMVYTILTRMTVHVAQIIADAIYLFAGTVPTRHPLDPERSNRALGFSALITGLCQFYGVLVIPSKVIRTSITQAFIEKYCTPRQVKGDAQQAADAPPPQQPDPVIPLSVERYLWHLVRQQTANHHGQVQLHEYFYRFSLSQ

SEQ ID NO: 145585 - protein, 569 aa, Glycine max
  Coding DNA Sequence Number=SeqID_28807
  Gene Ontology: Mol. function=microtubule motor activity; Cellular component=microtubule associated complex; Biological process =microtubule-based movement
  Homolog annotation: Hit_ID=Q9C7B9; Match level="QueryCoverage=98%, HitCoverage=53%, E-value=1e-151, Identity=55%"; Hit description =Kinesin heavy chain, putative; 55116-47986
MVLNFNYLKLEDGQVKLQSRLEQEEEAKAALLGRIQRLTKLILVSTTASSSTRFPNRPGPRRRHSFGEEELAYLPYKRRDLILDEENIDLYVNLEGNAATADDSFKGEKKMKKHGLLNWLKLRKRDSALTGTSDKSSGAKSTSTPSTPQAESGNHVESRLSHSQPAESSPSADLASEAREDKYIHEDSLLGQETPLTSIKSVDQIDLLREQHKILSGEVALHSSALKRLSDEATRNPQNGHIDVEMKKLKDEITAKSEQIDLLEKQISNSFIASDKTEHSGALQTVAELMAQLNEKSFELEVKAADNRVIQEQLNQKICECESQQETIASLKQQLADALDLRNFSHVVNHSQNFSGTKDYCGELHLDKGNVTINNSNEGIQLQAQISEIEDLKQRVAELTESKEQLEFRNQKLAEESSYAKGLASAAAVELKALSEEVAKFMNQNERLAAELAASKNSPAERRTSGTVQNGRRESHARVRRNDQGASNANIKRELALSKERELSYEASLLEKDEKEAELQRKIEESKKREAYLENELANMWVLVAKLKKSQGAETDVSVSTIENLQLDG

SEQ ID NO: 145586 - protein, 178 aa, Glycine max
  Coding DNA Sequence Number=SeqID_28808
  Subcellular localization annotation: CTP_CleavageSite=55; ConfidenceScore=5.00e-01
MKLGGRQRYPSGYPYKHSFTIRKTQSTIACRDNRRLLHPLSIATNEPVDTCRFTSSSALPVILTREGRFTLVIRRRSSPTTHEILLCWVRAIKFNGVGVATYPSAGGRRVTRGMRVPRKEYARSRHQRLFEENVGKTGKDAIYELLSERFGSCIYARGRVFPFAPTYSSICDEEIRPT

SEQ ID NO: 145587 - protein, 113 aa, Glycine max
  Coding DNA Sequence Number=SeqID_28809
  Subcellular localization annotation: CTP_CleavageSite=45; ConfidenceScore=5.52e-01
MNSFPSAVHVSSTIESGAPRIHCLALFANSPFSNLIRRPMNSLPSAVHVSSTIESGAPRIHCLAVFANSPFSTFIRRPMNSLPSLVHVSFVIKRGTSEKKKREEGVETRVVID

SEQ ID NO: 145588 - protein, 220 aa, Glycine max
  Coding DNA Sequence Number=SeqID_28810
  Homolog annotation: Hit_ID=Q6N8F0; Match level="QueryCoverage=95%, HitCoverage=30%, E-value=6e-15, Identity=28%"; Hit description =Possible FusB/FusC Fusaric Acid resistance pump
MGFPEVTTPLGITSTVLSRIEEITLGIVCSSLVHALLFPVSMRSLLEQSVSQWYLNGRKLCRDLLSGISADRSPERDEILTRMATNPQQVEILITHCVYEGDAARRLIRLVSTQYQHLSYLIPTLTAIEMRLERLAARQIAFPAWVEQTLQQFLLWLNDGEAVGDVIGIQLELSLCQDRLNAAWRNGELSTEHCLLFTGLLERLVDFVRIAGAYQSVGGL

SEQ ID NO: 145589 - protein, 111 aa, Glycine max
  Coding DNA Sequence Number=SeqID_28811
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=35%, E-value=2e-49, Identity=59%"; Hit description =Photosystem II P680 chlorophyll A apoprotein
LYGPGIWVSDPYGLTGRIQSVNPAWGVEGFDPFVPGGVASHHIAAGTLGILAAFVVAGTMWYGSATTPIELFGPTRYQWDQGYFQQEIYRRVGAGLAENQSSMDNGDGIAV

SEQ ID NO: 145590 - protein, 91 aa, Glycine max
  Coding DNA Sequence Number=SeqID_28812
MEASLCIPGKGFILNTEGQPWRLLRKDLTTLAQTWSVFSYSNLAPTSRTSDFNTDRARLVYGLITKMDMNIGDRGEWDLMPLPPMKPKADH

SEQ ID NO: 145591 - protein, 210 aa, Glycine max
  Coding DNA Sequence Number=SeqID_28813
  Gene Ontology: Mol. function=DNA binding
  Homolog annotation: Hit_ID=Q1SFS3; Match level="QueryCoverage=90%, HitCoverage=35%, E-value=8e-22, Identity=32%"; Hit description =Lambda repressor-like, DNA-binding
MGTNQNGKRFYQVKVKGLDVTSLKELGRLMGPLQRQAFRKVYGKILDLTVAEVFTEAVVSLAQYYDQPLRCFTFGDFQMVPTIEEFEEILGCPLGGRKPYLFSSFLPSLSKVATVIGDSAKELDRMKQIRNSVVGLPRKYLEGKARDMASQEKWGPFADVLALLIFGVVLFPNVDGLVDLAAIDAFLAYHHSKESPVVAILADLFDTFDR

SEQ ID NO: 145592 - protein, 212 aa, Glycine max
  Coding DNA Sequence Number=SeqID_28814
  Homolog annotation: Hit_ID=Q1RUD8; Match level="QueryCoverage=46%, HitCoverage=20%, E-value=1e-08, Identity=33%"; Hit description=IMP dehydrogenase/GMP reductase
MGSNHTPSFKKSFYQVKIKSLEVASLQELGQRMGQLQRQAFRKTYGKIWDLAMIEVSVEAIASLTQYYDQPLRDLGMPARRKEAISVFWVVPLCGKSSEGEWASFIDGITLLVFGIVLFPNVDGLVVLAAIDAFLAYHHSKESPVVAVLADVYDTFDRRCEKSSTRIVCCTPALYVWRVFHIFHHENRPVYPLQGHRMCAEKGKANWEHLLA

SEQ ID NO: 145593 - protein, 106 aa, Glycine max
  Coding DNA Sequence Number=SeqID_28815
MGIACPKNHLKMYCPKMGAHAKDENLLMHFFQESLTGAAVTWYTNIKPSRVDSWKDLMVAFVRQYQYNSDMALDRMQLQNMCKKSMNPSRYTPKGGGIWQLKWHLQ

SEQ ID NO: 145594 - protein, 114 aa, Glycine max
  Coding DNA Sequence Number=SeqID_28816
  Subcellular localization annotation: CTP_CleavageSite=70; ConfidenceScore=5.29e-01
MSLAQIGLDSASPSHRYLNRRMSVHPHKMNSLSVHYCRNVPFCGRAKARLTGALSKGEKMRGVATNEGISTSHVDKSGTLAPMYPPSKRKSDLRSSSLCVNQAILFTLKGDHLK

SEQ ID NO: 145595 - protein, 149 aa, Glycine max
  Coding DNA Sequence Number=SeqID_28817
MKGQDIYSSREGTTSSPSSSGNEDEVKVKSLVRKSAPMKKVAKDQVQIKLKWDEKKNRKRKEQQPLMVKEKCKEVSVSSKRLTKKESHFAIKKNIKETSLLRQHSHLLLCKRTLVSIVIPLELEVIPQENESLDDGLVLRKEPQSFKNL

SEQ ID NO: 145596 - protein, 92 aa, Glycine max
  Coding DNA Sequence Number=SeqID_28818
MRLPGKESLLMKSPITINEILDVSISFLNDHLEETLGSTKIEEIHSKCINLAQGKDYGESGFWLKACRMARHDTCQGLVWFKDKKGCPTLFP

SEQ ID NO: 145597 - protein, 177 aa, Glycine max
  Coding DNA Sequence Number=SeqID_28819
  Homolog annotation: Hit_ID=Q1SDS1; Match level="QueryCoverage=73%, HitCoverage=25%, E-value=2e-13, Identity=34%"; Hit description=IMP dehydrogenase/GMP reductase
MVGFTPFSSRGETCLPARRPPLMHREKEASWDRLLASKEGASVNWFPRWKEGRTGILISCGGFPNVPLMGTRGCINYNPILAIRQLGYPMRGAPLEEDLTPIIARGFNSTNVEALQKVHKAWEMVQKKDKKLRGSSNGPIGDYHRWLKAYTQGLDWLPNLRTTKGVEVEAPEEGEEV

SEQ ID NO: 145598 - protein, 219 aa, Glycine max
  Coding DNA Sequence Number=SeqID_28820
  Subcellular localization annotation: CTP_CleavageSite=53; ConfidenceScore=5.47e-01
MAKRFQMKNNKNKTNLFSNQSIDRYLTTNQTVSAATNSSVLDGWKKCRINQTSVSQDWTLTTCMSDNLDVVNKGDQPVGSAFFGDVKFPHQNLIQEELLLDKDAKALSKLSAEIEKINTEKNEAIAIVVENMREEKELLNKKLKLVDAKLKKVEDQVNRFSLALKDAKDDVVESFTKDFDAVKDQVKFFHKDIDLTGLGYFKMIHGNQIIDHMVVDVVN

SEQ ID NO: 145599 - protein, 333 aa, Glycine max
  Coding DNA Sequence Number=SeqID_28821
MYASSIALFGGDWIKHESLKINDCIRDQLNRALITRIGIQSGSTTLQPQALDSLVLVVKFVTTHQVFGDKPGARYSLDQQGGEALVLGERSQLRGDIGEKNSYSKHYPYVKADVLEKHSRFITQEVVNQVKSSFVLTRSGDDQSIVCISAETGKPVFRTNPYFGEVLYFFEARVNKRISWWSLNNVSGNMDPHKMEKRFQLKTRRTKVILLIKVSMDLRFPTKQFWLLLTKAKIKAKRKKLGDREKELLAEIEKMKTGKNVVITNVMAKMKEEKELVDQNVDAIKIKLEMANKKVNELTPVLEDAKDDVVESFTKGFDAAIDQATFPQGNRLI

SEQ ID NO: 145600 - protein, 222 aa, Glycine max
  Coding DNA Sequence Number=SeqID_28822
LEDEGLCTYWIGSYHDPYNLASMHQVLEAGRLYTFEIESYPNPYNIASMHQVLEMTNSDGGCDAKVKNNKGATCELKENPTRGLGGKLKTTELERGDQKESKGGTSGVKTIGGRGYGRTAKGFPTSFRNDHGGENSAKLFVSHDHSLLVHGVACKTVLGIIGSAKCCDHGRGLIPCNMPHRGGGGVMVSSSVNHDVLDRPRVVVEAVEMIPLNTTRRAILKD

SEQ ID NO: 145601 - protein, 72 aa, Glycine max
  Coding DNA Sequence Number=SeqID_28823
MVPCFALLLVLNIIKARTLSPMKDKDEDFKSCEKARSLSPVKDKDEDFESCEKARTLSPMKDKGEEFESYEG

SEQ ID NO: 145602 - protein, 104 aa, Glycine max
  Coding DNA Sequence Number=SeqID_28824
MYKDNWTQPWPMGSEIYPKVHENPRAFFSSSSPIFLEPLAHGSSDWSLPREDFITLGALLELPDPPPLGVFFERFMLPFTHIMQLHSIRGHIRIVLILPEESCH

SEQ ID NO: 145603 - protein, 147 aa, Glycine max
  Coding DNA Sequence Number=SeqID_28825
MEAMKEQMTTMMEAMMSMRKMMEVNTAIVVAASTTTEVDPIHPSGLYQVNRPVSDMVQSKHSFSPYGLPPNYTPPNVDNSALIPIKSQQPQSSHERVPQPMEETLEVPRDHTLADFKPHLGYATEGQTFGGIPLPNTLGGPQYCPQP

SEQ ID NO: 145604 - protein, 268 aa, Glycine max
  Coding DNA Sequence Number=SeqID_28826
  Gene Ontology: Mol. function=RNA-directed DNA polymerase activity; Cellular component=intracellular; Biological process=RNA-dependent DNA replication
  Pfam annotation: Domain name=rve; Domain location=79-235; Score =128.8; E_value=1.5e-35; Accession=PF00665.16; Description=Integrase core domain
MVLLRCVDKQEAEFLMHEVHEGSFGTHSNGHAMAKKLLRAGYYWMSMETDCCKHARKCHKCQIYADRIHVPPTTLNVLSSPWPFSMWGIDMIGRIEPKASNGHRFILVAIDYFTKWVEAASYANVTKQVVVRFIKNQIICRYGVPNRIITDNGTNLNNKMMKDLCEEFKIEHHNSSPYRPQMNGAVEAANKNIKKIVQKMVVTYKDWHEMLPYALHGYRTSVRTSTGATPFSLVYGMEAVLPVEVEIPSMRVLMEAQLSEAEMVPKQI

SEQ ID NO: 145605 - protein, 221 aa, Glycine max
  Coding DNA Sequence Number=SeqID_28827
MGSIIRYLNDSDLPLDQHEDVKLIKESAGFIMLITSYIDGGLASFTKIYEGTCGSHIGGQALENKGTSFVVQVEGTSTWVVVTKNKRWYISCGSVQVEGTSTWLFKENKGRYIPCGSLLVKDFTRLKEISRIGGCLGTGCRHREWQTKVTAIFESKDLSSMYLATLFGKLQEHEMELQRLNQNEETDKKKRSIALKASSSMQEENEEEESEDEEDFSLFVK

SEQ ID NO: 145606 - protein, 325 aa, Glycine max
  Coding DNA Sequence Number=SeqID_28828
  Gene Ontology: Mol. function=RNA-directed DNA polymerase activity; Biological process=RNA-dependent DNA replication
MNKDDENDDGRTDEANAALKRMKGEIVVKQSRDFQPFAVVIVVEQILQNYFLPTITCYDGTRNLVHHGESLKYFLVRFNEVLVWVFNLDEHMVVATFCKGLLAGQFGECLVRQCVVTIAEAAGPIVEWRPTSVKDLKDVMIGKGKIAKVGLTLSLAVESTEMPVGKFLGFMLSHRGIEANMDKCSTILNMQSPNNVKEVQQLTGNILLTKIFFGLTFDHDQARSRSEDQIPKAEGLSGFVNNSEAETLFLKSSELSENGILYESRGSIKKSLKFDFNVNNNQAEYEALLRRMILAWDMRVTSLVARSDSTLVINQVLGIFQARDL

SEQ ID NO: 145607 - protein, 84 aa, Glycine max
  Coding DNA Sequence Number=SeqID_28829
MSLGNYFLKIPSESTASFILPHYEVVKTRQQLVPLSPTLGRRKALCKNFKRTYGQIRSSHPIGSLLQGPDERQRLMPQSLTLGQ

SEQ ID NO: 145608 - protein, 70 aa, Glycine max
  Coding DNA Sequence Number=SeqID_28830
  Subcellular localization annotation: CTP_CleavageSite=64; ConfidenceScore=5.69e-01
MTKEVIHGHNSTTPRLHFSSSPSSSMFFFGFRLLKNPFRVDKFTQASCSLPRRVCDLVLKVQIRSSELLA

SEQ ID NO: 145609 - protein, 53 aa, Glycine max
  Coding DNA Sequence Number=SeqID_28831
MRRRKWRKELEYPEPRSVVGFYLKNPCASSMKYKLGTRVRERNERFQISDFEI

SEQ ID NO: 145610 - protein, 90 aa, Glycine max
  Coding DNA Sequence Number=SeqID_28832
  Homolog annotation: Hit_ID=Q8W486; Match level="QueryCoverage=85%, HitCoverage=15%, E-value=4e-23, Identity=72%"; Hit description =Similar to auxin-independent growth promoter
MSQTIAFHYVCEESLFPRLENHSSVENSEELAENTRGLAGSAVDYMVCLLSDIFMPTYDGPSNFATISLDIAFTMASGLLSADRILPLSS

SEQ ID NO: 145611 - protein, 452 aa, Glycine max
  Coding DNA Sequence Number=SeqID_28833
  Homolog annotation: Hit_ID=O22159; Match level="QueryCoverage=90%, HitCoverage=85%, E-value=7e-56, Identity=31%"; Hit description =Expressed protein
  Pfam annotation: Domain name=DUF247; Domain location=22-401; Score =399.2; E_value=6e-117; Accession=PF03140.6; Description=Plant protein of unknown function
MTNNGDAVEINIEEMLKGAWAPVTTECCIYKVPFSIRRHNEEAYTPKVVSIGPFHHGHPHLQDMEKHKLFYSMAFLKRTQTTVGSLIGNIQEMEPEFRRCYSHTLEFSNEQLVKIIFVDCAFILELFCRVHDQLLKEDDDMCLSKPWLSNNIMYDLLLLENQVPFFVLERLFNLSFSSPSFLALTFHFFQQFNRSGLNFNNINRIMHFTDLIRTFHLQDPLPSRIDGNIIEHLPSVTELSEAGLKFKVLESESCLLKLDFSGEVLEIPQLVVDDRTETLFRNMMALEQCHYPFQSYITDYVDFLDFLVNTNRDVDILVRERVFLNWLGNTDCVATMINGLMKNITISNNISSQYLDVSEKLNAFHENPWHKLKSTLRRDYCRGPWQTAASTAAVILLILSFVQTVCSILQLFQGGTKVPRQPYTYLQFDQKRGEIGKVVSLSINYKRLSEQY

SEQ ID NO: 145612 - protein, 560 aa, Glycine max
  Coding DNA Sequence Number=SeqID_28834
  Homolog annotation: Hit_ID=Q1ZY19; Match level="QueryCoverage=64%, HitCoverage=76%, E-value=3e-50, Identity=33%"; Hit description =Fgenesh protein 60
  Pfam annotation: Domain name=DUF247; Domain location=22-400; Score =339.8; E_value=4.7e-99; Accession=PF03140.6; Description=Plant protein of unknown function
MEYKGDVVRINVKEMLEGARAPVTAECCIYKVPFSIRRHNEEAYTPKGVSIGPFHHGHPRLQDMEKHKLFYSMAFLQRSQTTSDSFIGKIEEMEPELRRCYSHTLEFSKEQLVKIIFVDCAFILELFCRFGSGEWKEDMYLSKPLTMRSMRYDLLLLENQVPFFVLERLFNLSFSSRGDDFPSFLQFTFHFFRWINRSSLNFNNNNRIRHFTDLIRTFHLQDPLPSRIDGKIIKHLPSVTELSEAGLRFKVLESESCLLKFDFSGRVLEIPQLVVHDSTETLFRNMVALEQCHYPFQSYITDYLHFLDFLVNTNRDVDILVQERVFLNWLGDTDSVATMINGLVKDIVLPNISSKYLDVSGKLNALHKNPWRKLKSALRRDYCRGPWQTAASTAAALSQRPAARRRIPPAAAERVMLAAACCTWHWWACFRSRGGYGGGRGGGTAGAGKRGGGTVAGGLEEVPVEEKNNESVQIKSTTAATDNFTIIPLNPEPPPLLCLLFNNASVVLRFRGEVGIGMVVAAESAGDLSGGGRWICGGGRKKGGMGLWVGLEWAIEIVLD

SEQ ID NO: 145613 - protein, 73 aa, Glycine max
  Coding DNA Sequence Number=SeqID_28835
  Subcellular localization annotation: CTP_CleavageSite=59; ConfidenceScore=5.28e-01
MRRTGFHKRQSRGGGSGFKGMIVKLSVAAVVLLICTLSLFFSSTGTSSNLQSNYCSEVRAIRSESFIDTNTKT

SEQ ID NO: 145614 - protein, 479 aa, Glycine max
  Coding DNA Sequence Number=SeqID_28836
  Gene Ontology: Mol. function=nucleic acid binding
  Homolog annotation: Hit_ID=Q8W486; Match level="QueryCoverage=99%, HitCoverage=99%, E-value=0.0, Identity=68%"; Hit description=Similar to auxin-independent growth promoter
  Pfam annotation: Domain name=DUF246; Domain location=94-408; Score =398.4; E_value=1e-116; Accession=PF03138.5; Description=Plant protein family
  Subcellular localization annotation: CTP_CleavageSite=59; ConfidenceScore=5.25e-01
MRRTGFHRRQSGGGGSGFKGMIVKLSVAAVVLLICTLSLFFSSTGTSSNLQSNYRSEIRLEELWSNAGSGGWRPSSAPRTHWAPPPTESNGYLRVRCNGGLNQQRSAISNAVLAARIMNATLVLPELDANSFWHDDSGFHGIYDVEHFIKTLRYDVKIVESIPENQKNGKKKKIKPFQLRPPRDAPVSWYTTDALKKMKEHGAIYLTPFSHRLAEEIDNPEYQRLRCRVNYHALRFKPHIVKLSQSIVEKLREQGPFMSIHLRFEMDMLSFAGAIGKCPLTPQEVGLILRALGFDNSTRIYLAAGELFGGDRFMKPFRSLFPRLENHSSVENSEELAENTRGLAGSAVDYMVCLLSDIFMPTYDGPSNFANNLLGHRLYYGFRTTIRPDRKSLAPIFIDRENGQTAGFEEAVRKVMLKTNFGEPHKRVSPESFYTNSWPECFCQISAQNPADKCPPNDILNIMNDELQKTETDTNSTIS

SEQ ID NO: 145615 - protein, 60 aa, Glycine max
  Coding DNA Sequence Number=SeqID_28837
MVVATESAGDLSGGGRWICGGGRKKKMEWTNRLWTGGYGFLGGFGEWATDCIGLRILGFN

SEQ ID NO: 145616 - protein, 478 aa, Glycine max
  Coding DNA Sequence Number=SeqID_28838
  Homolog annotation: Hit_ID=Q1ZY19; Match level="QueryCoverage=79%, HitCoverage=80%, E-value=1e-49, Identity=33%"; Hit description =Fgenesh protein 60
  Pfam annotation: Domain name=DUF247; Domain location=22-404; Score =376.6; E_value=3.9e-110; Accession=PF03140.6; Description=Plant protein of unknown function
  Pfam annotation: Domain name=GRP; Domain location=392-474; Score= -26.1; E_value=0.035; Accession=PF07172.2; Description=Glycine rich protein family
  Pfam module annotation: Pfam domain module=DUF247::GRP; Domain location=22-404::392-474
MAYSGDVVRINVAEMLEGAREPVTTECCIYKVPFSIRRHNEEAYTPKVVSIGPFHHRHPRLQDMQKHKLFYSMAFLQRTQTTSDSFIGKIEEMEPEFRRCYSHTLEFSKEQLVKIIFVDCAFILELFYRFGSGEWKEDMYLSKPLTRRSMRYDLLLLENQVPFFVLERLFNLSFSSQGDDFPSFLEFTFHFFGWFNRSSLNFNNINRIRHFTDLIRTFLLQDPLPSRIDGKMIKHLPSVTELSEAGLRFKVLESESCLLKFDFSGRVLEIPQLVVEDGTETLFRNMVALEQCHCPEESYITDYVGFLDFLVNTNRDVDILVQERVFLNWLGDTDSVATMINGLMKDIATPNNTSSQYFDVSEKLNAFHKNPWRKLKSTLRRDYCRGPWQTAASSAAIILLVLSFVQTNISPGPLPKTCSSPLDPTAAAERAMPAAACCAWHWWPCFRRRGGYGGGRGGGTAGAGKRGGGTVAGGWRNG

SEQ ID NO: 145617 - protein, 359 aa, Glycine max
  Coding DNA Sequence Number=SeqID_28839
  Homolog annotation: Hit_ID=O22159; Match level="QueryCoverage=89%, HitCoverage=64%, E-value=1e-42, Identity=33%"; Hit description =Expressed protein
  Pfam annotation: Domain name=DUF247; Domain location=1-313; Score =165.7; E_value=1.1e-46; Accession=PF03140.6; Description=Plant protein of unknown function
MEPEFRRCYSHTLEFSKEQLVKIIFVDCAFILELFCRVHDQEWDDDDMHLSNLRLTSSIVYDLLLLENQVPFSVLERLFKLSFSSRGDDFPSFLKLTFHVFNDFNTSRLNVNNIIRVRHFTDLIRTFHLQHPLPPRTPGNTIKHLPSATELSEAGLRFKVLESESCLLKLDFSGRVLEIPQLVVDDLTETLFRNMVALEQCHYLFQSYITDYVGFLDFLVNTNRDVDILVQERVFINWLGDTDSVATMINGLMKNITTPINTSSQYLDVSEKLNAFHKNPWRKLKSALRRDYCRGPWQTAASTAAVILLILSFVQTVCSILQVLKQINLLVLPEITMGMHQVIQCCLLKSVYGAKYDLK

SEQ ID NO: 145618 - protein, 122 aa, Glycine max
  Coding DNA Sequence Number=SeqID_28840
  Homolog annotation: Hit_ID=Q1T281; Match level="QueryCoverage=40%, HitCoverage=18%, E-value=6e-18, Identity=90%"; Hit description=Ras small GTPase, Rab type
MSHTYNIVHTNIKLRTTIDRVSMCLRDYFMYMDLMMMMMCVAMCDIEKARKYAKALNATLFFSSATYNINVNKIFKFITAKLFDLPWTVERNLPESEEKLEESQGIARDVVIAVGRHVSPLR

SEQ ID NO: 145619 - protein, 72 aa, Glycine max
  Coding DNA Sequence Number=SeqID_28841
MKNRFNESNSAPHMQNLSSILTPECLDDTSYPEWHQKGKKVKSPKDNSTVATGFVRTFQPIWDFSVTIKGIG

SEQ ID NO: 145620 - protein, 95 aa, Glycine max
  Coding DNA Sequence Number=SeqID_28842
MKVLEKRALDAKASNKLNKEEVVRLEVALVKNTLIDYIEDLIDYIVLERLCQTLKGLSQLAANFPSDESFRVSPQALQTRSPSLNCLSINFELKY

SEQ ID NO: 145621 - protein, 194 aa, Glycine max
  Coding DNA Sequence Number=SeqID_28843
MGDQEEIQEQMKADMSALKGQMASMMDAMLGMRQLMENNVATAVAVSSAAKADPTLPATAHHPLPNVVAYPYGLPPNYTPLVMRDDAGHVPSPILEGEPPRQSDEVHEDRREYAQRDIDFYPGKLDLIEKRLRAVEGFGDYPFTDMVDLCLVPDVVIPPKFKVPDFDKNKGTTCPKDHLKKYCCKMGAHFRDEK

SEQ ID NO: 145622 - protein, 75 aa, Glycine max
  Coding DNA Sequence Number=SeqID_28844
  Gene Ontology: Mol. function=dihydroneopterin triphosphate pyrophosphohydrolase activity; Cellular component=cytosol
  Homolog annotation: Hit_ID=Q9CA40; Match level="QueryCoverage=90%, HitCoverage=40%, E-value=7e-14, Identity=60%"; Hit description=Nudix hydrolase 1
MENKNNNSGESELRVVVVIFLLKGRSILLGRCRSAVGNATFTLLGGHLEFESSNHNSSGMESFEECAAREVKEET

SEQ ID NO: 145623 - protein, 39 aa, Glycine max
  Coding DNA Sequence Number=SeqID_28845
MDYLDGNQYTQAQGLEPNKVDIKKVGLPGQGAPDADTIS

SEQ ID NO: 145624 - protein, 157 aa, Glycine max
  Coding DNA Sequence Number=SeqID_28846
MVWTEASLRETEGVGFEVRGVNEEVLEVSSSMSTLVIVSSISFLEKDSSSTGNGESSDFSTFLNQLLEKVSRPLSPEAAKEEADSPHPSDEVVREKHRCLFTEKKVCPPISLLGYTWVEEECPCQYDEYAKEYLNNEELLDLAFLENLLLVVSLPNQ

SEQ ID NO: 145625 - protein, 394 aa, Glycine max
  Coding DNA Sequence Number=SeqID_28847
  Homolog annotation: Hit_ID=O22159; Match level="QueryCoverage=74%, HitCoverage=75%, E-value=2e-29, Identity=36%"; Hit description =Expressed protein
  Pfam annotation: Domain name=DUF247; Domain location=22-336; Score =283.3; E_value=4.6e-82; Accession=PF03140.6; Description=Plant protein of unknown function
MAYKGDVVRINIEEMLEGAKAPVTTECCIYKVPLSIRRHNEEAYTPEVVSIGPFHHGHPHLQDMEKHKLFYSKAFLKRTQTTLYSFIGQIEEMEPEFRRCYSHTLEFSKEQLVKIIFVDCAFILELFYRFDSGERKEDIIRHFTDLIRTFHLQDPLPSRIDGKIIKHLPSATELSEAGLRFKVLESESCLLKLDFSGRVLEIPQLVVEDPTETLFRNMVALEQCHYPFQSYITDYVCFLDFLVNTNRDVDILVQERVFINWLGDTDSVATMINGLMKDIATSNDTSSQYLDVCEKLNAFHKNPWRKLKSTLRRDYCRGPWQTAASTAAIILLILSFVQTNMSPGSLPMTCSYFREGGTKVPTQPYTYLQFDQKRGEIGKVVSLSINYKRLSEQY

SEQ ID NO: 145626 - protein, 168 aa, Glycine max
  Coding DNA Sequence Number=SeqID_28848
MAPIPPQPLTVESAILTSNYVSSSKEKCNNIKIQEFLYSDLDAAINGFSNRKLLGKGSHNYVYKAVVRGCPVAVKHPSRPQHHHNNVSQRPISCSSSSAPSEVNNEIDIFLCIHGVAEVVGVEGHDYVNGGGGRGATVLVDEGLPKERELPGRTASNNNLTVLLKIKW

SEQ ID NO: 145627 - protein, 475 aa, Glycine max
  Coding DNA Sequence Number=SeqID_28849
  Homolog annotation: Hit_ID=Q1ZY19; Match level="QueryCoverage=81%, HitCoverage=82%, E-value=4e-46, Identity=31%"; Hit description =Fgenesh protein 60
  Pfam annotation: Domain name=DUF247; Domain location=25-408; Score =375.9; E_value=6e-110; Accession=PF03140.6; Description=Plant protein of unknown function
  Pfam annotation: Domain name=GRP; Domain location=396-471; Score= -22.1; E_value=0.013; Accession=PF07172.2; Description=Glycine rich protein family
  Pfam module annotation: Pfam domain module=DUF247::GRP; Domain location=25-408::396-471
MANNGDVVKINIEEMLEMLEGAKAPLITECCIYKVPFSIRRHNEKAYTPEVVSIGPFHHGHPRLQDMEKHKLFYSKAFLKRTQTTLDTLIGNIQEMEPEFRRSYSHTLEFSMEQLVKIIFMDCAFILELFCRYHYREWKEDDMCLPKPWLTSNIVYDLLLLENQVPFFVLERLFNLSFSSRGGHFPSFLELTFDFFEEFNRSRLNFNNINRIRHFTDLIRTFHLQDPLPSRIDGKVLKHLPSVTELSEAGLRFKVIESESCLLKLDFSGRVLEIPQLEVEDGTETLFRNMVALEQCHYPFQTYITDYVDFLDFLVNTNRDVDILVQQRVFLNRLGDTDSVATMINGLMKNITISNNISSQYLDVSEKLNAFHKNPWRKLKSALRRDYCRGPWQTAASIAAIILLILSFVQTVKEFSSDELEDLVHIDVVGLNESSNMPWWPCFRSRGGYGGGRGGGTAGAGKRGGGTVAGGWRNG

SEQ ID NO: 145628 - protein, 47 aa, Glycine max
  Coding DNA Sequence Number=SeqID_28850
  Homolog annotation: Hit_ID=Q9SZR1; Match level="QueryCoverage=100%, HitCoverage=4%, E-value=9e-12, Identity=70%"; Hit description =Putative calcium-transporting ATPase 10, plasma membrane-type (EC 3.6.3.8) (Ca(2+)-ATPase isoform 10)
MAADSLHCVAIAYRSYEKEKVPTNEELLSHWSLPEDDLISLAIVGLK

SEQ ID NO: 145629 - protein, 929 aa, Glycine max
  Coding DNA Sequence Number=SeqID_28851
  Gene Ontology: Mol. function=ionotropic glutamate receptor activity; Cellular component=integral to membrane; Biological process=ion transport
  Homolog annotation: Hit_ID=Q8GXJ4; Match level="QueryCoverage=96%, HitCoverage=94%, E-value=0.0, Identity=61%"; Hit description =Glutamate receptor 3.4 precursor
  Pfam annotation: Domain name=ANF_receptor; Domain location=62-420; Score=322.1; E_value=9.7e-94; Accession=PF01094.18; Description =Receptor family ligand binding region
  Pfam annotation: Domain name=Lig_chan; Domain location=603-866; Score= 318.3; E_value=1.4e-92; Accession=PF00060.17; Description=Ligand -gated ion channel
  Pfam annotation: Domain name=SBP_bac_3; Domain location=484-827; Score=-27.3; E_value=2.9e-06; Accession=PF00497.10; Description =Bacterial extracellular solute-binding proteins, family 3
  Pfam module annotation: Pfam domain module=ANF_receptor::Lig _chan::SBP_bac_3; Domain location=62-420::603-866::484-827
  Subcellular localization annotation: CTP_CleavageSite=68; ConfidenceScore=5.11e-01
MVMGRRTLLLLVLCLCLWIPFEVVGRKEPFFSPTSVNSTVSSRPKVVKFGALFTMDSVIGRSALPAIMAAVKDVNSSTSILPGIDLQVILRDTNCSAFLGTMEALQLMENDVVAVVGPLSSGIAHVISHVVNELHVPLLSFGATDPTLSSLQYPYFVRTTQNDYFQMYAIADFVDYYRWKKVIAIYIDDDNGRNGVSVLGDAMSRKRAKISYKAAFPPGATESDISDLLNEVNLMESRVYVLHVNPDHGLAIFSIAKRLRMMDSGYVWIATDWLPSVLDSFDLPDTDTMDLLQGVVAFHHHIPDTDLKKSFLSRLKSQRDNETVSFNSYALYAYDSVWLAARALDAYLNEGGNISFSSDPKLRDTNGSMLQLASLRTFDGGPQFLKTILGMNFTGLSGQVEFDMEKNLVRPAYDILNIGGSGSHRIGYWSNHSGLSVIAPEVLYEKKPSKTSLKSNQQLYSVIWPGEATTTPRGWVFPNNGQPLRIAVPNRVSFKDFVAKSKNPQGVQGYCIDVFEAALNLLTYPVPRQYMLFGNGERNPSYNELVQQVAQNNFDAVVGDVTIVTNRTRIVDFTQPFMPSGLVVVVPVEEEKSSPWSFLVPFTTQMWLVTGAFFLFVGTVVWILEHRLNPEFRGSPRKQLITVFWFSFSTMFFSHRENTVSGLGRLVLIIWLFVVLIINSSYTASLTSILTVQQLSSQIAGIDSLISSTQPIGIQDGSFARKYLIDDLNIAESRIVTLKNMEDYIDALRRGPKAGGVAAVVDELPYVEVLMSSIDCKFTIVGQEFTKSGWGFAFQRDSPLAIDLSTAILQLSESGDLQKIHDKWLNKKECSTVDTDSNKLALTSFWGLFLICGIACVIALTIFFARIFCQYNKFSPEPDKIDDKEMQPVRPRRPSRTRSIKKLMVFVDRREADIKEILRENKKRRLSIG

SEQ ID NO: 145630 - protein, 312 aa, Glycine max
  Coding DNA Sequence Number=SeqID_28852
  Gene Ontology: Mol. function=protein dimerization activity; Cellular component=chromatin; Biological process=DNA integration
  Homolog annotation: Hit_ID=Q2R1C3; Match level="QueryCoverage=91%, HitCoverage=44%, E-value=2e-69, Identity=42%"; Hit description=HAT family dimerisation domain containing protein
  Pfam annotation: Domain name=DUF659; Domain location=67-180; Score= -28.4; E_value=4.6e-05; Accession=PF04937.6; Description=Protein of unknown function (DUF 659)
MQDGAPLKVPRPLEKGFNLQGRDGLDARIARMFFSLGLPFHLARNPYYREAFSYATNTPNLSGYKPPSYNKLRTTLLTTERSHVENLLQPIRNLWNQKGVTIVSDRWSNPQGRPLINFMAITKSGPIFLKAVNCFGDIKDKDFISQQIKDAIMKGAKKNNVTYDQCSWITQIADYANFIMRHSMRLSMYNNFNSLKLLFVAPTRFSSTIVMLKRFRSLKEGLQKMVISPEWSTYKDDDVGKAKKVKETLLDDIWWDKFDYILSFIAPIYDVLRKIDTNMTCLYLGGILEIANLFLDETTLAAAFFNEDDQRL

SEQ ID NO: 145631 - protein, 112 aa, Glycine max
  Coding DNA Sequence Number=SeqID_28853
MKTPEEAMNLIENMVASDDAILRDRAHISTKNSLLELTSQDALLAQNKLLSKQLEALTEKLRCSICGGAHGSGSCIPNEEQMTQEVNYMRNQPRGNFNPGGFFGFQNSQQYQ

SEQ ID NO: 145632 - protein, 83 aa, Glycine max
  Coding DNA Sequence Number=SeqID_28854
MNNNPKVNIKKKVAPHFRISKQKKLQCNQRERDREVKCKVKKMQETPFHCFSLTIEFRVEREKRERALQLARHIIRDDHVRGT

SEQ ID NO: 145633 - protein, 279 aa, Glycine max
  Coding DNA Sequence Number=SeqID_28855
  Gene Ontology: Mol. function=GPI anchor binding; Cellular component =anchored to membrane
  Homolog annotation: Hit_ID=Q8GUI4; Match level="QueryCoverage=97%, HitCoverage=54%, E-value=4e-60, Identity=45%"; Hit description =Uncharacterized GPI-anchored protein At1g61900 precursor
MQFEIRVQQCNTGEFNAMVRRSLSDGNHSLPGPTARINDCKNIVLRWLASKLDPSTANSVFRGLSNCNLKEVNSVCPLVFPNVTSVVKECGNLINNQTACCKAIKSYVSYLQEQSFLTNLQALKCATSLGKKLQEANVSKNVYYLCRISLKDFSLQGNCYFTLFASTDTDTDTSRVMLLMADGLPLDQSVGLQESGCLLTSLPSNAVFDGTSGIGFICDLNDNIVAPWPTTSYSLPSSCNRTTKLPSLPTATSSQNGLSINSLVLPLLFTSILLPKRLL

SEQ ID NO: 145634 - protein, 79 aa, Glycine max
  Coding DNA Sequence Number=SeqID_28856
  Subcellular localization annotation: CTP_CleavageSite=67; ConfidenceScore=5.28e-01
MYAVMNKSHGSSIRFAKYSFSITNKVDALPPAISPSSTQPQPFIPLLAPSPLIPFTNKSVPKLSGIKGGREVKENEALN

SEQ ID NO: 145635 - protein, 149 aa, Glycine max
  Coding DNA Sequence Number=SeqID_28857
MGNCLRNNKISSQDHENYAEAPVIDGKVEKVKALSLSKLEEAPRMDQQGMKKVRFKMQNDDSTYEGERGSEGNSRSVRIRVVMTQEELKRMMRCKDEHTSLEQLLHAVKLRGGKISEVGEFDDDQGLNSSWKPSLDSIPEDHWLDKFIK

SEQ ID NO: 145636 - protein, 134 aa, Glycine max
  Coding DNA Sequence Number=SeqID_28858
MVAIWRWKRSTTGATAVIGGRGESGEVEWRRWLQRGTEQRRREGAAEKEEVREAKVLEGEGEGKKSLGLVALRSEETVVIYMLVTISDHAFGGRKDKDGWWRFWLRAFVMTIDWDVIAMATLRLSSINYYCEVT

SEQ ID NO: 145637 - protein, 643 aa, Glycine max
  Coding DNA Sequence Number=SeqID_28859
  Gene Ontology: Mol. function=4 iron, 4 sulfur cluster binding; Cellular component=mitochondrion; Biological process=metabolic process
  Homolog annotation: Hit_ID=Q6YZX6; Match level="QueryCoverage=96%, HitCoverage=63%, E-value=0.0, Identity=77%"; Hit description =Putative aconitate hydratase, cytoplasmic
  Pfam annotation: Domain name=Aconitase; Domain location=63-630; Score= 594.0; E_value=1.4e-175; Accession=PF00330.10; Description=Aconitase family (aconitate hydratase)
MYLVWLTNENPFKGNLTSLPKPGGGEFGKFYSLPSLNDPRIDRLPYSIRILLESAIRNCDNFQVKKEDVEKILDWENNSTKQVEIPFKPARVLLQDFTGVPAVVDLACMRDAMNKLGSDSNKINPLVPVDLVIDHSVQVDVTRSDNAVQANMELEFQRNKERFAFLKWGSTAFLNMLVVPPGSGIVHQVNLEYLGRVVFNNEGLLYPDSVVGTDSHTTMIDGLGVAGWGVGGIEAEAAMLGQPLSMVLPGVVGFKLSGKLHNGVTATDLVLTVTQILRKHGVVGKFVEFYGDGMGELSLADRATIANMSPEYGATMGFFPVDHVTLQYLKLTGRSDETVAMIESYLRANKLFVDYNEPQQDRVYSSYLELNLSDVEPCISGPKRPHDRVPLKEMKADWHACLDNKVGFKLEHQAISDHLCMICFLAFEKVKTRSFLSMTHVPIFARLCSGDLNSSNDVKMSVWEIHGFAIPKEAQGKVAKFDFHGQPAELKHGSVVIAAITSCTNTSNPSVMLGAGLVAKKAHELGLKVKPWVKTSLAPGSGVVTKYLLQSGLQKYLNEQGFHIVGFGCTTCIGNSGELDESVASAISENDVVAAAVLSGNRNFEGRVHALTRANYLASPPLVVAYALAGTATHKLLSLLTAS

SEQ ID NO: 145638 - protein, 162 aa, Glycine max
  Coding DNA Sequence Number=SeqID_28860
  Gene Ontology: Mol. function=ribonuclease H activity; Biological process=DNA integration
  Pfam annotation: Domain name=rve; Domain location=47-162; Score=-9.2; E_value=0.035; Accession=PF00665.16; Description=Integrase core domain
  Subcellular localization annotation: CTP_CleavageSite=47; ConfidenceScore=5.10e-01
MAKIQGPKEEKKPILIFTKKSGPNLDPWAQKSTLRFIRTLRPSLSALAQSSWSLLLMALVTGPFLGRIASRSVVVRSIKKKIICWCRLPRKIITNNATNLNNKMMKEMCEDFKIQHHNSTPYRLKMNGAVEAANKNIKKMVQKMIVSYKDWHEMLPFTLHGY

SEQ ID NO: 145639 - protein, 77 aa, Glycine max
  Coding DNA Sequence Number=SeqID_28861
MEMQRKTKENRREDPTLVHGSEIYPGIHENPKAFFSSSSPILLESSIQYPCEEMTPKKLPAKRSRKDTAGEGSSVAP

SEQ ID NO: 145640 - protein, 57 aa, Glycine max
  Coding DNA Sequence Number=SeqID_28862
MGGGCNTARLVASFRSNMLAQIAMETTIVLKVMKMDDHDGFRVPTDSLVSGWQGRLQ

SEQ ID NO: 145641 - protein, 114 aa, Glycine max
  Coding DNA Sequence Number=SeqID_28863
  Homolog annotation: Hit_ID=Q1SGQ8; Match level="QueryCoverage=44%, HitCoverage=11%, E-value=5e-09, Identity=59%"; Hit description=Zinc finger, C2H2-type
MYIFAVVQLERDGSSCKIIQQICKDNLIESKASQIECVLRVQNKQETFACFEESRGMVRTKAERVIAGRIHNPLQEIKEMVEPEFDSLVKKMSDQSEIEELIVLNPRAVLPCFL

SEQ ID NO: 145642 - protein, 80 aa, Glycine max
  Coding DNA Sequence Number=SeqID_28864
MMIGCRITWMLWKLGRIDGDPALRGTRIRAAWEYVSSVGGGQQGMSGTWRYVAGVRRPWGRQVGCYCPKPSLSNPDPTRA

SEQ ID NO: 145643 - protein, 289 aa, Glycine max
  Coding DNA Sequence Number=SeqID_28865
MTGASISWFPWWKEGGAGVLCLCEGFPNIPLIGTRGCINYNLVLAIRQLGYPMRGAPSEETIVPFIARGFNEANTKTLQKIRITWLPKLKSLSGEEIEMPEESEEVQALKAELEKTRVVNEKLKVAVIRVRKECDELKDINMSAAEALEREMKKARKEEWSRNKFRGALLGSSNELKLRKIERDKSRMESLMLEDKLKSCQRSKRSLKEQLRKMEENMLIIIDQYKKREAKEGVIELLHKEAMKWMDIFALTLNENQELPRLLARAKAMADIYSTPNEVHSLFNYCQHM

SEQ ID NO: 145644 - protein, 62 aa, Glycine max
  Coding DNA Sequence Number=SeqID_28866
  Subcellular localization annotation: CTP_CleavageSite=68; ConfidenceScore=5.25e-01
MKGTMVSSDGAPLIGTPAPPSFHHGNQLMDAPVMPAKSSFQFALSFPKHMRWPRMGQTNLLS

SEQ ID NO: 145645 - protein, 161 aa, Glycine max
  Coding DNA Sequence Number=SeqID_28867
  Gene Ontology: Cellular component=flagellum
  Homolog annotation: Hit_ID=Q9WZE1; Match level="QueryCoverage=51%, HitCoverage=37%, E-value=6e-17, Identity=48%"; Hit description=Basal- body rod modification protein FlgD
  Pfam annotation: Domain name=FlgD; Domain location=42-159; Score =75.3; E_value=1.9e-19; Accession=PF03963.4; Description=Flagellar hook capping protein
MTYRNLEQKNDVSSTTQTNRFELAERLQSSRNLEQIYEKIREFSLSNRIEERVQMKLLPENLGNLDIEMRKEDKEAFLKLLITQLKSQDPLEPMKDRDFIAQMSQLSSLEQVMNMSKSVQSFVDTAAQLYRTQAVSMIGKTAVVKTNVINVENGVSRIKSI

SEQ ID NO: 145646 - protein, 287 aa, Glycine max
  Coding DNA Sequence Number=SeqID_28868
  Gene Ontology: Mol. function=motor activity; Cellular component =flagellin-based flagellum basal body; Biological process=ciliary or flagellar motility
  Homolog annotation: Hit_ID=Q9WZE6; Match level="QueryCoverage=47%, HitCoverage=41%, E-value=8e-33, Identity=52%"; Hit description =Flagellar motor switch protein FliM
  Pfam annotation: Domain name=FliL; Domain location=20-155; Score =28.4; E_value=1.4e-05; Accession=PF03748.4; Description=Flagellar basal body-associated protein FliL
  Pfam annotation: Domain name=FliM; Domain location=169-286; Score =13.0; E_value=9.2e-09; Accession=PF02154.6; Description=Flagellar motor switch protein FliM
  Pfam module annotation: Pfam domain module=FliL::FliM; Domain location=20-155::169-286
MPEEMEQQQEQGGKKPNPIMGILKLVGIPLIVSLVVTLAVFFLLGQNKQPQQQQEQQQVTAPTQIKAVVIQAGKFQTFMLKGGRDVVVIDSLTLLVGSEPCRAAVAEKNDEIMDALSIIFLSKERFELTTPADVLSQEEIDRLLAALSQGEVNIEEVKKEGEEKKIRTYDFLRPQKFSKEQIRTVQMIHENFARSVSTYLSGKLRSFTSVNVVGIDQLTYDEYMKSIGNPSFITIFTAREFVGSSILNINLEIFYGILDVLLGGPGEVIDAKRVPTEIEIGIIKKEI

SEQ ID NO: 145647 - protein, 168 aa, Glycine max
  Coding DNA Sequence Number=SeqID_28869
  Pfam annotation: Domain name=zf-CCHC; Domain location=53-70; Score =21.6; E_value=0.00027; Accession=PF00098.13; Description=Zinc knuckle
MNQNETIQDMQKRFTHIVNRLALLGKTIPNEDLTKNFNPKKNLKKSEKSSPNPRCYECNQLGHMKMKCPTYKNKMEKLEKKSLKEKKAYITWEENAMDSSSDSENEVANLSLMARDCESDEKKGRKVSTCSIRKNENTIGKMIWVLKGTLPKSNLQGPKEIWVPKSKL

SEQ ID NO: 145648 - protein, 87 aa, Glycine max
  Coding DNA Sequence Number=SeqID_28870
MELENKEEENKKETPFQEESRNIDLPKEWKASKNHPLDNIINDISKGVTTWNSLKDACNNMAFDFVIEPKNIDAAIIHEHWIIAMQD

SEQ ID NO: 145649 - protein, 51 aa, Glycine max
  Coding DNA Sequence Number=SeqID_28871
MSMMDELNFFLGLQIKQTKEEEIVTPMSSACYLDKDEGGKSVDIKKYKGQS

SEQ ID NO: 145650 - protein, 239 aa, Glycine max
  Coding DNA Sequence Number=SeqID_28872
  Gene Ontology: Mol. function=RNA-directed DNA polymerase activity; Biological process=RNA-dependent DNA replication
MDQVVDGWGTFVHKKKLKGVKMVLKKWNMEEFGMLHTKQQQIAKEMNELDLREEQGDLGDEDIKKRLYLQQEFWKVEKFNESLLLQKSRARWIKEGDNNSKLFHSIINWKRRKNAVKGIHVDGIWIEEPNRVKDRVKNTLKIDFWKQILKDQSLMELTFNKSIMTIIACSWGTLGWRSHTQEFKCYKGLRQGDSLAPFLFLVVVEGLSGLMREAKAKDLFSGNKVGGGGVLCCEHATIC

SEQ ID NO: 145651 - protein, 84 aa, Glycine max
  Coding DNA Sequence Number=SeqID_28873
MELDIGVTHSDLTLAESWFASDTSTGYLEDAIAGWGIWCKQHNIPSYSQDQKKSQYLVDQEDLLPTFSSTSQILHVQFISTHLL

SEQ ID NO: 145652 - protein, 74 aa, Glycine max
  Coding DNA Sequence Number=SeqID_28874
  Subcellular localization annotation: CTP_CleavageSite=46; ConfidenceScore=5.11e-01
MLPPQGSFFLLRLCVIVVTPSPLSVSIGSVQAIYTIVVLFRCRESRAAMEVEEVFVENERNTMLYKTINPNDFD

SEQ ID NO: 145653 - protein, 597 aa, Glycine max
  Coding DNA Sequence Number=SeqID_28875
  Gene Ontology: Mol. function=binding; Cellular component=nucleus; Biological process=protein kinase C activation
  Homolog annotation: Hit_ID=Q9FI80; Match level="QueryCoverage=96%, HitCoverage=89%, E-value=0.0, Identity=62%"; Hit description =Putative selenium-binding protein
  Pfam annotation: Domain name=PPR; Domain location=231-265; Score =44.2; E_value=4.6e-10; Accession=PF01535.11; Description=PPR repeat
  Pfam annotation: Domain name=PPR; Domain location=333-367; Score =34.2; E_value=4.5e-07; Accession=PF01535.11; Description=PPR repeat
  Pfam annotation: Domain name=PPR; Domain location=368-402; Score =16.7; E_value=0.078; Accession=PF01535.11; Description=PPR repeat
  Pfam annotation: Domain name=PPR; Domain location=404-438; Score =11.3; E_value=0.34; Accession=PF01535.11; Description=PPR repeat
  Pfam annotation: Domain name=PPR; Domain location=470-504; Score=8.9; E_value=0.65; Accession=PF01535.11; Description=PPR repeat
  Pfam module annotation: Pfam domain module=PPR::PPR::PPR::PPR::PPR; Domain location=231-265::333-367::368-402::404-438::470-504
MNALMFQPNTASYYPRLDVPQIKACKSMRELKQVHAFLVKTGQTHDNAIATEILRLSATSDFRDIGYALSVFDQLPERNCFAWNTVIRALAETQDRHLDALLVFCQMLSEATVEPNQFTFPSVLKACAVMARLAEGKQVHGLLLKFGLVDDEFVVTNLLRMYVMCGSMEDANVLFYRNVEGVDDVRNLVRDERGREFNVVLCNVMVDGYARVGNLKAARELFDRMAQRSVVSWNVMISGYAQNGFYKEAIEIFHRMMQMGDVLPNRVTLVSVLPAISRLGVLELGKWVHLYAEKNKIRIDDVLGSALVDMYAKCGSIEKAIQVFERLPQNNVITWNAVIGGLAMHGKANDIFNYLSRMEKCGISPSDVTYIAILSACSHAGLVDEGRSFFNDMVNSVGLKPKIEHYGCMVDLLGRAGYLEEAEELILNMPMKPDDVIWKALLGASKMHKNIKIGMRAAEVLMQMAPHDSGAYVALSNMYASSGNWDGVAAVRLMMKDMDIRKDPGCSWIEIDGVIHEFLVEDDSHSRAKDIHSMLEEISNKLSLEGHMPDTTQVLLKMDEKHKESVLHYHSEKIAVAFGLISTPPKTPLCIEAFSPF

SEQ ID NO: 145654 - protein, 148 aa, Glycine max
  Coding DNA Sequence Number=SeqID_28876
  Homolog annotation: Hit_ID=Q1S0W6; Match level="QueryCoverage=73%, HitCoverage=22%, E-value=2e-15, Identity=38%"; Hit description=EGF -like
  Pfam annotation: Domain name=TPX2; Domain location=39-95; Score=28.1; E_value=3.1e-05; Accession=PF06886.2; Description=Targeting protein for Xklp2 (TPX2)
MYSKTSSMTRLKLQEGLHPKKAPPRSPPKENTKPQEFKLHTQERAVKRAMFNYAVTTKFYIMELQKKQEEKLQKLIEEEEVRLLRKEMVPRAQLMPYFDKPFLPQRSSRGVPRESCLHMMSSKCWSCSIANEMYNLHHYGHQALKPIK

SEQ ID NO: 145655 - protein, 474 aa, Glycine max
  Coding DNA Sequence Number=SeqID_28877
  Gene Ontology: Mol. function=protein serine/threonine kinase activity; Cellular component=chromosome, telomeric region; Biological process=protein amino acid phosphorylation
  Homolog annotation: Hit_ID=Q54T05; Match level="QueryCoverage=85%, HitCoverage=75%, E-value=1e-94, Identity=47%"; Hit description =Hypothetical protein rio2
  Pfam annotation: Domain name=APH; Domain location=95-294; Score= -10.9; E_value=0.034; Accession=PF01636.13; Description =Phosphotransferase enzyme family
  Pfam annotation: Domain name=Kdo; Domain location=81-277; Score= -68.8; E_value=0.004; Accession=PF06293.4; Description=Lipopolysacchar ide kinase (Kdo)
  Pfam annotation: Domain name=RIO1; Domain location=106-275; Score =193.4; E_value=5.3e-55; Accession=PF01163.12; Description=RIO1 family
  Pfam annotation: Domain name=Rio2_N; Domain location=8-89; Score =177.6; E_value=3e-50; Accession=PF09202.1; Description=Rio2, N -terminal
  Pfam module annotation: Pfam domain module=APH::Kdo::RIO1::Rio2_N; Domain location=95-294::81-277::106-275::8-89
MKLDVDVLRYLSKDDFRVLTAVELGMRNHEIVPTELIDRIARLKHGGTYKVLKNLLKHKLLHHDSSKYDGFRLTYLGYDFLAIKTMVNKGVFVAVGRQIGVGKESDIFEVAREDGTVLAMKLHRLGRVSFRAVKSKRDYLRHRSSYNWLYLSRLAALKEFAFMKALETHGFPVPNAIENNRHCVVMSLVQGYPLVQVKQLQNPETVFEAILGQVVRLAEHGLIHCDFNEFNIMIDDDEKITMIDFPQMVSVSHRNAQMFNLSFQESIDDNDDSDEGRDEAGKPCFSSIERSAGFLDRELAASGFTRKNEEDIQRIVSLKGLQIYVQFIEGGAESDTNSDSEGVDLVEDLNEADTVDGDSSHLSVEELNEADTVDDDSSHLLEQNEGYKCQGKEESCEARESSGSEKEVVSDNEENNEEALQSEAELVKNLSKQRRCAIAKAHKGRKTVAARNSYKDKGGRSSHNSKIQKQLSSW

SEQ ID NO: 145656 - protein, 95 aa, Glycine max
  Coding DNA Sequence Number=SeqID_28878
  Gene Ontology: Mol. function=GTP binding; Cellular component =intracellular; Biological process=small GTPase mediated signal transduction
  Homolog annotation: Hit_ID=Q1T281; Match level="QueryCoverage=62%, HitCoverage=21%, E-value=8e-23, Identity=91%"; Hit description=Ras small GTPase, Rab type
MSHTYNIVHTNIKLRTTIDRVSMCLRDYFMYMVYPTISSYAARNYAKALNATLFFSSATYNINVNKIFKFITAKLFDLPWTVERNLTVGEPIIDF

SEQ ID NO: 145657 - protein, 65 aa, Glycine max
  Coding DNA Sequence Number=SeqID_28879
  Gene Ontology: Mol. function=GTP binding; Cellular component =intracellular; Biological process=small GTPase mediated signal transduction
  Homolog annotation: Hit_ID=Q1T281; Match level="QueryCoverage=83%, HitCoverage=19%, E-value=4e-21, Identity=85%"; Hit description=Ras small GTPase, Rab type
MFDLTSRCTSNSVVEWYKEARKWNQTTIPVLIGTKFDDFIQLCIDLQWTIANEVRIPIFNIKIAL

SEQ ID NO: 145658 - protein, 100 aa, Glycine max
  Coding DNA Sequence Number=SeqID_28880
MANNGDVVKINIEEMLEGARAPITTECCIYKVSFSNRIHNEEAYTPKVVSIGPFHNDHPRLQDMEKHKLFYSKAFLKQTQTTLDGLIDKIQEMEPEFCRC

SEQ ID NO: 145659 - protein, 422 aa, Glycine max
  Coding DNA Sequence Number=SeqID_28881
  Gene Ontology: Mol. function=galactosyltransferase activity; Cellular component=membrane; Biological process=protein amino acid glycosylation
  Homolog annotation: Hit_ID=Q8LEJ9; Match level="QueryCoverage=86%, HitCoverage=87%, E-value=1e-156, Identity=74%"; Hit description=Avr9 elicitor response-like protein
  Pfam annotation: Domain name=Galactosyl_T; Domain location=122-323; Score=231.8; E_value=1.5e-66; Accession=PF01762.12; Description =Galactosyltransferase
MFVKSRIWTIPENNKGLARPTASEAEKLSLVSEGCNSRILQEMEMKRDKDIYGEVFKSHNSIQTLDKTISNLEMELAAARVTQESLRSGAPISDDIRLSESSSGKRKYLMVVGINTAFSSRKRRDSVRATWMPQGEKRKKLEEKGIIMRFVIGHSATSGGILDRAIEAEDRKHGDFLRLNHVEGYLELSAKTKTYFATAVNLWDADFYVKVDDDVHCHILSVSATLGQTLVRHRSKPRIYIGCMKSGPVLSQKGVRYHEPEYWKFGEAGNRYFRHATGQLYAISNDLATYISINQNVLHKYANEDVSLGSWFIGLDVEHIDDRRLCCGTPPDCEWKAQAGNICVASFDWSCSGICRSAERIKEVHRRCGEVLCSVEKNVILHEKSRSERECVREKYDNACPMDLQHFKRRLTMGARDRYIYI

SEQ ID NO: 145660 - protein, 48 aa, Glycine max
  Coding DNA Sequence Number=SeqID_28882
  Subcellular localization annotation: CTP_CleavageSite=21; ConfidenceScore=5.25e-01
MEKSGSNSPKSALKFVKTTSQSAAQWSSTNSRGMVRLCLALPSHIYKP

SEQ ID NO: 145661 - protein, 420 aa, Glycine max
  Coding DNA Sequence Number=SeqID_28883
  Homolog annotation: Hit_ID=Q1ZY19; Match level="QueryCoverage=90%, HitCoverage=80%, E-value=1e-51, Identity=32%"; Hit description =Fgenesh protein 60
  Pfam annotation: Domain name=DUF247; Domain location=25-407; Score =373.1; E_value=4.3e-109; Accession=PF03140.6; Description=Plant protein of unknown function
MAYNRDVVRINIEAMLEGARALVTTETTKCCIYKVPFSIRRHNEEAYTPKVVSIGPFHHGLPRLQDMENHKLFYSMAFLKRTQTTVDGFIRKIEEMEPEFRRCYSHTLEFSKEQLVKIIFVDCAFILELFYRGHDPVLKEDDMCLSIPPLRDNIPYDLLLLENQVPFFVLESLFNLSFPSPGADFRSFLELTFHFFAHFNISCLNFNNISRIRHFTDLIRTFHLQDPLPPKTTGNTIKHLPSVTELSEAGLRFKVLKNESCLLKLDFSGWVLEIPQLIVHDRTETLFRNLVALEQCLYPLQSYITDYVDFLDFLVNTNRDVDILVRERVFLNWLGDTDSVATMINGLMKDISVHNIRSQYFDVCEKLNDFHKNPWRKRKSALRRDYCRSPWQTAASTAAIILLILSFVQTVCSILQVIHQ

SEQ ID NO: 145662 - protein, 102 aa, Glycine max
  Coding DNA Sequence Number=SeqID_28884
MTKISACQRACRPQLTKGAEDDVSLCVLSGFSSYRQQKRMFIRITTRTSKKNVYTDNHSGISARQRDSNVNMTDLVSAEDDVNLRVSTGLSAAIDEGRRRRR

SEQ ID NO: 145663 - protein, 88 aa, Glycine max
  Coding DNA Sequence Number=SeqID_28885
MACLDQQHSGKEGQVVVVMEDLLISDLDDFSNLYCICCLKDHNYSVVVGFVAEGVYYKCLQHKLQKNIDHRLLQQVQISDSWQAELLG

SEQ ID NO: 145664 - protein, 284 aa, Glycine max
  Coding DNA Sequence Number=SeqID_28886
  Gene Ontology: Mol. function=RNA-directed DNA polymerase activity; Cellular component=chromatin; Biological process=chromatin assembly or disassembly
MLLCKDKFMWNPEVQTAFQHLKTLMTQAPILASPDFTLPFTLETDASGTTIDVVLLQKSRSIAFFSKQLCPKLQRASTYFCELHAITTAVHHRSLKELMSQVIQTPEQQRYLAKLLGYDYTIQYKPNATNVVVDALSRVPAQPSLMLLSVPHNLFMEQLRQSCSQDTAYQELLHEVLRCPVDHPRFTVKQNMLLFRDKLWLPAGHDLSKVLLEECHLTPLGGHMGVTKTLHRIQQHLCWPKISAHILLMTYPWILLRVFRLLKDTPPSWWLSTITPREPTSGPY

SEQ ID NO: 145665 - protein, 149 aa, Glycine max
  Coding DNA Sequence Number=SeqID_28887
  Gene Ontology: Mol. function=chromatin binding; Cellular component =chromatin; Biological process=chromatin assembly or disassembly
  Homolog annotation: Hit_ID=Q1SAV4; Match level="QueryCoverage=100%, HitCoverage=58%, E-value=2e-25, Identity=34%"; Hit description =Integrase, catalytic region
MNLEKGYMKYWVDFGSWWQLQAADINPITNVEGEVPTVRIGYTFHRILILLEPACEASTVEVPAEYKGRAGGGLPYITSNGEKPIPLWTEDAVDNLCLTVCLRMVSRAESKLGTTYVKELMPQTTDENGIPVRNDTTRKIVVLANSIHE

SEQ ID NO: 145666 - protein, 62 aa, Glycine max
  Coding DNA Sequence Number=SeqID_28888
MARADHICFQHGGNLPLKFILLGIEVGAGWVPRIYLFIVEEDDLGRGWDTWERPHEEIWADP

SEQ ID NO: 145667 - protein, 122 aa, Glycine max
  Coding DNA Sequence Number=SeqID_28889
  Gene Ontology: Mol. function=RNA-directed DNA polymerase activity; Cellular component=chromatin; Biological process=RNA-dependent DNA replication
MQSLPGFSLGPVRRPAGTQCVRDSSVVVRQRYILNGGGAVDEDFVEKDSRKLPQKRPEKAVHGGLEGRGCIGQTEGYHLEFIVTMMGAERRFWDVIFVHSNLMEPLMEIQLRKPRGVSNLIQ

SEQ ID NO: 145668 - protein, 65 aa, Glycine max
  Coding DNA Sequence Number=SeqID_28890
MDSASSNGRPDTPILPTADQRALEEAEDLSTRGVDVLVPRVNYRDVRRQKIPNLGGEEKLVASNT

SEQ ID NO: 145669 - protein, 105 aa, Glycine max
  Coding DNA Sequence Number=SeqID_28891
MQENFKHQKPQQIGIIENTEDEEGKRSASTSEQQRKCRLLIKIKALLRWKEASGEISKSMSSKGETTPTHCLPCFFLTGEKINTKPSNMDATGMRNGSVPENAKW

SEQ ID NO: 145670 - protein, 418 aa, Glycine max
  Coding DNA Sequence Number=SeqID_28892
  Gene Ontology: Mol. function=metalloendopeptidase activity; Cellular component=integral to membrane; Biological process=proteolysis
  Homolog annotation: Hit_ID=O80885; Match level="QueryCoverage=88%, HitCoverage=81%, E-value=1e-135, Identity=67%"; Hit description =Expressed protein
  Pfam annotation: Domain name=PDZ; Domain location=145-224; Score =18.6; E_value=0.0089; Accession=PF00595.14; Description=PDZ domain (Also known as DHR or GLGF)
  Pfam annotation: Domain name=Peptidase_M50; Domain location=43-396; Score=203.0; E_value=7.1e-58; Accession=PF02163.12; Description =Peptidase family M50
  Pfam module annotation: Pfam domain module=PDZ::Peptidase_M50; Domain location=145-224::43-396
MVETQNPLPKTTPFPNKNRLDFRTWSIAGFDYGNFEGPQSVLEAAAVLTAIIVVHESGHFLAASLQGIHVSKFAVGFGPVLAKFNAKNVEYSIRAFPLGGFVGFPDNDPESDIPVDDENLLKNRPILDRVIVVSAGVVANIIFAFVIIFAQVLFVGLPEQEVFPGVVVPDVRPFSAASRDGLVPGDVILEVNGSEFPKPGPSAVSEVVDAIKRNPKRYVLLKIKRGEQNFDIRVTPDENFDGTGKIGVQLAPNVKIAKVRPKNLVQAVEFTGQEFWGLASNVLDGLKQTFLNFSQSASKVSGPVAIIAVGAEVARSNIDGLFQFAAILNINLAVINLLPLPALDGGTLALILIEAARGGRKLPLEVEQTIMSSGIMLVIILGGLQKKYFMILIFNAVAHQCLSRWYICTRGGKIILND

SEQ ID NO: 145671 - protein, 36 aa, Glycine max
  Coding DNA Sequence Number=SeqID_28893
MEDNVLVSFLLCCSCSCLSHHWLPSTVAAYTHKRTL

SEQ ID NO: 145672 - protein, 510 aa, Glycine max
  Coding DNA Sequence Number=SeqID_28894
  Gene Ontology: Mol. function=oxidoreductase activity; Cellular component=cellulose and pectin-containing cell wall; Biological process=lignin catabolic process
  Homolog annotation: Hit_ID=Q655H5; Match level="QueryCoverage=88%, HitCoverage=83%, E-value=0.0, Identity=73%"; Hit description =Putative PS60
  Pfam annotation: Domain name=Cu-oxidase; Domain location=197-335; Score=216.7; E_value=5.1e-62; Accession=PF00394.12; Description =Multicopper oxidase
  Pfam annotation: Domain name=Cu-oxidase_2; Domain location=415-510; Score=25.3; E_value=1.9e-06; Accession=PF07731.4; Description =Multicopper oxidase
  Pfam annotation: Domain name=Cu-oxidase_3; Domain location=71-187; Score=179.1; E_value=1.1e-50; Accession=PF07732.5; Description =Multicopper oxidase
  Pfam module annotation: Pfam domain module=Cu-oxidase::Cu-oxidase _2::Cu-oxidase_3; Domain location=197-335::415-510::71-187
MLNYVTGYYLSHPHANARGGSLNDPLLLLKNPLKQKLSFSHFCIFGLGEEKPRIKKWVAPGEDPYRFYTWNVTYGDIYPLGVKQQGILINWQFPGPQIEAVTNDNLIINVYNSLDEPFLLSWNGVLQRRNSWQDGVYGTNCPILPGHNFTYVLQVKDQIGSYFYYPSLAFHKAAGGYGGFKIASRPGIPVPFPTPAGDFTILAGDWYKRNHTDLRAILDGGSDLPFPDGIIINGRGSNAYTFTVDQGKTYRFRISNVGLTTSINFRIQGHKMTIVEVEGTHTLQNVYDSLDVHLGQTYSVLVTADQPPQDYLIVVTTRFTSQVLNATSIFRYSNSGGGVTGLFPWGPTIQVDWSLNQARSLRRNLTASGPRPNPQGSYHYGLINTTRTIRLQNSGPVINGKQRYAVNSVSFIPADTPLKLADYYKIQGVFSLGSIPDYPTGSGGYLQTSVMEADFRGFIEVVFENTEDTVESWHVDGHSFFVVGMDGGQWSSASRLNYNLRDTVSRSTVQ

SEQ ID NO: 145673 - protein, 189 aa, Glycine max
  Coding DNA Sequence Number=SeqID_28895
  Gene Ontology: Mol. function=nucleic acid binding
  Homolog annotation: Hit_ID=Q9LSY3; Match level="QueryCoverage=56%, HitCoverage=23%, E-value=3e-12, Identity=37%"; Hit description =Arabidopsis thaliana genomic DNA, chromosome 3, P1 clone: MSD21
MELILFLLADTSGYGRRDYLDNDLRDKLDRRHVSPRRERYAHAALPNDFAPAVFLMFHELKIAEYSPTRSLEKKSDRRYRRKQDITGQSKVSGNLKVSDRVQDRVKEGKLLSSGSRNNLEEKLKKVDSDISTLQNRKFQLEKCIFLKVFLDENVQEVDSLNSRIRELEGQLSKEDEECKRYWNVSLCKC

SEQ ID NO: 145674 - protein, 73 aa, Glycine max
  Coding DNA Sequence Number=SeqID_28896
MLRAPSKPFTALVPYSHVPVYYAPLLFCWGGCSCGPLYQSVAPASVKKVVFDNNISFLSLIYRIKVQCPSRTK

SEQ ID NO: 145675 - protein, 102 aa, Glycine max
  Coding DNA Sequence Number=SeqID_28897
MYKQNHKDFLRLVVRLGYKNSLVFLGFKAYKRSKGYNYLARDSCKDYYSQLAIHSQSNVTLLPVLVQAFLSQSICLLTNNSTAYLFKLMKRNTNFILIMHSI

SEQ ID NO: 145676 - protein, 116 aa, Glycine max
  Coding DNA Sequence Number=SeqID_28898
  Gene Ontology: Mol. function=zinc ion binding
  Homolog annotation: Hit_ID=Q01AF1; Match level="QueryCoverage=56%, HitCoverage=34%, E-value=1e-11, Identity=50%"; Hit description =Homology to unknown gene
  Pfam annotation: Domain name=SWIM; Domain location=44-95; Score=9.7; E_value=0.059; Accession=PF04434.8; Description=SWIM zinc finger
MVDVSTWEGRNIERCKMVGLHYNIERVKGCWTTLVVLFDSRRIFEINVTGESRRKDQYLCFAENFCACYSFFYDVVNRGEQLCCKHQLAARLAASLGSYVEVKVSDEELAVLLSKV

SEQ ID NO: 145677 - protein, 278 aa, Glycine max
  Coding DNA Sequence Number=SeqID_28899
  Gene Ontology: Cellular component=integral to membrane; Biological process=vesicle-mediated transport
  Homolog annotation: Hit_ID=Q6ZC59; Match level="QueryCoverage=86%, HitCoverage=79%, E-value=1e-23, Identity=30%"; Hit description=Zinc finger (C3HC4-type RING finger) protein family-like
MMKTSARFYNKGILVFSEVKLTFEIQNKRKANLIGGDQEDENVAALCLERAPPFHRWYFETIDGYVYFTIVDKGFGNPVVLQFLEHVRDEFKKLSRKGSRGILPNMNSIYIQEKLVPVIRGLITSLESVSHGSSNWRDETSLSFQVDLSPSPSNLNGQIEGASSTKAPLLGKSNKPDKKKVKDHVIAMRDVELEEHRKSTDRGARVDSGNLDGVSQGGAGASVSLQKDMGSMRMRSAPQNIRKKWWRQVRIVLAIDAAVCILLFIIWLVICRGISCIR

SEQ ID NO: 145678 - protein, 250 aa, Glycine max
  Coding DNA Sequence Number=SeqID_28900
  Gene Ontology: Mol. function=sulfuric ester hydrolase activity; Cellular component=integral to membrane; Biological process =metabolic process
  Homolog annotation: Hit_ID=Q1ZTU4; Match level="QueryCoverage=91%, HitCoverage=49%, E-value=3e-41, Identity=38%"; Hit description =Predicted PE--lipooligosaccharide phosphorylethanolamine transferase
  Pfam annotation: Domain name=DUF1705; Domain location=9-132; Score= -80.8; E_value=0.094; Accession=PF08019.2; Description=Domain of unknown function (DUF1705)
MGYSGGKGIDILFIALILLLLSNHSLTRYGLIIPFILLCALYAPVGAIYGSPSAAVVSALLQTNSTEASEFLHTLPARFIWRQALPKKIILPLLALFAVIVITRIFSGGLVKLKLPDFFLSTYSAYDQYQQQIDELNTGVSEPYSWSITSGAPKNENYVIIVGESMRRDHMSLFGYPVSTTPFLDNAKGRFYSNYISTAPNTFESLPRTLALSNGHSIALGDNIITLAKAAGLNTHWLSNQGMFGQFDTP

SEQ ID NO: 145679 - protein, 82 aa, Glycine max
  Coding DNA Sequence Number=SeqID_28901
  Pfam annotation: Domain name=DUF543; Domain location=1-65; Score =85.5; E_value=1.6e-22; Accession=PF04418.3; Description=Domain of unknown function (DUF543)
MAEKKEMIPQQFDIDAKWDACIDLTVRRFVYSATAGSPVTRWASIAFGAGVGIGSAYAECSRLFDGPPTNLPLPKVSETATQ

SEQ ID NO: 145680 - protein, 373 aa, Glycine max
  Coding DNA Sequence Number=SeqID_28902
LRDGEMHSRLKGVDIMLNEVVWVGIVGFLTYGMKVIEGLNGFDKVEIYKECLTKRNHATLNTKDHTLIDAMTLGMKICSTSCVVDNMKTRRLLNNQIPYAVFFTKVMEHYRMDFTNEKFKILISTNKVSNALMFHMALIERNSHWFYKDEALRLKVKVGRSLQSKSSEEKETLEREGEKKEQISKENKKDEEDHSEPQNKVLAADKGGQLAQNEEAEIQKNIVGFEPIQEDLNVEIIVDALAKLRTIAATAKTSQIAPKVTVSKRTHVRSVKDSLFYIENMHNLFISSIFDTYLKIACGLGPLHGEPLTFTIPFPQSPFELAIADPSKVQEEVRPALILKVSHLQHKPPPPPRATTMPSPSSSLEKYSPNEHD

SEQ ID NO: 145681 - protein, 66 aa, Glycine max
  Coding DNA Sequence Number=SeqID_28903
MARRDKLLSSRGSESGDKRAETNYGHSAPFVIQGQRVGWGSESGDKRAETNYGHSAPFVIQGQRVG

SEQ ID NO: 145682 - protein, 162 aa, Glycine max
  Coding DNA Sequence Number=SeqID_28904
MATRMEAMMSIKEIMEVNAVAIAVTNTIVEVDLTPSYGLNQINHPTSDMVGLEGKELGGAGGPHLVRKTGIPSHHMACLPIICHPMWRTLPMRMSIAPLLYSLRANNLNLIMHIFATYPSAGGRRMTRGIIFQERNMRGVATNVYLRKTSEKPEKTWSTNFK

SEQ ID NO: 145683 - protein, 57 aa, Glycine max
  Coding DNA Sequence Number=SeqID_28905
MERWYNYLLSVTPSSSKREAIDGVGVVGGKEHVEASRLDRREVSEEHIDVVEQNKLC

SEQ ID NO: 145684 - protein, 128 aa, Glycine max
  Coding DNA Sequence Number=SeqID_28906
  Gene Ontology: Mol. function=transition metal ion binding; Cellular component=endoplasmic reticulum; Biological process=intracellular protein transport
  Homolog annotation: Hit_ID=Q9FH68; Match level="QueryCoverage=90%, HitCoverage=46%, E-value=9e-39, Identity=70%"; Hit description =Arabidopsis thaliana genomic DNA, chromosome 5, TAC clone:K16E1
  Pfam annotation: Domain name=HALZ; Domain location=86-127; Score =16.3; E_value=0.0061; Accession=PF02183.8; Description=Homeobox associated leucine zipper
MGERLTYTKRFVLFLSLMIDRLHHYIRELRSLRKTMEAIKKQSRSFEDGKNGNLEEHKALNEEITTLKSKIKKLESECEAKGNQAKTLETEVEALKKQSEGFLMEYDRLLEDNQSLRSQLQAIEQNPL

SEQ ID NO: 145685 - protein, 40 aa, Glycine max
  Coding DNA Sequence Number=SeqID_28907
MKLSNSFPSIKFVVAKKVNSLYSIVSGANIVAKLLSVEKV

SEQ ID NO: 145686 - protein, 181 aa, Glycine max
  Coding DNA Sequence Number=SeqID_28908
  Gene Ontology: Biological process=response to biotic stimulus
  Homolog annotation: Hit_ID=Q27JA0; Match level="QueryCoverage=75%, HitCoverage=74%, E-value=5e-17, Identity=37%"; Hit description =Dirigent-like protein pDIR12
  Pfam annotation: Domain name=Dirigent; Domain location=13-178; Score =111.4; E_value=2.6e-30; Accession=PF03018.5; Description=Dirigent -like protein
  Subcellular localization annotation: CTP_CleavageSite=87; ConfidenceScore=5.23e-01
MAPSLSTPMKFLALSMFFISIIYQDNAQFPTPNPNQTTMVFYLQDLAAGPNATVVAPVAGINGRVWSFTTFGSIFVVDFPVTLSISPASELVGQAQGLLIASALDGASVNVALSIVFNNLQYNGSTLELQGISRRHENYREVSVVSGTGKFRFARGYAVLETAFFDISRSTLRLTITIQTN

SEQ ID NO: 145687 - protein, 50 aa, Glycine max
  Coding DNA Sequence Number=SeqID_28909
MMMDINIITIERNTDFIGVENDGVIFDLFEGATESLRCEEGHPMPSSSTT

SEQ ID NO: 145688 - protein, 76 aa, Glycine max
  Coding DNA Sequence Number=SeqID_28910
MEGSGSSSSAPNNGEGDDNNDSGHVTSEKMVGYMSSSFADLVFAGERIKVGLRRDKFDYTALMNRQPGANGENKKE

SEQ ID NO: 145689 - protein, 115 aa, Glycine max
  Coding DNA Sequence Number=SeqID_28911
  Gene Ontology: Mol. function=protein-tyrosine kinase activity; Biological process=protein amino acid phosphorylation
  Homolog annotation: Hit_ID=Q1SVI3; Match level="QueryCoverage=96%, HitCoverage=22%, E-value=5e-25, Identity=55%"; Hit description =Protein kinase
MGIRCSKLIPAVSIHNLRHLLLKLQMLVEIEDSNEVSNWPTFREYTLEQLKNATSGFVVENIVSEHGQKDPTVVYKGKLENQMRIDVKRFNKNAWPHALQFLVNSPASIGYLPCS

SEQ ID NO: 145690 - protein, 163 aa, Glycine max
  Coding DNA Sequence Number=SeqID_28912
  Gene Ontology: Cellular component=integral to membrane
  Homolog annotation: Hit_ID=Q8L4G8; Match level="QueryCoverage=73%, HitCoverage=19%, E-value=3e-21, Identity=44%"; Hit description=C4 -dicarboxylate transporter-like protein
  Pfam annotation: Domain name=C4dic_mal_tran; Domain location=1-113; Score=-40.5; E_value=4.4e-05; Accession=PF03595.8; Description=C4 -dicarboxylate transportermalic acid transport protein
  Subcellular localization annotation: CTP_CleavageSite=52; ConfidenceScore=5.21e-01
MGWKESALCMFSLGITHYLVLFVTLYQRLAGNNSVPSMLRPVFFLFFAAHSMASLAWNSICGKFDTTCKMLFFLSFFLFMSLVSRPLLFKKSMKKFNVAWWAYSFPLTALALASAEYEHEVKGVMAHVIMFVLSSVSVLVSLILMVITALNISKHVLSRSQPS

SEQ ID NO: 145691 - protein, 111 aa, Glycine max
  Coding DNA Sequence Number=SeqID_28913
MKGFASLEAKMKFRAPWVSPTAINETKNSTASVIDSDNWGSVPPLNSHIGYSCATSISKFTKSPCHEKKILEHTVLQQPRQPIHKLCLWLHGHTNVKDTAKGKTREEETTK

SEQ ID NO: 145692 - protein, 509 aa, Glycine max
  Coding DNA Sequence Number=SeqID_28914
  Gene Ontology: Mol. function=DNA binding; Cellular component =membrane; Biological process=DNA integration
  Homolog annotation: Hit_ID=Q1SS72; Match level="QueryCoverage=99%, HitCoverage=58%, E-value=9e-32, Identity=31%"; Hit description =Integrase, catalytic region
MASIKQGDQSITDYFTKLRIILDELESYRIMQFLRGLNDQFNTMRSNVLMMDPLPNIAKVFSYVVQQERQINSNELTGSMSLINAAGSNSSNTRPSCTYCGKDNHTIDRCYRKNGPPQNYPSKGGKRTQSNSDKGNFGAKGNKVCTHYGLSNHTIDDCYKKHGYPPGHKFYKVQNPNINNVNTIREEGDGSPLDQNQETQNEDVRLTTQQYKALMSLMQQQAPAQSNSQINQIGTVTNKGSILSVTCSVSKTSQDEWILDSGATDHITAFPHLFSLCKKIKPVMDMNQQKIGTVEMVEGLYRLKMIPIKSKYKSDFAGSSISNFFAFSCFKPNTKGFIMFDLKTKAISVSRNVIFYEDCFPFIGQDKPDAISVLPIPSSHAIDQPNDVSLELPFDNIMPVPNNADSDPLTLEQSSNTTRRSLRQTHKPSKHKDFHVSYSSSTIASYFASTCLYPLNSVLSYRKLSPSYHNIVLSITQSLEPRSYNEASKDPVWVEAMNAEIKALELNDT

SEQ ID NO: 145693 - protein, 51 aa, Glycine max
  Coding DNA Sequence Number=SeqID_28915
MEFLPMVTLWEYGVVTFDGQWLQGRHIILLRGKGQERTGAVAVTHLTPKRK

SEQ ID NO: 145694 - protein, 65 aa, Glycine max
  Coding DNA Sequence Number=SeqID_28916
MVTKGWIFNGEEEEENGNSLAFLCTRRGQFSKVGNIYIKTLRMKPRASFRAIQNAPFTKIPGRNF

SEQ ID NO: 145695 - protein, 120 aa, Glycine max
  Coding DNA Sequence Number=SeqID_28917
MTSKKRKTPSTPRKILPERNVILHHSEFYANLYDPKDKPPKQVKVRGRLVKFDADTLNLFLKTPVILEEGENFLVYSRFCHSKPEPRELVARLCIPGRGFKLNADGLPLKILRKNLTMLG

SEQ ID NO: 145696 - protein, 69 aa, Glycine max
  Coding DNA Sequence Number=SeqID_28918
MTIICLHMSSGSLPLDDKRAQNDHNLSLRAIGHDCLRMAKRVSMTEIVGWPTKARLLLLRILNEELIPM

SEQ ID NO: 145697 - protein, 113 aa, Glycine max
  Coding DNA Sequence Number=SeqID_28919
MTGHDWPRILFPTCRYMGTDASGDRVTTDRSLPFPGAKQAENIAASFGLLCVATYPSAGGRRVARGMCVPRKEYARSRHQRLFEENVGKTRKDTIYELLSERLGSCIYARGRY

SEQ ID NO: 145698 - protein, 252 aa, Glycine max
  Coding DNA Sequence Number=SeqID_28920
  Gene Ontology: Mol. function=RNA-directed DNA polymerase activity; Biological process=RNA-dependent DNA replication
  Subcellular localization annotation: CTP_CleavageSite=86; ConfidenceScore=5.11e-01
MYSHLSKHSRNSLCGKSTVTRVYSRRIFGFQQGPYNQQGQWRTHPGNQFNKDQSGPSNRPIQQGPNIFQRTTKLEETLTQFMQVTMSNHKSTESALKNLEVQMGQLAKQIADKSSNNFVANTKQNPKEECKAVMTRSKRFVEAEDEESVVHKEKAAEKKGVEVPYPVVPSKKEKDRHLARFLDIFRKLEIAMPFGEALQQMPLYSKFLKDMLTRKHKYIHQENIIVEGNCSAVIQKILPPKHKDPGSVIFLV

SEQ ID NO: 145699 - protein, 233 aa, Glycine max
  Coding DNA Sequence Number=SeqID_28921
  Gene Ontology: Mol. function=unfolded protein binding; Biological process=cellular protein metabolic process
  Homolog annotation: Hit_ID=Q9ZQX5; Match level="QueryCoverage=35%, HitCoverage=2%, E-value=1e-22, Identity=68%"; Hit description =Putative transport protein
MRLKEFERTSIRSASSSPVIYAPPSVDKPPLPRKIKSFEAHATGAGNWDSKKGLYMGNVLDAGYIGSTLETINPVYPRLSEVRMLDFHALMPSDGSYTELKFVELLDSVIAMAKTTFDRVSMLAHQTGNLSQVGSSLVAELVDIQIGNLSVSELESNKYVHEDIQTVQSLDGDNAGFYAFMDLSKGKIRNNFETGVIEPAMSKVKIIQFATEATILRIDDMIKLIKDESQNEE

SEQ ID NO: 145700 - protein, 44 aa, Glycine max
  Coding DNA Sequence Number=SeqID_28922
MEIKADPEPSSEEGGTVAEDEALEARDTVEVGGDGSEGSKIKRG

SEQ ID NO: 145701 - protein, 81 aa, Glycine max
  Coding DNA Sequence Number=SeqID_28923
MHIERCSCRDGKYKKATVGLGQQAALGVTPDKGDLIFVVRLTGLGNGNNNNNDSESPVSGRNKKHNPFWDVSHKVPFIASY

SEQ ID NO: 145702 - protein, 87 aa, Glycine max
  Coding DNA Sequence Number=SeqID_28924
  Subcellular localization annotation: CTP_CleavageSite=22; ConfidenceScore=5.35e-01
MVTRSRDYITKGNKAVTSSQTRKKAITSSPNTSLTYLIRPMSLLPTLDRKPCWWWNRGVAWNRIKQGCCESLAGKVELVERKKEAVE

SEQ ID NO: 145703 - protein, 151 aa, Glycine max
  Coding DNA Sequence Number=SeqID_28925
EIVGKFDWRREEDLRCGWDEEDLSTFVAPRPKQQLRFTSTSACCHQHHSVVVWGQRSDIHNLPPPSKRSSTKNVAILNSSRRKSIAMVFGLGDAGVVFWGPQGWVLGLLDVDLAGAGVEVFHGDDGCTSSDLDGGDKLGEKKVIGRGKGKK

SEQ ID NO: 145704 - protein, 186 aa, Glycine max
  Coding DNA Sequence Number=SeqID_28926
MVRVETLNHLFFFIYHYYHIVDILEAQSICQSLSYGQSLNKEALAIQNQPLGWGGYALKCKLQNLKHRLKSWSRDICGDLGSKVKQTQNRSLQGRHSIFYMYGRLNAPRHFGNDNRNYLPSSVFMEQTPYEISAHGSSRLHPTALFNSKMMIRSSSGWDKDLYNCQSYQRSFCSPNLTGHAKFDAE

SEQ ID NO: 145705 - protein, 94 aa, Glycine max
  Coding DNA Sequence Number=SeqID_28927
MCWRGLIVVDGETWILDTDHERDGVWWALSLVLEVFVVANTKWAIEWIGGRTPREVMVNAYLYRGCCPCSYVSPGAMRKSDLHNSLSLNVCVLN

SEQ ID NO: 145706 - protein, 200 aa, Glycine max
  Coding DNA Sequence Number=SeqID_28928
  Gene Ontology: Mol. function=RNA-directed DNA polymerase activity; Cellular component=nucleus; Biological process=RNA-dependent DNA replication
  Homolog annotation: Hit_ID=Q1SLA3; Match level="QueryCoverage=98%, HitCoverage=20%, E-value=1e-43, Identity=39%"; Hit description=RNA -directed DNA polymerase
MNPYTAPRPYGFQPIFSQTYWDTIHDDVWKMVSMVFSTGFINPSLIDTFIVPIPKVDNTTCMRDFRPISLCKALLKIISKVLVLRIRPHLDTFIGPCQISFIPGGGMVIMNCITSTSLAWRWNSEVQEGFKPSKGLRQGDHMSPYLFVLCTEKLALMIQELVTSKKWHPVKITKQIPTISHLFFAYDFLLFTMAKFSQGD

SEQ ID NO: 145707 - protein, 76 aa, Glycine max
  Coding DNA Sequence Number=SeqID_28929
MYDGDEDVVGCSTIPSQGGEVSYHMLQMVTDSDKDDGDYVVSNSFFEKTYDEEDVVNDDSSNTNDETTFIESSELI

SEQ ID NO: 145708 - protein, 216 aa, Glycine max
  Coding DNA Sequence Number=SeqID_28930
  Homolog annotation: Hit_ID=Q1SP02; Match level="QueryCoverage=62%, HitCoverage=28%, E-value=3e-20, Identity=39%"; Hit description=IMP dehydrogenase/GMP reductase
MSGWGDFETCIRASAGPDDGDLAQAGGFAWGAAALIHMYDHLNDASQASTRQLGGYITLLHCWIYEHFLTVHTSVVDDAYDEGSPRACRWLTGKAHITGIKGAPYRRRLDALSVTDVCWMPYDEHQRVRAFDLISSYTGQLRWGQIVVYVRPEQVLRQFGYLQTVPSPPVHCEGCQGMAQDLGAIAEDLEWVINLRMVTEGTDLHDIMTHSLSKES

SEQ ID NO: 145709 - protein, 85 aa, Glycine max
  Coding DNA Sequence Number=SeqID_28931
  Homolog annotation: Hit_ID=Q7X8K7; Match level="QueryCoverage=55%, HitCoverage=4%, E-value=1e-10, Identity=66%"; Hit description=CTR1 -like kinase kinase kinase
MDLGCGPELLFNVQNRLWLLISTSMCMLDMLCRIGSLYMIDVAKENPQLAQKLHDVLVESGVVAPPRNLFYKIYDEELGSSIDTN

SEQ ID NO: 145710 - protein, 263 aa, Glycine max
  Coding DNA Sequence Number=SeqID_28932
  Gene Ontology: Mol. function=cellulose synthase (UDP-forming) activity; Cellular component=membrane; Biological process=cellulose biosynthetic process
  Homolog annotation: Hit_ID=Q2HT16; Match level="QueryCoverage=95%, HitCoverage=33%, E-value=1e-81, Identity=61%"; Hit description =Cellulose synthase
MYDNLSSKIELDSSIISNPCNGDFAVFSNTERTNHPSIIQVIWENKEHIADGLPHLIYISREKRPKQPHHYKAGAMNVLTRVSGLITNAPFMLNVDCDMIVNNPKIVHHALSILLDHKGEKEVAFVQFPQKFYATLKDDPFGNQMTILAKYLAAGIGGLQGPFYGGTNCFHRRKVIYGLSPENIEKDKFSGNSISEEELKQKFGTSKEIMKSVACTLEGRTYSYNDINISNVVDVASQVAGCAYEYGTGWGKQVFKTNILESF

SEQ ID NO: 145711 - protein, 206 aa, Glycine max
  Coding DNA Sequence Number=SeqID_28933
MVWSYIHYEEVPAHKGNLYALDAIVPETRLPVKPENWLEIKLPKVEPIIEQIRSEALDGVSDSKAATSASEDSNKKDKEFSPIKDDYFKDFGVEPGLGNLQESDTTLDHQINGIGIETPLPIKPQNWPDKNLIEVEHSRSDALNRLSDSKSAINASEDSSQKNKKFGTTEDDYLKDASVEPGIRNHKKLEPATENDTQPKCCSIGC

SEQ ID NO: 145712 - protein, 117 aa, Glycine max
  Coding DNA Sequence Number=SeqID_28934
MVILCFTAQAQSCPTKRRDKLWFRWQGGSLAEWCFARTKLVSYLYFPFISNKRQVKRGNCHTLISSGDHPLLGCDPRLTTSRYLAPIVRQFVKFRDVPEVKRRHCSTIRGVPQHVRN

SEQ ID NO: 145713 - protein, 67 aa, Glycine max
  Coding DNA Sequence Number=SeqID_28935
MGASDGTVGGRNDLWVSVAFIARVAQYYSHQYSYTVINMPMLSLDWMMYVMCWLLVQQVILIPHPYT

SEQ ID NO: 145714 - protein, 74 aa, Glycine max
  Coding DNA Sequence Number=SeqID_28936
MEHEIDVVELRQEIFNVEYSSNWKRRWLVVVIVNKVVAIIFLVRASNILKLLMVSTLNDRKDHFEPFENDKGLK

SEQ ID NO: 145715 - protein, 89 aa, Glycine max
  Coding DNA Sequence Number=SeqID_28937
  Gene Ontology: Mol. function=RNA-directed DNA polymerase activity; Biological process=DNA integration
MDLVMGPLLGRIASEGVWMSNILSCKSRLKRSLYGQKRSLRPWYNKSNEFIISHWYNRSPYDSIVYHSKVEDGCHIYLQLYAGNMLIAS

SEQ ID NO: 145716 - protein, 68 aa, Glycine max
  Coding DNA Sequence Number=SeqID_28938
MEDTCSWGLYEDRHALQGRDERTSSKELGGMLSGHNCRNLPFGGRATRDSRDACSTKGIRAESPPTFI

SEQ ID NO: 145717 - protein, 63 aa, Glycine max
  Coding DNA Sequence Number=SeqID_28939
  Subcellular localization annotation: CTP_CleavageSite=23; ConfidenceScore=5.14e-01
MSHFQGFFKGIASNGGSWWPPVVVGVGGGGSRLGARLAKQESTYGAKHDNSRSAQFPPGWNCA

SEQ ID NO: 145718 - protein, 116 aa, Glycine max
  Coding DNA Sequence Number=SeqID_28940
ATKRLKERDIVRDSAKADQHSEGRVRNVIVHIIRGVGMHADKCVGVGGERDLVQVGSGVVCEGEGGQRACAEGWVLRGLNSGLGSLCMRYLQATQEDNKHKKMAPLTGRERRLHSK

SEQ ID NO: 145719 - protein, 65 aa, Glycine max
  Coding DNA Sequence Number=SeqID_28941
  Homolog annotation: Hit_ID=Q2HTG0; Match level="QueryCoverage=45%, HitCoverage=6%, E-value=3e-09, Identity=100%"; Hit description =RhoGAP; Wiscott-Aldrich syndrome, C-terminal
MQLSFDARGNSVPTILLLMQRHLYAQGGLQISQTELSLDVMVKAELLSESIAFHVQPLDSVQMNF

SEQ ID NO: 145720 - protein, 381 aa, Glycine max
  Coding DNA Sequence Number=SeqID_28942
MAKLKVGAAKRNPLRSLAHILAADVQLSQLSGPCLAKRPMASRKRKSIGRHILPKRKVEIYHIELDEFKAELERRNFHKRLTNLVDNSIDLALVKEFYASLYSPEGPSPKQVRVRGHVVKIDADNLNTFLETPVVLAEGHPRKILRKDLTTLSQVLSVLSYSNLAPTSHTSDLTMDMNVGALISGQITSMAQCNSSRLGFPALITSLCKSNGVASDSLVFECLSPVSNLAYIRKNCWNPDDLTVTIRRARRARTRPTEAPSTSTAPPPARTLAAPSASTPMVAPPDSISVEQFNEWVAWPGTQSSLHREDEGPTAQAAQEAVATSEKSFEATSEPLEPVADTNSIQQAADPSTPEDQTTPVLSLNTSPTATPVLHLTDEED

SEQ ID NO: 145721 - protein, 80 aa, Glycine max
  Coding DNA Sequence Number=SeqID_28943
  Homolog annotation: Hit_ID=Q9XIS5; Match level="QueryCoverage=67%, HitCoverage=6%, E-value=4e-14, Identity=76%"; Hit description=Starch branching enzyme
MIGFKTPYWYYLWPLSAKTLALKASHDSDSLSSAIAKFDKVLIPQDQDNSASLTDQLETPDITLKDTHVLFSYSISNMLM

SEQ ID NO: 145722 - protein, 37 aa, Glycine max
  Coding DNA Sequence Number=SeqID_28944
MVDVSSSMHVETADDMVMSFQRLRLQQQVITDVETAK

SEQ ID NO: 145723 - protein, 138 aa, Glycine max
  Coding DNA Sequence Number=SeqID_28945
MEHQIFAQPYLQNTAVLRPLQKGVLTGFGGATTRRDAGRGDGGVGKRHKSWRGHSTQKFQTHREAGARASVHEIAQITTLYTSTLTTRATYKDGHPWPTSLNVSRAMHMAHKMLTYLRNCHRYSYYDIFGRNDVERAS

SEQ ID NO: 145724 - protein, 55 aa, Glycine max
  Coding DNA Sequence Number=SeqID_28946
MGIFKGLQLVWEMGFRNQVDECNLKYSEMYLNRKDVQKALHARLVGTTKYRLCSK

SEQ ID NO: 145725 - protein, 257 aa, Glycine max
  Coding DNA Sequence Number=SeqID_28947
MASRKRRAVPTPGEASSWDSSRFTSEIIWHRYQDNIQLRNILLERNVELTPRMFDEFLQELQRCRWDQVLTRLPEKRIDVALVKEFYSNLYDPEDHSPKFCRVQGQVMWFDAETINDFLDTPVILADVEEYPAYSQYLRTPPDHDAILSTLCTPGGRARLIYGLVMKMDLDVDSFISQQISQIAQSNTSRLGFPALITALCDIQGVVSNTLIFELLNPMINLAYITLLKKSYFTTRVPHRFCQKCRNRSSGGNSVNK

SEQ ID NO: 145726 - protein, 98 aa, Glycine max
  Coding DNA Sequence Number=SeqID_28948
  Homolog annotation: Hit_ID=P35016; Match level="QueryCoverage=50%, HitCoverage=6%, E-value=2e-10, Identity=68%"; Hit description =Endoplasmin homolog precursor
MKKKTKIHRMFQANAEGDSDELVDPPKVEDEIGAVPHGLSTDLDVIKRWRHSQSQRDLSRATRRSLSSKRKCHGLWIMFRPRNPNRKPIQSLKSHHGR

SEQ ID NO: 145727 - protein, 100 aa, Glycine max
  Coding DNA Sequence Number=SeqID_28949
MVVEARGEARCCRPANYSHRAMTTSPTSPPWSSSAATAEALPYGICMATRVVLRTSLRFETEGFCLTGVELPTVEEEADGGADAEAEEGEGNNGREHYLC

SEQ ID NO: 145728 - protein, 181 aa, Glycine max
  Coding DNA Sequence Number=SeqID_28950
  Homolog annotation: Hit_ID=Q10SE0; Match level="QueryCoverage=92%, HitCoverage=43%, E-value=1e-17, Identity=56%"; Hit description=CBS domain-containing protein, putative, expressed
MSSYFEERAPCCRSHFWILLSICWASLLFAAITSGLALGLLSFSQVDLEVFIKAGQPKIQKNAAKIMSIVKNEHLLLCTLLLAKSMALELLDWLFGKGHTALLGRAELKTLVHLHANIYYDMLKFIIRQGKVESCHFMKLIIAGALDLTQKTAKDGMTPISETFSLDINSKLDMYAPHLYI

SEQ ID NO: 145729 - protein, 98 aa, Glycine max
  Coding DNA Sequence Number=SeqID_28951
  Homolog annotation: Hit_ID=Q33BI2; Match level="QueryCoverage=87%, HitCoverage=7%, E-value=4e-25, Identity=63%"; Hit description =Expressed protein
VFDGARARERERELLYPDACGGGGRGWISQGIVSYGRGHGTRETCALHTARLSCDTLVDFWSALGEETRLSLLRMKEEDFIERLMYRCLSIFSFLTLS

SEQ ID NO: 145730 - protein, 772 aa, Glycine max
  Coding DNA Sequence Number=SeqID_28952
  Homolog annotation: Hit_ID=Q33BI2; Match level="QueryCoverage=86%, HitCoverage=51%, E-value=2e-12, Identity=23%"; Hit description =Expressed protein
NLVIETDETNLLRDDSPNIEDEEFSSECSTLKPQDLSYDDCEEEISNAEDEMGQSTIEQSMSSHRKLRCRKEFQLDMPMKWSDRRRYAVVSENSVMVCRSEPRHYGESFVTSSRVMNGLNRQSRINFPTKSNCRNVGPPKYNEKFYSSKNRMNEKCDIHSCSCSLNNESKTRVEQHSPMTRVRRETKPTCQSESARDTSKQFCRGNKNNQVAYMHESNGRPKSKIISGNCPTRDLFQSKKVWEPIESQKKYPCSNSDSDAILRSTKVEGTQSDLVKLSIGEAVDSGGNDDKECNSKRFSGMDESCQNDFHVEAEGSCSSTEIALEESGICPTGGFALNNSSDPTQSSTFSSDNCSSCLSEGDNNTTSSNHENTESSITSDSEDVSQQSEVRNNSDCVETVLSHCHEVAVENSQNASGEGLTRKSSSLIGLSLDGTRNYALGNLVETAQNFDNCFSTTNVCSQLQSMLPPLSNQNIHFPVFQAPSAMGYFHQNPVSWPAAPTNGLIPFPHSNPYLFAGPLGYGLNEDPRFSLRYGALQQPTSLFNPGVPVYQPVARANVLNAEERTQVSKPASLPEHLNGSVAEMVFPAGPISKRPASHGEVRHDNSSKPLENKNDFSLFHFGGPVALSTGCKSAFTSLNGDTVGDFSSKSSADHVEKVHNCNKKETPAMEEYNLFAANQNPRTLFDVSGSYNAVSGSVFGAIKHGPVLLDDFWDGNEGRALGEGNGGVDVRVCGSKKSGFLCQGNWGESAEYGLVFGLKKRAELAWCEDEGT

SEQ ID NO: 145731 - protein, 128 aa, Glycine max
  Coding DNA Sequence Number=SeqID_28953
  Gene Ontology: Mol. function=cation transporter activity; Cellular component=membrane; Biological process=cation transport
  Homolog annotation: Hit_ID=Q1S6S2; Match level="QueryCoverage=75%, HitCoverage=24%, E-value=4e-20, Identity=53%"; Hit description =Cation efflux protein
MEGGLEHLKAPFLSSNSGELSEVTRLKCDFFSKLPDKVRCGLDPDLSFHIDYSKATGLTEGEKEYYERQFSTLRSFEEVDSTESSNVIEDGSVHGEQVQSERAMKISNLANVLLLAFKVPFLSFLIEL

SEQ ID NO: 145732 - protein, 54 aa, Glycine max
  Coding DNA Sequence Number=SeqID_28954
MDHQQQRTVDFLSKMEGASNHARHPVGATFSPSYKFDGGKKIDIGSNSEGFPSE

SEQ ID NO: 145733 - protein, 253 aa, Glycine max
  Coding DNA Sequence Number=SeqID_28955
  Gene Ontology: Mol. function=transcription factor activity; Biological process=regulation of transcription, DNA-dependent
  Homolog annotation: Hit_ID=Q75G59; Match level="QueryCoverage=56%, HitCoverage=27%, E-value=2e-18, Identity=35%"; Hit description =Expressed protein
  Pfam annotation: Domain name=CDT1; Domain location=52-167; Score =49.1; E_value=1.5e-11; Accession=PF08839.1; Description=DNA replication factor CDT1 like
MEQNACKELSKIASNFKCEKVLETVDESIVCPTPQKNEEPLTVKSKEGQTNLPEKYSTLADLFGHMSCSLRLLYLCKKAPIFKMFAARKFSHAHLTQMKYILPKSVYIDRVLVHDKKSLCMVPDMKITLKFEVVKDCFGESADLALRRYFKSKLIDFFDMHPEDMPTQKSTSSYKPAKRVLDFSLMEDNDGLGIEMDKLESIRALHESSRGCYEDCNSFGSVSAPQEEGTHACILEKSGINEMFMTTGKIMMK

SEQ ID NO: 145734 - protein, 88 aa, Glycine max
  Coding DNA Sequence Number=SeqID_28956
  Subcellular localization annotation: CTP_CleavageSite=27; ConfidenceScore=5.15e-01
PTRKVSSALYAKSTALARRSEFNFVKPAETLRGRIRWRSRPLRVPLSLMDVRMYYLLPLDDQNTLVVCVLLEGLPACLPPWLPKTWSS

SEQ ID NO: 145735 - protein, 57 aa, Glycine max
  Coding DNA Sequence Number=SeqID_28957
  Subcellular localization annotation: CTP_CleavageSite=35; ConfidenceScore=5.30e-01
MLSFSQMQSQFQPQMQSQFQSQMQSQGLTLPPKPEGMIKKRVTQKNTGCASKKILPA

SEQ ID NO: 145736 - protein, 144 aa, Glycine max
  Coding DNA Sequence Number=SeqID_28958
MLPKVLEKIWLELEMQEVWSMGNGNVVNMQSDEWINEYLRLKDVVANIQVQNSTYIPYEVIEVIKPILPPYEVDDMKIGQSSLSKPNSITELLDVDGPFDSLGKLSHAATIVEAMPCHFDMALGKNSAMRGPRRNYRTPNETCD

SEQ ID NO: 145737 - protein, 84 aa, Glycine max
  Coding DNA Sequence Number=SeqID_28959
MDWFYMISHPFMKLAQPGDPPRHPAVMQDETYMEPDMPKYPVATIAIEEAPAQAPSDVEQPRHVVLTLTTHVRLNPKYYSNPKQ

SEQ ID NO: 145738 - protein, 49 aa, Glycine max
  Coding DNA Sequence Number=SeqID_28960
MEKGTSLPMEKDHHRSFIFPKKREKARKTLFLRDQRSGGWLRKGKVLAP

SEQ ID NO: 145739 - protein, 211 aa, Glycine max
  Coding DNA Sequence Number=SeqID_28961
MGEQWRQFKYDLTSKWAFAADKESVDDTDMRKKAQANQKHNIAPHVLSREGYEYSENKLMDEKRKKKLEEVAQSGSTDTVIDPLSPIRQHMKWKMARTKKTGQMTSEAAKEIAEKIESLEEQASYGFFVAIGRPEHRSRVGVVGVGVTIKKYFGLAPRTSRMSSSMAPEDLEQLMQQIRDQLEESITEKVTQRLMLSFQATVHPEIRAIEI

SEQ ID NO: 145740 - protein, 225 aa, Glycine max
  Coding DNA Sequence Number=SeqID_28962
MAVQHLIFLESCEIDRLRKRKRAQSLNFPVKFQNQPLDEAAQQDGRGKAHNPIRQSFELHKVLTNNADLLEFEQSALRVIVEGGNKPAIHVKGCSAVGQHCSGRRRRCQRERGEENNRQNHSPSHVRPSLLGLTLYRRRSTIHCVGDCTVQILSLVFVRVGIADSTDEERHGEHEKALSAILSLITSTSFAMIWKVLLEYMTFMESLAKRRKCKEVVFFVTFMAL

SEQ ID NO: 145741 - protein, 151 aa, Glycine max
  Coding DNA Sequence Number=SeqID_28963
  Gene Ontology: Mol. function=oxidoreductase activity; Cellular component=membrane; Biological process=electron transport
  Homolog annotation: Hit_ID=Q2LAK5; Match level="QueryCoverage=99%, HitCoverage=56%, E-value=2e-56, Identity=68%"; Hit description =Cytochrome P450 monooxygenase CYP71D54
DLEQLTYLKLVIKETFWVHPPTPLLLPRECSQPTIIDGYEIPAKTKVMVNAYAICKDSQYWIDADRFVPERFQGSSIDFKGNNFNYLPFGGGRRICPGMTLGLASIMLPLALLLYHFNWELPNKMKPEEMNMDEHFGLAIGRKNELHLIPN

SEQ ID NO: 145742 - protein, 100 aa, Glycine max
  Coding DNA Sequence Number=SeqID_28964
MPEMRMLKLGEGQAWVRFSFSAVLLFLSMEGFVWDMMLGVYTSEEGDDRSGGGWWMKVFFAADRRRIAVLSSDGRPQANPGVIGNSGKEGRVKFGGEGVQ

SEQ ID NO: 145743 - protein, 901 aa, Glycine max
  Coding DNA Sequence Number=SeqID_28965
  Gene Ontology: Mol. function=nucleic acid binding; Cellular component= chromatin; Biological process=DNA integration
  Pfam annotation: Domain name=zf-CCHC; Domain location=192-209; Score =23.7; E_value=0.00012; Accession=PF00098.13; Description=Zinc knuckle
  Pfam module annotation: Pfam domain module=RVT_2::zf-CCHC; Domain location=584-827::192-209
MEAYLDANDVWEAVEEDYEVPPLPNNLIVAQMKSHKERRLRKSKAKSILFTVWMKDSETIKDYADKLLGIENKIRLLGTEIPDSRIVQKILVTIPEKYEATLTSLENSKDLTTITLAELLIALQALKQRRLMRQEGTTERALVAKSLDKKKNGKSGSFNHKKGSKSSHDFPSCPFCKKNNHPQKKCWWRPDVKCHKCGQLGHVEKICKSSQKQENVQAAIEGVDEEELFVVSCFATARSIGSWLIDSGCTNHMTYDQELFKDLDATYNTKVRIGNGAKIAVKGKGTMMIEGCISLKLIPDVLYVLEITQNLLSVGQFLEKGYKVLFEDKSGMIKDSDNKELFRVQMKGKSFALNLIDEEQLDVHKVEDNTLVWHKRMGHFHHGSLLYLRKNDLVQGMLELEEKSLVCAACQYGKQMRLPFPKGKSWKATSKLQLVHTDVGGPQKTPSLNGRIEHQLTSPYTPQQNGVVEHKNIMFLEMVKRDKLDKKAKAGIYVGYSSTSKTYRIFLPQSNKVIVSRDVQFFEEEKWSKESEKLQVQEESKEDVDDQLVRGTRSLSDIYQRCNVAVMEPVDYNEAATNSKWVSAMKEELDMIEKHQTWELTEKPKDKNVIGVKWVYRTKLNVDGSINKHKARLVVKGYVHMFGVDFSKTFFPVARLDTIRLLLALAAHKGWIIHHMDVKSTFLNGHLEEEIFVEQPEGFVVRGQEEKAPRSWYGIIDAHLISLGFEKSLSDFTLYVKKTNVGIVIVSLYVDDLLMTRNSKELIEEFKGGMKEAIEMTDLGKMSFFLGIQVQQDRGQVFVSQEKYEKEILRNFKMEECKPSTTPMNQKEKFSNEDEAEKAAKRILRYTKGTIGYGVKFQLVKDFSLYGYSDSDWAGSNDDMKNTSGYCFTFGSRVFSWRSKK

SEQ ID NO: 145744 - protein, 63 aa, Glycine max
  Coding DNA Sequence Number=SeqID_28966
  Homolog annotation: Hit_ID=Q9M223; Match level="QueryCoverage=93%, HitCoverage=25%, E-value=2e-08, Identity=48%"; Hit description =Probable U3 small nucleolar RNA-associated protein 11
MYREEAKDLESRHQKSEIPLTSGDIPVGIKRKIDRSYQELEARRGRLSQLEKIYMDMTMQKDN

SEQ ID NO: 145745 - protein, 1385 aa, Glycine max
  Coding DNA Sequence Number=SeqID_28967
  Gene Ontology: Mol. function=RNA-directed DNA polymerase activity; Cellular component=chromatin; Biological process=chromatin assembly or disassembly
  Pfam annotation: Domain name=RnaseH; Domain location=805-922; Score= -23.2; E_value=0.0084; Accession=PF00075.14; Description=RNase H
  Pfam annotation: Domain name=rve; Domain location=1058-1210; Score =46.2; E_value=1.1e-10; Accession=PF00665.16; Description=Integrase core domain
  Pfam annotation: Domain name=zf-H2C2; Domain location=999-1040; Score= 8.4; E_value=0.028; Accession=PF09337.1; Description=His(2)-Cys(2) zinc finger
  Pfam module annotation: Pfam domain module=RVT_1::Retrotrans _gag::RnaseH::rve::zf-H2C2; Domain location=545-714::30-125::805 -922::1058-1210::999-1040
MGDRIDALEAQMGDVQAMLQSLAQQMQQQSLIMSELSKQIAQKGVNRESENSVGESSQEESCLSVKKVKLPLFEGDDPNPFEELSTLRQKGSVEEFVEAFELLSSQVGRLPEEQYLGYFMSGLKPQIRRRVRTLNPLNRMQMMRIAKDVEEELKEEDEDGERSDSKRGKSRSRLNPRDPTRSPNLGWSNPTQKTGSSGSNTISTMSLASTGRKGETDACTGVSEKWKGVRSIRNDEMAERRAKGLCFKCGGKYHPTLHKCPERALRVLILGEGEALNDEGEIVAMEAVQSDSEEEIEVECKSVGVLGSMGEHRTMKIEGKIENVDVLVLIDSGASHNFILPQVTTALGLTITVGVAKHIKLGDGHKVVSEGVCYGLNIQLGPIVVKVDALVLELGGLDMVLGVSWLSTLGKVVMDWKVLSMQFLYEDQWVKLKGQGGTQEKQSYLNTFLEDKQRRLGTDWWWSQEEQSKTVIPGDLKGILEQFHEVFKEQIQLPPERTQVHQIKLFQDHGTINVRPYRYPHHQKEEIGKQVRELLKVGVIRPSMSAYSSLVNLVKKKDKSWRMCVDYRALKKATIPDKYLIPVVDELLDELYGATIFSKIDLKSGYHQIRVHEDDIHKTAFRTHNGHYEYLVMPFGLMNAPATFQATMNDIFRPFLRKFVLVFFDDILVYSRDTQEHQDHLTQVLSVLLANCFVANPSKCKFGCKQIDYLGHVISGDGVAVDPEKVKCILEWPEPKNVKGVRGFLGLTGYYRKFIKDYGKVAKPLTDLTKKDNFVWGTDAMKAFNLMKQIMTSPPVLVLPNFELPFEVECDAAGRGIGAVLMQQRQPIAFFSKALSDGNLAKSVYEKELMALVLSIQHWRHYLLGKQFIVYTDHKSLKHFLQQRVSSPDQQCWLAKLLGYQFEVKYKPGLDNKAADALSRCYDETEFSTMISYPQWVHSMKLLEEVAMDPEIQKLIPKLQASPEAKPGFHVKQGILFYHGRLVLSLKSPSILNLLEEYHSTPTGGHSGFLRTYRSLADNLYWVGMQRSVRDFVRACDVCQRQKYVATTPGGLLQPLPIPNAIWEDLSLDFITGLPKSRGYEAVLVVVDRLSKYSHFILLKHPYTAKSIFELFVKEIVRLHGIPKTLISDRDLLFVSNFWLELFRLHGTKLQMRSAYHPETDGQTETPFEVVYGRQPPSILRFLTNETKVAAIAMELSERDEALNQLKLHLSRAQDQMASYVNKKRRDLSFVIGEWVFLKLCPHRQHSVVKRINKKLSARFYGPFKILAKIGEVAYRLRLPEQSRIHPVFHVSLLKKAIGEYQVQGELPKDLEITDVADVYPEQSLDDVTWEDDAFLRGQFPDFSLEDKVVSKEQGVDRNIDPKVGLDIGPSKIWRVYKRKKGKGI

SEQ ID NO: 145746 - protein, 291 aa, Glycine max
  Coding DNA Sequence Number=SeqID_28968
  Homolog annotation: Hit_ID=Q1T493; Match level="QueryCoverage=97%, HitCoverage=59%, E-value=2e-13, Identity=22%"; Hit description =Nucleic acid-binding, OB-fold, subgroup
MSRKENLISELHPRKGTWKIAVRITDMWDVKKHNGRQAIDMGVKIEATLWQELFPEFQPKLALGCSYLIQNIKVVDNQSEYKFIYSTYVQHNLILFIYVGLKIDVVGVVAKVIEQKIVNPAYKVTVKLRDNSDAEILMTLWEDYALQLDDAIEKNHFVREPLVLMLTLTKIKDAKDKYPLSVQNIKNGSKLYVNSDDIAEIRKFLDSFCVPFYVGGLTEEGSGLQSQYTSNSQRGDRDKFLHNAQMVNLGDISRLRDDCFCLTVATVDDVLIDTPWSYDSFPNCTTTFDPL

SEQ ID NO: 145747 - protein, 92 aa, Glycine max
  Coding DNA Sequence Number=SeqID_28969
  Gene Ontology: Mol. function=DNA binding; Biological process =regulation of transcription
  Homolog annotation: Hit_ID=Q8LRL8; Match level="QueryCoverage=77%, HitCoverage=12%, E-value=3e-15, Identity=52%"; Hit description=Nam -like protein 7
MVFVGYIIDPDYYALYKVYKKSGPGPKNGEQYGAPFNEEQWADDDIVDFNINPAYQEAPNDVLDNDNVLQPLLDDEIDNIIRGILDDELVLD

SEQ ID NO: 145748 - protein, 69 aa, Glycine max
  Coding DNA Sequence Number=SeqID_28970
MASPPGSPLPPPPPSDTCALPSAVKPPGAERPVVHVDPTTGKADDPHRKKLKTYLGIVARDKVYVTYEN

SEQ ID NO: 145749 - protein, 114 aa, Glycine max
  Coding DNA Sequence Number=SeqID_28971
MRGYLMITRTCCQPRANEPIDAQRLTSSPAPFVVQTREVSQVTRGITLWLPAPFINQGANEPVDAKRLTSSSAPFAIQGQRVKWQREIPYGYSRLSSTEGNKFDGIRMMWVVRC

SEQ ID NO: 145750 - protein, 78 aa, Glycine max
  Coding DNA Sequence Number=SeqID_28972
GNNERVKREQLGGCSAARIFDVVGSTSSDLRPRPRTRVDTCDRVAGQWTHVTKNKRGWAVAWWQLAPLNEANTADAVK

SEQ ID NO: 145751 - protein, 120 aa, Glycine max
  Coding DNA Sequence Number=SeqID_28973
MECHQRQTLRQSILLISFGQLLQFRSSILNNEPLEKLRKGGLRSQSELMLDASTSGKISLKTPREAIEIIENMATNANEFKRCHTTNECAMIQEEVQYMNNKGEGTTTTTTTKDTNLILA

SEQ ID NO: 145752 - protein, 297 aa, Glycine max
  Coding DNA Sequence Number=SeqID_28974
ASGAAAFFAIVYFKSPALLEQNPESASKPVPPTVIDAYAVNSSNRDRYLELFRTGQFGQRDKLRIGCVEWSESSCVAAGNFLRLLSDAGWEIDSDAVFRMQPSVPVEGVSIVSRGDDLVGLPKVPPHMGRWSRSDISYEILTAAFKLMGVPVYFSSDPALQPGTTGVYFGPKPKLDVPIKQKDENARRELLRYVGLGMAIQRACSQQSVEVCADELFSWETSVSSFLRLQRFNSDAVNRWLALPHANAAAATADMKIKPRFLFVKACGIELVFYDAWFGEDLGDSVRQEAHPEAASA

SEQ ID NO: 145753 - protein, 115 aa, Glycine max
  Coding DNA Sequence Number=SeqID_28975
  Gene Ontology: Mol. function=DNA binding; Biological process=DNA integration
VKTCTSLWIKLVRKESALSELDEFRLEAYENAKFYNEKTKKFHDSMIVKKDFMVGQKVLLYNFRLGLRSVEIKRDSTNKSFKVNGHGLKPFLTNLFLVEVVVEETSLLPLIFLPP

SEQ ID NO: 145754 - protein, 105 aa, Glycine max
  Coding DNA Sequence Number=SeqID_28976
MVATSEDGANDANGDTATEEPIEPKIKIFFEGIDIGGNNDNQEANEHMEPTTKVVPVVDVEPKEGELNDVVVKENSAKGIIVVEVASKEIDEVDSIIRSVISSID

SEQ ID NO: 145755 - protein, 216 aa, Glycine max
  Coding DNA Sequence Number=SeqID_28977
  Homolog annotation: Hit_ID=Q1S393; Match level="QueryCoverage=64%, HitCoverage=91%, E-value=5e-37, Identity=58%"; Hit description=Auxin responsive SAUR protein
  Pfam annotation: Domain name=Auxin_inducible; Domain location=8-101; Score=124.8; E_value=2.4e-34; Accession=PF02519.5; Description=Auxin responsive protein
MSAKCSQIRHIVRLRQMLRRWRNKARMSANRAPPSDVPAGHVAVCVGSNLTRFVVRATYLNHPVFKKLLLQAEEEYGFTNHGPLAIPCDETLFQDVLRFISRSDPAKSNRFLNLELDDFQRHHCHVGISNNLDFWPESRPLLHGPTDKTIWIGLVVTVEIDVRGFITCWVLVIVIVHQKQRMVSQKCRSRRWQRVGVVPGSDWSGGCDFMAIFKLR

SEQ ID NO: 145756 - protein, 119 aa, Glycine max
  Coding DNA Sequence Number=SeqID_28978
MAYKRSYMQMRYFQSQYVHSPHGEGPRGAQTMKVISRSVWYIYKLLTSSTSPGEVQGICPKGVVNPLLNSLPFKVRSGVDAILPRKGPITRTMSKRLQEDWARAAEEGPRVLMNLRVDF

SEQ ID NO: 145757 - protein, 105 aa, Glycine max
  Coding DNA Sequence Number=SeqID_28979
MGSSWLAGLMPLKSLSVKVTILVELVVRPVMVVVSICLNLLLFSCLLPDSLAAPLDVLWVLILPGGCLGCVTLIHGPFGERLVLIWLVPLVRLVRVGLDICFTFV

SEQ ID NO: 145758 - protein, 224 aa, Glycine max
  Coding DNA Sequence Number=SeqID_28980
  Gene Ontology: Mol. function=RNA-directed DNA polymerase activity; Biological process=RNA-dependent DNA replication
MKDKIEELIQVGYLAKFVKRPDNHQAGSRPKGHQEEQQGNFKGINPANQDDPMVVSIIENFMVPRVLIDQGSSTDILYLKTFQRLEVSSDTVHPHASPLLDFASGRVEAKGYMNLMTTFGQGKLSRSFTIRYLLVDAATSDFGLVSRKTFNELGAIVSMPNEIPYTDRGDESLKVAPYPPIRELTMPYPIMARGTQVMTVDEGSPIQALTVYQASLGSEFDIDL

SEQ ID NO: 145759 - protein, 101 aa, Glycine max
  Coding DNA Sequence Number=SeqID_28981
  Gene Ontology: Mol. function=RNA-directed DNA polymerase activity; Biological process=RNA-dependent DNA replication
MELASGVAFPGYVIHFETFEIVNERLHYVRVLEHHCFLGLHRCCLTLTSLASFKPTMSASYSVWLFEALKWSLRAFSRVMLSGPSRMVPALLPFMLDAPSM

SEQ ID NO: 145760 - protein, 206 aa, Glycine max
  Coding DNA Sequence Number=SeqID_28982
  Homolog annotation: Hit_ID=Q59296; Match level="QueryCoverage=12%, HitCoverage=5%, E-value=6e-08, Identity=96%"; Hit description =Catalase
  Pfam annotation: Domain name=zf-C2HC_plant; Domain location=97-141; Score=3.7; E_value=0.015; Accession=PF07567.3; Description=Protein of unknown function, DUF1544
MVGFLVSLSLNQFLVGFVWEKVWEVSHFLSCLILQLLKDYMFAKRPKTFVVCLFFFLDFNLNTAQVTHLLGVLSFDSEKSLISYHQVLLAPILDGNIALNDSCVCNLCGNVTKGGITREKEQLIADSRNVAAYAKCPKEVREELWRCLKDKKKQERETFHRTSQHFIEDYGDSDGYRARIRNHGHSCFLCEIVIRSQFHTTYEPEA

SEQ ID NO: 145761 - protein, 174 aa, Glycine max
  Coding DNA Sequence Number=SeqID_28983
MDRGEGFDDGDFGDEGRGMGTRFSNIVGAEVGAGGGEGGWMVRGSLYCISIFMLKRTESLKDLSKDSKFLPDWPIKGATFLESSLQTHRWSKGGQKSYLTCSIGSDNRCKGIFNNRLGRDFNKRRFNCIHLGSKMSVFCLILHLHKLVVKLVLFLLEFNNHSLSWNPRVLIRRE

SEQ ID NO: 145762 - protein, 264 aa, Glycine max
  Coding DNA Sequence Number=SeqID_28984
MTLEELVGILKVHEQKLDQDEGTKKGKSLTLTTQRPKCSFASKESSSKALVVNDDSKEESDDDDYDEEDDELSPKLGHFKLECPDLEKLKDKKKKFFKPKKTSLMSTWEDLDNSSSDEDGEEEANLCLMANAFTSKADPTLDVSLDDEDSQPDDIANSDGEEEVKALLDEKVSSGCKSLRKDFQDLEEKVKSLTTTLEDSEEWHKEILKQKLLLQKECTFANDELDNLKKKDSDLWMECQHDKKMAFDLNCKLKGHEVLKELPP

SEQ ID NO: 145763 - protein, 77 aa, Glycine max
  Coding DNA Sequence Number=SeqID_28985
MLKLQVHIHLYEIQVEKHEPKGSRRKTKYLSLDDTASASNLEKTSALALDSQYKSNGAVTRSSSTENIHKKVTSIGS

SEQ ID NO: 145764 - protein, 122 aa, Glycine max
  Coding DNA Sequence Number=SeqID_28986
MPNRIALRLPPLDLDKKKGKVPPHTKPMPHPGPKDNIALCPIPYDWSRYFTRDAAKKTITLKLDAEFDQNDAMIFYFKDMYDTPRIASTLEYDKEDTSNHICMDKLNYQLMEMQDEAKAKQQ

SEQ ID NO: 145765 - protein, 126 aa, Glycine max
  Coding DNA Sequence Number=SeqID_28987
  Subcellular localization annotation: CTP_CleavageSite=27; ConfidenceScore=5.55e-01
MSATNTPAPYSSSPVFSQKVSPSGWPSGSLKSSLLLHIDGTSPVAEDIGRQPYRKTSLLFCMTIHVEDAGPKQCNVMLMIIVAVRNREKINQLRERETMNEGVFHVGCVPYYLTHWEKFGNSVGRT

SEQ ID NO: 145766 - protein, 244 aa, Glycine max
  Coding DNA Sequence Number=SeqID_28988
  Gene Ontology: Mol. function=metalloendopeptidase activity; Cellular component=mitochondrial respiratory chain; Biological process =proteolysis
  Homolog annotation: Hit_ID=Q9AXQ2; Match level="QueryCoverage=79%, HitCoverage=42%, E-value=5e-93, Identity=77%"; Hit description =Mitochondrial processing peptidase beta subunit
  Pfam annotation: Domain name=Peptidase_M16_C; Domain location=39-195; Score=137.6; E_value=3.3e-38; Accession=PF05193.11; Description =Peptidase M16 inactive domain
MEQVEGQMEEVIFDHLHATAFQYTPLGRTILGPAQNIMTITKDHLQNYIQTHYTAPRMVVAASGAVKHEEIVEQVRILDDDIPLAQFAVAFEGAAWTDPDSVALMVMQAMLGSWNKTAGGGKHMGSELAQRVGINEVAESMMAFNTNYKDTGLFGVYAVANKDCLDDLSYAIMYETTKLAYRVSEDDVTRACNQVMCYIPIAQSIKVVGASSLSRLAIPPYHDLTIPPVCNILSERDTKPSRKA

SEQ ID NO: 145767 - protein, 163 aa, Glycine max
  Coding DNA Sequence Number=SeqID_28989
  Gene Ontology: Mol. function=metalloendopeptidase activity; Cellular component=mitochondrial respiratory chain; Biological process =proteolysis
  Homolog annotation: Hit_ID=Q9AXQ2; Match level="QueryCoverage=73%, HitCoverage=22%, E-value=8e-53, Identity=81%"; Hit description =Mitochondrial processing peptidase beta subunit
VASHVLDLLLELPDGALRGALEDHVLEEVRGAVGLLRLEPRPGVDPDAHSRGLGGEGGLRGDAEAVGEGRHAGLGRAQDPRVVRQRGHRGPVFQEAWVRVIEPAEFGFGRLREAVVEHGVGRGRGRRGGGLGGRRKGGEEAEGGWLEAMVGGSDGGVDLTGGE

SEQ ID NO: 145768 - protein, 83 aa, Glycine max
  Coding DNA Sequence Number=SeqID_28990
  Subcellular localization annotation: CTP_CleavageSite=74; ConfidenceScore=5.07e-01
HCCPQQGHQAPYQSSFHLEVLRLQAGAGRNTTAAWGWPAAGNRRTAITSRVHLSSSTKRTHLVAHDPGDLNKTSASSKGRKIP

SEQ ID NO: 145769 - protein, 306 aa, Glycine max
  Coding DNA Sequence Number=SeqID_28991
MRSWVRGQWIHFDADALSQFLGDSQVLEEGQECEFSQRRNRADGFDEEAIAQLLCITGQDFARTTARRRVRIMLTNMTTLTQMWMTLLHSNVLPSDHNSDLPLPKCQLVYAILTRMSVHVARLIANAIYLFAGMPPTSVDHGSLPVTPSKVIRPPITRAFIEKYCTPRQAQGDDAPQAADAPPPPHQADPAGSFGMERYFQHLVRQQAANHRGQVQIHECLYQLSLSQQSQGFAPFACPTPDQFRAEVAWPGDWPEDQTEEALAGAPDGAEDARMDEEMTRFLGRKRSHVTEVTAFFDISVFFRFV

SEQ ID NO: 145770 - protein, 70 aa, Glycine max
  Coding DNA Sequence Number=SeqID_28992
MASGQEYKGWKMSVNVLREDYFRGGVMARWNDHAIVEALQALAQAIGNQNKGKAVGATEYQRMDHFQQNN

SEQ ID NO: 145771 - protein, 98 aa, Glycine max
  Coding DNA Sequence Number=SeqID_28993
MSLATLFGKLQEHEMELMRLNQHEEHVKKKKGISLKASSSIQEEIDKEDLNEIEEDDDFSFFVKRFKQFLRNKRNQRRTNFNSKKRGEYSSFVPKCYE

SEQ ID NO: 145772 - protein, 108 aa, Glycine max
  Coding DNA Sequence Number=SeqID_28994
  Homolog annotation: Hit_ID=O81190; Match level="QueryCoverage=48%, HitCoverage=7%, E-value=5e-07, Identity=46%"; Hit description =Putative transposase
MEEAKDSRKVEQLGEWWEMFGDGTPKLRRFAIHVLSLTCCSSGCKRNWSSFEMNDEDEQPRGEGDGGNVELVGDVGRSSNDLVVDVFDLDNLILVEPNDDAQSKEDLD

SEQ ID NO: 145773 - protein, 139 aa, Glycine max
  Coding DNA Sequence Number=SeqID_28995
  Homolog annotation: Hit_ID=Q1SP02; Match level="QueryCoverage=86%, HitCoverage=25%, E-value=8e-08, Identity=30%"; Hit description=IMP dehydrogenase/GMP reductase
MPYADHQGVRGFDLISYFQGQLRWGPIVVFVRPERVVRQFRYIQTIPPPPVSASLSYEEIDDRWMNFSDHVAPAGEIRVVLGQVSADYMDWFFQISHPFVTPTQAGDQPRHPPAPHDEEYVEPHIPEVPVASNLPRDSV

SEQ ID NO: 145774 - protein, 71 aa, Glycine max
  Coding DNA Sequence Number=SeqID_28996
MKELEAAMKATRRGQIKVAKGDNCPSFIRITLVISLVDVRLNTTPHTLHNEGDRGYMKATQRHRTIKWKRG

SEQ ID NO: 145775 - protein, 668 aa, Glycine max
  Coding DNA Sequence Number=SeqID_28997
  Gene Ontology: Mol. function=zinc ion binding; Cellular component =nucleus; Biological process=transcription
  Homolog annotation: Hit_ID=Q1SW42; Match level="QueryCoverage=92%, HitCoverage=89%, E-value=0.0, Identity=50%"; Hit description=Heavy metal transport/detoxification protein
  Pfam annotation: Domain name=FAR1; Domain location=58-265; Score =237.2; E_value=3.6e-68; Accession=PF03101.5; Description=FAR1 family
  Pfam annotation: Domain name=SWIM; Domain location=550-586; Score =26.8; E_value=7.5e-05; Accession=PF04434.8; Description=SWIM zinc finger
  Pfam module annotation: Pfam domain module=FAR1::SWIM; Domain location=58-265::550-586
MEEVCLNSEPLFDESDEVDVEGNSSVAEHDLESLNSQPNNSPLPTVGLEFDSFDEVYNFYNIYAKEQGFGIRVSNSWFRLKKKERYRAKLSCSSAGFKKKSEANNPRPETRTGCPAMIVIRMVESNRWRIVEVELQHNHQVSPQSKRFYKSHKKMIVEASKSQPPSEPVTEVHTIKLYRTTVMDVDYNGYSNFEESRDTNFDKLKYLELREGDASAIYNYFCRMKLTDPNFFYLFDIDDDGHLKNVFWADSRSRIAYNYFNDIVTIDTTCLANKYEIPLISFVGVNHHGHSVLLGCGFLGHESVDYFVWIFKAWLQCMLGHPPHVVITDQCKPLQIAVAQVFPHARHCYSLQYIMQRVPEKLGGLQGYEEIRRQLYNAVYESLKIVEFESSWADMIKCHGLVDNKWLQTLYKDRHLWVPVYLKDAFFIGLIPTKENEGLTAFFDGYVHKHTSFKEFVDKYDLVLHRKHLKEAMADLETRNVSFELKTRCNFEVQLAKVYTKEIFQKFQSEVEGMYSCFNTRQVSVNGSIITYVVKERVEVEGNEKGVKSFEVLYETTELDIRCICSLFNYKGYLCRHALNVLNYNGIEEIPSRYILHRWRRDFKQMFNQFHVYDNVDSHNPVPLYTRLFNSALPVLEVGAQSQEHYMVALKELEELLGKFDIEDNNIM

SEQ ID NO: 145776 - protein, 601 aa, Glycine max
  Coding DNA Sequence Number=SeqID_28998
  Gene Ontology: Mol. function=calmodulin binding; Cellular component =alpha-glucosidase II complex; Biological process=protein kinase cascade
  Homolog annotation: Hit_ID=Q9FM96; Match level="QueryCoverage=95%, HitCoverage=89%, E-value=1e-77, Identity=49%"; Hit description =Arabidopsis thaliana genomic DNA, chromosome 5, P1 clone:MCD7
  Pfam annotation: Domain name=PRKCSH; Domain location=519-568; Score =71.8; E_value=2.2e-18; Accession=PF07915.3; Description=Glucosidase II beta subunit-like prote
MKLLRLRILLIALLLMLCAPFSSSSKPKDPFLGVAPEDDDYYKSSDVISCKDGSGKFTKAQFNDDFCDCADGTDEPGTSACPGGKFYCRNAGHSPVYLFSSRVNDGICDCCDGTDEYDGQVKCPNTCWEAGKVARDRLKKKIATYQEGVKLRKQEIEQAKVAMEKDEAELSKLKKEESILKGIVKQLKDHKEQIDKAEEEERLQKEKEEKQKRESEEKANEAKDKADEDTEHRNEAEKHSDIEDNTLENNHDKIENLEGSPADQDEAGDKLADVLDDDDDDDDDEASDSHGSEGSLHNKVEENAKEAEEEPIVKSETDIKVRNKESSDEIINKHQGLGHPLLQDHSQAQVSHHSNTMDSGQWSQGNDASENTEGLSREELGRLVASRWTGENTDKPSAVPDTTLDNEDREDPKGRNNEEYEGYASETDDDNNKYDDDSHKYDDEDEVDDEYREDEHDDLSSSYKSDSDNEPDLSDAARVRKEYDESSAKLSKIQSRISSLKQKLKHDFGPAKEFYSFYDHCFEGKENKYTYKVCPYKQASQEEGYSNTRLGSWDKFEDSYRVMVFSNGDKCWNGPDRSLKVKLRCGLKNEITDVDEPSRCE

SEQ ID NO: 145777 - protein, 204 aa, Glycine max
  Coding DNA Sequence Number=SeqID_28999
  Homolog annotation: Hit_ID=Q9LJF0; Match level="QueryCoverage=46%, HitCoverage=69%, E-value=2e-11, Identity=41%"; Hit description =Arabidopsis thaliana genomic DNA, chromosome 3, P1 clone: MRP15
MCACVCGNLENDAKIGCALIGSLGASYNGVSLVNLAIALFALVAIESSSQSLGRTYAFLLFCAILLDISWFILFANEIWNISTKYYTTFFTFSVKLTLAMQIVGFTVRLSSSLLWIQIYRLGASYVNAASRAADSDLRSSFLSPMTPAVARQCSNSNEILGGSIYDPSYYSSLFEDAQENKYSSEVGLTLLKTIAMITFSVGIN

SEQ ID NO: 145778 - protein, 553 aa, Glycine max
  Coding DNA Sequence Number=SeqID_29000
  Gene Ontology: Mol. function=pyruvate kinase activity; Cellular component=mitochondrion; Biological process=glycolysis
  Homolog annotation: Hit_ID=Q5F2M7; Match level="QueryCoverage=99%, HitCoverage=100%, E-value=0.0, Identity=83%"; Hit description =Pyruvate kinase
  Pfam annotation: Domain name=PK; Domain location=11-408; Score=695.5; E_value=3.8e-206; Accession=PF00224.11; Description=Pyruvate kinase, barrel domain
  Pfam annotation: Domain name=PK_C; Domain location=422-553; Score =179.7; E_value=7e-51; Accession=PF02887.6; Description=Pyruvate kinase, alphabeta domain
  Pfam module annotation: Pfam domain module=PK::PK_C; Domain location =11-408::422-553
MATTRIEAEKKPKTKIVCTLGPASRSVPMIEKLLRAGMNVARFNFSHGSHEYHQETLDNLRAAMENTESNLEYNVGESRSPDMIRLIYEGSNLGPFPPSFLLNHPTNLMSLDFGHNTIPIVMPSIEEKWGPEIRTGFLKDGKPIQLIQGNEITISTDYDLKGDEKTICMSYKKLPEDVKPGMVILCADGTISFTVLSCDKQAGLVQCRCENSATLGERKNVNLPGVIVDLPTLTDKDKEDILAWGIPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 145779 - protein, 113 aa, Glycine max
  Coding DNA Sequence Number=SeqID_29001
MKNAVSLMEKLMKNNSEAKKEVQLCTLRAPAFIMEEPKFSSKGNPPAMLAIRGQGKSPMTNAFHTSFKNQLAVVLLVPIFKLGCYLWMILKCNIDATFRDHKLKIGWGIRMCL

SEQ ID NO: 145780 - protein, 89 aa, Glycine max
  Coding DNA Sequence Number=SeqID_29002
MVVTTNMRSRVDAVSGKGYYAAAGDDKLGLAVAATVIEMSYVAQFEQIEWQNAEDSPQSTPAIARVLHLKRTTNLSLPLFSDGCTALGG

SEQ ID NO: 145781 - protein, 78 aa, Glycine max
  Coding DNA Sequence Number=SeqID_29003
MAPKLIWLCMILLQNFLPEAVSQYRTYEDAFVNKVKGFGKNGLMIAKENPAVSAGVAISAALLAMRVSIVLTSHMESI

SEQ ID NO: 145782 - protein, 65 aa, Glycine max
  Coding DNA Sequence Number=SeqID_29004
  Subcellular localization annotation: CTP_CleavageSite=51; ConfidenceScore=5.03e-01
MAETDSSSSSDGEPSQSLASIAENLQRSAIQSARTVQHSSSTHFRAFQLVRTEKVNADLGISIPL

SEQ ID NO: 145783 - protein, 306 aa, Glycine max
  Coding DNA Sequence Number=SeqID_29005
  Gene Ontology: Mol. function=binding; Cellular component=thylakoid; Biological process=photosynthesis
  Homolog annotation: Hit_ID=Q337L2; Match level="QueryCoverage=91%, HitCoverage=38%, E-value=9e-78, Identity=55%"; Hit description=TPR Domain containing protein, expressed
  Pfam annotation: Domain name=TPR_1; Domain location=161-194; Score =9.0; E_value=0.45; Accession=PF00515.18; Description=Tetratricopeptid e repeat
  Pfam annotation: Domain name=TPR_1; Domain location=195-228; Score =26.6; E_value=8.7e-05; Accession=PF00515.18; Description =Tetratricopeptide repeat
  Pfam annotation: Domain name=TPR_2; Domain location=107-140; Score =1.2; E_value=24; Accession=PF07719.7; Description=Tetratricopeptide repeat
  Pfam annotation: Domain name=TPR_2; Domain location=161-194; Score =6.8; E_value=5.3; Accession=PF07719.7; Description=Tetratricopeptide repeat
  Pfam annotation: Domain name=TPR_2; Domain location=195-228; Score =23.2; E_value=0.00091; Accession=PF07719.7; Description =Tetratricopeptide repeat
  Pfam annotation: Domain name=TPR_2; Domain location=71-104; Score =10.1; E_value=2.2; Accession=PF07719.7; Description=Tetratricopeptide repeat
  Pfam module annotation: Pfam domain module=TPR_1::TPR_1::TPR_2::TPR _2::TPR_2::TPR_2; Domain location=161-194::195-228::107-140::161 -194::195-228::71-104
MRNCPDTQDAWASGMFWSLLLSQCQLAEGMMRESDLYIVLHLCLEYAEQRKLSIAFDHEKKLIKLEGGSSVSGYILLARILSAQQKFVDAELVIDAALDQSGKWDQDELLRTKAKLRIAQGKLKNAVETHTLAVLQVQNKSLGTASNVVKNKGNRDRSLEMDIWLDLANVYPALSKWQDAEVCLVKSEAINPYSASRWHTKGLLFEARGLHREALKSYRKGLDIEPNHVPSLISTACVLRQLGDQSSSIVRSLLTDALRLDRTNPPAWYNPGLLYKANLGTSAMETVECFEAAAFLEESSSIELFR

SEQ ID NO: 145784 - protein, 171 aa, Glycine max
  Coding DNA Sequence Number=SeqID_29006
  Gene Ontology: Cellular component=mitochondrion
  Homolog annotation: Hit_ID=Q10M34; Match level="QueryCoverage=82%, HitCoverage=63%, E-value=2e-24, Identity=44%"; Hit description =Expressed protein
MEHQTVLQASFILLKPFGTTCCKRHDWASRAPRRFLFRHTLGRFQSEEARYARIEKNVKDLNLSVDLLKKENAKLLQRTTLAEKEMKYGHTELVSAGTQFQQLAKSAYKVETRAADLLDKLRYIPSREALALRAEASQLCLIVASMASNLKRQRSSLNKRIMKINELGVPV

SEQ ID NO: 145785 - protein, 78 aa, Glycine max
  Coding DNA Sequence Number=SeqID_29007
MPNCTLWRWIITYLNKVGQWAKARVESTFYNSKERSSRDHLKDREGWNHSHKGIRTDHDTMIEQGMSGAEKTCSEGPI

SEQ ID NO: 145786 - protein, 80 aa, Glycine max
  Coding DNA Sequence Number=SeqID_29008
MMIGKQRAKLVMATTRWVLKHPVYGIVILRLGIYTSRPNISKLCSFIGSRNPSILISDDVPKGKLYKVPEFQHTLSTIRK

SEQ ID NO: 145787 - protein, 126 aa, Glycine max
  Coding DNA Sequence Number=SeqID_29009
MTLKEQTEGAQNVRPSKNTLSQLIPQTKTDEIHDPPPSYSLPINVYDDDVMAQFQSCSSPSLRMLPYDSSSSCSHQQFPRYLPFQVTGFGPQGIPAMMPQYNKGHLWLHPPTLTDFPKLVQAWEVN

SEQ ID NO: 145788 - protein, 167 aa, Glycine max
  Coding DNA Sequence Number=SeqID_29010
MNPEGAQANANNQNEVILHLSLDLESLSLLPLFPVAESVQRFNEGLLPQPQMNLHNGPKTVVPLHEFSNVALRSNISPSSSLAKTPQKPSTNLDLSLASGLGMNPNNNLAQGHAVQEQGMRRGTLTNIVHLRTKRRFSDCVFQEFQVGESSKMGEQAALAKRRATRF

SEQ ID NO: 145789 - protein, 309 aa, Glycine max
  Coding DNA Sequence Number=SeqID_29011
  Gene Ontology: Mol. function=oxidoreductase activity; Cellular component=cellulose and pectin-containing cell wall; Biological process=lignin catabolic process
  Homolog annotation: Hit_ID=Q1SBP2; Match level="QueryCoverage=97%, HitCoverage=54%, E-value=1e-139, Identity=77%"; Hit description =Multicopper oxidase, putative
  Pfam annotation: Domain name=Cu-oxidase; Domain location=1-59; Score=- 27.6; E_value=0.03; Accession=PF00394.12; Description=Multicopper oxidase
  Pfam annotation: Domain name=Cu-oxidase_2; Domain location=138-281; Score=118.3; E_value=2.1e-32; Accession=PF07731.4; Description =Multicopper oxidase
  Pfam module annotation: Pfam domain module=Cu-oxidase::Cu-oxidase_2; Domain location=1-59::138-281
RRVPRVVQNNYDSLDVHVGQCYTVLVTADQEPKDYFMVASTRFTKKVLTATRVIRYSNGVGPASGGLPPAPQGWAWSINQFRSFRWNLTASAARPNPQGSYHYGQINITRTIKLVNTVSRANGKLRYGLNGVSHVDTQTPLKLAEYYGVADKVFKYNLISDSPDTAFPDLTVAPNVINATFRDFIEVIFENPGKVIQSYNLDGYSFFALAVEPGKWTPEKRKNYNLLDAISRHTIQVFPNSWAAIMLTFDNAGMWNLRSEMAENRYLGQQLYVSVLSPNRSLRDEYNLPETQLLCGIVKDMPKPPPYSS

SEQ ID NO: 145790 - protein, 177 aa, Glycine max
  Coding DNA Sequence Number=SeqID_29012
  Gene Ontology: Mol. function=oxidoreductase activity; Cellular component=cellulose and pectin-containing cell wall; Biological process=lignin catabolic process
  Homolog annotation: Hit_ID=Q1SBP3; Match level="QueryCoverage=89%, HitCoverage=28%, E-value=6e-68, Identity=74%"; Hit description =Pollen-specific protein Bp10 (Clone Bp 1002)-rape
  Pfam annotation: Domain name=Cu-oxidase_3; Domain location=42-159; Score=172.8; E_value=8.3e-49; Accession=PF07732.5; Description =Multicopper oxidase
MAFLDVRKKIMGRVWTWTMALMLCLMAASVRSEDPYIYYTWKVTYGTIAPMGVPQQGILINGQFPGPEINSTSNNNVVINVFNNLDEPLLFTWHGVQHRKNSWQDGTLGVQCPIAPGTNYTYHFQVVKDQIGTYFYYPTTGLQRAIGGFGGLRIFSRLLIPVPYADPADEYWVLIGD

SEQ ID NO: 145791 - protein, 78 aa, Glycine max
  Coding DNA Sequence Number=SeqID_29013
MVAATPNEADVDVHHVRHAVDGFVAISDELERLLNLRILTEGTKAYTVVEECVSITRSYIGQPTVGHRSRRRRRMDDH

SEQ ID NO: 145792 - protein, 51 aa, Glycine max
  Coding DNA Sequence Number=SeqID_29014
MSLRRVRSQGQSLLLYQREGGDLTFPSPVISTRQFESDGSIKEEMIWKRWG

SEQ ID NO: 145793 - protein, 84 aa, Glycine max
  Coding DNA Sequence Number=SeqID_29015
  Subcellular localization annotation: CTP_CleavageSite=64; ConfidenceScore=5.28e-01
MLLILTTIPEFTNLASSQSPSLLSFIVVQVVDSLKVVTLEPIRPFSLKFSLGPLSLEALRSNVGAVHLSSVSIKGVCVGLSLLK

SEQ ID NO: 145794 - protein, 215 aa, Glycine max
  Coding DNA Sequence Number=SeqID_29016
  Gene Ontology: Mol. function=chromatin binding; Cellular component =chromatin; Biological process=chromatin assembly or disassembly
  Homolog annotation: Hit_ID=Q1SAV4; Match level="QueryCoverage=84%, HitCoverage=56%, E-value=6e-33, Identity=36%"; Hit description =Integrase, catalytic region
  Pfam annotation: Domain name=Chromo; Domain location=132-180; Score =9.6; E_value=0.07; Accession=PF00385.14; Description='chromo' (CHRromatin Organisation MOdifier
MWAEWSYNTSIHYATSVSPFEITFGWKPPSIPQYLTGSARVIVMDELLTNRETVFTSLRKKLSKSQARMKSLANTHIREIHFEVGQWVMLLEGCRIHLVFHCSILKPFHQSPSATDIPITLPSQTRDQQPVISPLAILSTCQDVIGDETHLMVLIQWECLHPNETSWKDWANLKKAYHLEDKVLPDGIGNDGPKFNDQMSTRPKRVITIPRHLRD

SEQ ID NO: 145795 - protein, 394 aa, Glycine max
  Coding DNA Sequence Number=SeqID_29017
  Gene Ontology: Mol. function=RNA-directed DNA polymerase activity; Cellular component=chromatin; Biological process=chromatin assembly or disassembly
  Pfam annotation: Domain name=zf-H2C2; Domain location=273-314; Score =6.2; E_value=0.054; Accession=PF09337.1; Description=His(2)-Cys(2) zinc finger
MAFRTHHGHYEFRVMPFGLCNAPSSFQTMMNETFRPFHQKFVIVFFDDILIYSKNFADHLHQLEHTFRALEKGVEPVPDKVRAIHQWPTPRSFRALRGFLGLVGFYHRFIKGIGIGAVLSQLGHPLAFFSKQFCPKLRLASAYVREFAVITTTIKKWQQYLLGHTYLARLMGYDYTIHYRTSKTNTVADVLSRILEEGHASLLVLSVPHFAFLDQLKRELTFHPEFIALKQALQDNPTIKPDYVVVQNFILYKNSIWLPSRLDFIHTLLLEFHTTPTGGHMGIKKILAHLVENFTLSSMRDDVRKIIASCRDCQHTKYEARKSASLLCPLPMPLRPWEDLLLDFIVGLPPYRGHTTILVVVDRFSKGVHLGALSSEWHVTAHEFDLPSLNGWPN

SEQ ID NO: 145796 - protein, 162 aa, Glycine max
  Coding DNA Sequence Number=SeqID_29018
  Gene Ontology: Mol. function=asparagine synthase (glutamine -hydrolyzing) activity; Cellular component=cytosol; Biological process=asparagine biosynthetic process
  Homolog annotation: Hit_ID=Q2QN88; Match level="QueryCoverage=99%, HitCoverage=17%, E-value=1e-31, Identity=81%"; Hit description =Asparagine synthase family protein, expressed
MRLDMQRIWRRNLGRDDRCIADNGKEARFPFLDEDVIRLLLNIPLWEVANLDQPSGIGDKRILREVAELLGLYEAAVLPKRAIQNTVVPFVQQFKFYTLLVHLCTGTILPFPFMLDVNRVLLLLGCIEELKFWFKNCKGIKSEEFWKQSSSKSGIGWQRNDS

SEQ ID NO: 145797 - protein, 167 aa, Glycine max
  Coding DNA Sequence Number=SeqID_29019
  Gene Ontology: Mol. function=asparagine synthase (glutamine -hydrolyzing) activity; Biological process=asparagine biosynthetic process
  Homolog annotation: Hit_ID=Q2QN88; Match level="QueryCoverage=58%, HitCoverage=14%, E-value=3e-32, Identity=69%"; Hit description =Asparagine synthase family protein, expressed
MADWLLVTGREAGKLSDRRLGNKCVGVPVEEPVLDMFTTKTNTGELHRWRLVEIDADLSDLVFETSHVMSLINPANTYMDLNIGIALWLAAGGDGWVSDANTYDNDGNHVRIKYKSNAKILLVGSGADEQCAGYGRHRTSYRRGRDYFDNVLHDWGTKLMKLYEGLN

SEQ ID NO: 145798 - protein, 84 aa, Glycine max
  Coding DNA Sequence Number=SeqID_29020
MAEQDTTNTGTNERPKNQFCWSGGWIRLKGYACDVCYFHSCTSITAPLYAICIYLICTEQKQARNTISFLTFAIGVPSPPILGS

SEQ ID NO: 145799 - protein, 111 aa, Glycine max
  Coding DNA Sequence Number=SeqID_29021
  Subcellular localization annotation: CTP_CleavageSite=24; ConfidenceScore=5.03e-01
MFAHSIKGCRPLGRTCGVLIPSPCVNTTPEPFHLKVCRSRLFRFFRRFPQINIGGDSARIPFVEHASRESRVALPPKGNWKGGLVPYLEEFESRSKGPTTLRAIGLRSTPN

SEQ ID NO: 145800 - protein, 134 aa, Glycine max
  Coding DNA Sequence Number=SeqID_29022
  Gene Ontology: Mol. function=DNA binding; Biological process=DNA integration
MATNKNLTCLGAFGYGPSMSIPYMAKGQGELFVIVRGCAWNICKFLALSAPLCDVEGSGLECQPIVADTHHFGCQGVSPDMECILDDGLEVSSPLHASQLGEQVCPYVAFTWYVIHLETIEIINKGVDYVIIFE

SEQ ID NO: 145801 - protein, 139 aa, Glycine max
  Coding DNA Sequence Number=SeqID_29023
MTTFGQGKLSRNFTVRETLNELGTILSTPHLKMKFPTFTGKIITVKVNQKQTHQCYVESLKVALYPPIRESDKPHPTSSGSSQVMNMDEESKLRTLVFYETTRIYQDGVFDVDPWDDIFHKGLKPIEELVKLELGHKPR

SEQ ID NO: 145802 - protein, 216 aa, Glycine max
  Coding DNA Sequence Number=SeqID_29024
  Gene Ontology: Mol. function=RNA-directed DNA polymerase activity; Cellular component=intracellular; Biological process=RNA-dependent DNA replication
MGEEQQKVVRKEVDKLLKAQFIRELLSFLDAYSGYNQIRMHPPDEEKIAFIIEDINFCYMVMPFGLKKHRGHVPKAHGPEIRKYNMRLNTKKYTFGVEGKKFLSFMITYHGIEANADKFLLRLAKKEKPLYKLLWKTEPFLWDKTCKQAFLAFKKIIETPPILSRQKPEVPLLLYLVVAEKAINDREGSVGDHNLSPTSQAIFSESASGSRDKPPY

SEQ ID NO: 145803 - protein, 224 aa, Glycine max
  Coding DNA Sequence Number=SeqID_29025
MTTMHNTTVTITHDNYVKVHEGANTMTIERRKGAVERRRSAQGFGTEEEILEYQELKKYLEMKSIFYPYLIKVFYTTTHVDGEKGNLCANVKGKSIEMTLELWMDIVGLSSVGMIANEKGLEDEEVTFNKFLDHFEVDVSNEIEDFVDPNFEAKTKVLKQMGYVEAKDGNGWIEKQKDSTTNNIEKQMKPFAEMLLAKMDELMRVQKEDYKEWKKNVSTPSLKD

SEQ ID NO: 145804 - protein, 137 aa, Glycine max
  Coding DNA Sequence Number=SeqID_29026
  Gene Ontology: Mol. function=asparagine synthase (glutamine -hydrolyzing) activity; Biological process=asparagine biosynthetic process
  Homolog annotation: Hit_ID=Q2QN88; Match level="QueryCoverage=76%, HitCoverage=14%, E-value=3e-23, Identity=56%"; Hit description =Asparagine synthase family protein, expressed
MPAHILLNALKESVLRRTSILRLQVYDCTLVCLAVISGIRQEKFFPVAILFSGGLDSMILAALLDKCMDPSYEIDLLNVSFDGQLAPDRKSAKAGLNELRRVAPSRKANPGAAVKLCLGDLLVMGSNPETASLHMQG

SEQ ID NO: 145805 - protein, 76 aa, Glycine max
  Coding DNA Sequence Number=SeqID_29027
MKTEKSKVDTVIAISPNTWHASKIIHISPQDSEYVIYGDNKQRPLDQQAQQVVVIIKKGENVNHEDFNDVKKIKPW

SEQ ID NO: 145806 - protein, 65 aa, Glycine max
  Coding DNA Sequence Number=SeqID_29028
MWQRCLKQGGAKDWLAEVDPKMHRQGKVEDVLTKDLLNHLIKWETLCLGQTSTFRSNDELVTHSL

SEQ ID NO: 145807 - protein, 294 aa, Glycine max
  Coding DNA Sequence Number=SeqID_29029
  Gene Ontology: Mol. function=hydrolase activity
  Homolog annotation: Hit_ID=Q3BSG6; Match level="QueryCoverage=73%, HitCoverage=69%, E-value=1e-56, Identity=54%"; Hit description =Metallo-beta-lactamase superfamily protein
MASTIASSDSQKWVFSAAAGGFGPHDDEGLQIDNIKQPGSKEKAQRQRLKQGKQRHANNRASRESCAQPAQKVNRADGTGSVPARRGCRTVAPLARAAVTVHAAAADCCARRRGHCTSGADRRAGPAYSGAGCGVAAMQQPAALVTNRHARMAQRMSRQRHQQNLIAEIVDRLHRIKAIPALAAAGVTAPAIVRCPLLRAKPLTRQPAAVARLGYGIQFTLQQMNAGGRKITDAAGVVKIEVGQNNVAHIFRAKTQQLNLCQRAELLVIANIIQRAEKARQAAVRMVHILRAQT

SEQ ID NO: 145808 - protein, 301 aa, Glycine max
  Coding DNA Sequence Number=SeqID_29030
  Gene Ontology: Mol. function=oxidoreductase activity; Cellular component=integral to membrane; Biological process=electron transport
  Homolog annotation: Hit_ID=Q82S57; Match level="QueryCoverage=98%, HitCoverage=75%, E-value=2e-79, Identity=49%"; Hit description=L -sorbosone dehydrogenase
MSALWIAVLLSACDSGSDLDPQRQIGPDPQLPQAKNFFMPPMQVPEGTAWKEGETPKVADGLKIEKIPASLMHPRQLYVLPNGDVLVAEANGVKNPVTAPKELIMSLVQKSSGKGGPGGNRITLLRNVNGKWEQHRFIENLNAPFGMQLIGNTLYVANADSLVKFPYQTGETEIRTPPEEVTSLPGGELNGALDQSAARQSGRQQTVRWCRLQHRIYASGIRNPTGLQWEPQSGKLWAIANERDEIGSDLVPDYLTSVQDKGFYGWPYSYFAAGSGRESHQAGLCAELTRGTARPAVLWRG

SEQ ID NO: 145809 - protein, 164 aa, Glycine max
  Coding DNA Sequence Number=SeqID_29031
MSFISDFWVWVEAIMRVVGMGSHSNRRLLIGGDRLLDPRHVDEGSSQPHEIVLPYVAPLGEEPIPIITILPSSPSAAKRRGDSGVVRVSPCNRHSHSARMSSPPPFIAGYELVRVDVLKHRSSITFVMSIVTLWRQLELAKLEDSRNMIVQACGEDEFSFMRAA

SEQ ID NO: 145810 - protein, 175 aa, Glycine max
  Coding DNA Sequence Number=SeqID_29032
  Gene Ontology: Mol. function=caffeoyl-CoA O-methyltransferase activity; Cellular component=integral to membrane; Biological process=lignin biosynthetic process
  Homolog annotation: Hit_ID=Q40313; Match level="QueryCoverage=84%, HitCoverage=60%, E-value=2e-57, Identity=72%"; Hit description =Caffeoyl-CoA O-methyltransferase
  Pfam annotation: Domain name=Methyltransf_3; Domain location=33-174; Score=154.4; E_value=2.9e-43; Accession=PF01596.8; Description=O -methyltransferase
MANEEEQKNHLFGIKDLGHKTLLQSDALYQYILETSVYPREHECLKEIRKMTAKHPLNIMATPADEGQLLSMLVKLTNSKNALEIGVFTGYSLLSTALALPPDGKILALDVNREYYELGLPIIQKAGVAHKIDFREGPALPFLDEMLKDVGAQFLTISSFIHDFLLTLGNIFRFG

SEQ ID NO: 145811 - protein, 434 aa, Glycine max
  Coding DNA Sequence Number=SeqID_29033
  Homolog annotation: Hit_ID=Q2NUY0; Match level="QueryCoverage=44%, HitCoverage=80%, E-value=3e-71, Identity=72%"; Hit description =Suppressor for copper-sensitivity C
  Pfam annotation: Domain name=DSBA; Domain location=182-317; Score =69.2; E_value=1.3e-17; Accession=PF01323.10; Description=DSBA-like thioredoxin domain
SLVWQPLTEAAINQALEQDKRVFVDVTADWCITCKVNKSRVLNQPDVRAALGAEDVVLLRGDWTQPDPAIGEFLRRRDRVAIPFNQIYGPALPHGQILSPLLSPPALAAAPFTPEQEARIKQLIRETLVQNPAILAEAADAFDKEAARQQQNVVAQMVEKNRAALFDDAGSPRIGAKKPALTLVYFTDYNCVFCKKFEADIEKLLHNYPQVAVVLKPLPYRAESSLSSARLALTVWEQQPNNFLKLHERLMAKKGNHDEASIAAALDKSGISLSAPSTASLDTINLNLTLAQQLGVQGTPATLVRCRLSHEPGNALAARRRAIVADGSGAAAGHGLAACTAAARGCGPAAAQRAAGRGEPGDAEPAAAGAGLRLGQLVWRVQTHHTDGGRAQSARHAGALANQRHADVHRAASGQGGQHQQRLDQQLGAEAAPV

SEQ ID NO: 145812 - protein, 295 aa, Glycine max
  Coding DNA Sequence Number=SeqID_29034
  Gene Ontology: Mol. function=molecular_function; Cellular component =endoplasmic reticulum membrane; Biological process=biological_process
  Homolog annotation: Hit_ID=Q1SBN2; Match level="QueryCoverage=99%, HitCoverage=81%, E-value=1e-138, Identity=84%"; Hit description=SPFH domain / Band 7 family, putative
  Pfam annotation: Domain name=Band_7; Domain location=53-242; Score =112.7; E_value=1.1e-30; Accession=PF01145.15; Description=SPFH domain  Band 7 family
  Subcellular localization annotation: CTP_CleavageSite=42; ConfidenceScore=5.31e-01
MDSQQRTAASPRSPPRQGHDSTAILFTLLSFFAIVALVLLPSASPFFQNSLSILHQVPEGHVGVYWRGGALLKTITEPGFHLKMPFLTQYEPVQVTLQTDMVTDIPCGTKGGVMISFGKIEVVNRLRKEFVFETLLNYGVHYDKTWIYDKIHHEINQFCSSHSLQQVYIDVFDQIDEKMKDALQVDCTRYAPGIEILSVRVTKPTIPESIRRNFEQMEEERTKVLIAIEKQKVAEKEAETMKKMAISEAEKNANVSKILMEQKLLEKDSARRQEEIENAMYLAREKSLADADFYR

SEQ ID NO: 145813 - protein, 552 aa, Glycine max
  Coding DNA Sequence Number=SeqID_29035
  Gene Ontology: Mol. function=nucleic acid binding; Cellular component= intracellular; Biological process=transport
  Homolog annotation: Hit_ID=Q2PEP2; Match level="QueryCoverage=87%, HitCoverage=100%, E-value=1e-135, Identity=56%"; Hit description =Putative ras-GTPase-activating protein SH3-domain binding protein
  Pfam annotation: Domain name=GRP; Domain location=427-503; Score= -25.2; E_value=0.029; Accession=PF07172.2; Description=Glycine rich protein family
  Pfam annotation: Domain name=NTF2; Domain location=83-199; Score =161.4; E_value=2.4e-45; Accession=PF02136.11; Description=Nuclear transport factor 2 (NTF2) domain
  Pfam annotation: Domain name=RRM_1; Domain location=369-457; Score =35.2; E_value=2.2e-07; Accession=PF00076.12; Description=RNA recognition motif. (a.k.a. RRM, R
  Pfam module annotation: Pfam domain module=GRP::NTF2::RRM_1; Domain location=427-503::83-199::369-457
  Subcellular localization annotation: CTP_CleavageSite=56; ConfidenceScore=5.47e-01
MKKSIFSHRHSTEISLNSIASTLSRKPFFFSSLPLSLSSLLGGKIGCWNAFVDKCVVTEGVGFLVMEGYEMAASEESSTTQMIGNAFVQQYYSILHQEPDQVHRFYQESSILSRPEEDGTMTMVTTTLEINKKILSLDYTSFRVEILSADAQPSFKDGVIVVVTGCLTGSDNLKRKFTQSFFLAPQDKGYFVLNDVFRYVDEYKSVDIESVPANDAATADESAPTDAFVPEPEVIHVAEDVPPSQTAVVDADISVSKEVSQPLENGNVSVTEKVVPVNHVKESSHQEHSHYHAEKAASNNALEDTPKKSFASIVNALKENAAPFHVRVSPVKLVEQPRVSSIPAPEAPAPSIESPPEKNNENGGKAYAIFVANLPMNATVEQLERAFKKFGPIKQDGIQVRSNKCTSTTSSIDTMFCSYFQQQQSCFGFVEFESATSMQSALEASPPVTLDGRRLSIEERRANNDRGRYSSGRGGYRNDRNDNFRGRGNFSGGRGGGGYGNRNDSFEKRSEFSGRPRGGNNNGGGRSNGEAVPRSYQNGGGAKVTRQSVKVQ

SEQ ID NO: 145814 - protein, 317 aa, Glycine max
  Coding DNA Sequence Number=SeqID_29036
MAKNERRVKRMAVESWPCRGGDRGEAAVRCCESMASQSGVIGKRRFMKEVVSNPSSIISLPIISTTPTTAPPQPHTTTKANGDAEGYAFCPCNGCNNRTRGFNLILIMELLVVVAIDAGGEGWPSWLSKVAGEAISMGGWNPEMGNYCRKLVEFCSGKAVSELCHNIEGNINVGSFSRLIYDMMLAWERPSYYDEEDTTENVAKEKEERKITLNTTQEQDDIPLFYSHVNVSMSMVRVGCEANTGDGIGIMVALSHQFYEEIWRMSIQDGLQALTTPWYQFRRDNNLMARDEVVFYYGPNQGVWEIILRKDIGWDED

SEQ ID NO: 145815 - protein, 912 aa, Glycine max
  Coding DNA Sequence Number=SeqID_29037
  Gene Ontology: Mol. function=cysteine-type peptidase activity; Biological process=pyrroloquinoline quinone biosynthetic process
  Homolog annotation: Hit_ID=Q7X5R9; Match level="QueryCoverage=73%, HitCoverage=97%, E-value=1e-163, Identity=48%"; Hit description=PqqF
  Pfam annotation: Domain name=Peptidase_M16; Domain location=153-291; Score=114.6; E_value=2.8e-31; Accession=PF00675.10; Description =Insulinase (Peptidase family M16)
  Pfam annotation: Domain name=Peptidase_M16_C; Domain location=308 -479; Score=22.5; E_value=0.00036; Accession=PF05193.11; Description =Peptidase M16 inactive domain
  Pfam module annotation: Pfam domain module=Peptidase_M16::Peptidase _M16_C; Domain location=153-291::308-479
MGSSGNLTNLLFVTPDYYEERPKPCMGGWGSIFLSVTPEGTALPCHSARQLPVQFPSVLEQSLEDIWYNSFGFNRYRGFDWMPEPCRSCDEKEKDFGGCRCQAYMLTGDADNTDPVCSKSPHHGKILEARREASCSDIKIAQLQFRNRSNSELIFKQRPDARESAALVRVGAGSLHEPDRWPGLAHLLEHLLFCGSAGFTGDERLMPWLQQQGGQVNATTQLSRSAWFFQLPAQALAAGMARLADMLAAPLLTGTAITQEAAVIEAEYQLLRHHAETLSEAALLDAAGGALRRFRVGSAACFGDNVTELQQALRLFHQQHFVAANQQLWLSGPQSLDELQQLAEAFAVRQSGGAVHSSLPAIPAPEPVETLIQLPDEESFWLSLFITGEENALRDNVTLLGAFWQDEAPGSLMAQLRSEQLCASLQCEWLWQSADYSWLALRFSAPALSASAARRIEQLFWQHLRAVHAATPAQHRHYLQLAQQDFAALSPLTQLRGRALGSAPSADVPADFTGFITALPQASCPRLLTQRQLSAAPYTTQGFCMQRAPWPPTAAGPVAPVNWSFYPCADVLHLPELPVNGPPLLRVSPVQPRGTLLVRPAFYYTLSDEAALSWQQQLRPRLAALRHAGGSGRWQQQQGVWQLVIDLSDDAMPALQQLPGVLAALNAPVLPQPHRAAQSIVIRQLLEALPQQLLAPAVHPAWQAAWCGRSESVSQHAAHWLSEVVRTQPAPTRSAALQHGVSALRCAANDQALLLFIPLPAADDASLAALRALALMFEPRFFQRLRVEQQIGYVVSARYQRVADVDGLQLALQSPSIGWRTLLQHCKAFLRDMVSELAAINDETLRGWQATLLAQCQPHQNADAASEALRKQQGLPVLTPEAVAALTLPQLQRLHQRLLRERRRWRLLINHS

SEQ ID NO: 145816 - protein, 299 aa, Glycine max
  Coding DNA Sequence Number=SeqID_29038
  Gene Ontology: Mol. function=sequence-specific DNA binding
  Homolog annotation: Hit_ID=Q5DY05; Match level="QueryCoverage=32%, HitCoverage=100%, E-value=7e-35, Identity=75%"; Hit description =Transcriptional Regulator
  Pfam annotation: Domain name=HTH_3; Domain location=232-286; Score =51.9; E_value=2.2e-12; Accession=PF01381.12; Description=Helix-turn -helix
AVAGDRPAARRAGALQHGYFARCAASRYRRLARVYAVDRVVLFPEDAEREMAPSQRHKQRFTPPDGFITAGTVINGGAVSSNANDRLSREIEAALDETKCQHQTNQCQNPFCALGRYRHATASEKSAASLREDMLAVMQILAEIGPKPGRPYVDTLKGCQFPNLKELRVQHAGMPVRAFFAFDPVRRAIVLCAGNKAGWIMGTYKQLLAKQSPESQQRIAEKVEKLRQEIALSQLREELNLSQTELARTIGVSQPTLAKMENPENDPRLSTLKRYVAALGGELRIDVKLPNGKHFAFQL

SEQ ID NO: 145817 - protein, 141 aa, Glycine max
  Coding DNA Sequence Number=SeqID_29039
MKFDRLEKSMRKEKVAQGSTRTSGFSYRGLSSQSRNCHFYAIRDIDVNCVNIQPPRSLPPITITERDFKGINPINLNDPMVVSIAIANSMVSKVLIDQDTSYLTLIGRKTLNKLGAIVVSTPHLKMKFPTLTGEIITVKVD

SEQ ID NO: 145818 - protein, 151 aa, Glycine max
  Coding DNA Sequence Number=SeqID_29040
  Gene Ontology: Mol. function=RNA-directed DNA polymerase activity; Cellular component=mitochondrion; Biological process=RNA-dependent DNA replication
  Subcellular localization annotation: CTP_CleavageSite=69; ConfidenceScore=5.20e-01
MQKLHEGIFNLHTGGRSLATKVVRASYYWLTLKTNTLNFMRRCRRCQEFTNVLRTPPVNLHNLSSSWPVAMWGMDILRPLPKAPRQVKFLLVVIDYFTKWIEARPLREISASEVEKFTWKHLLCRYSLPYAIVLTMTPNSRLKPMKNSCQG

SEQ ID NO: 145819 - protein, 119 aa, Glycine max
  Coding DNA Sequence Number=SeqID_29041
MVDKAILKRLLALLDARAILSLPSTNDPLIVLDVKQVGPIEGDMPPPPTIIQEPFIGEGDPTKARANLSRDVDAIEDDVVEFTLVVPPSAATTGKLNEEFGGTGQCKKLRAPFSLRALK

SEQ ID NO: 145820 - protein, 307 aa, Glycine max
  Coding DNA Sequence Number=SeqID_29042
  Subcellular localization annotation: CTP_CleavageSite=32; ConfidenceScore=5.77e-01
MNVSDPPTPLSPPIYATSIPSSFAPASPTPASAALAPTSSTTPLLLSVGVTTTGVLTSMPPPSSTLSPSAPIILPLAMPSSSSRPSISLDQVKNLADTTKVFLQRSLAILKKNVNRHKETRGGITSLEVEVAKWRATTRTVWRVEFPKVENATVALAEVVRSNHRLLSKVNNIFTKLVSTRLEGDKVSRRYKDLLKEKNDLECEAWLRDSELIVSNFQTKLKESKLKVENEKEVNKELEDELLMFKKKSMEQYEMGFFKVIRMSLRGREAHQGKTLGLMSLWRFNQGHVPPRLGETHQGQTLGLMSL

SEQ ID NO: 145821 - protein, 203 aa, Glycine max
  Coding DNA Sequence Number=SeqID_29043
  Gene Ontology: Mol. function=RNA-directed DNA polymerase activity; Cellular component=intracellular; Biological process=RNA-dependent DNA replication
MAQFIIEVRYLTWLANIVIVKKANGKRCMCTDYTNLNKGTTKLEYTLQTKKKSITEDINSYCRVMPFGHKNAKATYQRLMDWEVFGETSKYDMHLNLEKCTFGISDKIFLGFMITYWGIEANLDKCTAILEIHSLTNIREVQKLNGRLASLSKFLPKLAKKAKPFYMLLRKIEPFLWDDAYKQAFLAFKKTITTPLVLSQPKP

SEQ ID NO: 145822 - protein, 46 aa, Glycine max
  Coding DNA Sequence Number=SeqID_29044
MESKHITKGVYAPLALLIPVVDVGLIANVGVVPPVDGVVPGGEPVD

SEQ ID NO: 145823 - protein, 73 aa, Glycine max
  Coding DNA Sequence Number=SeqID_29045
RIRDSSLLHGSWLKNFSASSSACYSAGAAHAVSFDGSPPDEQLANSSFSPDPFFNLVLATLDSNLPHWVAYVD

SEQ ID NO: 145824 - protein, 94 aa, Glycine max
  Coding DNA Sequence Number=SeqID_29046
  Homolog annotation: Hit_ID=A0ELU7; Match level="QueryCoverage=51%, HitCoverage=6%, E-value=7e-12, Identity=71%"; Hit description=Cullin 1-like protein C
MTALSRGNPWSRNLEQLCSAQCCQWSHGSLLKNVLDIFVEIGMGEMDQYEQDFEVHMLEDTVDYYKSKAANLIEIDSSQIICLRQVCLYCALRV

SEQ ID NO: 145825 - protein, 95 aa, Glycine max
  Coding DNA Sequence Number=SeqID_29047
MGTTCPKNHLKMYCRKMRVDAKDEKLLIHFFQESLAREAITWQYQYNSDMAPDRRQLQNMCKKEHKSFKEYAQRWRDLEAQDDNNDSKHFTSVLL

SEQ ID NO: 145826 - protein, 52 aa, Glycine max
  Coding DNA Sequence Number=SeqID_29048
MSLPSAVHVAPLSRAKLLKKEEEVEMRVVIAKRAGRTKSVSYLCFPLISDER

SEQ ID NO: 145827 - protein, 194 aa, Glycine max
  Coding DNA Sequence Number=SeqID_29049
MASRKRKSTASRPQAQNVKIYHTEFDEFKAKLERRNLHKRLANLQEGSIDVVVVKEFYGNLYNPEDHNPKQVKVRGNLIRIDADSLNTFLEIPVVLEEGETLPTYSRFTRMRIDPQEFAARLCIPGRGFVLNAEGHPRKLLRKDLTTLAQTWSVLSYSNLTPTSHTSDLNMDRARLVYGLVIGTNMNIGALISG

SEQ ID NO: 145828 - protein, 223 aa, Glycine max
  Coding DNA Sequence Number=SeqID_29050
  Subcellular localization annotation: CTP_CleavageSite=41; ConfidenceScore=5.04e-01
MEDLRESTVGTMIDSRKHDLSLSASQTSSATQLLSGQRTLRARKFQEMNALSRHAALSEFMSHMHMIPSSWLQRQIGFVTKIMFIFGTFYRRGTGFLRLACMTDFIMSSRGTNKFDAQTLSDFLGTRAIVPKGEQLNARAIAANVLSYFNLAPTSHTSDLNMDWTRLIYGLVMQMDIDLGIDSDTLTYESFNPVPSATQLLSGQHTLSARKYGEAKIVKGHLV

SEQ ID NO: 145829 - protein, 224 aa, Glycine max
  Coding DNA Sequence Number=SeqID_29051
MGDDMVLILGCSEDWVTDNTKQEGFFYSIRKWNPSAVYWSSVGCVGRGMLWSDRRKFWKIGENGRDVCHVGKCELCQITGVGGITNAYSENENVSLNGFSDEVGGEDGEGKGTRRESQHRGSGEEHRSTKLEFSKFNNVDIIHETNTLPNGFNMEDTPGKDGEEVACSPVEDDSLVTRLSRADVDMSKKVPQGERDAHNDINCVAKCIDPTNGWASVKLYRQRT

SEQ ID NO: 145830 - protein, 244 aa, Glycine max
  Coding DNA Sequence Number=SeqID_29052
  Gene Ontology: Mol. function=O-methyltransferase activity; Cellular component=integral to membrane; Biological process=lignin biosynthetic process
  Homolog annotation: Hit_ID=Q0P0L9; Match level="QueryCoverage=82%, HitCoverage=99%, E-value=7e-69, Identity=63%"; Hit description =Caffeoyl-CoA O-methyltransferase
  Pfam annotation: Domain name=Methyltransf_3; Domain location=48-243; Score=288.4; E_value=1.4e-83; Accession=PF01596.8; Description=O -methyltransferase
MTLPTMMVNNRQVIVGSNERDHVTKLFAIFITGQDKGAGMTCTGLMKQEEEKLREKKIGVDGMHKSGNLMATPLDEGQLFSMLLKLMNANNTMEIGVYTGYSLRSTALALPPDGKLGLPIIQKAGVIHKINFREGPALPLLIELLKDEDNKGAFNFIFVDADKDNYLNYHKRVIDLVKIRGLIGYDKTLWNGSVVASADAPMKDYIKNYRGHVIELNKYPAQDSRIDICQLPVGDGITLCRRII

SEQ ID NO: 145831 - protein, 90 aa, Glycine max
  Coding DNA Sequence Number=SeqID_29053
PRVVPQAPQTDIPHVPEPGASSTSVDEPRHAVEVCDDIVERLEHHLSLGVVTPGSSTHKVIEECLRMARSGTQDHLVYVRSRRRRRTDQA

SEQ ID NO: 145832 - protein, 305 aa, Glycine max
  Coding DNA Sequence Number=SeqID_29054
MAFSQQVLGAPAKLLVHLAILLYLPQECTVISWISVRNKRIRSQDIGVSIGPIRRPSLLKEPSKSGNKGIGKMVDAKLKRKMLRAVSFKNELLDECIRNYNKLLWIKNDNVEPHRIWNMGKDIVVSYEAKESMVINRIKEIVMRGEMGKTERKPRWKKEFRWLLSTYMHPQIGSGGESCDFNCVHKASERVGIKGQDTGGGEKEEFNVCIEGLGLIDLPMVGKSYTWYRPNGSARNKIDKVLVSMEWFAVWPRSTQFVLERNVSDHCLIVVKTKLIDWGPRPFKVLDCWFEDKSFEKTVKEIWQA

SEQ ID NO: 145833 - protein, 303 aa, Glycine max
  Coding DNA Sequence Number=SeqID_29055
  Gene Ontology: Mol. function=RNA-directed DNA polymerase activity; Cellular component=nucleus; Biological process=RNA-dependent DNA replication
MEVQEEWWKVNRCNDSLIRQKARVRWLSEDDKKSKYFHSCLKWCRRSGSLKKLWIDGTPKLEGVRFNQISELENRGLIASFLESEVNEAVWECREHKLSNLDWYNFHFIKTFWSLLKNDVMKFIGDFHTDEVFPKGANSSFISLIPKVHDPQGLEQYRPISLIGCMYNIVAKVLSKRLKKVLGLVIYERKYAFLKRNNFFRKSHDSVDWNFLQYMMFRLGFCETWIKWIDGCLISSRVSVLINSSPTKEFSVSKGLHQGDPFAPFLFNIVAKGLTGLMRETLRKNMFANLLVGEREVSVNLLK

SEQ ID NO: 145834 - protein, 58 aa, Glycine max
  Coding DNA Sequence Number=SeqID_29056
MSAFIHSFTSSTSPITLALARIRCHTLISSGDHCFMACNLCLTASRYLAPFVAQYVKF

SEQ ID NO: 145835 - protein, 147 aa, Glycine max
  Coding DNA Sequence Number=SeqID_29057
MQCGTYRIQYQGNSPKRVYMTPHLGNHAVFVEATQSCTVTPPLGDQPGATRSSLPGDTPPSTKYILPQFILFPVSYEFPTQGTSNKVNVPPHEHTLHTTYERGQKQVPKTMDQLKRLSIPSEMLRFFNHACPPQMDHSTRSVHSAPH

SEQ ID NO: 145836 - protein, 329 aa, Glycine max
  Coding DNA Sequence Number=SeqID_29058
  Gene Ontology: Mol. function=DNA binding
  Homolog annotation: Hit_ID=Q1S0F5; Match level="QueryCoverage=93%, HitCoverage=59%, E-value=6e-27, Identity=31%"; Hit description=IMP dehydrogenase/GMP reductase
MVEEFKEILGCPLGGRRPYLFSGFYPSLARISKIVQISAQELGHRKQVKNGVVGIPRKYLEAKARILAGKGEWAPFIDILALLIFGGVLFPNVDGLVDLAAIDAFLAYHDHKESLVVAMLADLYDTFDRRCEKSSTRIVCYTPALYVWLVLNLFRREVRHACPLESHYSYTEKGGASWDQLLANKEEASVNWFPRWKEGRTGVLISCGGFPSVPLMGMRGCISYNPVLAIRQIGYPIRGAPLEEELALVISQGFNKINMETLQKVCKAWEVLQKKDKELRGSNNGPIGGYRKWLKAHVQGLDWLPSLRTAKREEVEAPEEDEEVQALRT

SEQ ID NO: 145837 - protein, 170 aa, Glycine max
  Coding DNA Sequence Number=SeqID_29059
MASRDQVWSFCTHDTRRYLTVIRPPLPFRHSRVRWQAETKFGHSAHMIRGDTLRLSAPPLPFRHSRVRWQAETKFGHSAHMIRGDTLRLSAPPLPFRHSRVRWQAETKFGHSAHMIRGDTLRLSAPPLPFRHSRVRWQAETKFGHSAPMIRGDTLWLFAPFLLLSVRQNA

SEQ ID NO: 145838 - protein, 68 aa, Glycine max
  Coding DNA Sequence Number=SeqID_29060
  Subcellular localization annotation: CTP_CleavageSite=21; ConfidenceScore=5.37e-01
MPSPPHPRSTATSSPPQPALCCNAIVVSSSQYLATKKFIGVLVVCIVLVLVVFDSVGLIIICLHGSGS

SEQ ID NO: 145839 - protein, 109 aa, Glycine max
  Coding DNA Sequence Number=SeqID_29061
MDEHQQNWKEIANTMMKINKKAEEMFNTVHVMDQDELEPIWHLLHSSGNMHFVTNNQDLVSLTLLVGWTELREFYGLTRNHQVTLTHYGQSVFLLTIFKRISEPKAYPK

SEQ ID NO: 145840 - protein, 242 aa, Glycine max
  Coding DNA Sequence Number=SeqID_29062
  Homolog annotation: Hit_ID=Q51613; Match level="QueryCoverage=20%, HitCoverage=61%, E-value=3e-16, Identity=60%"; Hit description=, complete genome
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMMIAPEKESIDSLPIGWTVGAMIYFTGEVSAQLVELRSCNWVVAITGWMSNCPGGNDSILRAVKNVEEGFLIWDPGEEDQAGHCEQLDALSPFNPLSEMWQKEKESMDRPHRLHPVGTTRSPQGRIRHP

SEQ ID NO: 145841 - protein, 160 aa, Glycine max
  Coding DNA Sequence Number=SeqID_29063
MKLPQEPLNEKPRRLARKSMAETNSVELYGAATELAACSRSKRNLSHRLCETETNMLAIVSRYQEELNLAAAHKHKVADEYAQVYAKKEARGRVIDALHQEATIWMDRFAHTLNGSQELPRLLAKAKAMADTYSTPEEIHGLLSYCQHMIDLMAHIIRNR

SEQ ID NO: 145842 - protein, 170 aa, Glycine max
  Coding DNA Sequence Number=SeqID_29064
MSISPDHTHKTPSGPGEVQQGPGVFSSGYRPLLVLPGIAPARHPVDPEESNRVLGFPALITRLCQFYGVPVAPKKFIRPPINRVFIKKYCAPQVGVGRDTTTAWGWPAAGNRRTAATSRAAQLIYQGWSIAYDLWLTSRQPSPKPKVRKSTRSVTDESSRVQLKTLKKRY

SEQ ID NO: 145843 - protein, 94 aa, Glycine max
  Coding DNA Sequence Number=SeqID_29065
MSRNLTDYAAVPTLASGMLRNFTDCALTLPFDSRHVAELHGLPNDGCQKGVTSGIGVLETFCQKAVVMWEEEKKEWKGPWEEEEEEKEEDTRDR

SEQ ID NO: 145844 - protein, 87 aa, Glycine max
  Coding DNA Sequence Number=SeqID_29066
MGEKEGIAASLDKMANSFNRMVDKMDGKVDDEDIQEVLREAALIPDLNRQQWAKAIKWFADDPKQLAIVKALPIHQKTDYVLTHLGE

SEQ ID NO: 145845 - protein, 108 aa, Glycine max
  Coding DNA Sequence Number=SeqID_29067
  Gene Ontology: Mol. function=nucleoside-triphosphatase activity; Cellular component=chloroplast
  Homolog annotation: Hit_ID=Q2PMM5; Match level="QueryCoverage=99%, HitCoverage=8%, E-value=2e-39, Identity=78%"; Hit description =Protein ycf2
MKKLTILLYLLSCSAGSVAQDLWSLPGPDEKNGITSYGLVENNSDLVHGLLEVEGALVGSSRTEKDCSQFDKDRVTLLLRSFRDKRIIYDEEDELQENDSELLQGGTM

SEQ ID NO: 145846 - protein, 78 aa, Glycine max
  Coding DNA Sequence Number=SeqID_29068
MLHQLVGQSKLSCALGATLVLSAHVQLDQVATRYAARYALSALAHDSCLPTCLLALCSFLGWSGCDSLSEEVTLSMTL

SEQ ID NO: 145847 - protein, 60 aa, Glycine max
  Coding DNA Sequence Number=SeqID_29069
  Subcellular localization annotation: CTP_CleavageSite=47; ConfidenceScore=5.08e-01
MGVQIATRPTWAFQILPPEGGCFWRKQPGLPGRARRFRNVSVGDFVKIFYRSSTFFGLQP

SEQ ID NO: 145848 - protein, 82 aa, Glycine max
  Coding DNA Sequence Number=SeqID_29070
MGAKSLEVVKRGSHPNNGWFPDEIRDGIISSEVHGISMIIDQSLFFSLTKLPSQGAPFEGTIVDDWKFDYSSHDARSMVCHD

SEQ ID NO: 145849 - protein, 161 aa, Glycine max
  Coding DNA Sequence Number=SeqID_29071
  Gene Ontology: Mol. function=nucleoside-triphosphatase activity; Cellular component=chloroplast
  Homolog annotation: Hit_ID=Q2PMM5; Match level="QueryCoverage=98%, HitCoverage=8%, E-value=3e-82, Identity=79%"; Hit description =Protein ycf2
MSHTNGFGSTTMGSNVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRVTLLLRSEPRNPLI

SEQ ID NO: 145850 - protein, 94 aa, Glycine max
  Coding DNA Sequence Number=SeqID_29072
MIDEMDKGDILVPHPLTNACLLIQLSPECGCKPLVCLLKRPALLSVDFQDCSIRDYSSCTLVGESSTTRDPRSLNPFSEIRRREEEVSRKRGRL

SEQ ID NO: 145851 - protein, 144 aa, Glycine max
  Coding DNA Sequence Number=SeqID_29073
MAPKKLIAKRAMKDVAGEGSSVAPQVDMEFDGHRRVQLREREYAEFQEEIARRQWTQHVRPMAKNDPEIVMEFYANAWPTEEGVRDKCSWVRGQWILFDVDAINQFLGHPLVLEDGQRCEFSQRRSQASRFDEEAIGQLLCIPG

SEQ ID NO: 145852 - protein, 160 aa, Glycine max
  Coding DNA Sequence Number=SeqID_29074
METFQVSQVIKNYVGHVTCTLVSSRGGGPDDTRRYLTVICTLLSSRGGGPDDKQRPKTKFGHSAPLYHPEAAGPMIRGDTLRLSAPFCHPEAAGPMTSRDQVWSFCTLVSSRGGGPDDTRRYLTVIRTFCHPEAAGPMIRGNTRVVIRINILLLSVRQNA

SEQ ID NO: 145853 - protein, 57 aa, Glycine max
  Coding DNA Sequence Number=SeqID_29075
  Homolog annotation: Hit_ID=Q7X9V3; Match level="QueryCoverage=54%, HitCoverage=12%, E-value=9e-07, Identity=83%"; Hit description =Nuclear shuttle interacting protein
GQGLGKALIEKLIRTLLQRDIGNITLFAYSQGTTVLTTFMHSIIDANYEITHNMSNL

SEQ ID NO: 145854 - protein, 125 aa, Glycine max
  Coding DNA Sequence Number=SeqID_29076
  Gene Ontology: Mol. function=DNA binding; Biological process=DNA integration
MSPYRIVFGKACHLPEEIEQKAYWAVKTCNFSMDQAEAYENAKFYKEKTKKFHDSMIIKKDFMVGQKVLLYNSKLGLMSVEIKSDSTNKSFKVNGHRLKPFLTNPSLVDVVVEKSSLLHPTLPPP

SEQ ID NO: 145855 - protein, 225 aa, Glycine max
  Coding DNA Sequence Number=SeqID_29077
  Gene Ontology: Mol. function=arylamine N-acetyltransferase activity; Biological process=metabolic process
  Homolog annotation: Hit_ID=Q4KF26; Match level="QueryCoverage=61%, HitCoverage=51%, E-value=6e-24, Identity=48%"; Hit description=N -hydroxyarylamine O-acetyltransferase, putative
  Subcellular localization annotation: CTP_CleavageSite=53; ConfidenceScore=5.06e-01
MQRALVRRLPGAVLGVVAAADGAAPAPADRSGTSPASRRWIRMTARSRPRQADAAADSAHAAWPAAAHRAAAAARSGSGCRNRHHQPVVPIHMHAQQQMGTRGQFAVMRCQQHARTQRLRIKAQCLQQGQQAAIEFEAVPTAAVVKQLALHAVQVDRHRVAQQAAEGSGRPGSAVAAHPAAGVAGQARRPCHAPVACTLYKGRVHPRRGDPDEEGAKVALNPADT

SEQ ID NO: 145856 - protein, 213 aa, Glycine max
  Coding DNA Sequence Number=SeqID_29078
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=28%, E-value=1e-106, Identity=84%"; Hit description =Photosystem I P700 chlorophyll a apoprotein A1
  Pfam annotation: Domain name=PsaA_PsaB; Domain location=1-213; Score=- 209.9; E_value=0.0033; Accession=PF00223.9; Description=Photosystem I psaApsaB protein
LMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDY

SEQ ID NO: 145857 - protein, 168 aa, Glycine max
  Coding DNA Sequence Number=SeqID_29079
SLDGLDNIYYAALINKLSWDQGVYHVFKRMDKDSKHTLIVKGLVVGKQQNFSKTNLKDMKVALERSLNEALEVDLEAINKRKQKTLAKSNTDEELEEEEMLAEQHKTKRRHRAGVSDPQKRKVVDPDTPPKKAKKAQQVIEPRASVLPSALLGCIKTSMTKANPNFGD

SEQ ID NO: 145858 - protein, 77 aa, Glycine max
  Coding DNA Sequence Number=SeqID_29080
MAADKCYPSLPVWDAAKKKGFELYYKEQMPSLWMKLIRTPDAHDARTFWSQIMLMDSQKASTSSYDGSDNVVHYNVV

SEQ ID NO: 145859 - protein, 100 aa, Glycine max
  Coding DNA Sequence Number=SeqID_29081
MSEAQIIAHATQLHEAQQKKRAEDVVVVAITEKELVAILGREAISTIQVCEKMKNKKVVVAGVSLSEACALSENYPLSEALSPLRELGKSRGESAQHLRA

SEQ ID NO: 145860 - protein, 56 aa, Glycine max
  Coding DNA Sequence Number=SeqID_29082
GGGKDHAYHHVIVGVQVDLHGGELSVTFLGMYLSMGGWMVGMESEVEMVVVGVRDV

SEQ ID NO: 145861 - protein, 75 aa, Glycine max
  Coding DNA Sequence Number=SeqID_29083
MDNHEHANHRDTAQARIKNKGIRQHKVNDQAQNIDFNIRDSSEDESSESTQVSSPENQNYMSSANEPAINREGND

SEQ ID NO: 145862 - protein, 206 aa, Glycine max
  Coding DNA Sequence Number=SeqID_29084
  Gene Ontology: Cellular component=mitochondrion
MSIGFRFMPGQGEFLIKDLRAPDTLVGLRKLKDSLGLSLTKGSLNSNPLLKLKGISDSVSNSMESLASRVLVEVITFNEGYYGRFLILVQMGIGCTVWYGFVPGDGINMPIEGLNTLFSPIENYDTIFTNPDAHVIPGFNKMTLIEGVNNPAASLSQAFAQDRPFMDMDIEIPDSNKSIIIGVSLGLAVAILFTFGINPCCGEVIV

SEQ ID NO: 145863 - protein, 78 aa, Glycine max
  Coding DNA Sequence Number=SeqID_29085
  Gene Ontology: Cellular component=mitochondrion
MDRFPAFLQSLEDMNNVDMMYKVDMSASTSVITKALVLKAVKPFVGDNDYVFRLLPIYTKDGDKVLVGSDDIPPPLGE

SEQ ID NO: 145864 - protein, 139 aa, Glycine max
  Coding DNA Sequence Number=SeqID_29086
MEETDQICSLVLRNLYDRTTNIGDCAWIYGISWGLKKEYYPFIMSIQRWTNQPSLEELQNFLTNQEAFLQQSSSSPAQEAPDTPDTTEARRKWKVKCGKMLVVLRMTVNKELIDHIRDLDTPKDVWETLEKLFSKKNVA

SEQ ID NO: 145865 - protein, 91 aa, Glycine max
  Coding DNA Sequence Number=SeqID_29087
MSVKNLVGRLGVHDKTNHTLGDQSGSHYFARMLHPYGIGTGLKEHSNRVYLPPRPTLRRVRQGLSLLIQVQLGKHFSTQTLSMDYKKYTTP

SEQ ID NO: 145866 - protein, 232 aa, Glycine max
  Coding DNA Sequence Number=SeqID_29088
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=1e-28, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MLSKRRQCLHLHFRGLHALSFRALHVLTFRGLHALTFRGLHVLTFRGLRALTFRGLHVLTIRELHVLTFRGQHALTIRGLHVLALRGLHALTFRGLHVHSFRGLHALNFRGLHVLAFNGLHALTYRGIHILTFRGLHAVTIRELHVHAFRGLHAFTFRGLHVHTFRGLHALTFRGLQALSLRGLQVLAFRGLHTLTFRGLQRTTCPRLQRVATPPLKRIARPHLQGATRTHL

SEQ ID NO: 145867 - protein, 137 aa, Glycine max
  Coding DNA Sequence Number=SeqID_29089
  Subcellular localization annotation: CTP_CleavageSite=27; ConfidenceScore=5.03e-01
MITASHSNAMLGDVYAYGLISGRGSVRDFTKPAVGCLRGSVNLRRLQPLYGPLSFGCSTFDANRRIRDSSLLHGSWLKNFSASSSACYSAGAAHAVSFDGSPPDEQLANSFFSPDPFFNLVLATLDSNLPHWVAYVD

SEQ ID NO: 145868 - protein, 134 aa, Glycine max
  Coding DNA Sequence Number=SeqID_29090
  Gene Ontology: Mol. function=2'-5'-RNA ligase activity; Biological process=RNA metabolic process
  Homolog annotation: Hit_ID=Q6D1Y2; Match level="QueryCoverage=98%, HitCoverage=81%, E-value=3e-43, Identity=67%"; Hit description=2'-5' RNA ligase
  Pfam annotation: Domain name=2_5_RNA_ligase; Domain location=10-88; Score=76.8; E_value=7e-20; Accession=PF02834.6; Description=2',5' RNA ligase family
MATQRLFFALELPDALQQQLVQWRADCFAADAGKPVAAANLHLTLAFLGEVSTETAGQLQQLAARIRQPGFTLDLDDAGHWPRPGVVWLGCQRAPRGRAPWLCAEYAAVPSPHHPAAPRGAGRGAAAARFSLAR

SEQ ID NO: 145869 - protein, 111 aa, Glycine max
  Coding DNA Sequence Number=SeqID_29091
MEKSDKMNFKEKKEKKGYITWEDNVINYSSDSEKKIISLDIMMKDYENGEEQSRYIDSNFSKHMACIQQTKTTFLPKKSEYVIYGDNKQRPLDQQPQQVISNDTNGSLVFD

SEQ ID NO: 145870 - protein, 54 aa, Glycine max
  Coding DNA Sequence Number=SeqID_29092
  Subcellular localization annotation: CTP_CleavageSite=19; ConfidenceScore=5.02e-01
MLVATPRTFPPLESAPVSLAFARPQKGTLRQLATPLGTFLSGGESIIMLGLRLA

SEQ ID NO: 145871 - protein, 103 aa, Glycine max
  Coding DNA Sequence Number=SeqID_29093
MYDGDIPSSIEGLLLLPGIGPKIAHLGQCPRDMCRYSCAPHLQLSWMGFIVAYILTIGNTSGAIWENVIKEKAVENLKMPMAESLTCGTFAGFLVILPLQLWA

SEQ ID NO: 145872 - protein, 172 aa, Glycine max
  Coding DNA Sequence Number=SeqID_29094
  Gene Ontology: Mol. function=unfolded protein binding; Cellular component=cytoskeleton; Biological process=cellular protein metabolic process
  Homolog annotation: Hit_ID=Q6K3R8; Match level="QueryCoverage=70%, HitCoverage=21%, E-value=6e-45, Identity=80%"; Hit description =Putative chaperonin containing TCP1, subunit 3
  Subcellular localization annotation: CTP_CleavageSite=41; ConfidenceScore=5.09e-01
LKFTPTFVLIGVSVWFHFASFFKKKNSNIFFYLVREKLPFVERAKVSIFYCEEEDWSLLLRMEEEYIEELCMQILKFKPDLVITEKGLSEFAWHFLSNHGLTAIRRLRKTDNNRIAKACGAVIVNKADELQESDVGTGAGLFEVKKIGDEYFAFIDGCYQGPQGLQCTIEGC

SEQ ID NO: 145873 - protein, 91 aa, Glycine max
  Coding DNA Sequence Number=SeqID_29095
PASVGIKLLALKFLETFVLLFSSDIGDTEKLATKGIRQAVNVEWLVGGHPHPVLDPVVLISDANRTIGILLNLLLLVGSLPTCLTITVVNW

SEQ ID NO: 145874 - protein, 78 aa, Glycine max
  Coding DNA Sequence Number=SeqID_29096
  Gene Ontology: Mol. function=nucleoside-triphosphatase activity; Cellular component=protein complex; Biological process=protein catabolic process
  Homolog annotation: Hit_ID=Q9SST5; Match level="QueryCoverage=86%, HitCoverage=15%, E-value=1e-19, Identity=73%"; Hit description=TAT -binding protein homolog
MRQIKCFVTKNVKELAPKLGDPDQRSNFVPLQAVCTEAGMFALRERRVHVTQEDFEMAVAKVMKKETEKNMSLRKLWK

SEQ ID NO: 145875 - protein, 265 aa, Glycine max
  Coding DNA Sequence Number=SeqID_29097
MDMNLGYLISHQISLTAQHDTSRLGFPALITTLCKARGVQLDSRSLENLSPAINSAYIKKNCWNLDDPIVTFRGGRKAKGKRLEVPTTSAPPETTTPSSSTAPVPLIQTRAIPPTSTQIPLPASSQIPLPAFLSVGPSNFSFTPQMLHSMFQSLHRGQSIIMKSLQGLGLPSIMSMDEFDVYTWLRRRRLPQTKSQSHPQYPYCRSKLHDESRLIQRCFDDNKGDDKKLKESRFKVQASKNQDQDSRIKRRLNQDKYEKVFSKTE

SEQ ID NO: 145876 - protein, 119 aa, Glycine max
  Coding DNA Sequence Number=SeqID_29098
  Subcellular localization annotation: CTP_CleavageSite=67; ConfidenceScore=5.89e-01
MGSPPASTPPPPPPPPPPPPPPPPAPSPPPPPPTSDTSASTSTVKRTLKALRLRSLSTRPPGVERPVVNADPTIEKADGPHKKKLRTYLGIVAHDKVDITYENWKEVPTTQKDLIWEDI

SEQ ID NO: 145877 - protein, 340 aa, Glycine max
  Coding DNA Sequence Number=SeqID_29099
  Gene Ontology: Mol. function=hydrolase activity, acting on glycosyl bonds; Cellular component=cytoplasm; Biological process=pyrimidine base metabolic process
  Homolog annotation: Hit_ID=Q6LQG2; Match level="QueryCoverage=54%, HitCoverage=59%, E-value=3e-65, Identity=67%"; Hit description =Pyrimidine-specific ribonucleoside hydrolase rihA
GQRHAGFQHHFGGFGIDEDVELRDRRGIAGVHAAAHKYDALDAAFQLGMLGQQQGDVGHRAGHHQGYRLRAGAQQVGDQFDGAAGIGFEGRRRQVGVAHAGFAVDIVGDHQLAHQRAAGAGGDRYVLAPHQGQQAQRVMQGFLRRLVAGGGGDGFDVQLRRTQRHGQRDGVVEAGIAIDDNRAGHVLSPLFVIQRASDQNRGETSAFSAGRLRDGIRRSDTAEFMSAAFPFFHLGWVQEGVIDGSAVGQDILQCLHAVGLAGAQLDIHVGDRHLLLIGVKAFDASYRRNQRGHFGMKLDPIMGVDIRRHLHFHLAIAKGIASAAAQLVFDGGATGLRPVT

SEQ ID NO: 145878 - protein, 180 aa, Glycine max
  Coding DNA Sequence Number=SeqID_29100
MGSSQKPSLKKRFYQVKIKSLEVTSLRKLGQLMGQLQRQAFRKAYGIRPPKASRKWGGRNTEKIFGAIDVFLAYHNHKESPVVAMLADLYDTFDRRCEESNARIVCCTPTLYVGLVSHLFLQEGRPVYPLQGYRSCVEKGKANRDQLLASMGGRLLIGSLARRKEESRFYLHAKDVQMFP

SEQ ID NO: 145879 - protein, 58 aa, Glycine max
  Coding DNA Sequence Number=SeqID_29101
FAYGPEAAEKAAQDSRIAVAQKIPAGVAVPASAPAQAQAAPATVSGGFLSNLLKKLFR

SEQ ID NO: 145880 - protein, 209 aa, Glycine max
  Coding DNA Sequence Number=SeqID_29102
  Homolog annotation: Hit_ID=Q8X405; Match level="QueryCoverage=100%, HitCoverage=69%, E-value=8e-64, Identity=53%"; Hit description=No significant matches
MDDFYVRTTEFLCPYLKCRIKATPCSYRTENVNQSYFKYTGEHKSGCGIHDAKNRNRNNSNDEKTHNSPPAPFISILRLENDERIHREKNDNRTRKVNDEEDVVREHPVSSSSIKPIVDYYLSGVNNNEFLSIPPYEKRTYNETFQKLKYKPDVKYFKPAIYFGALQSNLTLDPNADEYEIVFLARKKGTKEAFRLKVDASSWNSSQKD

SEQ ID NO: 145881 - protein, 60 aa, Glycine max
  Coding DNA Sequence Number=SeqID_29103
MPQVRERDDARGRASLRGTKHFNRGLHTRGSSSLREGKLVDRGRPRKFERSSSRVREIVE

SEQ ID NO: 145882 - protein, 142 aa, Glycine max
  Coding DNA Sequence Number=SeqID_29104
MNADHAHQHDHSYMDMDRAHKTPSGPGEVQQGPGVSSSGYGPLSVLQGARSPSEVMPSYIGIAPARHPMDSKKSNRVLELSSSNYGSLKGIRPPTNRAFIKKYCVSRQVQGETPQQPGDGQQRATDAPPSPLEFTSAHQQKG

SEQ ID NO: 145883 - protein, 66 aa, Glycine max
  Coding DNA Sequence Number=SeqID_29105
MEASQRSLMRKLLKEASRESFSRKLSELSQKKCPVNRWIFSKFGLEVHRIDVHDLTVAICDMYLDV

SEQ ID NO: 145884 - protein, 50 aa, Glycine max
  Coding DNA Sequence Number=SeqID_29106
  Homolog annotation: Hit_ID=Q1RWA4; Match level="QueryCoverage=97%, HitCoverage=5%, E-value=3e-15, Identity=80%"; Hit description=DNA -binding SAP; Zinc finger, MIZ-type; Zinc finger, FYVE/PHD- type
MVYSLERQGSIQDAMATVYRPAGVPVRATNRPGSQLLGANGRDNGPILVP

SEQ ID NO: 145885 - protein, 182 aa, Glycine max
  Coding DNA Sequence Number=SeqID_29107
  Gene Ontology: Mol. function=nucleic acid binding
  Homolog annotation: Hit_ID=Q1SN43; Match level="QueryCoverage=97%, HitCoverage=31%, E-value=7e-35, Identity=42%"; Hit description =Nucleic acid-binding, OB-fold, subgroup
  Pfam annotation: Domain name=CRC_subunit; Domain location=76-142; Score=-52.9; E_value=0.078; Accession=PF08624.1; Description =Chromatin remodelling complex subunit
  Pfam annotation: Domain name=DUF223; Domain location=52-148; Score =20.6; E_value=3.5e-05; Accession=PF02721.5; Description=Domain of unknown function DUF223
  Pfam module annotation: Pfam domain module=CRC_subunit::DUF223; Domain location=76-142::52-148
MNKIIANKYNSVAEINVEKESWRIMVRVVHLWMVSDVSNNKQTSSSKIPLSMEMVLVDSKGDRVHGSVKQTFIYKFDKALQEGKWYSIQFFGVAENGGIYRTTHHKYKIVFQYSTKVALVDNASIPNSMYDFVPIRDIVCGGYDTDYLVDVIGILTGVGTERENERNERRTKMNVIQIENDG

SEQ ID NO: 145886 - protein, 391 aa, Glycine max
  Coding DNA Sequence Number=SeqID_29108
  Homolog annotation: Hit_ID=Q1SFS3; Match level="QueryCoverage=38%, HitCoverage=28%, E-value=6e-14, Identity=31%"; Hit description =Lambda repressor-like, DNA-binding
MGQLQRQAFRKAYGKICDLTMAELTPTVEEFEEILGCPLEGRKPYLFSRFYPSLARISKIVKISAQELDRRKRVENGVVRVPRKCLEAKARVLASQGEWAPFIDILALLIFGVVPFPNVDGLVDRAVIDAFLAFYDRKESPVVAILADLYDTFDRRCEKNNARIVCCMPALYVWGCINYNPVLAIRQLGYPMRGAPSEEGLIPFIVRGFNSTNTGVLQRVHKACNGPIGGYNRWLKAYAQDLNWLPSLRTPKGMEIETPEEDEETKRARREEHGRNKFRGALWGSNSELKLRREERDQSRVDSLILKDELKVCLRSKRSLSQRLSETETNMLAIISKYQEELNLATANEHKVADEYARVYAEKEARRRVMDSLHQEATMWMDRFALTLNGS

SEQ ID NO: 145887 - protein, 74 aa, Glycine max
  Coding DNA Sequence Number=SeqID_29109
MGSEEKRENKENAEGDGDSRSERNSEPERVMNDLIQRKQHSLTRLSKSESRIFSFTLLRKERQEGRHRFDILYV

SEQ ID NO: 145888 - protein, 62 aa, Glycine max
  Coding DNA Sequence Number=SeqID_29110
MRLSHEVLKVTVELSSLRKGESGKASASRTCPKREISVQSATIVFSQAQRITGAKFKSTYSH

SEQ ID NO: 145889 - protein, 77 aa, Glycine max
  Coding DNA Sequence Number=SeqID_29111
MAILMDDKDFRSRGRLPCGRDSHLKGRCVGLQVSPYVVARGPQVYPSNLPNNWYQSRWFKLVTGSDEYASTAGSQNG

SEQ ID NO: 145890 - protein, 189 aa, Glycine max
  Coding DNA Sequence Number=SeqID_29112
  Gene Ontology: Mol. function=coproporphyrinogen oxidase activity; Cellular component=cytoplasm; Biological process=porphyrin biosynthetic process
  Homolog annotation: Hit_ID=Q6DB74; Match level="QueryCoverage=56%, HitCoverage=23%, E-value=3e-46, Identity=78%"; Hit description =Oxygen-independent coproporphyrinogen III oxidase
MAAQQRHQPADLLLIEEGWRAAAPVQLRNATASKQRRALTNLLRQHVKIAIGLVQLARHDFIAAAEVAETMAERDVHVQRQRALGIALNRVLEIARTKAFAKLQCGGIRGRVAWQKRRRSAGRNAAVSAISAATGGAHHILFCLLVFGVVVQRNAQRFHQLVNAIQRLIQPRLIFCAQGFAALKAIEQR

SEQ ID NO: 145891 - protein, 513 aa, Glycine max
  Coding DNA Sequence Number=SeqID_29113
  Homolog annotation: Hit_ID=Q9LSG4; Match level="QueryCoverage=99%, HitCoverage=100%, E-value=4e-31, Identity=29%"; Hit description =Arabidopsis thaliana genomic DNA, chromosome 3, P1 clone: MJL12
  Subcellular localization annotation: CTP_CleavageSite=82; ConfidenceScore=5.21e-01
MTELSFSNTSNKKNELSSNLFSIFFHFCFSIFSHPLYFSYFIFFSPYLLRILSFLSPLFITTTLLLVALLTFTPNNLAQEKCGSEPSESKWGIVLSVMKSFLAWLHSKADEIDEEMGLLGEVEAYLVMFQASIFEVFEPKSVEECSEGFEAVDAECSVEGREDSCAVEEPKPSVNLDKNLPSQRGEPTFEYPSKVSTFNAQQCLEQDCLEKRIIVDESLHSQPKFESPLEEVPIFSARQSFEKDCPQRKIPVESQINMDGNPVEKVDEVEATMPIVEVKSLESLFQENQELEDLSSQKEHKEVKPLIAEFNKVEESNEKWPLRSGSKVVMGYRDNKVSTNSDGEFAFAASGRVKSLSQRLEANIGSPESNWVYSGKGMGNNNHALGSFGSMRVEKEWRRTLACKLFEERHNADGSEGMDMLWETYETESNNKVLKKSNTKKGKKKGEVENSEEDEEEEEEDMEAKLCCLQALKFSTGKMNLGMGRPNLLKFSKALKGIGWLHHVGKNGRKSNH

SEQ ID NO: 145892 - protein, 90 aa, Glycine max
  Coding DNA Sequence Number=SeqID_29114
MKQAFKRTETQLSKLIYDMTKVMDRREEEYAKIEEHQESILQVTTIHHQLINKEEKGEDQKISFNLFEVVKHSNMGDAYFEEEEVEQEIA

SEQ ID NO: 145893 - protein, 58 aa, Glycine max
  Coding DNA Sequence Number=SeqID_29115
MENLRTALCNNFTGLQTRRWRMHEHCWAMTFMGLRKQWRMENWRTALGNDIRGAPDSK

SEQ ID NO: 145894 - protein, 145 aa, Glycine max
  Coding DNA Sequence Number=SeqID_29116
  Gene Ontology: Mol. function=nucleic acid binding
MIRSCPHHGFYQQRLVHIFYGGVSYHNKTSLDAACGGNLMLKSHVDAIKIIGDIYSNPYNNSKDRRIIKRGINQVEKDDSEMELGKQVKPMALKIKTLLRAQTQVLITTPSLPTCDKCGIVHGSRECIVYDKLVAAMDEINFVGE

SEQ ID NO: 145895 - protein, 100 aa, Glycine max
  Coding DNA Sequence Number=SeqID_29117
MDTRLRVIGDPMNGVQRYTKMKVDGAVPFLIPMTMCIINCGNIKVEVFIYVYFWGEGHNSLFEDSPSECGGGAATVRYGLISKGHSRNKIQVQGRVTRYH

SEQ ID NO: 145896 - protein, 88 aa, Glycine max
  Coding DNA Sequence Number=SeqID_29118
MTNANCLQESLHSVSNRNLRFFLQKEVASGGSNLARLGKLGGKLIPYFAINKGRNEEGRGSAFLALRILLKLLRKIVSVKKIQAEALP

SEQ ID NO: 145897 - protein, 68 aa, Glycine max
  Coding DNA Sequence Number=SeqID_29119
MAVTLGCHSLLKHLKTLLIKSSLGKVFPKDEKPIGEQHQKQNLKESYASSSEGNNTRNLAFHKFNKSR

SEQ ID NO: 145898 - protein, 50 aa, Glycine max
  Coding DNA Sequence Number=SeqID_29120
MTILCVILKLEWAMALKKFSIKRARKTTAGEGSSAVPQAEIEFDGHRFRS

SEQ ID NO: 145899 - protein, 73 aa, Glycine max
  Coding DNA Sequence Number=SeqID_29121
MCIHLKGECCENFPGRPKWTRMNAQIDKRTYFGNTVGHPLHPRTAGQTLTYIMTSRSTSLELEFQLTINLDPG

SEQ ID NO: 145900 - protein, 118 aa, Glycine max
  Coding DNA Sequence Number=SeqID_29122
MRNSDLRSSCKSGYSVNDRKKGEEVAAQLAQATLARPGELGGNLLSLFPINRLKGAVLRIPQPPGYVFQLFWVKKNCFREENPSRGASVTLPRCFRKQIREGLRPFFIVLHPFFVLQR

SEQ ID NO: 145901 - protein, 65 aa, Glycine max
  Coding DNA Sequence Number=SeqID_29123
MASSSAKTMDRLKLLTIPFRRCLDSLTTLFFPTKDIRQDLSHPIRQKHCFLKKNSACNMDMHVFP

SEQ ID NO: 145902 - protein, 89 aa, Glycine max
  Coding DNA Sequence Number=SeqID_29124
MVGYAPSSFTDLVFVGERIEAGLKRGKFNHLAWTNEKTGANEEGVNEGETHAVIVVPTWKIPTSLTNIITQPISALLITHHPIIHKGHP

SEQ ID NO: 145903 - protein, 210 aa, Glycine max
  Coding DNA Sequence Number=SeqID_29125
  Gene Ontology: Mol. function=nucleic acid binding; Biological process= RNA-dependent DNA replication
MQRRSNAGDLISIDLEINATCRRRNIERIINFLQDLEAAATPKEEPRSSEASSSFPIPVKSHTDLIEEVIMAEEPRRVTLEDYSSSSVPQFFTSIAQPEVQAQTITYPPSLIQLVQNNLFHDAIRLSLFSFSLSGEANRWLHSFKGNSLKTWDEVVVKFLKKYFPESETVDGKTSISSFHQFPDESLSEALERLRGLLRKTPTHGFLESI

SEQ ID NO: 145904 - protein, 40 aa, Glycine max
  Coding DNA Sequence Number=SeqID_29126
MYICVEMAPKKLSLKRSRKDAAAAETSAAPEFDSLVLGER

SEQ ID NO: 145905 - protein, 491 aa, Glycine max
  Coding DNA Sequence Number=SeqID_29127
  Gene Ontology: Mol. function=kinase activity; Cellular component =proton-transporting two-sector ATPase complex; Biological process =ATP synthesis coupled proton transport
  Homolog annotation: Hit_ID=Q1SMI5; Match level="QueryCoverage=99%, HitCoverage=43%, E-value=1e-178, Identity=53%"; Hit description =Prefoldin; tRNA-binding arm; t-snare; Protein kinase PKN/PRK1, effector
  Pfam annotation: Domain name=KIP1; Domain location=1-52; Score=78.7; E_value=1.8e-20; Accession=PF07765.3; Description=KIP1-like protein
MDAKVKQMIKLIEEDADSFARRVEMYYKKRPELMKMVEEFSRAYRALAERYDHATGVICHAHKTMAEAFPNQGAFLDPDEPQKDASAHFHAIKRNGGYIGEPDSPLNKTGLKQLNDLYIPGEQENLPKFARRGLNFFEMQEESNQQNRGSNNTLSESERVTKDETEILALKKAIAKLEDEKEAGLLQYQQSLEKISNLELEVSTAQENSRKLDERASKAEAEVQALKEAQIKLQAESEASLLQYHECWEKISNLEKNISSLQKEAGELNERATKAETKSESLKQELARVEAEKEATLVQYNQCLETISKLEERIKEVEENARRIKEHANIAEKEIEALELQVTKLNEEKEDAALHYQQCMEIISSLEYKLSCAEEDVHRLNSKIVDGVEKLQSSKQKCLLLETSNHTLQSELQSLAQKVGSQSEELNEKQQELGRLWGCIQEERLRFIEAELLSKLFSSCILSLRNSLDLLLLNLTVKWKYWGMWNLVSRL

SEQ ID NO: 145906 - protein, 358 aa, Glycine max
  Coding DNA Sequence Number=SeqID_29128
  Homolog annotation: Hit_ID=Q2HVA4; Match level="QueryCoverage=63%, HitCoverage=25%, E-value=1e-46, Identity=48%"; Hit description =Putative centromere protein
  Pfam annotation: Domain name=Kinesin; Domain location=56-281; Score= -127.3; E_value=2.7e-06; Accession=PF00225.13; Description=Kinesin motor domain
MVVRELERKIVQLEQHNKELGDLLKELREAQINNGGANSVHKHCASIVKSKESQWGDQVAKMEADIVTYKSTLTNKEQEIRELQMELENCYYAIEENHLGLLIFKSELVEAYSKSCRGRADLDKAFDIKENEDMVLISVEQLRVKDKSVKTMAQAAQQHYLLEEELKQQKKKLEESSEGQLILEEQLLQMEYTVQYERNAAFEALEKTSGAEGERLKEAANINKSLSTLGHVIMILVDVANGKQRHIPYRDSRLTFLLQAVVNEDSTGDVIALQHQIRLLKEELSILKRRQNVSRSLSFSLSSIRDIKQSLELEDCCLENATDMVDQHEDNMPNYESKGIRMSHKQVYMGRLGYVNEG

SEQ ID NO: 145907 - protein, 81 aa, Glycine max
  Coding DNA Sequence Number=SeqID_29129
  Gene Ontology: Mol. function=protein domain specific binding; Cellular component=nucleus; Biological process=negative regulation of ubiquitin ligase activity during mitotic cell cycle
  Homolog annotation: Hit_ID=Q9C5W6; Match level="QueryCoverage=80%, HitCoverage=26%, E-value=4e-25, Identity=84%"; Hit description=14-3 -3-like protein GF14 iota
MWEKLASPSMVEVPACHLAKQAFDEAIAELDTLSEESYKDSTLIMQLLRDNLTLWTSDLPEDGGDEIKTEEAKPAETSEHS

SEQ ID NO: 145908 - protein, 515 aa, Glycine max
  Coding DNA Sequence Number=SeqID_29130
  Gene Ontology: Mol. function=RNA-directed DNA polymerase activity; Cellular component=chromatin; Biological process=RNA-dependent DNA replication
MVFDCLSQGQFFLKESKCVFAQQQLKFLGHIVSARGMAPDPSKLEAMVTWPVPTTTQSLCGFLGLIGFYPKFICGYAALVVPLTTLFQKNNFHWGVDAQNAFDNLKHAMTQAPVLSLLDFSIPFTIKTDAYGVVKGVVLTQRDHPLAFFSKAFCPQLQHASIYVRELHAVMNAVHKWRQYLLGHPFTILTDHKSLKDLMGQVIQTLEQQVYLSNLLGYDYTIQYKSEKSNIVVDALSRVPQHTSGQYMLLSIPHFIFIDAMHKHFITSAPFQTKLQQVNSDLGSHPDFEFRDGLLFFNDRVWLEPENPFIVPLIEDFHLTPIEWCYNTVVHSATDITPFEATYGKPPPLLATYLKGSSTVKVVDSLLSSRQDLWTSLSTRLRKVTTPLPLQAADNHPLVEPLNIVDTKWDDTTTPPSLLVLVQWNGLVLIECSTFGLRERPTSQCSCKITCDHRPLAYLSGCSTTLISSPRDNHYEMASNLSSTKASGIFLKWMFGAWSANRSAQELLGKGLLKH

SEQ ID NO: 145909 - protein, 50 aa, Glycine max
  Coding DNA Sequence Number=SeqID_29131
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=Q49CA9; Match level="QueryCoverage=82%, HitCoverage=9%, E-value=3e-15, Identity=90%"; Hit description=PsbC
MKWDAWFNNTAYPSEFYGSTGPQASQAQAFTFLVRDQHLGANVGFAQRYN

SEQ ID NO: 145910 - protein, 168 aa, Glycine max
  Coding DNA Sequence Number=SeqID_29132
  Gene Ontology: Mol. function=protein domain specific binding; Cellular component=germline ring canal; Biological process =intracellular signaling cascade
  Homolog annotation: Hit_ID=Q9C5W6; Match level="QueryCoverage=99%, HitCoverage=62%, E-value=7e-78, Identity=85%"; Hit description=14-3 -3-like protein GF14 iota
  Pfam annotation: Domain name=14-3-3; Domain location=1-168; Score =233.3; E_value=5.4e-67; Accession=PF00244.10; Description=14-3-3 protein
MVECMKTIAKLDLELTVEERNLLSVGYKNVIGARRASWRIMSSIEQKEESKGNESNAKLIKNYRQKVEEELSKICSDILSIIDQHLVPSSTSGEATVFYYKMKGDYYRYLAEFKTDQDRKEAAEQSLKGYEAALATASTELPSTHPIRLGLALNFSVFYYEILNSPER

SEQ ID NO: 145911 - protein, 247 aa, Glycine max
  Coding DNA Sequence Number=SeqID_29133
  Gene Ontology: Mol. function=ATPase activity, coupled to transmembrane movement of substances; Cellular component=integral to membrane; Biological process=transport
  Homolog annotation: Hit_ID=Q5TJC4; Match level="QueryCoverage=27%, HitCoverage=22%, E-value=4e-24, Identity=83%"; Hit description =Impaired sucrose induction 1-like protein
MATMMWSLERSDWDSVKTRSDDVEVELALRVLEGCFLLHPQSTALAHQHNAIQVLMNILSTRGVLEQGACLDALISLMVDSSSNQMDVLIDVPLDAYEIVCLRVGVAVHNLGQFYLGQRKLEEAPYVAVSRSGQENLLQAPLLSRSNSMEASLAKDTSSNDVKNGQGFKGHSMLAPFTAGWQTTDLHPLVIERSEGGHDLTEIGERGVNISGGQKQRVSMVRAVYSNSHVYIFDDPLSALDAHVARQ

SEQ ID NO: 145912 - protein, 515 aa, Glycine max
  Coding DNA Sequence Number=SeqID_29134
  Gene Ontology: Mol. function=methyltransferase activity; Cellular component=cellulose and pectin-containing cell wall; Biological process=metabolic process
  Homolog annotation: Hit_ID=Q1SBM2; Match level="QueryCoverage=66%, HitCoverage=80%, E-value=1e-168, Identity=82%"; Hit description =Putative methyltransferase, putative
  Pfam annotation: Domain name=DUF248; Domain location=101-515; Score =190.2; E_value=4.9e-54; Accession=PF03141.7; Description=Putative methyltransferase
  Pfam annotation: Domain name=Methyltransf_11; Domain location=227 -322; Score=22.5; E_value=0.00034; Accession=PF08241.2; Description =Methyltransferase domain
  Pfam module annotation: Pfam domain module=DUF248::Methyltransf_11; Domain location=101-515::227-322
  Subcellular localization annotation: CTP_CleavageSite=79; ConfidenceScore=5.44e-01
MRSSWLKKQSFVIGHKPPLNWLILFLISLLALIAVLSSSSSPLSSSKKNSSRRTTVESLIYTSYRRIEEQAAVDYLELRAVSSAGGARQKEVGLCRKERENFVPCHNVSANLVAGFKDGEEFDRHCEVYKGTEKCLVRPPKEYKAPLQWPAGRDVIWSGNVKITKDQFLSSGSMTKRLMLLEENQIAFHAEDGTIFNSVKDYTRQLAEMIGLGSDTELPQAGIRNILDINCGFGSFGAHLLSLKIMAVCIAAYEATGSQVQLSLERGLPAMIGNFISRQLPYPSLSYDMVHCAQCGIMWDEKNGMFLVEVDRVLKPGGYFVLTSPTSRPQGSSREKKRIMANPIEGLTQQLCWTLLAQQDETFIWQKTADIDCYASRKLPTIQVCKADDTQSYYRPLLPCIRVQPEEFYEDFQYWRSAVNNYWSLLTPLIFSDHPKRPGDEDPLPPYNMIRNVMDMSANFGGLNAALLEEKKTVWVMNVVPARASNALPLILDRGFAGVTHDWYEGNTVELEGEN

SEQ ID NO: 145913 - protein, 95 aa, Glycine max
  Coding DNA Sequence Number=SeqID_29135
  Subcellular localization annotation: CTP_CleavageSite=48; ConfidenceScore=5.06e-01
MKFETPIRKPDMSSKYLMAKVPSSLGSLMRLTVLDFNNQNLSSELPLKAFYIGSNDLSTSITTRGGNTVSLNTDIGWRTVFEGRLFYIGCVAQPM

SEQ ID NO: 145914 - protein, 86 aa, Glycine max
  Coding DNA Sequence Number=SeqID_29136
MAQQQQNHRDEFGNDQRAYDVRHRDLAVAEPVRKPNCHRPRGELRLREHREWRVRSATHRRTALRLKAMEPLIAAVVTVKGTRIWT

SEQ ID NO: 145915 - protein, 191 aa, Glycine max
  Coding DNA Sequence Number=SeqID_29137
LLGWGPVAVYYRPERVVRQVGYTQTIPAPPVDSWVSYDDIHDRWIHYSDHMVPAGEVCTVSGQCVSDYMDWFFRISHPFMTSDQASDPLPDGHAPQPRVIPQAPQTDIPHVPEPGAPSTSARPVVEEPKHAVVKVCHGIVERLERHLSLGVVKPGSSTHEVIEECLRMTRSVTQDHLVYIRSRRRRRTDQA

SEQ ID NO: 145916 - protein, 47 aa, Glycine max
  Coding DNA Sequence Number=SeqID_29138
MAFRGGTMLILTMMALLEIQICSSEINRGNFPNGFVFGTASSAFQKK

SEQ ID NO: 145917 - protein, 91 aa, Glycine max
  Coding DNA Sequence Number=SeqID_29139
MGRSRRCGCSNLERAKHGSDSGFVWDMMLGDYTSAKGDDGSGGGWWMKVLFAADRRRIAVLGSDGRPQANAGVIGNGGEEGRVKFGGEGVQ

SEQ ID NO: 145918 - protein, 136 aa, Glycine max
  Coding DNA Sequence Number=SeqID_29140
WIVSQLLFSLDLATFIAIAGSLATFFRDMVEEKANALTPTAPTPSPKAGYLPEYNKRKAKKRRKRRMQKKVGTRFVGSTPLSKRSVGIRLYRTELSSHTYNLRCSPVSLLSYSTALGTDARLSAFHRYGYPAYLTT

SEQ ID NO: 145919 - protein, 136 aa, Glycine max
  Coding DNA Sequence Number=SeqID_29141
  Gene Ontology: Mol. function=transcription factor activity; Biological process=regulation of transcription, DNA-dependent
  Homolog annotation: Hit_ID=Q5PEP7; Match level="QueryCoverage=90%, HitCoverage=44%, E-value=7e-56, Identity=92%"; Hit description =Transcriptional activator protein LysR
  Pfam annotation: Domain name=HTH_1; Domain location=18-77; Score =81.6; E_value=2.5e-21; Accession=PF00126.17; Description=Bacterial regulatory helix-turn-helix protein, lysR family
MIWLSDANREPPMPAVNLRHIEIFHAVMTTGNLTEAARMLHTSQPTVSRELARFEKVLGLKLFERARGRLQPTVQGLRLFEEVQRSWYGLDRIVSAAESLREFRQGELSVASVPGALSGRQPADRAAGVAAAGGVA

SEQ ID NO: 145920 - protein, 59 aa, Glycine max
  Coding DNA Sequence Number=SeqID_29142
MSLDYCWRCESGILDNGHIEVRIATRLPWWHWRMVLPENAEEPPLADIEKSKPIRKKME

SEQ ID NO: 145921 - protein, 84 aa, Glycine max
  Coding DNA Sequence Number=SeqID_29143
MRRFRNVSVGDFAKIFNRSSTFFVVLQSSIGQGLAFSPWVKVYGKLGFWLKACRMAGHDICQGLANGLGIKGMSHIISMIHMQQ

SEQ ID NO: 145922 - protein, 118 aa, Glycine max
  Coding DNA Sequence Number=SeqID_29144
KEHVLWCPYQTRARARVMGEIEEVQEQMKADTEALKEQMVTMMSIKGIIEVNAAAIVTTSTIDEKGKAIGDIPLQNTLEGLQYHPQTTPLAFHSGVKTFMLWAEMGKVGSSRGKAQGH

SEQ ID NO: 145923 - protein, 95 aa, Glycine max
  Coding DNA Sequence Number=SeqID_29145
MWDATVFGVHNDNFSLYIKHEDLSEIAHDGQCLSISVIQLWIFALKGLDDTPQSKPKVAARWIVVKCFNDARPLEPERLKTLRIHWAKYYLKVKK

SEQ ID NO: 145924 - protein, 159 aa, Glycine max
  Coding DNA Sequence Number=SeqID_29146
  Gene Ontology: Mol. function=sugar porter activity; Cellular component=integral to membrane; Biological process=carbohydrate transport
  Homolog annotation: Hit_ID=Q1T4L1; Match level="QueryCoverage=78%, HitCoverage=25%, E-value=1e-58, Identity=86%"; Hit description=Major facilitator superfamily
MVVQAFQQFTGINTVMYYSPTIVQMAGFHANELALLLSLIVAGMNAAGTILGIYLIDHAGRKKLALSSLGGVIVSLVILAFAFYKQSSTSNELYGWLAVVGLALYIGFFSPGMGPVPWTLSSEIYPEEYRETKGLTFDEVEVLWRERAWGKNPKNTKPS

SEQ ID NO: 145925 - protein, 33 aa, Glycine max
  Coding DNA Sequence Number=SeqID_29147
HVDVTLTSSVGPECVELISIVCGVDLYCSESNL

SEQ ID NO: 145926 - protein, 331 aa, Glycine max
  Coding DNA Sequence Number=SeqID_29148
  Gene Ontology: Mol. function=transporter activity; Cellular component= membrane; Biological process=transport
  Homolog annotation: Hit_ID=Q7CHF3; Match level="QueryCoverage=86%, HitCoverage=79%, E-value=1e-120, Identity=77%"; Hit description =Inner membrane permease of iron/siderophore ABC transporter
  Pfam annotation: Domain name=ABC-3; Domain location=82-326; Score= -166.0; E_value=0.022; Accession=PF00950.8; Description=ABC 3 transport family
  Pfam annotation: Domain name=FecCD; Domain location=39-331; Score =237.5; E_value=2.9e-68; Accession=PF01032.9; Description=FecCD transport family
  Pfam module annotation: Pfam domain module=ABC-3::FecCD; Domain location=82-326::39-331
MRSTDSALVAEHGTEADTLTRYRQVLRQRLLLIGVLVLAILASVILDFTLGPAGLTLDTLWQTLLHPAAVDAGTRVIVWDIRLPYALMAVVVGFSLGLAGAEMQTILNNPLASPFTLGVSSAAAFGAALAIILGIGIPGVPDQWLISANAFVFALFAALMLDGITRWTKVSTSGVVLFGIALVFTFNALVSMMQFIASEDTLQGLVFWTMGSLARASWEKLGVLSAAFAILLPFSMLSSWKLTALRLGEDRAVSFGIDVRRLRLATLLRISILSALAVAFVGPIGFIGLVAPHIARMMFGEDHRYYLPASALTGALVLSLASVASKNLIPG

SEQ ID NO: 145927 - protein, 83 aa, Glycine max
  Coding DNA Sequence Number=SeqID_29149
MTTLTQIWMTLLLSNILPSDHNADLPLRKDHAHKTHSGPGEAQQGPGVSSSSYEPLSVLTGARPPQQGITLVRHPVDPEKSNR

SEQ ID NO: 145928 - protein, 222 aa, Glycine max
  Coding DNA Sequence Number=SeqID_29150
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=6e-31, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=78; ConfidenceScore=5.78e-01
MWSPMKVRACSPTTVRASNPLKTRTCSPQKARACSTLKVRKCTPLNVRACSPLKRRTSSPLKARACSPLKERMGSPMKARTRSPQKAKTGSPLKARACTPRKARTCSPLKVRACSPLMARTCSPLKVRACSPLEVRACSPLIARTCIPLKARACNPLKVRTCSPLKVRACSPLMARTCSPLKARACSPLKVRTCSPLMVRACIPLMARACSSLKARTYSPLK

SEQ ID NO: 145929 - protein, 105 aa, Glycine max
  Coding DNA Sequence Number=SeqID_29151
  Homolog annotation: Hit_ID=Q1GXZ1; Match level="QueryCoverage=70%, HitCoverage=57%, E-value=2e-09, Identity=43%"; Hit description=DoxX
MRLNVYRHASSRCLHAWQAEGNAFNNDKERSRHRQGYGSGRNYCLYRECTLATAAGGLRGCADCRARAGPGVTGRVQGATGCGGNLAVYLCDGIDVSQQYGRSSA

SEQ ID NO: 145930 - protein, 462 aa, Glycine max
  Coding DNA Sequence Number=SeqID_29152
  Gene Ontology: Mol. function=protein transporter activity; Cellular component=membrane; Biological process=protein secretion
  Homolog annotation: Hit_ID=Q1GY90; Match level="QueryCoverage=55%, HitCoverage=71%, E-value=2e-52, Identity=43%"; Hit description =Secretion protein HlyD
  Pfam annotation: Domain name=HlyD; Domain location=247-461; Score= -15.4; E_value=0.015; Accession=PF00529.10; Description=HlyD family secretion protein
  Pfam annotation: Domain name=TetR_N; Domain location=18-64; Score =72.3; E_value=1.6e-18; Accession=PF00440.13; Description=Bacterial regulatory proteins, tetR family
  Pfam module annotation: Pfam domain module=HlyD::TetR_N; Domain location=247-461::18-64
MPPKVKTDAEKQAVRTAIMDAARELFIHQGVQAVTMRAVAQRIGYSATSLYLYFTDKEQLLRAVVDADVIKLAQALKSTLSIADPLQRFLQFGQHYVQFALTNPNHYRMMFMTQHPPCDPALSSIEQNNPEQDAYSMLIGVVTSAWHAGVFKPSLTDPVLIAQTIWAAMHGLCALHINLADDAWINWRSLESRIQAMIEILCLAAIVSACHQPPEETAAPRPVWIMSVGSTTSSIEASYTGEVKSRYESNIGFRIAGKIISRAVNVGDAVKKGQLIAQLDPNDSRLNALAAGAEVQTAQANLALAQAELARRQQLYSQKFISKSALDSYETQVKTTQARLEQAKSQAAVSQHQTGYTQLVADRSGVIGMIQAEPGQVVSAGQTVAQIYDLQTLEIQIAVPESTISTLHVGDAAQVALNDLSQGYQGRIREISPAANSQTHAFDLRIQLLDADPRIKLGMTAQ

SEQ ID NO: 145931 - protein, 71 aa, Glycine max
  Coding DNA Sequence Number=SeqID_29153
MTTYRPPLLMAHIYPGIRPNISMCVQRCRCHSPVELPSVTTYHSTGGRGEMKNTFVSWGENEWESPPTFIR

SEQ ID NO: 145932 - protein, 64 aa, Glycine max
  Coding DNA Sequence Number=SeqID_29154
MRKFPFTKRKPRTKRISVHALSRESHALSAQPLHLRLIHSAKLAMAKLSLIEFDLNLAKLQPDR

SEQ ID NO: 145933 - protein, 52 aa, Glycine max
  Coding DNA Sequence Number=SeqID_29155
MMYAQVCFNCMTLAYETFINTPAGDVVDNLIQECGTVTHPLAYETFNDMTLA

SEQ ID NO: 145934 - protein, 286 aa, Glycine max
  Coding DNA Sequence Number=SeqID_29156
  Homolog annotation: Hit_ID=Q8TGM6; Match level="QueryCoverage=42%, HitCoverage=97%, E-value=1e-09, Identity=43%"; Hit description =Protein TAR1
GDPTNQLPCALRVYSPVDSHTCQTPWSVFQDGPNGEPTGRRQERAGAEARQGRALPSTIAMTTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRSRE

SEQ ID NO: 145935 - protein, 144 aa, Glycine max
  Coding DNA Sequence Number=SeqID_29157
MEAMKDQMAAMMEAMLSMKKIMESNVVAVATMSAATEVDPSHPSSLNQSKNSFPPYGLPPNYAPPNVVPVPDENADNSTPIPIEGQQPQYDHAHVHQPMGETHEVPHHNLADFEPRLGYATKGQAVGGIPLPNTMKGLQFCPQP

SEQ ID NO: 145936 - protein, 145 aa, Glycine max
  Coding DNA Sequence Number=SeqID_29158
  Gene Ontology: Mol. function=ribonuclease H activity; Cellular component=membrane; Biological process=DNA integration
MFVSYKDWHEMLPFALHGYWTSLRTSTGATPFSLVYGMEVVLPFEVEIPSLRILAESGLEEVEWAQTHFDQLNLIEGKRLAAMSHGQLYESRVKNAFDKRVHPSKFSKGDLVLKKVSQAQKDHRGKWAPNYEGPYVVKKAFSGGV

SEQ ID NO: 145937 - protein, 60 aa, Glycine max
  Coding DNA Sequence Number=SeqID_29159
MVMKLHHSLIIVVEGFPDAEFALMEWDESHSSACWCSGVTFPGCVMVIIVNCSLIIPLKL

SEQ ID NO: 145938 - protein, 196 aa, Glycine max
  Coding DNA Sequence Number=SeqID_29160
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=51%, HitCoverage=30%, E-value=2e-16, Identity=46%"; Hit description =Similarity to MADS-box DNA-binding protein
MKPQHKQHFSLLNLFLLFSGHHHGSEEGREEPEPEVWPSELGVLSVVERFRSRPELDQGRKKVNQESFVSQSIVKGQDKLQKVVKENKEIEMSSFMTQCLNIGNVQPCKNITTADLNVLSSMIEQDLMDVDKRMEMQNCNQLEAPSQLQMQTTPTYKPDMQTLANQPGDQMQTLENQPDMQTLTNQLGDQMQNLAN

SEQ ID NO: 145939 - protein, 66 aa, Glycine max
  Coding DNA Sequence Number=SeqID_29161
MEPIERNYEVYMHVFRWRCICSGRKLIALEVLGADLDLDEEVVNAEGVKHGATRAVIGGACVGEDY

SEQ ID NO: 145940 - protein, 60 aa, Glycine max
  Coding DNA Sequence Number=SeqID_29162
MGDNGYGSMSSYATKLYGGQLSDLYLDAFILKQLSLSPKPWFESEIPLTSPTGLLPNMLN

SEQ ID NO: 145941 - protein, 93 aa, Glycine max
  Coding DNA Sequence Number=SeqID_29163
CWWVVVLGLVEPTSISESSSDSEAIFAQSVLLLLVWGIPEWMTQVDDPVWVGEPEDDEVVFLITDSGRAKRTSFPLLLVLPPLPEELDTLGGI

SEQ ID NO: 145942 - protein, 83 aa, Glycine max
  Coding DNA Sequence Number=SeqID_29164
ELGFELVRGDDGNASNVSIDGERGKARYARLRPTGMISEDNFEKQYMCVPDGKTITTPSSRVFGRATCAIPHNPGVHVFDIVM

SEQ ID NO: 145943 - protein, 138 aa, Glycine max
  Coding DNA Sequence Number=SeqID_29165
  Gene Ontology: Mol. function=catalytic activity; Cellular component =cellular_component; Biological process=fructose 2,6-bisphosphate metabolic process
  Homolog annotation: Hit_ID=Q01H81; Match level="QueryCoverage=88%, HitCoverage=18%, E-value=2e-61, Identity=91%"; Hit description=[G] KOG0234 Fructose-6-phosphate 2-kinase/fructose-2
  Pfam annotation: Domain name=PGAM; Domain location=1-84; Score=-8.3; E_value=0.018; Accession=PF00300.12; Description=Phosphoglycerate mutase family
MAPRVLRNLDEIYAGVCDGMTYDEIRTAYPREYELRRQNKLSYRYPRGESYLDVIARLDPLIQELESYREDVLIVGHQGVLRLIYAYFAGLNRDEAATLSIPLNTVMKLTPRTHDCIEERFLLHDPNENNEPLDPPSN

SEQ ID NO: 145944 - protein, 85 aa, Glycine max
  Coding DNA Sequence Number=SeqID_29166
MGQKATKRKNKGKGVGTSTNLVDLTGVEEAMRKRNVLNAKLVALREKELEKEYYDILMNNIFTMSETQLEDHQAFYKIIRHKLGI

SEQ ID NO: 145945 - protein, 86 aa, Glycine max
  Coding DNA Sequence Number=SeqID_29167
MKHTPPHTYSQNNSKGNIGSKGLSKELIQGRLIWLEAYKNKMPKSSPNMDMKQEVSTRVKPRLLCKQSMGQNTPNKIDDDGSNSHQ

SEQ ID NO: 145946 - protein, 126 aa, Glycine max
  Coding DNA Sequence Number=SeqID_29168
  Gene Ontology: Mol. function=anthranilate synthase activity; Biological process=folic acid and derivative biosynthetic process
  Homolog annotation: Hit_ID=Q6TAS3; Match level="QueryCoverage=96%, HitCoverage=14%, E-value=7e-28, Identity=49%"; Hit description =Aminodeoxychorismate synthase/glutamine amidotransferase
ALGYVHGAQIVHASEPIHGRLSEVEHNGCQLFHDIPSDSESLPEELIPIAWTSSTSTLPFIGSKDFGKFNTHEVQPDQSIFIDPFLAKVGSGSSNQFDYGKTRSARVLMGIKHSTRPHYGVQVSSA

SEQ ID NO: 145947 - protein, 521 aa, Glycine max
  Coding DNA Sequence Number=SeqID_29169
  Gene Ontology: Mol. function=anthranilate synthase activity; Cellular component=cytosol; Biological process=folic acid and derivative biosynthetic process
  Homolog annotation: Hit_ID=Q6TAS3; Match level="QueryCoverage=96%, HitCoverage=55%, E-value=0.0, Identity=64%"; Hit description =Aminodeoxychorismate synthase/glutamine amidotransferase
  Pfam annotation: Domain name=Anth_synt_I_N; Domain location=42-194; Score=90.9; E_value=3.9e-24; Accession=PF04715.3; Description =Anthranilate synthase component I, N terminal region
  Pfam annotation: Domain name=Chorismate_bind; Domain location=248 -512; Score=296.6; E_value=4.8e-86; Accession=PF00425.8; Description =chorismate binding enzyme
  Pfam module annotation: Pfam domain module=Anth_synt_I_N::Chorismate _bind; Domain location=42-194::248-512
MKHLEMFNMVNTPHATTGSKCLKLKWRKFGHLAGQVGGAKSIFCGLFGHEAENTFWLDSSSTEKGRARFSFMGGKGGSLWKHLMFRLSHQSDGSSKGGGYLSTEDSQGSAETIFLEEGFLDFLNKELQSYHYGKNECEGLPFDFHGGYVGYIGYDLKVECGVKSNRHKSKTPDACFFFADNLVAIDHKNDDVYILAIHEESSSITQWLDDTEEKLLSLNGSVRVALEIQNSHPLTFYSCKAGLAAEKSREQYIEDVKKCLNYIKDGESYELCLTTQIRKPIEELNSLGLYLHLRERNPAPYAAWLNFSKENLSICCSSPERFLQLDRKNILEDKPIKGTIARGATKEENELLKLKLQFSEKDQAENLMIVDLLRNDLGRVCDPGSVHVPRLMDVESYATVHTMVSTIRGKKRSDVSAINCVKAAFPGGSMTGAPKLRSMELLDSIESCSRGIYSGCIGFFSYNQRFDLNIVIRTVIIHEGEASIGAGGAIVALSNPEDEYEEMVLKFCLELICQRNSFFLS

SEQ ID NO: 145948 - protein, 70 aa, Glycine max
  Coding DNA Sequence Number=SeqID_29170
MPEVVKYIKDTIGVWHNDIVKIASDLIGNNEFFMQPDVGTLESSGASGTGTRPESLTFGNKRSRYTQFFN

SEQ ID NO: 145949 - protein, 188 aa, Glycine max
  Coding DNA Sequence Number=SeqID_29171
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=3e-24, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTNALAFRGLHALSFRGLHVLTIRRLHALAFRGLHVLTFRGLHVLTFRGLHALTYRGLHVFTFGGLHALAFRGLHFLPLHALAFRGLHILTYRGLHALAFRGLHVLAFRGLHALAFRGIHFLVLRGLRALAFRGLHVLAVRGLHALSFKGRHVLNFRGLHSLTFRGIHVLTFSGLHIRTLREFKVLCP

SEQ ID NO: 145950 - protein, 303 aa, Glycine max
  Coding DNA Sequence Number=SeqID_29172
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=52%, HitCoverage=48%, E-value=8e-34, Identity=45%"; Hit description =Similarity to MADS-box DNA-binding protein
  Pfam annotation: Domain name=SRF-TF; Domain location=9-60; Score =36.1; E_value=1.2e-07; Accession=PF00319.9; Description=SRF-type transcription factor (DNA-binding and dimerisation domain)
MAPGKLKLTFIGNDFKRKNVCKKRKQSLLKKTEELSMLCGVEACAIVYGPNDPRPVIWPSELGVENVLRKFMSMPQLEQSKKMVNQESFIAQRIMKSKEKLQKIVKENKEIEMSLFMAHCFKTGMFQPDINMTTADMNVLSSIIEQNLKDIDKRMEMLKANQVIPNQPDVETSTLQPQIMHTLTYQPPMQTFAFQPQIQISEFQTQIQTPEFPTQTYQSKMQTQTFQPQMQSPALFQPRMQSPAFFQPQIMQTPSYQPHTQTPALEDMTLLNYGNGLGMQMQQFNGNGYETTMPAFGGANFPL

SEQ ID NO: 145951 - protein, 79 aa, Glycine max
  Coding DNA Sequence Number=SeqID_29173
MKKGLNIVSIGVIMEVDEAIFLGYSLHSKAYRVSQPTLRQEGNARLTGASSKGGRCTESPPTFIRVKRQKNRKGVVYEL

SEQ ID NO: 145952 - protein, 139 aa, Glycine max
  Coding DNA Sequence Number=SeqID_29174
MTEIPSIGHTYEVGTSGKPLIHHPSMRTITQIWANFLLANVILKTHESDINMDKAHLIWCIIQGLQVDVVAIISYKMQRIITHHQQLVAPLDLWDIWHSSLDCANFMGKEAAGVDDADEGEDKEEEEEVFDNVFHQGDN

SEQ ID NO: 145953 - protein, 81 aa, Glycine max
  Coding DNA Sequence Number=SeqID_29175
MSFKGVGHKSLDTLMEIPKEEETLEELREGSKVEEPKLLSKMLYQHLKYVFLEENGDKPIIISSFLTIFKEKKLVEVLRAN

SEQ ID NO: 145954 - protein, 316 aa, Glycine max
  Coding DNA Sequence Number=SeqID_29176
  Gene Ontology: Mol. function=DNA binding; Cellular component=nucleus; Biological process=regulation of transcription, DNA-dependent
  Homolog annotation: Hit_ID=Q71KV1; Match level="QueryCoverage=99%, HitCoverage=99%, E-value=2e-62, Identity=41%"; Hit description =Transcription factor Myb
  Pfam annotation: Domain name=Myb_DNA-binding; Domain location=13-51; Score=30.6; E_value=5.7e-06; Accession=PF00249.21; Description=Myb -like DNA-binding domain
  Pfam annotation: Domain name=Myb_DNA-binding; Domain location=57-102; Score=46.8; E_value=7.1e-11; Accession=PF00249.21; Description=Myb -like DNA-binding domain
  Pfam module annotation: Pfam domain module=Myb_DNA-binding::Myb_DNA -binding; Domain location=13-51::57-102
MGHRCCSKQKIKRGLWSPEEDEKLLRYINTHGQKSLQRCGKSCRLRWINYLRPDLKRGSFTAEEEQIIIDIHRILGNRWAQIAKHLPGRTDNEVKNFWNSCIKKKLISQGLDPQTHTLLSSHRRSSVCTISNIHQNSNSIFIMSSHIPNAPLENTSKTFSTLPKPPANIVQIPSVDVSSEFQTTTSNNGEPRQHLTYELLMENAITNICSPTYMNPSAVELFNNDNNVNWVSTVNVEDFSAQTLEEGTQVQVQVQHEKDKTCEDMGIDVREANNGNIETSASFESSNFDFGLLESVLTSEFISYDFNCMDELAWNF

SEQ ID NO: 145955 - protein, 41 aa, Glycine max
  Coding DNA Sequence Number=SeqID_29177
MSIRLAFSTIKHFSSAAKEMTVKETLNSALDDEMLVDPKFE

SEQ ID NO: 145956 - protein, 61 aa, Glycine max
  Coding DNA Sequence Number=SeqID_29178
MSAYSPFAKHEPCAKLIFGHALSRESQALSAQPLHLRLIHSAKLAKAKLSLIEFDLNLAKQ

SEQ ID NO: 145957 - protein, 168 aa, Glycine max
  Coding DNA Sequence Number=SeqID_29179
  Homolog annotation: Hit_ID=UPI00005F86CB; Match level="QueryCoverage =62%, HitCoverage=69%, E-value=1e-09, Identity=34%"; Hit description =COG2197: Response regulator containing a CheY-like receiver domain and an HTH DNA-binding domain
  Pfam annotation: Domain name=GerE; Domain location=106-163; Score =18.0; E_value=8.7e-05; Accession=PF00196.10; Description=Bacterial regulatory proteins, luxR family
  Pfam annotation: Domain name=HTH_10; Domain location=109-153; Score= -9.5; E_value=0.076; Accession=PF04967.3; Description=HTH DNA binding domain
  Pfam module annotation: Pfam domain module=GerE::HTH_10; Domain location=106-163::109-153
MERINIVIDDDNAYFVAGLRFSITEYAEKNHKTADMVIAASMWRAQRWRKMNPCEAVSAIMTIKEKRVGRVNESESVLYRTDNRSRLFELLAKSLVKNSAEKQLLGYVLTSREKQVIGFLKRGFDQSQTAKLLGINVKTVHSHKRSVMKKLMLNRQREFMYWLISQDD

SEQ ID NO: 145958 - protein, 227 aa, Glycine max
  Coding DNA Sequence Number=SeqID_29180
  Homolog annotation: Hit_ID=O21999; Match level="QueryCoverage=24%, HitCoverage=36%, E-value=2e-21, Identity=85%"; Hit description=LacZ -alpha
MVKVGTSYVPINVSFSPKVGPGLPGINRDTRIYLFCEVLQWLLFLSAVPPVQLLTGWCVTAKAPPDISAGKCSGRVPFAIQVAQLLGRAIGAGLFVITPAGERGMCCKAIKLGNARVFPVTTLNSICKDCHRVKISYTKTVSRVFASTSSPLPILKFMDVSYQAYLYRPPLGGARKPVVPTALMNRPTRGERRFAYWALTECILTYYVGSDEGVTEMLHVAGEKRLH

SEQ ID NO: 145959 - protein, 43 aa, Glycine max; identical to SEQ ID NO: 122045
  Coding DNA Sequence Number=SeqID_29181

SEQ ID NO: 145960 - protein, 168 aa, Glycine max
  Coding DNA Sequence Number=SeqID_29182
  Gene Ontology: Cellular component=nucleus; Biological process =response to oxidative stress
  Homolog annotation: Hit_ID=Q1SSK6; Match level="QueryCoverage=99%, HitCoverage=100%, E-value=1e-42, Identity=52%"; Hit description=Heat shock protein Hsp20
  Pfam annotation: Domain name=HSP20; Domain location=38-148; Score =97.7; E_value=3.6e-26; Accession=PF00011.11; Description=Hsp20alpha crystallin family
MSLFAPLLLNQSDPFDHFRALLGGNSESLDLGAYTQMDWKETLDAHVFEIDLPGFAKEDVKLGVKENRVLCIKAEKKAEQEEQEEKTKLKWHCRERRSSGVVSREFRLPENSKVDGVRASMCDGVLTVTVPKDESETLKKHKKEVQIFEEDGEGVAPKGIGRFVCCKS

SEQ ID NO: 145961 - protein, 211 aa, Glycine max
  Coding DNA Sequence Number=SeqID_29183
  Homolog annotation: Hit_ID=Q6Z1Z7; Match level="QueryCoverage=61%, HitCoverage=40%, E-value=1e-09, Identity=30%"; Hit description=PWWP domain protein-like
MAGNSFPGGRNSSVVNNEILQQPFACFPPMAGCNSQEPCGFNPLRQLEYGQNDMYLSSRGPQPNLQLQPANSPFAPRHMHPAQPLNPSNQYSYPNPTIQQHLPHSLHPFFSLPSLPDGQRQFVANEQWRMSSSEGLWIGRNPSCPTPAFGQEGNTINGEKKLTSTVEQHLQWRSSMPPKGGEEEEECNDVEETVARRTKRATKKKKKKRNN

SEQ ID NO: 145962 - protein, 253 aa, Glycine max
  Coding DNA Sequence Number=SeqID_29184
  Homolog annotation: Hit_ID=Q1SVP9; Match level="QueryCoverage=54%, HitCoverage=31%, E-value=1e-31, Identity=54%"; Hit description =Immunoglobulin/major histocompatibility complex; Tetratricopeptide- like helical
  Pfam annotation: Domain name=PPR; Domain location=117-151; Score =28.7; E_value=2.1e-05; Accession=PF01535.11; Description=PPR repeat
  Pfam annotation: Domain name=PPR; Domain location=189-223; Score =12.2; E_value=0.27; Accession=PF01535.11; Description=PPR repeat
  Pfam module annotation: Pfam domain module=PPR::PPR; Domain location =117-151::189-223
MAMTDAMIEVALISGRKVEAEKVQMIEESMKVEGLGVATLRVVGEVIKDNERGGGGGGKDGRGGGEGGESSGNGGEPSRISVKQTPENLKSVVCDSHPVPKSPDRNIPYQYILEHGDFYNSLVISLIRIKKLEEAEKLFKEMLAGDVRLDTLASSLLLKELCMKDQILDGFYLLEAIENKGFLSSIDSDIYSILLIGLCQRSHLKEATKLAKIMLKKSVLLRPPHKDAAIDILIKFGEKDLVNQLTGIHKKEL

SEQ ID NO: 145963 - protein, 99 aa, Glycine max
  Coding DNA Sequence Number=SeqID_29185
  Homolog annotation: Hit_ID=Q1RYJ3; Match level="QueryCoverage=47%, HitCoverage=7%, E-value=2e-07, Identity=65%"; Hit description=FAR1; Zinc finger, SWIM-type
MEFASLEGTTNHYTSTWLEAILGAYPKTVITDQDTAFTNTCAKCIPKEKGFSLPAQYILSRWTINAKKEKAKGLASEDFHEDNNEASGIQELMRRLDLL

SEQ ID NO: 145964 - protein, 424 aa, Glycine max
  Coding DNA Sequence Number=SeqID_29186
  Gene Ontology: Mol. function=transferase activity, transferring hexosyl groups; Cellular component=intracellular; Biological process= metabolic process
  Homolog annotation: Hit_ID=Q1SVP9; Match level="QueryCoverage=98%, HitCoverage=93%, E-value=1e-153, Identity=66%"; Hit description =Immunoglobulin/major histocompatibility complex; Tetratricopeptide- like helical
  Pfam annotation: Domain name=PPR; Domain location=112-146; Score =39.3; E_value=1.3e-08; Accession=PF01535.11; Description=PPR repeat
  Pfam annotation: Domain name=PPR; Domain location=147-181; Score =35.4; E_value=2e-07; Accession=PF01535.11; Description=PPR repeat
  Pfam annotation: Domain name=PPR; Domain location=182-216; Score =33.5; E_value=7.1e-07; Accession=PF01535.11; Description=PPR repeat
  Pfam annotation: Domain name=PPR; Domain location=218-252; Score =48.7; E_value=1.9e-11; Accession=PF01535.11; Description=PPR repeat
  Pfam annotation: Domain name=PPR; Domain location=253-287; Score=1.3; E_value=5.3; Accession=PF01535.11; Description=PPR repeat
  Pfam annotation: Domain name=PPR; Domain location=288-322; Score =21.6; E_value=0.0027; Accession=PF01535.11; Description=PPR repeat
  Pfam annotation: Domain name=PPR; Domain location=360-394; Score =12.2; E_value=0.27; Accession=PF01535.11; Description=PPR repeat
  Pfam module annotation: Pfam domain module=PPR::PPR::PPR::PPR::PPR::PP R::PPR; Domain location=112-146::147-181::182-216::218-252::253 -287::288-322::360-394
MVKPKLDSQSIIQVLNTCPPQLGVRFFVWAGFQSGYRHSSYMYTKASNLLRIHHNPQIIRDVIESYEAEGSLVTVNMFREVLKLCKEARLADMALWVLRKMEDTFNLHADTVMYNLVIRLCCKKGDIETALKLTSEMSSNDLCPDLITYMAIVEGFSNAGRSEEAYSVLKVMRLHGCSPNLVILSAILDGFCRSGSMERALELLDEMEKGGVCTPNVVTYTSVIQSFCKRGQWKEALDILDRMKAFGCHANHVTVFTLVESLCAGGHVEQAYGLFDKFVVEHGVSYGDFYSSLVISLMRIKKLEEAVKLFKEMLAGDARLDTLASSLLLKELCMKDRILDGFYLLEAIENKGCLSSIDSDIYSILLIGLCQRSHLKEATKLAKIMLKKSVLLRPPHKYAAIDILIKSGEKDLVNQLTGIHKKEL

SEQ ID NO: 145965 - protein, 179 aa, Glycine max
  Coding DNA Sequence Number=SeqID_29187
  Homolog annotation: Hit_ID=Q1S8Q1; Match level="QueryCoverage=84%, HitCoverage=15%, E-value=7e-49, Identity=66%"; Hit description=PWWP; Regulation of nuclear pre-mRNA protein
  Subcellular localization annotation: CTP_CleavageSite=53; ConfidenceScore=5.00e-01
MDLPVSLSASSSSLLSAQIFKSQIHFSGITGASYIPIAQGGLSHLLGAAAPPRDSARENCCQCLKVLRLWVERKIFPESVLRRYMDDIEVSNDDMTVSFSLKHPSRAEGSLDDPIREMEGMLVDLYGSCLAFYLLICLKKMKTMIFRVTHLQLMSVALLWIQKLLQLPRVTSAIVSWRM

SEQ ID NO: 145966 - protein, 204 aa, Glycine max
  Coding DNA Sequence Number=SeqID_29188
  Homolog annotation: Hit_ID=Q6Z1Z7; Match level="QueryCoverage=61%, HitCoverage=40%, E-value=8e-08, Identity=29%"; Hit description=PWWP domain protein-like
  Subcellular localization annotation: CTP_CleavageSite=57; ConfidenceScore=5.10e-01
MESSLQGNQIVQMARNSFPGGHNSSVVKNEILQQPSACFPPMTGCNSQEPCGFNPPRQLEYGQNDMYLNSRGPQPNLQLQSANPPFSPRHMHPTLPQNPSNQYSYPNPTIQQHLPHSLHPFFSLPSLPDGQRQFVANEQWRMSSSEGLWIGRNPSCPTPPFGQEGFQHANPSNMPAHPMSGYGVPQMSCRPNIPALNCWRPTRC

SEQ ID NO: 145967 - protein, 400 aa, Glycine max
  Coding DNA Sequence Number=SeqID_29189
  Gene Ontology: Mol. function=DNA-3-methyladenine glycosylase I activity; Biological process=base-excision repair
  Homolog annotation: Hit_ID=Q1SSK0; Match level="QueryCoverage=98%, HitCoverage=99%, E-value=1e-156, Identity=72%"; Hit description =Methyladenine glycosylase
  Pfam annotation: Domain name=Adenine_glyco; Domain location=211-389; Score=275.0; E_value=1.4e-79; Accession=PF03352.4; Description =Methyladenine glycosylase
  Subcellular localization annotation: CTP_CleavageSite=40; ConfidenceScore=5.14e-01
MCGSKTKVTIGLEVIAAAATTTTAKPSVARINGRPVLQPTCNRVPNLERRNSIKKVAPAKSLSPPSPPLPSKTSLTPPVSPKSKSPRLPATKRGNDNNGLNSSYEKIVIPRSSIKTPTLERKKSKSFKEGSCVSASIEASLSYSSSLITDSPGSIAAVRREQMALQQAQRKMKIAHYGRSKSAKFERVVPLDPSNTSLASKPTEEEKRCSFITANSDPIYIAYHDEEWGVPVHDDKMLFELLVLSGAQVGSDWTSTLKKRLDFRAAFSEFDAETVANLTDKQMMSISSEYGIDISRVRGVVDNANQILEIKKDFGSFDKYIWGFVNHKPLSTQYKFGHKIPVKTSKSESISKDMVRRGFRYVGPTVVHSFMQASGLTNDHLITCHRHLQCTLLAARSFVP

SEQ ID NO: 145968 - protein, 188 aa, Glycine max
  Coding DNA Sequence Number=SeqID_29190
  Gene Ontology: Mol. function=enzyme inhibitor activity
  Homolog annotation: Hit_ID=Q1S1D0; Match level="QueryCoverage=78%, HitCoverage=84%, E-value=1e-24, Identity=40%"; Hit description =Pectinesterase inhibitor
  Pfam annotation: Domain name=PMEI; Domain location=37-181; Score =33.5; E_value=7.4e-07; Accession=PF04043.6; Description=Plant invertasepectin methylesterase inhibitor
MNASALCSLMLTLCLILISYSLLLANAKANGDHCLLGNSQQMIDQICNQTSQNENECLKILKADPKIVQAKDYFEISKAILKLATKKAKEGQHFLKGLAHKTGSAAIALCANQWYPYTVGSFGSALGELKESPDTANYDAKVAGDGPVYCDEAIAKAHIVNPAISALNHKTSLLSFIAFLATNCLSEE

SEQ ID NO: 145969 - protein, 290 aa, Glycine max
  Coding DNA Sequence Number=SeqID_29191
  Gene Ontology: Mol. function=zinc ion binding; Cellular component =integral to membrane; Biological process=behavior
  Homolog annotation: Hit_ID=Q1RYL8; Match level="QueryCoverage=85%, HitCoverage=58%, E-value=1e-104, Identity=75%"; Hit description=Zinc finger, DHHC-type
  Pfam annotation: Domain name=zf-DHHC; Domain location=127-191; Score =121.2; E_value=2.9e-33; Accession=PF01529.11; Description=DHHC zinc finger domain
MAASRDQSFKFICGGRLVFGPDARSLFVTLLLIIVPVIIFCICVARHLRHELSSYNSGYAILAVAILFTVHVLVVLFLTSSGDPGIVPRNPHPPEEEFRYDSSVSVDAGGAGRQTPSLQFPRTKEVVVNGIAVKVKYCETCMLYRPPRCSHCSICNNCVERFDHHCPWVGQCIGLRNYRYFFMFISSATILCIYVFSLSAFYIKVLMDNYDGTVWKAMKESPASVILMAYCFISLWFVGGLTGFHLYLIGLNQCTFRLSIKKVKWDDLRGINSTLLYLKLQVNELKSNIR

SEQ ID NO: 145970 - protein, 75 aa, Glycine max
  Coding DNA Sequence Number=SeqID_29192
MYRIKSQKDAKDRKNMKKEDFGIRFNENYPLIAQSAHREAQAKCVSPRRAQCVTRKHALVLSEKSRAKHKYRHPY

SEQ ID NO: 145971 - protein, 33 aa, Glycine max
  Coding DNA Sequence Number=SeqID_29193
MALQHLHRQKGGHFSMLFSGHQILVAKMDGSRN

SEQ ID NO: 145972 - protein, 415 aa, Glycine max
  Coding DNA Sequence Number=SeqID_29194
  Gene Ontology: Mol. function=RNA-directed DNA polymerase activity; Cellular component=nucleus; Biological process=RNA-dependent DNA replication
  Homolog annotation: Hit_ID=Q2HRL2; Match level="QueryCoverage=87%, HitCoverage=91%, E-value=2e-79, Identity=40%"; Hit description=RNA -directed DNA polymerase
MVRLWNKLKRLQHDMRRFNKPLSNLKQNLIKAREDLQFAQENLRNNNMNGDSIDRVRQLTEEVINLNELEEKMLMQRAKVDWIRKGDGNNSFFHAIIKSRNNRRNIYMLQKTDGTLLENQSEIEDEIMDFYKKLMGTEDSQLHHIDIDAMRNGKQVNMEQRRYLVSNITEQDIERALKGIGDDKSPGIDGFGAKFLKASWCIVKEDVIAAILEFFNTGRLYRGFNNTVVTLIPKGDNARYVKDYRPIAGCTTVYKIIAKIITERLGKILPSIISHSQAAFVPGQNIHNHILLAYELLNGYGRKGGTPRVMMQLDLHKAYDMVNWRAMECILKEIGLPMQFVSWIMTSVSTVSYRFNVNGIYSDIMQAKRGIRQGDPMSPMLFVIIMEYMHRTLGKMQQNPDFNHHSKWGIVNLYL

SEQ ID NO: 145973 - protein, 173 aa, Glycine max
  Coding DNA Sequence Number=SeqID_29195
MHEEAQRLAVLNKKLKSKLKLHITKLASTQGEVNKLKQENEKVVSSCKATGCDYTSTSFYMDDHKSLQTKFENFKMDHYAKRMKLQTELSYHKDMFEKLNKGKSNLNHMLTVQKHTTDKTSLAYNMQTTFSKKTKFVSSKGVCLKAKDSLWYLDSGYSRHMASDKSKLSDFVS

SEQ ID NO: 145974 - protein, 56 aa, Glycine max
  Coding DNA Sequence Number=SeqID_29196
MEREKRIARRQYIWSLQCLLRLSNVWELYRSSRRKNWRNLRKPLEMSLSLSEDTDP

SEQ ID NO: 145975 - protein, 63 aa, Glycine max
  Coding DNA Sequence Number=SeqID_29197
MFGRYNLDIATEIYSVAVFNYISVATSMAKVLLFFYMYSNRNSHRSLQRPSNSVANSVADTRK

SEQ ID NO: 145976 - protein, 115 aa, Glycine max
  Coding DNA Sequence Number=SeqID_29198
  Gene Ontology: Mol. function=proline:sodium symporter activity; Cellular component=integral to membrane; Biological process=sodium ion transport
  Homolog annotation: Hit_ID=Q6CZD4; Match level="QueryCoverage=60%, HitCoverage=14%, E-value=1e-23, Identity=70%"; Hit description =Sodium/proline symporter
MWSRMTRNGALAGMLVGAVTVIVWKQYEWLGLYEIIPGFILGCLAIVVVSLMGRRPSATMTERFDQAEAEAGGRADRQPDRQLPETHAAQPMAGRGVGRRDCRRGAVSGARHLHQ

SEQ ID NO: 145977 - protein, 298 aa, Glycine max
  Coding DNA Sequence Number=SeqID_29199
  Gene Ontology: Mol. function=hydrolase activity, acting on ester bonds; Cellular component=cellular_component; Biological process =lipid metabolic process
  Homolog annotation: Hit_ID=UPI000004839A; Match level="QueryCoverage =89%, HitCoverage=91%, E-value=7e-45, Identity=35%"; Hit description =carboxylic ester hydrolase/ hydrolase, acting on ester bonds / lipase
  Pfam annotation: Domain name=Lipase_GDSL; Domain location=37-279; Score=92.8; E_value=1.1e-24; Accession=PF00657.12; Description=GDSL -like LipaseAcylhydrolase
MAGSISLLEFSLVIFIQIMTHCHSSITTCLPEKHAALFILGDSLFDNGNNNYINTTTSYQANYPPYGETFFKYPSGRFSDGRMIPDAVAELAKLPILPPYLHPGHVEYVYGVNFASGGAGALRETSQGMVIDLKTQEIYNIGGKKFGFLNVPPIGCSPAIRILVNNGSTCFEEFSAIARLHNNALSKRLHELEKQLKGFKYSVMDFYSAFSQVFNNPTKYGFKVASVGCCGSGPYRGVDSCGGNKGIKEYELCDNVNEHLFFDSHHLTDRASEYFAELIWNANRTVTSPYNLKQLFEL

SEQ ID NO: 145978 - protein, 231 aa, Glycine max
  Coding DNA Sequence Number=SeqID_29200
  Gene Ontology: Mol. function=transferase activity; Cellular component= nucleus; Biological process=DNA integration
  Homolog annotation: Hit_ID=Q1RU49; Match level="QueryCoverage=98%, HitCoverage=37%, E-value=1e-45, Identity=52%"; Hit description =Polynucleotidyl transferase, Ribonuclease H fold
MVNEAKLFISSYFDMKDIGKADVILGVKIRKDYNGFSLCQTHYIEKILKKFNCYAEFPVKTPYDPSIHLKKNKGSSVSQAEYAKIIGSVMFLMNCTRPDIAYVVSRLSRYARNLGSKRWIALRRLLKYLKGTMDWCLHFCKFPVVLEGFYDANWVTDNDEATIGIAMNNVYNGKRRHIRIRHGLIRELLKNGVISLEFVRSERNLSDPLTKGLTRKLVLELLRKMGLKPLC

SEQ ID NO: 145979 - protein, 160 aa, Glycine max
  Coding DNA Sequence Number=SeqID_29201
  Gene Ontology: Mol. function=DNA binding; Cellular component=nucleus; Biological process=regulation of transcription
  Homolog annotation: Hit_ID=Q9FFI5; Match level="QueryCoverage=84%, HitCoverage=28%, E-value=8e-63, Identity=79%"; Hit description=NAM (No apical meristem)-like protein
  Pfam annotation: Domain name=NAM; Domain location=6-134; Score=320.0; E_value=4.3e-93; Accession=PF02365.6; Description=No apical meristem (NAM) protein
MAPMSLPPGFRFHPTDEELVAYYLERKITGRSIELDIIAEVDLYKCEPWDLPDKSFLPSKDMEWYFYSPRDRKYPNGSRTNRATQAGYWKATGKDRPVHSQKKQVGMKKTLVYYRGRAPHGIRTNWVMHEYRLIESVPGATLSSLKGIYMRYKNLYKSPI

SEQ ID NO: 145980 - protein, 441 aa, Glycine max
  Coding DNA Sequence Number=SeqID_29202
  Gene Ontology: Mol. function=nucleic acid binding; Cellular component= intracellular; Biological process=DNA integration
  Pfam annotation: Domain name=RVP; Domain location=173-280; Score= -12.3; E_value=0.063; Accession=PF00077.10; Description=Retroviral aspartyl protease
MLMNVLRMISDMLKLEPLDVTNYRRWSQKLLILFEALEVDYVLSEDPLADPVSLANPSPATPVVTPLFEGTKKLDEEAKKKYEKDNKTIRVMMMLEKENMWFKGKGKEKKFQKNGQQKNHIGINRGDNKIQKKKLICYVYSKTCHKAYPCYMRQGQQNQNQKPAAPFAPQAHLTGNEEVIVVVVVEANLVDNKVDWILDTGASKHLCSNKELFHHFEDVVDGECVFMGNSATTRVLGKGKILLKHTFGKTLSLSDVLYVPSLCRNLIFGSLLNRAGLKLVFEVDKVVITKYGNFVEKGYLVDGLFVLNSIYVASNANSSTGCAYIIESVDLWHNWLRHVNVASIKKLKNMNLINVPYVNKLSKCPICVEAKYAKKPFKPITNRTTELLGLIHTNLADFKNTVSRGGKGDYVTFIDDFSRYAKVYLLRSKNEVEEMFLKYKA

SEQ ID NO: 145981 - protein, 345 aa, Glycine max
  Coding DNA Sequence Number=SeqID_29203
  Homolog annotation: Hit_ID=Q01AS2; Match level="QueryCoverage=58%, HitCoverage=7%, E-value=3e-09, Identity=21%"; Hit description=[Z] KOG0239 Kinesin
MFCIVAASFQPVEGGVWTSQAKQRVLDKRHVEVLLDVRFAGYFAGGRGVWRPEREWAEAKQELNEERENVRRFTSDRDQTLKNSLRQVEDMSKELANALRAVASAESRAAVAESSQMVKINFKLYTQAKLSGLQRKMGSTDDKLGKLHIAVKRATLWTRLSPELVEIGGVSGSSTLSSDEVVAELQKAKDEIEKWKEEAHANKAHMLQYKSIAEVNEDALKEIEKAHEKFKTEADNGKKVLESELNSLREKMLEIENESSLKYEEVASETVGKEEALTSAMAEITNLKEEILTKSSQISAMEIQISGLKENLDREHQKWRATQTNYERQLIMAALAVGRCNEGGT

SEQ ID NO: 145982 - protein, 72 aa, Glycine max
  Coding DNA Sequence Number=SeqID_29204
MVSNKRVLILLKNFYASRVHQQDEETHDTHVVSSNAKSVNKDKNALDSKLPILTPEAREATEKNDAKNKDKV

SEQ ID NO: 145983 - protein, 280 aa, Glycine max
  Coding DNA Sequence Number=SeqID_29205
  Gene Ontology: Mol. function=catalytic activity; Cellular component =chloroplast; Biological process=cellular metabolic process
  Homolog annotation: Hit_ID=Q8SKU2; Match level="QueryCoverage=89%, HitCoverage=48%, E-value=1e-64, Identity=64%"; Hit description=Tic62 protein precursor
  Subcellular localization annotation: CTP_CleavageSite=73; ConfidenceScore=5.49e-01
MIKTIHKLHNSPSHSQSQRHPSTYAYGGFLRTVTIPSNLSRREATEKPSVSHVNLSHFTRYPGTSRATKHKIPATMNAACSAKTITATAEGISEKTDSKDDNLVFVACATGRVGSRSVRELIKLGFRVRAGVQNAQRAGALVQSVEQLKLDGASGGGASPAVEKLEILKCDLEKPDTIGYASKVICSIVASEKGGFHITAPFQFPKDYQVTKNLIEAVINLHCPNVENTKIQNVCSFYLAATVAKFVLGIPDLEKEGRRSIAGQWTSIRNSENWMYGAAY

SEQ ID NO: 145984 - protein, 113 aa, Glycine max
  Coding DNA Sequence Number=SeqID_29206
MSSPANFTLEMSSTRHDRCVMQIPHLGVKNELKTKWEDEKAQLEKSRNDAEKKYNEINEQNKILHSQLEAFHIQWAEKERNAAGISSGSSSADAFGDAGLQNVINYLRRSKEI

SEQ ID NO: 145985 - protein, 147 aa, Glycine max
  Coding DNA Sequence Number=SeqID_29207
  Homolog annotation: Hit_ID=Q01AS2; Match level="QueryCoverage=97%, HitCoverage=5%, E-value=2e-08, Identity=26%"; Hit description=[Z] KOG0239 Kinesin
MLETALKAAESAHASLETERAKSRSFLFTEEEFKALQLQVREMNLLRESNMQLREENKHNFEECQKLRELAQKVRAETENLENLLKEREIKLDGHTKEIETLKMEKDHLNKKVTELLERSKNVDVEDYDRVKKLAKEIQASVNLEVV

SEQ ID NO: 145986 - protein, 223 aa, Glycine max
  Coding DNA Sequence Number=SeqID_29208
MDELRRRAIGFIQMKELFEYRNKDKIEELVQKGCLNDFIRGNNFNHGEYHGGRGGCLGGYRGGYIKGHGNYNQQQVEESEQQQQETFMGQFEESSTPSINSMQIKKTSPRSLPAIMFTNVDFVRNDPTQDDLMVVRCPSQSYSTSLETDDRFCRRTCAHGKLSQSLVVPYVLVDMDTSYNLMLGKPMLNSIGAIVSTPHLTKKFSSTSRDIVMIKADHWDARE

SEQ ID NO: 145987 - protein, 660 aa, Glycine max
  Coding DNA Sequence Number=SeqID_29209
  Homolog annotation: Hit_ID=A0CFE1; Match level="QueryCoverage=44%, HitCoverage=70%, E-value=2e-11, Identity=23%"; Hit description =Chromosome undetermined scaffold_175, whole genome shotgun sequence
ANLKLDSEKHRKLLAQFKKRIDVLSREKEDLGKENQQLSRQLDEIKQGKRSTSDTTGEQAMKEEKDTRIQILEKHLERLRDELKKEKEESRLEKSRRLKTEKAIKDSYNNVEQEKIKSINEIERYKESLKRLSDEVEKLKIVIGNLPEGSNVVQLLSGSNVDDFAAPYISAVESFEKEAQSVFRELGGRGNLGDAATVTDGSAAATGSLVHPQPQGITFSAAPGASGLPPKASGESEKRLALPKASVETRRAGRRLVRPKLLRPEELQGGDTEMSDAEGPGGKPGPSSDTETSSVVQSSQQLARKRVAPTSTSELREESVAPGEKSSDVLKKSKGSESPEENTEEQPAATLEFTGSHPVTEELLDSSDMPQGQNEEVGDAQNEDGEIAVGNDEESKDPQNLDVTGQEELQGDKTGTLEENPDQPVDAKMLSDEMQRDQTDPDNQQSTLAPSGEREEGELLPDIGDLEGASDLSNIAENQESREGLSESAATPERSPATVDDDALEAGEINSPELSSDDKNDEGDSVEDAADASDKLMDVNEQISAESDQVAEPTPVASEGATLTSSVVESSSSKVNLPVPRQGTPNAPAETEETKQASPIGSTSTTIILSERARERAQMRQAGLVSSTLRGRGRGGAPRGRVGRGRGVVRRPPPPPGSDQ

SEQ ID NO: 145988 - protein, 125 aa, Glycine max
  Coding DNA Sequence Number=SeqID_29210
MTKNINLIQSKKVCFRRLFQRREGVQVLGSNFVISRDTMFDEQSMMPQTIETYVPVPDEAFPSSVDVHPHNPRLEATPVAKPRRLATSDGPQEYNLVKDREPCSIKLVVRDGFEDSSTFQEATNN

SEQ ID NO: 145989 - protein, 72 aa, Glycine max
  Coding DNA Sequence Number=SeqID_29211
  Gene Ontology: Mol. function=transferase activity
  Homolog annotation: Hit_ID=Q1STT2; Match level="QueryCoverage=63%, HitCoverage=10%, E-value=4e-11, Identity=54%"; Hit description =Lipocalin
MGIWRLAHEKLTINKKGHHPSYVWRSIYACQILLKGGLRWSIGSGANINVWGEPWLRNNGRLYAINQLPGEI

SEQ ID NO: 145990 - protein, 145 aa, Glycine max
  Coding DNA Sequence Number=SeqID_29212
MSALNSTHFTSLRDQVLNVFKELQEILIKFLTLSIALISLTNTESGKLLFTEQHKLMMFLILTIVLYFLFASTGTILQIYKGNLLPLVIWVMLIVGGIVSVLALSFISATVAWITLAMWVGIFAVVAYDYSVPQRIMNWVKGPSS

SEQ ID NO: 145991 - protein, 112 aa, Glycine max
  Coding DNA Sequence Number=SeqID_29213
MAPKKLLSKRARKEAAGEGSSVAPRVDIEFDGYRSTPMHGPQRKESGISAPGFGANGSPLLRMPLINSWCIRWSWKRGNAMSSARGGARLQGLKRRPSANYCVFQGKTSPEV

SEQ ID NO: 145992 - protein, 511 aa, Glycine max
  Coding DNA Sequence Number=SeqID_29214
  Gene Ontology: Mol. function=pepsin A activity; Cellular component =cellulose and pectin-containing cell wall; Biological process =proteolysis
  Homolog annotation: Hit_ID=Q9LTW4; Match level="QueryCoverage=59%, HitCoverage=60%, E-value=1e-66, Identity=47%"; Hit description =Chloroplast nucleoid DNA binding protein-like
  Pfam annotation: Domain name=Asp; Domain location=112-510; Score= -101.0; E_value=1.2e-07; Accession=PF00026.14; Description=Eukaryotic aspartyl protease
MGRRMMQWNTITKASILVTITLLLILPVAVNSMRLELVHRHHERFAGGGGDVDRVEAVKGFVKRDKLRRQRMNQRWGVVSNYDSRRKGFEMTTTPAEVEMPMHSGRDDALGEYFAEVKVGSPGQRFWLVVDTGSEFTWLNCVMQNATTTTTTRKNKTKKKQQQHHHHVHKHHSKRNNRTRTRRTRKKKVKSSKSNKSDPCKGVFCPHKSKSFEAVTCASRKCKVDLSELFSLSVCPKPSDPCLYDIRHKHKKWHAPAGEPAAILSSIQPCYADGSSAKGFFGTDTITVDLKNGKEGKLNNLTIGCTKSMENGVNFNEDTGGILGLGFAKDSFIDKAAYEYGAKFSYCLVDHLSHRNVSSYLTIGGHHNAKLLGEIKRTELILFPPFYGVNVVGISIGGQMLKIPPQVWDFNSQGGTLIDSGTTLTALLVPAYEPVFEALIKSLTKVKRVTGEDFGALDFCFDAEGFDDSVVPRLVFHFAGGARFEPPVKSYIIDVAPLVKCIGIVPIDGIG

SEQ ID NO: 145993 - protein, 121 aa, Glycine max
  Coding DNA Sequence Number=SeqID_29215
MVNELIRDNNDDGGNGDTGSDEDDICGGSSIGNGDGDYDTGDHNNGGGDGSSVNGEKHVKCDVSTKFATRALSAVIPHSCEATFGTLRGCSQTKASTNSSGVQCSLLSCKMGYLVFSKLKL

SEQ ID NO: 145994 - protein, 61 aa, Glycine max
  Coding DNA Sequence Number=SeqID_29216
MANGQGCYVVCGQVLYLKGTKKPWKFLSLSYLECYKDALNRLSIIPKGTQHLEVVRAPYWI

SEQ ID NO: 145995 - protein, 179 aa, Glycine max
  Coding DNA Sequence Number=SeqID_29217
  Gene Ontology: Mol. function=nucleic acid binding; Cellular component= beta-galactosidase complex; Biological process=DNA integration
  Homolog annotation: Hit_ID=Q1SCY9; Match level="QueryCoverage=93%, HitCoverage=15%, E-value=5e-43, Identity=44%"; Hit description =Integrase, catalytic region; Zinc finger, CCHC-type
MAHLSFAYQLSYVPIPSYFQGGLKDPKWKFAMVDEMKALQKNFTWEIVELPNDKKMVGCKCVFSIKYKLDGSIDMYKFDMRNAFLHGDILEWVYMDLAPSFTPKGGKVCKLNKVLYGLKQSPRAWFGRFSHSMKKYGFKKAMEDHTLFYQKVGVVITLLIFYVDDMIVIGSNLCEIEEL

SEQ ID NO: 145996 - protein, 330 aa, Glycine max
  Coding DNA Sequence Number=SeqID_29218
  Gene Ontology: Mol. function=hydrolase activity, acting on ester bonds; Cellular component=cellular_component; Biological process =lipid metabolic process
  Homolog annotation: Hit_ID=Q9FLN0; Match level="QueryCoverage=98%, HitCoverage=94%, E-value=9e-82, Identity=43%"; Hit description=GDSL -motif lipase/hydrolase-like protein
  Pfam annotation: Domain name=Lipase_GDSL; Domain location=37-322; Score=163.9; E_value=4e-46; Accession=PF00657.12; Description=GDSL -like LipaseAcylhydrolase
MAGSISLLGFALVIFIQIMTQCHSSITTCLPEKHAALFILGDSLFDNGNNNYINTTTSYQANYPPYGETFFKYPSGRFSDGRMIPDAVAELAKLPILPPYLHPGNVEYVYGVNFASGGAGALRETSQGMEILSKSVYLFNIGANDYGSLLDPNSTSVLLPVDHQGFVDIVIGNLTDAIKEIYNVGGKKFGFLNVPPIGCSPAVRILVNNGSTCFEEFSAIARLHNNALSKRLHELEKQLKGFKYSVMDFYSAFSQVFNNPTKYGFKVASVACCGSGPFRGVDSCGGNKGIKEYELCDNVNEHLFFDSHHLTDRASEYFAELIWNANRTVT

SEQ ID NO: 145997 - protein, 63 aa, Glycine max
  Coding DNA Sequence Number=SeqID_29219
MKGRMHKYGFNNNKRKKPEKVRVVDDETGDKHQLDEVLRMPSTCVFLKIQYLYSITHPLATDY

SEQ ID NO: 145998 - protein, 81 aa, Glycine max
  Coding DNA Sequence Number=SeqID_29220
MLDQFHPCIHDSIENIVDVKADGNCGYRVIFALSDKFKELKLSLLVDGLSMVAIDKWMNIIDMGYVIASRYFSETVVPYRQ

SEQ ID NO: 145999 - protein, 71 aa, Glycine max
  Coding DNA Sequence Number=SeqID_29221
MAINSWGSRLNGGGCMNDKHFMWLRIRFEGGGGCMNDKQFMGLRIKFEGAGYTTALGNQFSGATDSMVEDA

SEQ ID NO: 146000 - protein, 60 aa, Glycine max
  Coding DNA Sequence Number=SeqID_29222
MEPLKDVGLNNGSILGFNKSPFSNGLGLELLLNNHEESIGKGLVGRDHSFNVWEVATNHT

SEQ ID NO: 146001 - protein, 127 aa, Glycine max
  Coding DNA Sequence Number=SeqID_29223
METEPHPPQQSPPVIASMHDERLQPHPQSFEFTKQPHHHQEDYRYNPHVLSASGEEFMSNLIGKDLRTLESANTYMQSMLIPSSTNHFIKEEQPVVSDEQLQPQEHGRVHRQPTRNRKSLRCGTGGH

SEQ ID NO: 146002 - protein, 184 aa, Glycine max
  Coding DNA Sequence Number=SeqID_29224
  Gene Ontology: Mol. function=protein dimerization activity; Cellular component=nucleus; Biological process=regulation of transcription, DNA-dependent
  Homolog annotation: Hit_ID=Q1SGY6; Match level="QueryCoverage=26%, HitCoverage=5%, E-value=1e-20, Identity=89%"; Hit description =Transcriptional factor B3; Auxin response factor; Aux/IAA_ARF _dimerisation
MDEVKGEIFFMKAKGTPSSDGFGGSFYHYFWDLVQQDGFNLVNYFFLGESAKVIHSRRFSLVWRKKPSTKASPVSYLQMTYIPSLDHMKLVTVYWEKVCHHAKEEGNEKNQLLLGTHRANRPQTVMPSSVLSNDIRWDESTVGERQPRVSLWEIEPLTTSPMYLSPFPLRLKRPWPPGLPSFHE

SEQ ID NO: 146003 - protein, 119 aa, Glycine max
  Coding DNA Sequence Number=SeqID_29225
MVVLIIIEARKEEGDSRTREVKEVTPKIKANLNLIKEVEIAAAKEVVVLVLVEEKAKRSGIKEMLNASIMEKRGHYAEECWYKEKNANDEAQFATGVVSNTEPVLLMVTTKTGADAEDQ

SEQ ID NO: 146004 - protein, 104 aa, Glycine max
  Coding DNA Sequence Number=SeqID_29226
  Gene Ontology: Mol. function=zinc ion binding
  Homolog annotation: Hit_ID=Q1RWM6; Match level="QueryCoverage=68%, HitCoverage=27%, E-value=1e-11, Identity=48%"; Hit description=Zinc finger, SWIM-type
MEPTFNYYYNMLMEEVDVDRVINWLSEIPREKWTLASDGGRRWGQMTTNLVGSINFKKSINLPIGALVKYTDVRGLFGKLQNEAYWPSCHESMISPRPRLEKKY

SEQ ID NO: 146005 - protein, 425 aa, Glycine max
  Coding DNA Sequence Number=SeqID_29227
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=45%, E-value=7e-85, Identity=46%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVRSMLKTKKLPHFLWSKAAATTVYILNKCPTKRLKGVTHEEAWTGTKPKVNQLRLFGSLCYKHVPEQLRQKLDDKGEQMILIGYHATRGYKLLNPRSKQVSVSRDVIFDELKEYEWKEDPINNTTKVMVDSIILEELSDTTDELPTRNTEGGTRRSQRVLQPSQMLKDYEVMKDSQITDEGDIVHFSLYADVEPRNPAGEVVKHKARLVAKGFLQKEGVDYGEIFAPVARIETVRLVVAIASMKGWSMYQLDVKSAFLNGSLEEEVFVKQPPGFEVVGHEGKVYKLKKALYGLKQAPRAWNKKIDSVLIQIGFSKCISEHGVYVYASSKNSSHDATKRILRYIRGTINYGILLPNTITSSNMELVGYTDSDWKRDNDDRKSTVGYIFLLGDALVSWSSKKQDPVAISTCEAKYIATSMCSCQGL

SEQ ID NO: 146006 - protein, 76 aa, Glycine max
  Coding DNA Sequence Number=SeqID_29228
  Homolog annotation: Hit_ID=Q1SRV3; Match level="QueryCoverage=42%, HitCoverage=11%, E-value=3e-08, Identity=90%"; Hit description =Pathogenesis-related transcriptional factor and ERF
EAASSGKLRMADEPFIVSAATSWARAAISAVAKLDDDGDGDGDNDDEEEGEGVLVLVFRVESDNSELAATAGSTMV

SEQ ID NO: 146007 - protein, 139 aa, Glycine max
  Coding DNA Sequence Number=SeqID_29229
MSVEQFIEKVAWPVARPSFVGDNESFTVQTPQQHEPEPQNDHSSKATIPGVIDFSKRRLETRSNEAGHPGPVSASADASFPGVDPSLPQHTTNSFTPVIEIHEGQTMPVLPLDTSLPATPIRHLTDEKDGQTQDQSQEF

SEQ ID NO: 146008 - protein, 59 aa, Glycine max
  Coding DNA Sequence Number=SeqID_29230
MEFESALSTLEDAVNDAPRAAVSWLNFCESHNRECSHLTHVFQEIRLKQRITPESKKKG

SEQ ID NO: 146009 - protein, 47 aa, Glycine max
  Coding DNA Sequence Number=SeqID_29231
MAPKTCLTIHKCTNVVAANEPRGARPTRLDKVYSPKRVGWLRLKKFH

SEQ ID NO: 146010 - protein, 118 aa, Glycine max
  Coding DNA Sequence Number=SeqID_29232
MSRNFTGYAAMCVKRLKVINQGLHADNNCPQTKLGDVSSIGACRPRIFFINGFLCFLEVEWRRKRERRHHFKENMCLEEVHHHRRPWIRAWRKKEMNEGRGRKEHGILCSKRAPKSEV

SEQ ID NO: 146011 - protein, 460 aa, Glycine max
  Coding DNA Sequence Number=SeqID_29233
MVYSKAPTAYYSTLHDSISSLCKTILPFGLKKHRCLVSAEQKLWQLQSDNLKWQRDSLYQMLNLVALHRDDILSEAEVSAFRTHLLETLLASPPPHQDHALIIKDKLMFLQELLNAKCISEGEYHSSRRPLLVRLAVQGGEIEGRDVIIAGSKDTKQDSEEEWSEIDLKDEQCLVNKENSNSKKTSKQARKQVVKGATSVFGFGSSYKPSKNSTERSIFNSPSLHKHSAQSKMSSPSIYAQSELRHSKENNPFWDGPEKMKRKPFRALFHRDKNKKEGNGGGDGLEAAEKSANKQWGFDGLRKWKKSDTDDDTVPLSLNERSDSVAYLPSYQLSSTIPYGELSMKNKLHSGLSPSDFSMDDKKELSRTPTEMRSTNTNLNFSRDQKQANSTKLPDYYKAELESDFPKPLDVVKKQFKDSVGEFENMHNDAENSMGWTTFEDEENLHPNLFVHQEKSLRKQ

SEQ ID NO: 146012 - protein, 817 aa, Glycine max
  Coding DNA Sequence Number=SeqID_29234
  Subcellular localization annotation: CTP_CleavageSite=60; ConfidenceScore=5.43e-01
NTVEVSNSSCRSSLVYAITTREKTTEQPSKKSSSHHASTTTSVTQALVDPTFSNTNTFVVFAAVTTGHLGFILEGYVDSLGEAPSTMAPVLEMVLPIPSEECCHGQLEVTTNYVPKIQLYQPLTMRLVASIDAFRPPPMQFAFLGIQDALDDWQTTIHHVDKVALFPRGYKILGFATFSGEDEKFTMEHFMNEKDHKKSHRGGRNPHTISMIFEEEEEDLDDDFLVNQMVVELVKGKLYSCPTLQHFKGQKVEGKESNLFDIFSVEQGNEMQVDKNPFPLANIDIVPASRLANRLRCNVGGNITNNGNLSWTWESSLVVGRFELDGLLSDDTLAPTVAVGILPMEFSSQGQLTSLETNLSSLYGQWSFLECDVILHCQKVGEAQARFNQNLFSELWHELSRGEGLALDPIIGIIAKVTSLIPRWAIANGEILYWVVASIVLWHRPRWVKSQSTCGAWAVTFVSRKSYVLIVSYSFWPSGKRSMQQNQHASAYIIGNPTMIMGDLIAEIIVGPTTSTAAFIVVNAKLSYFVLLRRDWLHSNFCVPSTFHQVLIFLVGDKVEDYPKMLRLSRELVEHQLSFKEGFKPYKQSIRHFNPEVLPMVKKEVECLLSSGFIRTVKYVDWLSNIVPVIKKNGKVVMPYGLKNVGATYQRAMNQIFNDFIGRTMEVYIDDIVVKLIAFDQHLLDLEQALKRMRLHGLKMNPEKCAFGIAAGHFLGFLVHSKGIKVNKNKAKAIVEATPPRNKLELQSLVGKINFLKKFITNSTSKQFMDAEVVYVPLEENQEANELAQHASKYKELQVEELEYEWPDIDVQDLDHD

SEQ ID NO: 146013 - protein, 114 aa, Glycine max
  Coding DNA Sequence Number=SeqID_29235
MSLHVLYLYAFSRFPPRDFRSVVSLVTIFQRNEHGFEAFSPHGQDHLGLPSGVKTKHERQKPIKVGYLRMNASGDGITTDRSLPLLYAKQAGNVAARQPRILCILQLSFTICLF

SEQ ID NO: 146014 - protein, 150 aa, Glycine max
  Coding DNA Sequence Number=SeqID_29236
  Homolog annotation: Hit_ID=Q5ZBZ3; Match level="QueryCoverage=96%, HitCoverage=17%, E-value=3e-30, Identity=60%"; Hit description =Putative dymeclin
MSGNIGKPGTTCPPFECICISETSQPLWHAITEVCCQSIWAFIINCIHYSPKNFMYNKLADLRDGKLNNAGSNSIERSSLVEDMSAELQIYTDFLRLVLEIINAILTYALPRNPEVVYEIMHKQEVFQPFKNHPCFNELVENIYTVCFMC

SEQ ID NO: 146015 - protein, 265 aa, Glycine max
  Coding DNA Sequence Number=SeqID_29237
  Gene Ontology: Cellular component=integral to membrane
  Homolog annotation: Hit_ID=Q5ZBZ3; Match level="QueryCoverage=97%, HitCoverage=47%, E-value=9e-46, Identity=57%"; Hit description =Putative dymeclin
MLYSNADQTIENLVMRNVLNFIASIDVSPNTYFLHLELLNFMIIAMSTQLLRGPSPGPNDVNPFLDAAMAQDSHLVTSVVCKLLLNYITRPRVPFSRASYSIFYDGSQNSVLKKVGSEAVDRVDKEGNAHSDQDQHVKLPFAPLFDTLGMCLADETAVLLLYSLLQGNSTFLEYVLVRTDLDTLLMPILEALYDARRRTANQIYILLIILLILSQDSSFNAGIHKLILPTVPWYKERLLLQSSLGSLMVIILIRTIQYNLSKLRV

SEQ ID NO: 146016 - protein, 90 aa, Glycine max
  Coding DNA Sequence Number=SeqID_29238
MPLVLGNIGSGSTSQVRKWNMNSTRWEDTKKKGTLSKSGNRKEEKKGILKQAQPNSGAKRAQALSEQLAAGAKRGVKHEGVETVTRAKPS

SEQ ID NO: 146017 - protein, 134 aa, Glycine max
  Coding DNA Sequence Number=SeqID_29239
NFAFVDSGLFATDDRFNGSRRKANDNEVIGCGARLCDVIHIRLQGPQHRVVGKAIGDDVQPDIGGLARHILQALKLDTCSGFSTHGLYYIDRNCRPSPTVALSAHQALSEQLTASAKRDVKHEGAETVTRAKPS

SEQ ID NO: 146018 - protein, 43 aa, Glycine max
  Coding DNA Sequence Number=SeqID_29240
  Homolog annotation: Hit_ID=Q9FH45; Match level="QueryCoverage=75%, HitCoverage=4%, E-value=2e-07, Identity=78%"; Hit description =Arabidopsis thaliana genomic DNA, chromosome 5, TAC clone:K2N11
MDSGYYDVANTPDELPERLIGAVRISHLELKSAIVPKLEPDPS
